United States Patent 10,570,408 (TRANSGENIC PLANTS WITH ENHANCED AGRONOMIC TRAITS) - sequence listing, part 6

SEQ ID NO: 22457 - protein, 246 aa, Pseudomonas aeruginosa
MSQVNMRDMLKAGVHFGHQTRYWNPKMGKFIFGARNKIHIINLEKTLPMFNEALTFVERLAAGKNKILFVGTKRSAGKIVREEAARCGMPYVDHRWLGGMLTNYKTIRQSIKRLRDLETQSQDGTFDKLTKKEALMRSRDLEKLERSLGGIKDMGGLPDALFVIDVDHERIAITEANKLGIPVIGVVDTNSSPEGVDYVIPGNDDAIRAVQLYLNSMAEAVIRGKQGAATSADEFVEEAPAESAEG

SEQ ID NO: 22458 - protein, 359 aa, Glycine max
MAGSAIGFEGYEKRLEISFFEHGVFADPEGIGLRALSKDQLDEILKPAECSIVASLSNDYVDSYVLSESSLFIYPYKIIIKTCGTTKLLLSIPVILKLADALDIAVKSVRYTRGSFIFPGAQSFPHRSFSEEVSVLDSYFSNLGSGSKAYVMGDPSKSQIWHIYSASAQTKGSSEVVYGLEMCMTGLEKESASVFFKENTSSAALMTENSGIRKILPQSDISDFEFDPCGYSMNGIEGGAISTIHVTPEDGFSYASFEAVGYDFDEMALGELVERVLACFRPAEFSVALHIDMHGEKLNKFPLDIKGYYCGERSYEELGVGGAVVYQSFVQGCDGSTSPRSILKCCWSEDENEDEVREI

SEQ ID NO: 22459 - protein, 310 aa, Agrobacterium tumefaciens
MRKLWKRPEMTKWTEANIPNQRGRSAVVTGTGGLGLETALALARAGCDVTIAGRNPEKGSDAVSRIQRAAPHVTVSFEKLDLADLTSIALFAQRMENDRESLDLLVNNAGIMVPPKRQETRDGFELQFGTNYLGHFALTAHLMPLLKKGTDARVVTVSSVAARAGKINFADINSEKNYHPMRAYSQSKLACLMFALELQDRSRAAGWGVSSIAAHPGVSRTDLLHNAPGRNSLQGLARTFLWFLFQPVAQGALPQLFSATSKEVKSGGYYGPDRLGETRGHPQPARIPPEALDRVAGKQLWEISQRMTGL

SEQ ID NO: 22460 - protein, 180 aa, Mesembryanthemum crystallinum
MASMMSNAAVVGRTTPAQASMVAPFTGLKSVSAFPVTKKSNDITSIASNGGRVQCMQVWPPLGKKKFETLSYLPPLSEESLMKEVQYLLNNGWVPCLEFEPTHGFVYREHGNTPGYYDGRYWTMWKLPMFGCTDPSQVVAELEEAKKAYPEAFTRIIGFDNVRQVQCISFIAYKPASYDA

SEQ ID NO: 22461 - protein, 568 aa, Debaryomyces hansenii
MTKDYIWWKDASVYQIWPASYKDSNGDGVGDIPGIISTLNYVKSLGTDVIWLSPMYDSPQDDMGYDISNYEKVYPKYGTLEDMDNLIEGTHKRGMKLILDLVINHTSTEHDWFKQSRSSKTDPKRDWYIWKPARYDAEGNRHPPNNWVSHFSGSAWAYDETTDEYYLHLFAESQPDLNWENEETRKAIYKSALSFWFEKGIDGFRIDTAGMYSKVQSFSDAPIVFPDSEWQPCQKYFQNGPRIHEFHKEMFASVTSKYDAMTVGEVGHSPREDSLKYVSAKEKEMNMMFLFDAVEVGSNPSDRFIYDGYKLTDFKKAVQNQSSFIEGTDAWSTVFYENHDQPRSITRFGNDSNKYRVKSGKLLALLQSTLSGTLYIYQGQEIGMTNLPRSWSIDEYLDINTINYYKEFKAKYGDNKEKMDKLMDNINLLARDHARSPVQWDDTENAGFSTGKPWMRVNDNYKEINVASQVNDPNSLFSFWKQSLKIRKEYKDLLIYGSFKILDNENQKIFTYVKEAAGQKAYIVLNFTSESLKFENLDGGKLELLHSNVNVEDEGTLSPYEGRFYLIK

SEQ ID NO: 22462 - protein, 309 aa, Ureaplasma parvum
MNQEVYDLVIIGAGPAGLAAAVYAKRSGLNVIIVEKQFPGGKIALTSNVENYLGINSIPGPELAYKMYEQVLNLNVSIIYEAADEISLKEKYKKIKLTTQTLITKTVIIATGTENRRLNILGELEFENKGISYCAICDGPLYKNKAVSVIGSGNSAVEEAIYLATIAKEVHLIANKPQFKAEQQLVQIANNTPNIKIYYNKQTFEFFGHQFLEGLKFRDLITNEVTTLNIEANFTFIGLLPSRINTNNLCIFNEVNGFITTDKNMQTSVCGIFAAGDIVDKNVRQIATATNDGVIAALYAKEYITRNNW

SEQ ID NO: 22463 - protein, 434 aa, Zea mays
  misc_feature (254)..(254): Xaa can be any naturally occurring amino acid
MGLSTVYSPAGPRLVPAPLGRCRSAQPRRPRRAPLATVRCSVDATKQAQDGVATAVATEAPASRKECFGVFCTTYDLKAEDKTKSWRKLVNVAVSGAAGMISNHLLFKLASGEVFGQDQPIALKLLGSERSFQALEGVAMELEDSLYPLLREVSIGIDPYVVFQDVDWALLIGAKPRGPGMERAALLDINGQIFADQGKALNAVASRNDEVLVVGNPCNTNALICLKNAPNIPAKNFHALTRLDENRAKCQLAXALKAGVFYDKVSNVTIWGNHSTTQVPDFLNAKIDGRPVKEVIKDTKWLEEEFTLTVQKRGGVLIQKWGRSSAASTAVSIVDAIRSLVTPTPEGDWFSTGVYTTGNPYGIAEDIVFSMPCRSKGDGDYELASDVLMDDFLWERIKKSEAELLAEKKCVAHLTGEGNAFCDLPEDTMLPGEV

SEQ ID NO: 22464 - protein, 183 aa, Mesembryanthemum crystallinum
MASSLMSNAATTMAAATTTAQANMVAPFNGLKSVSAFPVTRKNNDITSVASNGGRVQCMQVWPPLGKKKFETLSYLPPLSEESLMKEVQYLLNNGWVPCLEFEPTHGFVYREHGNTPGYYDGRYWTMWKLPMFGCTDPSQVVAELEEAKKAYPEAFIRIIGFDNVRQVQCISFIAYKPASYDA

SEQ ID NO: 22465 - protein, 381 aa, Medicago truncatula
MEGSSNGSCSYVMGAFGENSGGLCPPMMMMPLVTSSHHNAHHPINSNNNNNNNNNNTNANNTTGLFLPIPNSTNNNNNHYTNCNNNTSSIMLQNNHQNTPGLGYYFMDNINNHGSSSSSSSSSVKSKIMAHPHYHRLLEAYINCQKVGAPSEVVARLEEACATAVRMGGDAVGSGCLGEDPALDQFMEAYCEMLIKYEQELSKPLKEAMLFLQRIEVQFKNLTVSSSSDNIACSEGGDRNGSSEEDHVDLYNNMIDPQAEDRELKGQLLRKYSGYLGSLKQEFMKKRKKGKLPKEARQQLLEWWSRHYKWPYPSESQKLALAESTGLDQKQINNWFINQRKRHWKPSEDMQFVVMDPSHPHYYMDNVLTNSYPMDLSNTML

SEQ ID NO: 22466 - protein, 308 aa, Oryza sativa
MGHLKEVAAGEVMGGLSMDQAFVQAPEHRAKPSVAEADGIPVIDLSPLFAADGVDVDALAAEVGRASQDWGFFVVVRHGVPEEVVARAAEAQRAFFALPPARRAAVARSEAAQMGYYASDHTQNVRDWKEAFDLVPTRHPPPPPPAGVLDNKWPDDLPGFSPDLALGLGHHKDAGALTVLYQDAVGGLDVRRRCDGEWVRVRPIPQSFIINVGDIIQVWSNDRYESAEHRVAMNVEKERFSMPFFFYPASYTMVEPLEEIVSEESPARYNPYCWGEFFSTRKNGDFKKLDVDNIQIAHFRKKALVHIQ

SEQ ID NO: 22467 - protein, 183 aa, Mesembryanthemum crystallinum
MASSLMSNAATTMAAATTTAQANMVAPFNGLKSISAFPVTRKNNDITSVASNGGRVQCMQVWPPLGMKKFETLSYLPPLSEESLLKEVQYLLNNGWVPCLEFEPTHGFVYREHGNTPGYYDGRYWTMWKLPMFGCTDPSQVVAELEEAKKAYPEAFIRIIGFDNVRQVQCVSFIAYKPASYGA

SEQ ID NO: 22468 - protein, 112 aa, Unknown
  marine gamma proteobacterium HTCC2207
MKLITAIVKPFKLDEVREALGDLGVAGVTVTEVKGFGRQKGHTELYRGAEYVVDFLPKVKLEIALADEMVDSAVEAITNAAQTGKIGDGKIFISTLEEVIRIRTGETGAEAV

SEQ ID NO: 22469 - protein, 613 aa, Triticum aestivum
RQGSSSADHRFRSAWTDEVELQDNLLTGDFPAVVGAAAPNLGEINLSNNQLTGALPASIGNFSGVQKLLLDRNSFSGALPAEVGRLQELSKAARGGNAIEGGVPPEIGKCRLLTYLDLSRNNLSGRIPPAISGMRILNYLNLSKNHLDGEIPPSISTMQSLTAVDFSYNNLSGLVPGTGQFSYFNATSFVGNPNLCGPYLGPCRPGIADAGHTNHGHGGLSSTIKLLIVLGLLLCSIIFATAAILKARSLKKASDARMWKLTAFQRLDFTCDDVLDSLKEENIIGKGGAGTVYKGSMPNGDHVAVKRLSAMVRGSSHDHGFSAEIQTLGRIRHRHIVRLLGFCSNNETNLLVYEYMPNGSLGELLHGKKGEHLHWDTRYKIAIEAAKGLCYLHHDCSPLILHRDVKSNNILLDSDFEAHVADFGLAKFLQDTGASECMSAIAGSYGYIAPEYAYTLKVDEKSDVYSFGVVLLELVTGRKPVGEFGDGVDIVQWVKMMTGPNKEQVMKILDPRLSTVPVHEVMHVFYVALLCTEEHSVQRPTMREVVQILSELPKPAANQDGEEELPLSCEGPESNPPAPTSYTEAPAGDAKDQQPQQQHTSSESSPPPDLISI

SEQ ID NO: 22470 - protein, 110 aa, Zea mays
  misc_feature (23)..(23): Xaa can be any naturally occurring amino acid
  misc_feature (34)..(34): Xaa can be any naturally occurring amino acid
  misc_feature (56)..(56): Xaa can be any naturally occurring amino acid
  misc_feature (80)..(80): Xaa can be any naturally occurring amino acid
MGRRPARCYRQIKNKPYPKSRDXRGVPDPKIRIXYDVGMKRKGADEFPYWAHLVSXEKENGSSEALEAARIGCNKSMTKXAGKDAFHLRAQGKPFHVLRVNEMLARTGAD

SEQ ID NO: 22471 - protein, 83 aa, Pennisetum glaucum
EPLVVGRVIGEVLDSFNPCVKMIVTYNSNKLVFNGHEVYPSSVVSNPRVEVQGGDLRSFFTLVMTDPDVPGPSDPYQREHLHW

SEQ ID NO: 22472 - protein, 83 aa, Setaria italica
EPLVVGRVIGEVLDSFNPCVKMIVTYNSNKLVFNGHEIYPSAVVSKPRVEVQGGDLRSFFTLVMTDPDVPGPSDPYLREHLHW

SEQ ID NO: 22473 - protein, 200 aa, Lactococcus lactis
MTRISHITRNTKETQIELSINLDGTGQADISTGIGFLDHMLTLLTFHSDFDLKIIGHGDHETVGMDPHHLIEDVAIALGKCISEALGNKLGIRRYGSFTIPMDEALVTCDLDISGRPYLVFHADLSGNQKLGGYDTEMTEEFFRALAFNAGITLHLNEHYGQNTHHIIEGMFKSTARALKQAVSIDESKVGEIPSSKGVL

SEQ ID NO: 22474 - protein, 1767 aa, Unknown
  Shewanella sp. MR-4
MDKSKLRTFRSKILSHIALPLILIMAAVYGINAWFNYLSAESKLYDSLAQASNHSAYRLQLLLEHAQINTQGMADFIGFITNKEDISNSEKIKRILTNRLERNPDFYGSAVAFKPYTFANKKLFSPYVFRDGDDFHYLDIGAEGYDYTDGSWDWWSKAINQAGGYWSKVYFDEGAGNTLMVTYSVPFGPENAYFGVATVDLALNQLPEQLGVSPSQLVVLDDQGRLIFHSDKEKVLAMTSAEWLDRNTRQNKDFWALLDKGVNGQARFVDDKNLVYLASVASVAKHKWRVIVMVPEQQLLSTLLDDMASVVLNLSLLTLLLILTCYIAAKRLTRPLEMLESGILAFGQGKTQQLAIPNGAVSEIVTLSSTFNQMAELLAEREQAILDSRGNRFARLIDGMSDKSFYCSLDASGQLAQVSEGVTKVLGMSPELLKRKYQRLFTANPLNEKNWEYTDLALKGQNVPSHQVELLDAGGHPRRLDLFMQPLVSDTGELMSVEMLFTDVTEQFSAAAWSNAVLEAAPEAMLIVDQMGLIVFSNTRCQILFGYEASAMLGLQVESLLPEALRSNHARDRLQFLREGRDRPMANAKHVRALKADGGEFVAEIALSILPADNEGRRQVAASIRDMTQKLAVEQKIRDSELRFRGLVTNIPGAVYRTRIGDVWVMEYVSENIADITGYAASQFIENRQRTFESLILEEDRALCHQHIDRALAQQETFEVEYRIRHRDGSVRWVHEKGKASYTDEGFPLWFDGSIDDITESKLALVELESSRQQLTNITESIPCTVYQLRWISPVDRTFTFLSGAAYHMLGLHRDDLLKDFNIIAERIFDEERSEVVRALAGKSEDKLQWVREFRYRHPNGSTRWMEAGASGHICDDGAIIWNGYVMDITERKAMEEELAVSEAHFKALFDGSTIGIVNIDAKGVILDCNDQYCEDMGQSRESLCGMSIFEVLSLQDKETAKAQFKELAEGRVDHYRGERSFIRPNGEPLWMTVNVSALFDSQKRFESAVVSMVDMTELKLLSDELLVAKEEADAASKAKGDFLANMSHEIRTPMNAIIGMSQLCLQTELDKKQKNYVEKIERASKSLLSIINDILDFSKIEAGKLDIESVPFQLDTMLEDLSDMFSEKAAHKQLELLFAVAPNVPRHLFGDSLRLGQVLINLMNNAIKFTERGEVLLSLNLVEQQNDDVVLRFSVRDSGIGLTAEQQAKLFKSFSQADTSTTRKYGGTGLGLAICKQLVELMGGTIGVESQFGHGSTFYFTVKLQISSGQKLTVAQELEGMSILVADDNATARDIMRTTLESMGFRVDTVRSGEEAVTRCSQQEYAVALIDWKMPNLDGIETAKQIKQLAKNAPRILMVSAHATQEFLSQIEALGLAGYISKPISASRLLDGIMNSLGRAGVLPVRRNSESIDPKLLLPLKGKRILLVEDNEMNLEVATEFLEQVGIILSIATNGQIALDKLAQQSFDLVLMDCQMPVMDGYQATQAIRKRPELAELPVIAMTANAMAGDKEMCLKAGMNDHIAKPIEVNLLYQTLLKYLGAGVLPTEAASPNQLVEIPVKPINLDSKSVVKWPEHPELDIDRGLQLVQNSTRLYQRIFDRFVTSQRNVVELINKALANDKRDDAVRMAHTLKGLAGNLSSSKLVELARQLELHLSEKTEYQTELDQIQVLVASICEAIERVNPQFEEPTQSATEHLSQEALVSALNQLRQSLEDADSDAVTQIDALKPQVSSKLWQQLSPALTMINQYQFDEAVDLIDEVLAELA

SEQ ID NO: 22475 - protein, 303 aa, Salmonella typhimurium
MNTLEQTIGNTPLVKLQRLGPDNGSEIWVKLEGNNPAGSVKDRAALSMIVEAEKRGEIKPGDVLIEATSGNTGIALAMIAALKGYRMKLLMPDNMSQERRAAMRAYGAELILVTKEQGMEGARDLALAMSERGEGKLLDQFNNPDNPYAHYTTTGPEIWRQTSGRITHFVSSMGTTGTITGVSRFLREQEKPVTIVGLQPEEGSSIPGIRRWPAEYMPGIFNASLVDEVLDIHQNDAENTMRELAVREGIFCGVSSGGAVAGALRVARATPGAIVVAIICDRGDRYLSTGVFGEEHFSQGAGI

SEQ ID NO: 22476 - protein, 535 aa, Brassica nigra
LQLDKRLDTTEQVVEEIMRIHRSLPPRPGLDEVEAARSLIQKLEKEEPILLEAIANQRKPSEVPDELFAVLQEMKRGLVRFRSKEQIREAAKLLDLETVHSHFDDFIQRASDCIASPSPNGVSAPASSRPLPRAPTPPSSLYFSEKTPARPKEMVSRDDSFVSKAKPSLYGDGFVAPRTPQIVDSTLTAGKFADNDGEKLSLIKLASLIEVSAKKATKELNLQNKLSAQVEWLPDSIGKLSTLTSLDLSENNIVVLPNTIGGLVSLTNLDLRSNRINQLPESIGELLNLVYLDLSSNQLSSLPSSFSRLLQLEELNLSCNNLPVLPESVGSLANLKKLDVETNDIEEIPYSIGGCSSLKELRADYNKLKALPEAIGKITTLEILSVRYNNIRQLPTTMSSLASLRELDVSFNELESVPESLCFATSLVKLNVGNNFADMISLPRSLGNLEMLEELDISNNQIRVLPESFRSLTKLRVFASQENPLQVPPRDIAEKGPQAVVQYMNDLVETRNAKSLVVKPKKSWVQMCFFSKPEF

SEQ ID NO: 22477 - protein, 492 aa, Unknown
  Frankia sp. CcI3
MTSTTDVRPVETVTISPSPTTPQVAVNDIGSAEDFLAAVDKTIKFFNDGDIVDGIIVKVDRDEVLLDIGYKTEGVIPSRELSIKHDVDPHEVVSVGDHVEALVLQKEDKEGRLILSKKRAQYERAWGTIEKLKDEDGVVTGTVIEVVKGGLILDIGLRGFLPASLVEMRRVRDLQPYVGRELEAKIIELDKNRNNVVLSRRAWLEQTQSEVRSEFLAQLAKGQIRKGVVSSIVNFGAFVDLGGVDGLVHVSELSWKHIDHPSEVVEVGQEVTVEVLDVDLDRERVSLSLKATQEDPWRQFARTHAIGQVVPGRVTKLVPFGAFVRVDEGIEGLVHISELAERHVEIPEQVVNVGDEILVKVIDIDLDRRRISLSLKQANEATGLAVDGEAFDPSQYGMEAKYDEQGNYVYPEGFDPETGEWLEGYEEQQAEWERQYAEAQARFEAHQVQIRAAQEADAAAAAPSSYTSQSEQPSSAIDEEALRRLREQFGRE

SEQ ID NO: 22478 - protein, 240 aa, Arabidopsis thaliana
MSSMSMSSSSAPAFPPDHFSSTDQLCYVHCSFCDTVLAVSVPPSSLFKTVTVRCGHCSNLLSVTVSMRALLLPSVSNLGHSFLPPPPPPPPPNLLEEMRSGGQNINMNMMMSHHASAHHPNEHLVMATRNGRSVDHLQEMPRPPPANRPPEKRQRVPSAYNRFIKEEIQRIKAGNPDISHREAFSAAAKNWAHFPHIHFGLMADHPPTKKANVRQQEGEDGMMGREGFYGSAANVGVAHN

SEQ ID NO: 22479 - protein, 63 aa, Pariana radiciflora
EPLVVGRVIGEVLDSFNPCMKMIVTYNSNRLVFNGHELYPSAVQSKPRVEVQGGDLRSFFTLV

SEQ ID NO: 22480 - protein, 388 aa, Escherichia coli
MKHLHRFFSSDASGGIILIIAAVLAMIMANSGATSGWYHDFLETPVQLRVGTLEINKNMLLWINDALMAVFFLLVGLEVKRELMQGSLASLRQAAFPVIAAIGGMIVPALLYLAFNYADPITREGWAIPAATDIAFALGVLALLGSRVPLALKIFLMALAIIDDLGAIIIIALFYTNDLSMASLGVAAVAIAVLVVLNLCGVRRTGVYILVGVVLWTAVLKSGVHATLAGVIVGFFIPLKEKHGRSPAKRLEHVLHPWVAYLILPLFAFANAGVSLQGVTLEGLTSILPLGIIAGLLIGKPLGISLFCWLALRLKLAHLPEGTTYQQIMAVGILCGIGFTMSIFIASLAFGSVDPELINWAKLGILVGSISSAVIGYSWLRVRLRPSV

SEQ ID NO: 22481 - protein, 83 aa, Flagellaria indica
EPLVVGRVIGEVLDSFTPCVRMIVTYSSNRLVFNGHEFYPSTVISKPRVQVQGGDMRSFFTLVMTDPDVTGPSDPYLREHLHW

SEQ ID NO: 22482 - protein, 431 aa, Arachis hypogaea
GRGEFGVTYLCIDRGSRELLACKSISKRKLRTAVDVEDVRRKVAIMRHLPRSSSIVSLREACEDDNAVHLVMELCEGGELFDRIVARGRYTERAAAVVARTVVEVVQLCHRHGVIHRDLKPENFLFANKKENSPLKAIDFGLSVFFKPGEKFSEIVGSPYYMAPEVLKRNYGPEIDIWSAGVILYILLCGVPPFWAESEQGGAQAILRGLIDFKREPWPSISESAKSLVKQMLEPDPKLRLTAKQVLEHPWIQMLRRAPNIPLGDAVKSRLKQFSMMNRFQKKALRVIADFLSNEEVEDIKDIFQKMDTDNDGIVSIEELKAEFQNFGSQLAESEIQMLLEAVNTNGKGTLDYGEFVAVSLHLKRMANDEHLRKAFSYFDKDGNGYIEPDELRNALMEDGTDDCADVANDIFQEVDTDKDGRISYEEFVAM

SEQ ID NO: 22483 - protein, 497 aa, Unknown
  marine gamma proteobacterium HTCC2207
MSQELLVNITPMETRVALVENGVPQEVCVERNNKRGLVGNIYKGKVVRVLPGMQAAFVDIGEARTAFLHIDDLLPRKTKLNATDTGEPDIRKLLHDGQQIAVQVIKDPVGTKGARLSAQLSVASHYLVYMVEGKHLGVSQRIESESERERLKLMLSTIVDEVSAEEGVKNPLSGGYILRTAADGAEEAELRNTVRFLRRLWQDILQRKVNAKAPSCLYEDLPLYKRVLRDMVGTEVEKICVDSREVFDKLTHFGNKFNPDMVRLLEHYPGERPLFYMHGIEEEIAKALQRKVMLKSGGHVVFDQTEAMSTIDVNTGAFVGHRNLEETIYKTNLEAAAVIARQMRMRNLGGIIIIDFIDMHGAEHRRQVLRALEKALARDPVRTTISGVTELGLVQTTRKRTSQSLGQILCEECPTCFGRGYVKSAESMSYEILRDILRVARAYECDNLRVLASAPVIERLTDEDSSQVADLELFINCTIQFRVESLYALEQFDIIPV

SEQ ID NO: 22484 - protein, 459 aa, Bdellovibrio bacteriovorus
MNKNKWMFLAVGGAAIVTVLVTALLVNIFERKSEEKNPFYRVVEITDDIDDPAVWGKNFPHQYDSYLKTADMTRTKYGGSEAFPHIPTDKDPRDVVSAQKLDEDPRLKIMWAGYAFSKDFREERGHAYMLVDQIFTERQNVVKQPGTCLNCHASTYLLYKKLGDGDITKGFEEMGKIPYKDIVHSVQHPVSCIDCHDPSTMALRVTRPAFMEGIKLVKAQQGIKEYDVNKMASRQEMRSFVCGQCHVEYYFKGEEKRLTYPWAKGLKADQIVEYYKENGFKDWVHALTGAEVLKAQHPEFEMFNQGTHARAGVACVDCHMPYQRVGAMKVTDHQVRSPLLNINKACQTCHNVPEAELKARVETIQDRHISLRDVAFDALVDYINDLKEFKDEKNPSETLKKARALQKEAQFLFDFVEAENSSGFHAPQESARILGLSIEKVREGQKLLATLRNSKVAGK

SEQ ID NO: 22485 - protein, 182 aa, Mesembryanthemum crystallinum
MASSLMSNAATTMAAATTTAQANMVAPFNGLKSISAFPVTRKNNDITSVASNGGRVQCMVWPPLGMKKFETLSYLPPLSEESLLKEVQYLLNNGWVPCLEFEPTHGFVYREHGNTPGYYDGRYWTMWKLPMFGCTDPSQVVAELEEAKKAYPEAFIRIIGFDNVRQVQCVSFIAYKPASYGA

SEQ ID NO: 22486 - protein, 117 aa, Listeria monocytogenes
MSTFKVGDVVSGKIAGIQSYGAFVALDNSTQGLVHISEITHGFVKDIHDFLEVGQEVKVKILDIDEEKNKISLSIRATEEAPKEQPTKKKQVSSSENDEGFNTLRDKLEEWIKKADK

SEQ ID NO: 22487 - protein, 186 aa, Mesembryanthemum crystallinum
MASSMLSNAAVATTAASRSAGAQASMVAPFTGLKSVSAFPVTRKSSNDLSTVPSNGGKVQCMQVWPPLGKKKFETLSYLPPLSEESLLKEVQYLLNNGWVPCLEFEPTHGFVYREHGNTPGYYDGRYWTMWKLPMFGCTDPSQVVAELEEAKKAYPEAFIRIIGFDNVRQVQCVSFIAYKPASYDA

SEQ ID NO: 22488 - protein, 183 aa, Burkholderia vietnamiensis
MNREEALHIFDHSEEIVSADAVNASISSMADAIRAEIGDAFPLVLSVMGGAAVFTGMLLPHLDFPLEFDYIHLTRYRNTTQGSPEMHWRVAPRESVKDRIVLVLDDILDEGETMAAIRDRILEMGAKRFMSAVLCEKTLAKAKPLHPDFCGFAVPDRYVFGCGMDAKGYWRNLPTIRALTANV

SEQ ID NO: 22489 - protein, 941 aa, Pichia pastoris
MPDASLFNGTSFITLFAPNISLLQASIDFYTNFLGFAIRKNSNQKLFWLQLEEDQNNVSIQLILDPEHAASVSQIDQNIRNLTRSLYRKDWRSIQSNIAFKSSSLSKLVKLLKDGGHPVQQSPNEISPFEVYTVDPLGSLIGFSGFKNPFAVNERSLLPKVSEEKAYRAEDDSEKLLNPVRKTIGVMTSGGDSPGMNPFVRAVVRAGIYKGCKVFCIHEGYEGLVRGGEKYIKETQWHDVRGWLVEGGTNIGTARCKEFRERSGRLKACKNMIDMGIDALIVCGGDGSLTGADRFRSEWPSLIEELLQTEQISQQQFNTHQNLNICGAVGSIDNDMSSTDATIGAFSSLDRICRAIDYIDATANSHSRAFIVEVMGRHCGWLGLLAGLATSADYILIPEKPASSREWQDQMCDIVGKHRARGKRKTIVIVAEGAISNDLSPISCDQVKDVLVNRLGLDTRVTTLGHVQRGGTAVAFDRIYATLQGVEAVNAVLECDADTPSPMIAIKEDQITRVPLVDAVELTQQVAKSIESRNFKKAISLRDSEFVEHMKNFISTNSADHVPPSLPLEKRKKIAIINVGAPAGGMNSAVYSMATYCMSRGHVPYAIHNGFSGLARHESVRSINWLDIEGWGSLGGSEIGTNRTLPNDADIGMIAYFFEKYGFDGLILVGGFEAFISLHQLERARINYPSLRIPLVLIPATISNNVPGTEYSLGSDTCLNSFMEYCDVIKQSAAATRNRVFVVEVQGGNSGYIATHAQLACGAQISYVPEEGISLAQLEMDINSLKESFANDQGKTKSGRLILKSENASKVLTTEVISTIIDDEASGRFDSKTAIPGHVQQGGIPSPMDRVRASRFAIRAVSFIERHSDRCQTFKNSISFRQTDEITSTAVVLGIHKSQLRFTPIRQLYDFESDVPRRMRKNIFWSNVREISDMLSGRTSL

SEQ ID NO: 22490 - protein, 556 aa, Vibrio angustum
MCSVFGILDIKSDAAALRPIALEMSKKLRHRGPDWSGIYASEHAILAHERLAIVGLNSGAQPLYSPDKKLILAVNGEIYNHKEIRARYEGKYDFQTDSDCEVILALYQDMGEELLEELNGIFAFVLYDEEKDTYLVGRDHIGIIPLYQGFDENGNYYVASEMKALVPVCKTVSEFPPGCYYGSADAEPQRYYTRDWNEYAAVQGNSTSKEELTEALEAAIKRQLMTDVPYGVLLSGGLDSSITSAVAKRFAAMRIEDNDQSEAWWPQLHSFAVGLEGAPDLKAAREVADKIGTVHHEMTYTIQEGLDAIRDVIYHIETYDVTTIRASTPMFLMGRKIKAMGIKMVLSGEGADEIFGGYLYFHKAPNAKEFHEETVRKLLALNMFDCARANKSLAAWGVEGRVPFLDKEFIDVAMRLNPEDKMCGNGKMEKHILRECFEHYLPESIAWRQKEQFSDGVGYSWIDTLKEVAEEKVTDQQLETAAYRFPYNTPTTKEAYAYREIFEELFPLESAAKCVPGGPSIACSSAKAIEWDESFKNAADPSGRAIAAVHNEAYKK

SEQ ID NO: 22491 - protein, 79 aa, Chlorella vulgaris
MTRKNIDLIEMEGVVTQCLSNGMFRVKLENGFLVLAHVSGKIRRNSIRILLGDRVAVELSPYDLHRGRITFRLRPGSKT

SEQ ID NO: 22492 - protein, 715 aa, Candida glabrata
MDKPLLSEKEKGASKDSSSLQPEKVKDYQYEEASFISKFIYDVILFLLSKILGCFFREIRSRGSFKVPRNGPVIFVAAPHANQFVDPVVLMSLAKKLSNRRISFLIAEKSLQHPAIGFLARRAMAIGVVRAQDNLATAQGKITVDPDNYKKIIGHGTQFTKDFKPKGLIGLPRSLGHVEIQSIESDTELTLRKEFKMNKTEVKHILTKGTSYKYAGKVDQSVVYHRVFEHLAHNECIGIFPEGGSHDRTDLLPLKAGVAIMALGCMAQHPNTNVKIVPCGMNYFHPHKFRSRAVVEFGDPIEIPTELIEKYKNPSTNKEAVKELLDTISDGLQSVTVTSQDYETLMVVQAMRRLYSGQFHQKLPLPLVVEMNRRLVKGYETFKDDPEIVQLKTDIMAYNAHLSQFNLPDHLVEHTKINVARNLGLLVFRSLRLTIMITLSLPGLILFSPVFVIARKISNDKKRAALASSTVKIKANDVVATWKILMSMGVAPILYVLWSSLATYYLRHKDISKVIIFILSYLACAIVTYSALVVGDIGMDIFKSLKPLYISITTPQGLKRLQVERRQLAKRITEVVNNFGSVLFPDFDYKALSEEYAVDEEEEERKTAELRRRRIIKRQKERENARGISDKNDYDDQTQDSDAISLVNSDNSLSNIPIFSSALGGKSEASSTYSLLPSSSTVSESDAEMEQESKEPSALSQKITAAMFSKRNENE

SEQ ID NO: 22493 - protein, 124 aa, Arabidopsis thaliana
  misc_feature (2)..(2): Xaa can be any naturally occurring amino acid
  misc_feature (10)..(10): Xaa can be any naturally occurring amino acid
  misc_feature (12)..(12): Xaa can be any naturally occurring amino acid
  misc_feature (31)..(31): Xaa can be any naturally occurring amino acid
  misc_feature (39)..(40): Xaa can be any naturally occurring amino acid
  misc_feature (42)..(42): Xaa can be any naturally occurring amino acid
  misc_feature (52)..(52): Xaa can be any naturally occurring amino acid
  misc_feature (54)..(56): Xaa can be any naturally occurring amino acid
  misc_feature (59)..(59): Xaa can be any naturally occurring amino acid
  misc_feature (62)..(63): Xaa can be any naturally occurring amino acid
  misc_feature (65)..(65): Xaa can be any naturally occurring amino acid
  misc_feature (67)..(68): Xaa can be any naturally occurring amino acid
  misc_feature (73)..(73): Xaa can be any naturally occurring amino acid
  misc_feature (78)..(78): Xaa can be any naturally occurring amino acid
  misc_feature (80)..(80): Xaa can be any naturally occurring amino acid
  misc_feature (82)..(82): Xaa can be any naturally occurring amino acid
  misc_feature (84)..(84): Xaa can be any naturally occurring amino acid
  misc_feature (86)..(86): Xaa can be any naturally occurring amino acid
  misc_feature (88)..(88): Xaa can be any naturally occurring amino acid
  misc_feature (91)..(91): Xaa can be any naturally occurring amino acid
  misc_feature (93)..(94): Xaa can be any naturally occurring amino acid
  misc_feature (96)..(96): Xaa can be any naturally occurring amino acid
MXSSMLSSTXGXTSPAQATMVAPFTGLKSSXSFPVTRKXXNXITFITSKGGXVXXXKVXPPXXKXKXXTLSLXSLTLXTXKXGXGXVXTFXPXXRXIPWQAFCYPHEPPPTLFVHNIRPVKKIN

SEQ ID NO: 22494 - protein, 475 aa, Vibrio parahaemolyticus
MSIKHWMSAPIAVATLFASQLLLAGSVLAAENNDRLDPRNDAFEQKHPDQYHSWKATSESKHIEDALSEDPNMVILWAGYGFAKDYNKARGHFYALDDVRQTLRTGAPADENSGPMPMACWSCKSPDVARVIEERGEDGYFSGKWARLGSEIVNPIGCSDCHDTRSEKFNQGEPELALTRPYVERAFDVIGKNFDDQSRLDKQASVCAQCHVEYYFTGPTKAVKFPWDMGTTVGDMEKYYDALDFKDWTHAVSKAPMLKAQHPGFETWREGIHGKNKVVCVDCHMPKVTKADGTVYTDHKVGNPFDRFEDTCAQCHTQTKEQLRNIVSSRKALVLNMKLTAEKQIVAAHFEAGEAWKAGATEEEMKPILQDIRHAQWRWDYAIASHGVHMHAPEVALEVLGTAVDRAADARTKLVRLLATKGITEPVQIPDISTKAKAQEALGMDMEKMNADKKHFLDTVVPDWDKAAAEREATY

SEQ ID NO: 22495 - protein, 75 aa, Zea mays
RPVRAVVIEALRCCKYKFPGQQKIIISKRWGFTPLDRADYVEARSKGLVKPDGCYVKFVPQKGSLANYFKEAVKA

SEQ ID NO: 22496 - protein, 387 aa, Oryza sativa
MEGGGAKDGSAAAAQTRGSGDDGSHKPLPPCCLKAKAAAAESEAKCHATVVSGWFTEPRSHSGKTSKVQYFNNPMWPGEAHSLKVENILYQGKSPYQEILVFESSTYGNVLVLDGIVQLTEKDECAYQEMVTHLPLCSIPSPKSVLVVGGGDGGVLREIARHASVENIDICEIDQLVIDVCKDFFPQLSVGFKDPRVQLHVGDAVDFLRNAPEGKYDAIIVDSSDPIGPAQELVEKPFFQTIARALKPGGVLCNQAESMWLHTHLIQDMLSICRETFKGAVHYAWTSVPTYPSGVIGFLLCAKEGPAVNFLSPVNPIEKLEGAMEAGREIRFYNSEVHRAAFVLPTFVRRELESHNTCAEKDKSETKPVAKPKKMKIMPNSAIPTAS

SEQ ID NO: 22497 - protein, 587 aa, Lactobacillus plantarum
MMTKMIAGQALVKVLEAWGVDHIYGIPGGSINHTVEGLYLEKADIDYIQVRHEEVGALAASADAKFTGKIGVSFGSAGPGATHLFNGLYDAKMDHVPVLALVGQVPQATMNTNYFQEMDETPMFSDVAVYDRTVTTAGQLPYVINQAIREAYRQKGPAVVIIPENLSAEEIDYQPVSTPNTVSDTFEQRVDPQAITATLKMLKAAKHPLVYAGRGLLGAKADLVKFSEQFNIPVMNTVPATGVIPTNHPNAIGTFGRLGSKSGFEALQHADLILFLGSEFPFASFWPKGIKIIQVNNNSFDIGKMVPIDYAVISDAQAYLQAMIATGETLPETAWLTTNRQNKRNWDKWLQQLAADDHDGLAPEAVMHKVASMVGPRDTYGVDTGNVSEWAVRGLPMDQEQRFALSGLFATMGFGLPAGMAGALSVPDSQAWSFSGDGGFAMVAPDIITEARYGLPVINVIFSNQRFGFIYREQVDTKQHLYGVDLTDADWAKVADGLGGIGFTVQNNQEVETVFDQIKALQAKGNKRPIVVNAVIKNDDPIGTAYMPLDPELYGQAEVDAYAKANHIDIKEQPSLGALLRAQGDQL

SEQ ID NO: 22498 - protein, 235 aa, Arabidopsis thaliana
MSSYSIASAISRISPLIFYSFEQTPNSSTLQSQPQSTRRPKRFDQLCVFSMASEARESPANNPGLSTNRDEATKGYIMQQTMFRIKDPKASLDFYSRVLGMSLLKRLDFSEMKFSLYFLGYEDTTTAPTDPTERTVWTFGQPATIELTHNWGTESDPEFKGYHNGNSEPRGFGHIGVTVDDVHKACERFEELGVEFAKKPNDGKMKNIAFIKDPDGYWIEIFDLKTIGTTTVNAA

SEQ ID NO: 22499 - protein, 1221 aa, Xanthomonas axonopodis
MKRMLINATQAEELRVAIVDGQTLYDIDIEQPSKEQKKSNIYKGRITRLEPSLEAAFVDYGAERHGFLPLKEISRDYFQAGVDHNKSTIRELLREGQEIVVQVDKEERGNKGAALTTFISLAGRYMVLMPNSPSAGGVSRRIEGEDRAALKEALDKLDIPDDMGVIIRTAGVGRDAEELQWDLDYLLQTWKAIAEAALSKPAAFLIYQESRLIIRALRDYLRADVGEILVDTPELYADAQEFMKQVMPQSLRKLKHYTDDIPLFNRFQIESQIEGAYERNVRLPSGGSIVVDQTEALTAVDVNSSRATKGSDIEETAFQTNLEAAEEVARQLRLRDLGGLVVIDFIDMASSKHQREVENRLQNALKYDRARVQLGRISRFGLMEMSRQRLRPSLGESSQIVCPRCDGHGRMRSVESLSLSIIRVAEEHAMKENTGQVLVQAPVEIANYLLNEKRSALREIEQRHESPIIIVADEQLHTPHYEVTRLRENELGEESGKPSYQRGTPRKLPVHALTKAQLNIPAAPAVTSIKPSQPAPVREEAPAPVAPVAAPVPVVTVPIPAPVTGVVGWLKRIFGGVEPVAPAPESTPRPRQNDAGRNNRSERGERGGQRRDGRDARNGGNSGNQQRGNGGNGNGANKERRDERRQPANAQGAQNGAQAQQQVQVPKPPRNEAQAPKPQQQKPKPQNQSPRPPRAPAQQDGAPAERQPRPARQDEGTAAAQTPTPTAATATTSSVVSAIADAAAAPPTNAQTNAHEAAQAHPVDVTVSESTADRGADANAAAPAQEAAGDDAANGEGGSRRRRGRRGGRRRRRGAGANGEGGASVDGLEGDDLDSDADNDLDGDSEGDDAGMHAHASAAPRAGQPEFDFDDDAPAPAVRAKPEPAVQATAKPRPVPKERAEPQVGSDTASTTAPVSNTVPASQPSATPVANADAARERPAAPVAATDATAKPAPAATASTVAGTEGAAAQAAEQRPATIAQQASATPAPIAAPAPGVSAPAAAVAPAAGTAPVAAAVAPAPAVASPVTSNAATSSPQQPSAPASAAPPAAAQAAKPDQQQPAASADVETPSVQATPVQPARATPAEDLSAPAAASPASQAAVVTVTSPHAEQSASQAPSSEVATTSTSTVVQASPSADTAPVRRPYAPVQTTMLDALSPNEAAPAASSASKPPAAPAAAQESQADKPKPTVVVSEAVKPVAPSAEADRPRDDDSNKPRGDH

SEQ ID NO: 22500 - protein, 238 aa, Nuphar advena
MTRRYWNISLEEMMEAGVHFGHGTRKWNPRMAPYISAKRKGIHITNLTRTARFLSEACDLVFDAASRGKHFLIVGTKDKAADSVASAAIRARCHYVNKKWLGGMSTNWSTTETRLHKFRDLRVRAEMGQLSRLPKRDAAILKRQLSHFQTYLGGIKYMTGLPDIVIIIDQQEEYTALRECVTLGIPTICLIDTNCDPDLADIPIPANDDAIASIRLILNKLVSAICQGRSSYSYIRSR

SEQ ID NO: 22501 - protein, 178 aa, Unknown
  Frankia sp. CcI3
MTVHDFTVDAADGTSRSLGDYAGQTLLIVNVASKCGLTPQYEGLESLYRDLHGRGLEILGFPCNQFGGQEPGTDAEIQEFCATKFDVTFPVLGKIEVNGPDAAPLYTHLRSEAPGDFGPDAGFLYEHIKKTRPEAIGTDEIKWNFTKFLVDPDGKVVRRYEPTVTPEEIRKDLEATLA

SEQ ID NO: 22502 - protein, 197 aa, Triticum aestivum
  misc_feature (49)..(49): Xaa can be any naturally occurring amino acid
  misc_feature (90)..(90): Xaa can be any naturally occurring amino acid
  misc_feature (109)..(109): Xaa can be any naturally occurring amino acid
  misc_feature (125)..(125): Xaa can be any naturally occurring amino acid
  misc_feature (138)..(138): Xaa can be any naturally occurring amino acid
  misc_feature (169)..(169): Xaa can be any naturally occurring amino acid
MAWPPSSGCVKVAAYVSWNVTPRQAAKAAFGDTVTVNSARKCGAPVRNXIFSPIPAVRMNTYSTKEEQMNVYYLNERDRNSPDDLPVSAXHTQILVCDLVPFTNKADYXSLDKLICISAIICILXQNVSDHNVNRYDXSYSIYFSYYAHFAPDWTYLSYKDAYLELTGXSQDFEGAYGRSSFSPIVFPFYIFYTFYL

SEQ ID NO: 22503 - protein, 448 aa, Helicobacter pylori
MYVEKILQSLQKKYPYQKEFHQAVYEAITSLKPLLDSDKSYEKHAVLERLIEPEREIFFRVCWLDDNHQIQVNRGCRVEFNSAIGPYKGGLRFHPSVNESVIKFLGFEQVLKNSLTTLAMGGAKGGSDFDPKEKSEHEIMRFCQAFMNELYRHIGATTDVPAGDIGVGEREIGYLFGQYKKLVNRFEGVLTGKGLTYGGSLCRKEATGYGCVYFAEEMLQERNSSLEGKVCSVSGSGNVAIYTIEKLLQIGAKPVTASDSNGMIYDKDGIDLELLKEIKEARRGRIKEYALEKTSAKYTPTENYPKGGNAIWHVPCFAAFPSATENELSVLDAKTLLSNGCKCVAEGANMPSSNEAIELFLQAKISYGIGKAANAGGVSVSGLEMAQNASMHPWSFEVVDAKLHHIMKEIYKNVSQTAKEFKDPTNFVLGANIAGFRKVASAMIAQGV

SEQ ID NO: 22504 - protein, 510 aa, Sorghum bicolor
MAVFISSSGSPGRATATTTTTTTLLLAVLAAAAAAGLLLAPVAARGSPPEHDKQLQLQQQEDDRIPGLPGQPNGVAFGMYGGYVTIDDNNGRALYYWFQEADTADPAAAPLVLWLNGGPGCSSIGLGAMQELGPFRVHTNGESLLLNEYAWNKAANILFAESPAGVVFSYSNTSSDLSMGDDKMAQDTYTFLVKWFERFPHYNYREFYIAGESGHFIPQLSQVVYRNRNNSPFINFQGLLVSSGLTNDHEDMIGMFELWWHHGLISDETRDSGLKVCPGTSFMHPTPECTEVWNKALAEQGNINPYTIYTPTCDREPSPYQRRFWAPHGRAAPPPLMLPPYDPCAVFNSINYLNLPEVQTALHANVSGIVEYPWTVCSNTIFDQWGQAADDLLPVYRELIQAGLRVWVYSGDTDSVVPVSSTRRSLAALELPVKTSWYPWYMAPTEREVGGWSVQYEGLTYVSPSGAGHLVPVHRPAQAFLLFKQFLKGEPMPAEEKNDILLPSEKAPFY

SEQ ID NO: 22505 - protein, 364 aa, Hordeum vulgare
MEEIGHHFGLGATAHGQHHSQLPWGSSPLSAVISPPPQQQQQHQQQSAGYLAHSPLSLNTAPPGVSHGGGSGCSNPVLQLANGSLLEACAKAAKEPSSSSYAADVEAIKAKIISHPHHSSLLAAYLDCQKVGAPPEVSARLTAVAQDLELRQRTALGGLGTATEPELDQFMEAYHEMLVKYREELTRPLQEAMEFLRRVETQLNSLSISVRSLRNILSTGSSEEDQEGSGGETELPEIDAHGVDQELKHHLLKKYSGYLSSLKQELSKKKKKGKLPKEARQQLLSWWEMHYKWPYPSESQKVALAESTGLDLKQINNWFINQRKRHWKPTDEMQFVMMDAYHPPNAAFYMDGHFVNDSGLYRFG

SEQ ID NO: 22506 - protein, 112 aa, Novosphingobium aromaticivorans
MKKVEAIIKPFKLDEVKEALHEIGVSGITVTEAKGFGRQKGHTELYRGAEYVVDFLPKVKLEVVVSDALVDRVVEAVAAAAQTGRIGDGKIFVIPVESALRIRTGERDDDAI

SEQ ID NO: 22507 - protein, 590 aa, Geobacillus kaustophilus
MNIVCATLNAKYIHMNLAIRYLKAYAQPEFDVKLVEYTIKDPVLNIVTDLYQRRPDVIGFSCYIWNIEETIKVVKLLKKAAPNIVIVAGGPEVSYDVREWMERVPELDFIVIGEGEETFKQLLFALEGRKEVADVAGLAFRDGDRIVMNPQRNKLRLADMPSPFRFPEDIPHLPNRIIYVETSRGCPFSCQFCLSSIEVGVRYFDREKIKDDLRYLMKHGARTIKFVDRTFNISRSYAMDMFRFLIDEHVPGTVFQFEITADIMRPEVIEFLNKEAPPGLFRFEIGVQSTNDEVNRLIMRKQNFAKLSRTVTMIKEGGKIAQHLDLIAGLPEEDYNSFRKTFNDVFALRPEELQLGFLKLLRGTGLRLRAEEYGYVYMDHAPYEVLANNVLSFDDVIRIKQVEDVLEKYWNAHRMDETIEYLVTDVFPSPFDFFQQFGTYWDERGWARIGHQLEDLFRRLHEFLRTCAPDALPVAESLMKYDYLRGQKHKPRKPWWEEKTEKTTRTTVYRALLERPEALGEDFAALGLGEKELFKHTVVEIVPVDVGCYIAAKQLSFAPTAIVAYFDPSGTGTTVFSAPLSTLFASSASD

SEQ ID NO: 22508 - protein, 448 aa, Listeria monocytogenes
MAKHRYLPMTEQDEKEMLDVIGVKSIDDLFQDIPEKIRFKRDYDLKPAKSEPALLRELSKLASKNANTSEYASFLGAGVYSHYIPTVVDHVISRSEFYTAYTPYQPEISQGELQAIFEFQTMIAELTGMDLANSSMYDGGTALAEAAMLASGHTKRKKILISGAVHPESSNVLKTYATGQHIEVEVIPELDGKTDIEALKKALSDDIAGFVVQYPNFYGQVEPLAELEKLVHENNSLLLVSSNPLSLGLLTPPGEFGADIVVGDSQVFGIPESFGGPHCGFFAVTNKLMRKVPGRLVGETVDENGKRGYVLTLQAREQHIRRDKATSNICSNQALNALASSVAMATLGKTGLVEMAKQNLDKSHYAKQKFREKGFEVLFSDGFFNEFVVKLSKPIKEVNESLLDEGIIGGYDLGFYEGKYKHHMLVAVTEMRTKEEIDAFVASLEGAK

SEQ ID NO: 22509 - protein, 309 aa, Lactobacillus acidophilus
MSTIFNSVTELVGNTPLLKLNRVVPEDAADVYVKLEFENPAGSVKDRIALAMIEKAERDGKLKKGGTIVEPTSGNTGIGLAMVAAAKGYHIIIIMPETMSVERRKLMKGYGAELILTPGSDGMKGSIAKAEELVKEKGYFMPMQFDNPENPNIHELTTGPEIIAAMNGIGKAIDAFVAGVGTGGTLSGIGRALKKENPNTKVYALEPSESPLLKDRKAGKHGIQGISAGFIPSNLDKNIYDGVIEVSTDEAMNTARKTAKKEGFLPGISAGANVHGAIELAKKLGKGHTVVTVIPDGGDRYLSTALFND

SEQ ID NO: 22510 - protein, 163 aa, Nostoc punctiforme
MQNANLQKATFGAGCFWGVEAAFRQVKGVTSTAVGYSGGHLDNPTYEDVCRGKTGHAEAVEVEYNPAIVSYDQLLNVFWNKHNPTASNHEELNVGYQYRSVIFFHTPEQELLVRASKEQLENSSRYHKNPIVTEILPASQFYRAEKYHQQYLEKHGRASYRIG

SEQ ID NO: 22511 - protein, 225 aa, Nostoc punctiforme
MSIHNFTPSRQLLRNLSIISLTFVLLYGASRVMLSAPATDISNAAPQGKQVAVFAGGCYWGMEAVFEHLLGVSDVVSGFSGGDARTADYTLVSAGLTNHAESVKITYDPSKISYNQLLKVYFLVAHNPTELNRQGPDSGKQYRSAIFFANDEQKQAAQEYIAQLNKSRVFDKPIVTELDPLKGFYQAAAYHQNYIVHHPSDRYVVVNDLPKLAKLQAKFPDMYSK

SEQ ID NO: 22512 - protein, 493 aa, Candida albicans
MTETSISGLRGPKSMYFMEIVDVSSQESSVLSSIVESFTSAVSASNLGVYSDEVLCDIKSSLKENSPITMLPNYNVSPTGDEHGQYLVIDLGGSTLRIAVVDISKPHPNLSRSERITIVVEKSWIIGNDFKRIDGEFFKYIGSKINEILMGQNVIDVKSVINTGITWSFPLETTDYNRGKIKHVSKGYTVGEDIYDKDLKMVLEDTLRQEYGLTLDVQSILNDSLAVYSAGCFIDSKMKLAMVLGTGINMCCSLKRSSDIHPSKMLADATLFNCELSLFGQNLCKDFATKYDIIIDKRFAGFSHHFKTFMEPDPITKTLFQPHELMTSGRYLPELTRLVVVDLIEAGEIFQNVDHQQMYQEYGGFSGELMCFVHENDDYDDIHDKLCKAYGWTTVGLSDIVCLKEVVSCIIKRAAFIVANAIIAFFKLLGSDELGGDVTIGYVGSVLNYFHKYRRLIVEYVNNAEEAKGIKVDLKLIENSSIIGAAIGAAYHK

SEQ ID NO: 22513 - protein, 91 aa, Triticum aestivum
  misc_feature (80)..(80): Xaa can be any naturally occurring amino acid
VSSRRRRSRRLPRAAVAMGRRPARCYRQIKNKPYPKSRYCRGVPDPKIRIYDVGMKKKGVRRFSPLCSPCLNGRRKCVQXRSFEAAPYAWQ

SEQ ID NO: 22514 - protein, 805 aa, Glycine max
GSWYTSDGNPDLLSSNVADIKLQSSSAPAQPLGFHGYVLTGKLKSPKLWSAEKPYLYTLVVVLKDRSGRIVDCESCPVGFRKVSKAHKQLLVNGHAVVIRGVNRHEHHPQVGKANIESCMIKDLVLMKQNNINAVRNSHYPQHPRWYELCDLFGMYMIDEANIETHHFDYSKHLKHPTMEPKWATSMLDRVISMVERDKNHTCIISWSLGNESGFGTNHFALAGWIRGRDSSRVLHYEGGGSRTPCTDIVCPMYMRVWDMVKIANDPTETRPLILCEYSHAMGNSNGNLHIYWEAIDNTFGLQGGFIWDWVDQALVKVYEDGTKHWAYGGEFGDVPNDLNFCLNGLTFPDRTPHPVLHEVKYLYQPIKVALKEGKLEIKNTHFFQTTEGLEFSWSISADGYNLGSGLLGLVPIKPQSSHAVDWQSGPWYSLWASTDEEELFLTITAKLLNSTRWVEAGHIVSSAQVQLPTRRNIAPHVIDINGGTLVAETLGDTIVVKQQDAWDLTLNTKTGLVESWKVKGVHVMKKGILPCFWRAPIDNDKGGGSASYLSRWKAAGMDCLHFITESCSVQNITENSVRILVVFLGVTKGEDGSLSNQDKSKVLFTTEMAYTIYASGDVIIECNVKPNPDLPPLPRVGIELNVEKSLDQVTWYGRGPFECYPDRKAAALVAVYEHNVSELHVPYIVPGESSGRADVRWATFRNKDAFGIYASKYGSSPPMQMSASYYSTSELDRATHNEELIEGDSIEIHLDHKHMGLGGDDSWSPCVHEQYLIPPVPYSFSVRLCPVNPATSGHDIYKSQFQNS

SEQ ID NO: 22515 - protein, 289 aa, Photorhabdus luminescens
MSQKEIWSETLHANFGQYFSVDKVLYHDKTEHQDLIIFENATLGRIMALDGTVQTTERDEFIYHEMMAHVPLFAHGNAKRVLIIGGGDGGMLREVCRHQYLESITMVEIDAGVVEFCRQYLPNHNAGAYDDPRFNLIIDDGVNFVNTTDQKFDVIISDCTDPIGPGEGLFTSEFYQGCQRCLNEGGIFVAQNGVCFLQQDEAVTSHKKLSNYFADSGFYQAAIPTYYGGIMTFAWASQNPALRHVDLATLQQRFDNASFTCRYYNPAVHVGSFALPQYLLDALFTGCTI

SEQ ID NO: 22516 - protein, 320 aa, Streptomyces coelicolor
MSDVRNVIIIGSGPAGYTAALYTARRSLKPLVFEGAVTAGGALMNTTEVENFPGFQDGIMGPELMDNMRAQADGFGAELIPDDVVAVDLSGEIKTVTDTAGTVHRAKAVIVTTGSQHRKLGLPNEDALSGRGVSWCATCDGFFFKDQDIAVIGGDTAMEEATFLSRFAKSVTIVHRRDTLRASKAMQERAFADPKISFVWDSEVAEVQGDQKLAGLKLRNVKTGELSDLPVTALFIAIGHDPRTELFKGQLDLDPEYLKVDAPSTRTNLTGVFGAGDVVDHTYRQAITAAGTGCSAAVDAEPFLAALSDEDKAEPEKTAV

SEQ ID NO: 22517 - protein, 607 aa, Momordica charantia
MISLLDFYHVMTAVVPLYVAMILAYGSVKWWKIFTPDQCSGINRFVALYAVPLLSFHFISTNNPYTMNLRFIAADTLQKLIGLAVLAVWSNISKRGCLEWTITLFSLSTLPNTLVMGIPLLKGMYGEFSGSLMVQIVVLQCIIWYTLMLFMFEYRGARMLISEQFPDTAGSIVSIHVDSDIMSLDGRQVLETEAEIKEDGKLHVTVRKSNASRSDIFSRRSVGLSSTTPRPSNLTNAEIYSLQSSPNPTPRGSSFNHTDFYSMMAAGGRNSNFGSSDVYGLSASRGPTPRPSNYEEDGGGKPRFHYNAAAGGNAGHYPVPNPGMFSPTGSKNAQPNAKKSANGNGVVAQKTEEGNRDLHMFVWSSSASPVSDVFGGNHEFGGNHDQKDVRLAVSPGKVEGRRENQEEYAEREDFSFGNREILNNNNGGAEKVGDIKPKTMPPTSVMTRLILIMVWRKLIRNPNTYSSLIGLTWSLVSFRWNVEMPAIVAKSISILSDAGLGMAMFSLGLFMALQPRIIACGNTIAAFSMAVRFLTGPAVMAVASIAVGLRGVLLRVAIVQAALPQGIVPFVFAKEYNVHPDILSTGVIFGMLIALPITLVYYILLGI

SEQ ID NO: 22518 - protein, 482 aa, Unknown
  Dehalococcoides sp. CBDB1
MTYPICHFTIALRECALNKERAFYKAVSRSIHSLNTPAELKAKLEGIIRLAARASHCAVSLLLIDAAGQKLSHNISFGLPQFYIHKGVLSAADSIGETVNIQTTAITDVQNDHRIQFPQMALKAGFSSILGSPVIYQEKVIGSIRFYCKDFYEFSQQDITFAENMARIISLAFCTLPTTTTPVDNTASMPASNLKTAQNITFAHQSETEFARLLDFYNIEWIYEPRSFPLDWEGELVTEMFTPDFYLPGLDMYIELTTLKQSLVTTKNHKLKMLRELYPDIKISLLYKNDYARLLSKYGCGPLAQTRAHGIDRVLYTAGDIAERVASLARQISDDYPDNRPILIGVQRGFICFMADLIRQIAIPLDIDFMTISYYSGSNASMVRITKDMDLEVAGRDVLLVEDIVDTGITLNYLLNHLRSKNPASLKVCTLLDRKVRRLIDINIDYVGFELPDEFVVGYGLDYHEEYRNLPFIGIPGIKQNP

SEQ ID NO: 22519 - protein, 947 aa, Unknown
  Oceanospirillum sp. MED92
MKRMLINATQPEELRVALVDGQRLYDLDIESGSREQKKANIYKGKITRIEPSLEAAFVDYGAERHGFLPLKEISREYFTQPPTRGSRPNIKEVLKEGTEVIVQVDKEERGNKGAALTTFISLAGRYLVLMPNNPRAGGISRRIEGEDRAQLKEALSGVNIPKQMGIIVRTAGVGRSSEELQWDFEYLQTLWTAIKQASEEKPAPFLIYQESNVVIRAVRDYLRSDIGEVLIDDPQVFEDAKNFVKQVMPTYESKIKHYSEQTPLFNRFQIETQIETAFQREVTLPSGGSIVIDPTEALVSIDINSARATRGGDIEETALHTNLEAADEIARQLRLRDIGGLVVIDFIDMTPIKNQREVENRLRDALKLDRARVQMGRISRFGLLEMSRQRLRPSLAETRGVVCPRCNGQGTIRDTESLALSILRLIEEESGKDRTAQIRAILPVTVATYLLNEKRHAVHDIELRQDVRVVIVPNPNMETPHYEVVRLRDDHTVATTNDASYTMQPEPEDDDPIEASSTQAAPAREQAAVRSVAPKTPAPEAAQAEQQPAAEKAKAAPAPAPSASLGSKVLGLFKGIFGGSEQQPEEKVEEKTEEKDKKKRPKRQRNERNDSGRKRRRRDNDRKQRNKQNDEIITVQPEPDQPLTSNEEKPKRRRRKRKSDTDKAESKSTENLNQSQDSAEEKEEAPRNPRRRGRRRRTTERSAKRSNESQATQTEKTEAHSEAPSDTANTVSMENQEQSPAAEVKDAVATTDTATPEPTAENNKQETTLADSTATEKPEAEAVEATTQEEKAESATAEAPAVETTPTPEISNDAESKPAENQGDTEGKETKEAKKASEIEQPSVAEAEIQPKPEIMAEAAEDNSTEDTVKAEAPVAEQSPEAQTEKPVAEDKPLEADAPSTEKAESDNTQQATQQDAPVRKRRTRRAPNDPREVRRRSATTETSDDK

SEQ ID NO: 22520 - protein, 179 aa, Clostridium difficile
MDIETKKWEVLYSEEKIKDKLRELGAIIEKDYKDKNLMVVSLLKGSFIFCADLVRNINLPLRVNFMTTSSYGNNEESTGRVKVVSDVTTDIAGYDVLVVDDITDSALTMDFVLKHLKAKNPASLKCCVLLDKPSRRKVDLVPDYCGFEIEDKFVVGYGFDFGDYYRNVPYIFNVTDEDR

SEQ ID NO: 22521 - protein, 168 aa, Unknown
  Malus x domestica
MAGHSESKSIHDFTVKDAKGNDVDLSTYKGKVLLIVNVASQCGLTNSNYTELAQLYEKYKTQGLEILAFPCNQFGAQEPGTNDEIVEFACTRFKAEYPIFDKVDVNGDNAAPIYKFLKSSKGGLFGDSIKWNFSKFLVDKEGKVVDRYAPTTSPLSIEKDVKKLLGVA

SEQ ID NO: 22522 - protein, 569 aa, Pichia stipitis
MVSTYPESEVTLGRYLFERLHQLKVDTIFGLPGDFNLSLLDKVYEVPDMRWAGNANELNAAYAADGYSRIKGLSCLVTTFGVGELSALNGVGGAYAEHVGLLHVVGVPSISSQAKQLLLHHTLGNGDFTVFHRMSNSISQTTAFLSDISIAPGQIDRCIREAYVHQRPVYVGLPANMVDLKVPSSLLETPIDLKLKQNDPEAQEVVETVLKLVSQATNPIILVDACALRHNCKEEVKQLVDATNFQVFTTPMGKSGISESHPRLGGVYVGTMSSPQVKKAVENADLILSVGSLLSDFNTGSFSYSYKTKNVVEFHSDYMKIRQATFPGVQMKEALQQLIKRVSSYINPSYIPTRVPKRKQPLKAPSEAPLTQEYLWSKVSGWFREGDIIVTETGTSAFGIIQSHFPSNTIGISQVLWGSIGFTVGATVGAAMAAQEIDPSRRVILFVGDGSLQLTVQEISTLCKWDCNNTYLYVLNNDGYTIERLIHGKSASYNDIQPWNHLSLLRLFNAKKYQNVRVSTAGELDSLFSDKKFASPDRIRMIEVMLSRLDAPANLVAQAKLSERVNLEN

SEQ ID NO: 22523 - protein, 195 aa, Glycine max
MTAIAGTHVFGVVSFQLKQAEMPFACSCLIRKRIGDSPQRNVALRRRVNGTILPQIRAQNLPDYVPKSEFYKVEAILRPWRVPQVSAALLKMGIRGVTVSDVRGFGAQGGSKERQGGSEFSEDNFVAKVKMEVVVRKDQVEAVIDKIIEEARTGEIGDGKIFLIPISDVIRIRTGERGEQAARMTGGRSDMLSAV

SEQ ID NO: 22524 - protein, 384 aa, Lactobacillus acidophilus
MAQEDYYKVLGVDRDASDQEISKAYRKLAKKYHPDLNHEPGAEEKYKQVNEAYEVLHDKQKRAQYDQFGSAGVNGQGGFGGAGQGFGGAGFDTSGFGDFGDIFGDIFGQGARQQRVDPTQPQRGQDLDYTLTIDFMDAINGKKTQVSYTRDETCETCGGNGCEKGTHPITCDKCHGTGVMTVTQQSMLGMIRRQTTCDKCNGRGVIIEHPCKTCGGKGTVERKNTIEVDIPAGIDNGQQLRYQGQGEAGRNGGPYGDLYISYRIKPSKDFERRGQNIYTEVPISFAQATLGDEITVKTVHGDAKLTIPAGTQPNKKFTLRGQGVPYLRGNGNGDQITTVNIVIPKHINDKQKEDLTNFVHDGGGNITPQEKGFFERLKDKLSGE

SEQ ID NO: 22525 - protein, 423 aa, Nocardia farcinica
MPNTSDTTEDQVAEPHYLVGLDLRGRRVVVVGGGTVAARRLGLLIAAGADVHVISREVTPTVEGMASSGQIRVTLRPYADGDLAEAWYAIACTDEPETNAAVVAEAERRRVFCVRADNARLGTAVTPATARYEGLTLGVLARGAHRRSAAVRTGLLEALQSGVVADDSVPVTPGVALVGGGPGDPDLITVRGRRLLARADMVVADRLAPPELLAELGPHVEVVDAAKIPYGRAMAQEAINTALVEGARAGKFVVRLKGGDPYVFGRGYEEVQACVAAGVPVTVVPGVTSPISVPAAAGIPVTHRGVTHEFVVVSGHVAPDHPDSLVDWSALARLRGTLVLMMAVERIEQFADALLAGGRPADTPAAVVQEGTLRTQRVLRADLGTVAARVRAEGIRPPAIIVIGPTAAFALADIGALTGSAGQ

SEQ ID NO: 22526 - protein, 393 aa, Nicotiana tabacum
LPFELPPAEIPLPEIPLPFDGPTFVLPPPSPPPPPPSPLPSPPPPSPSPPPPSTLIPLIPPFTGGFLPPLPGSKLPGLLPLIPNLPDLPPIGGGPPVNRPKPSSPSPPVKPPPPPPSPCKPSPPDQSTKQPPPPPPSKQPPPPPPVKASSPSPAKQPPPPPPPVKSPSPSPAKQSPPPPRAPSPSPATQPPIKQPPPPSAKKSPPPPVAYPPVMAPSPSPAAEPPIIAPFPSPTANLPLIPRRPAPPVVKPLPPLGKPPIVNGLVYCKSCNSYGFPTLLNTSLLPGAVVKLVCYNGKKTMVQSATTDNKGEFRIIPKSLTRADVGKCKLYLVKSPNPNCNVPTNFNGGKSGGLLKPLLPPKQPITPAAVPLSDLYGVGPFIFEASSKMPCDKN

SEQ ID NO: 22527 - protein, 132 aa, Bacillus anthracis
MSKQPMTPFEAIGGEQCIEILVDTFYSYVSKHPDLSPIFPDDLTETARKQKQFLTQYLGGPNLYTEEHGHPMLRARHLPFEITPKRAEAWLSCMEQAMDDTGVHGHIREFVFERLALTAQHMVNTPNETGEI

SEQ ID NO: 22528 - protein, 79 aa, Arabidopsis thaliana
  misc_feature (68)..(68): Xaa can be any naturally occurring amino acid
MAGYMLSSATMVDCSAQATMVAPLNGLKSCADLPVTRMANNDITFMTRNGGRVNCMHVWTSIGKKKWXTLSHLTDLTES

SEQ ID NO: 22529 - protein, 549 aa, Bifidobacterium longum
KGAAAVRQEVIDMVRALHEAGFEVIMDVVYNHTCEGGVEGPTVCWRGLDDLAYYRHQKSNTGRLEDTTGCGNTLDFTNTHVVTFAIDSLRYWAKRIGIDGFRFDLGVTLARLEGEFTHHHPFLYALRSDLLLGNLKLIMEPWDLGNLGWRTGQFSVPFAEWNDRFRDTARTFWLEDVDGGSDFGRISLQEMSTRLCGSADLFATEPGRGAPASINFVSCHDGFTLTDLTRYRSKHNEANGENNNDGSSVNHSANFGVEGVTDDPDVIAAREQAAMNMIGMLLLSLGTPMMLAGDEFRNTQDGNNNAYCQDNDITWLKWDWMYSTNKTREMRRLETVSRLVALRKSLDLYHHEDFFTRLTQIGLLKPSSRVQWFLPDGTTPMERDWFDLGVRSFTMRLLSNSEVDVCIVVNGTADDRTFRLPPDTHWTPKWCSAEINGRRAGHGTQVEECDLNGDTTVWTQHVPDASETVLKMVEEVAMQRTESSTENEADTIKFAMPVTDHAANGTSSAPRDEVSADMPDAPVDDTPDTPVDDNVWTMPALSITLMKQV

SEQ ID NO: 22530 - protein, 313 aa, Desulfitobacterium hafniense
MCALSADVNSWLKDIEVFKMKFTLEMKLKDIMAANPKTVEAMQELGLHCLGCPFSVNETLLNAAQMHKLDPEKLLEAVNSVEQGEMSEAAKAKAQPKGAILQMDKKTFAIAPHIPAGVATPEILRKIADVAEKYNAAAIKVTSAQRIAIVGLKPEVIPAAWDDLGMDPGHAIGLCVRSVKVCPGMTFCKRGLQETLGIGMEVDKRYHGMSLPAKFKIGIAGCPNKCTDSMNVDLGIMGTSKGYHVYVGGNGGVKPRRGDLLLENLQSDQLIPVIDAVMEYFKENAKPQERLGRLIDRVGLEGLQEAAQDVVNA

SEQ ID NO: 22531 - protein, 169 aa, Bdellovibrio bacteriovorus
MSNIPGVCVSPDKETQKYVFNHTMLRIKDPKASLDFYTRVLGMKLVRKLDFAEWKFSLYFLAYVPEGTDVPTENEANARYAFGREAVLELTHNWGTEEQETTPYHNGNTEPRGFGHICISVPDIQQACARFESLGVNFQKRLGEGGMKNIAFVKDPDQYWIEVVQPGLL

SEQ ID NO: 22532 - protein, 286 aa, Triticum aestivum
MASSVAAAASAFLGTRLADPAPQNGRIVARFGFGKKKAPPKKAKAPPTTDRPLWFPGAQAPEYLDGTLVGDYGFDPFGLGKPAEYLQYDVDSLDQNLAQNLAGEIIGTRFEDADVKSTPFQPYAEVFGLQRFRECELIHGRWAMLATLGAYTVQWLTGVTWQDAGKVELVDGSSYLGQPLPFTLTTLIWIEVLVIGYIEFQRNAELDPERRLYPGGSYFDPLGLAADPEKKETLQLAEIKHARLAMVAFLGFAVQAAATGKGPLNNWATHLSDPLHTTIFDTLGSS

SEQ ID NO: 22533 - protein, 607 aa, Momordica charantia
MISLLDFYHVMTAVVPLYVAMILAYGSVKWWKIFTPDQCSGINRFVALFAVPLLSFHFISTNNPYTMNLRFIAADTLQKLIVLAVLAVWSNISKRGCLEWTITLFSLSTLPNTLVMGIPLLKGMYGEFSGSLMVQIVVLQCIIWYTLMLFMFEYRGARMLISEQFPDTAGSIVSIHVDSDIMSLDGRQVLETEAEIKEDGKLHVTVRKSNASRSDIFSRRSVGLSSTTPRPSNLTNAEIYSLQSSRNPTPRGSSFNHTDFYSMMAAGGRNSNFGSSDVYGLSASRGPTPRPSNYEEDGGGKPRFHYNAAAGGNAGHYPVPNPGMFSPTGSKNAQPNAKKSANGNGVVAQKTEEGNRDLHMFVWSSSASPVSDVFGGNHEFGGNHDQKDVRLAVSPGKVEGRRENQEEYAEREDFSFGNREILNNNNGGAEKVGDIKPKTMPPTSVMTRLILIMVWRKLIRNPNTYSSLIGLTWSLVSFRWNVEMPAIVAKSISILSDAGLGMAMFSLGLFMALQPRIIACGNTIAAFSMAVRFLTGPAVMAVASIAVGLRGVLLRVAIVQAALPQGIVPFVFAKEYNVHPDILSTGVIFGMLIALPITLVYYILLGI

SEQ ID NO: 22534 - protein, 457 aa, Saccharophagus degradans
MNNANQQKAHLVIVGNGMATGRLLDELIKRDANAYNITVIGDEPEGSYNRIMLSPVLAGETELATIINKPAAWYAQNNIRFVAGVRANAINRQAQTVALADGSCIAYDELVIATGSRPALIPATNQHLQNIFSFRTIEDVNSIASCAQAGRKAVVVGGGLLGLEAAYGLAQKGVQVTLVHRSKGLLNRQLDSGAGEFLQQVMASKNIQFALGTEVAAFNSDALGGSGFASETLKSATLTNGETIECDLAVISTGITPNKELGQEAGLACGRAIIVDDYMTSSDNCISALGECCEHKGETFGLVEPIWHQCISLAEKLCFKRNVAFVNPVVATKLKVSGVQLFSAGEHLTGDDCREIKMVDVKNKIYRKIVLRNNRIVGVVLFGDTRSGADYFELMQQAVDVSSVAALLVMGKAFYAEQLQAAQNLNQCANQADFSQADSLNTASVTVSKNANNDIAA

SEQ ID NO: 22535 - protein, 915 aa, Saccharophagus degradans
MTVQKSQLANVIASDNRADIASKTVKTTCCYCGVGCGVEATVEDNRVTAVKGDELHPANLGRLCVKGSSLHETQSNPNRLLQPMLHGEATDWETALNYSADKFKAIVEQYGPESVAFYLSGQLLTEDYYVANKLMKGFVGTANIDTNSRLCMASAVVAHKRAFGGDVVPGNYEDLENTDLVLLVGSNTAYAHPIIYQRIVKAKAARPNMKVVVIDPRRTATCDIADYHLAIRPGSDAFLFNGLLGYLADNNALDSEFIANHSEGFDEALSVAKAQVASVEQAAVMCDVAKNDLTAVYDLFAKTTKAVTVFSQGVNQSSSGVDKGNTIINCHLATGKIGKLGAAPFSITGQPNAMGGREVGGLANQLAAHMSFDNQPDIDRVASFWRAPNMAQGEGLKAVDMFQAVHDGKIKAIWIMATNPVVTMPDANFIREALEKCELVLVSDCIANTDTGKLADVVFPATTWSEKNGTVTNSERRISLQKGFLPAPGQAKHDWQIISEFAQKIGFEQAFNYTHPVEIFREHAALSGVDNGVDVGTNTRPVRGFDISGMQHISKQAYENLQPIQWPVNSHKPNGTARLFEDANFFTASGRAKFVPISARFPQMPPKDNQVIMNTGRIRDQWHTMTRTGSAAKLLGHIDEPFIDIHPADAKRFGLAHKDIAVLENRGARYLGRVNVSDSQRVSEVFVPMHWNDNFASSSRADALVNAITDPLCGQPEFKHSPVEINPYNAQWSGFIASELPVTPNADYWVKIPVDKGYKYRIADTVTPSNWSEWLTEQFPLVSDWVELTDSSQAFYRKVGFIEGRLAVVLNIARGNEQPIENRWLEQQLGEQCDLNQRFAVLAGVAGEGVEDEGPIVCSCFQIGAKAIQTAIEGGCCSAEALGEKLKCGSNCGSCIPEINGMIRAFSPQHAAKQA

SEQ ID NO: 22536 - protein, 206 aa, Ureaplasma parvum
MIKNQKTRNDGIKMKDIDPRIKEVLITEEQIDQKITEAANWINKEYEGKEPIIIGILKGCIPFIGKLLPKIKIDMKLDFLAISSFKGATSAQTEPEIITDLKFEVKDRDLILVEDIVDTGRTIKKVYDLLKIRGARSIKLVTLVDKKDGRLVDLQADFVCCDIPLVFIVGFGLDYKEIMRNLPYIGVLKEEVYQNDLNNKNEGDGE

SEQ ID NO: 22537 - protein, 511 aa, Arabidopsis thaliana
MEEISPAVALTLGLANTMCDSGISSTFDISELENVTDAADMLCNQKRQRYSNGVVDCIMGSVSEEKTLSEVRSLSSDFSVTVQESEEDEPLVSDATIISEGLIVVDARSEISLPDTVETDNGRVLATAIILNETTIEQVPTAEVLIASLNHDVNMEVATSEVVIRLPEENPNVARGSRSVYELECIPLWGTISICGGRSEMEDAVRALPHFLKIPIKMLMGDHEGMSPSLPYLTSHFFGVYDGHGGAQVADYCHDRIHSALAEEIERIKEELCRRNTGEGRQVQWEKVFVDCYLKVDDEVKGKINRPVVGSSDRMVLEAVSPETVGSTAVVALVCSSHIIVSNCGDSRAVLLRGKDSMPLSVDHKPDREDEYARIEKAGGKVIQWQGARVSGVLAMSRSIGDQYLEPFVIPDPEVTFMPRAREDECLILASDGLWDVMSNQEACDFARRRILAWHKKNGALPLAERGVGEDQACRAAAEYLSKLAIQMGSKDNISIIVIDLKAQRKFKTRS

SEQ ID NO: 22538 - protein, 401 aa, Streptomyces avermitilis
MADSTATSTPRAVPSHEDRPVYVIGGGPGGLAAAHALRAQGVRAVVLEKSDRVGASWRRHYDRLHLHTTRRLSALPGLPMPRSFGRWVSRDNVVRYLEKYVEHHQLEIVTGVEVSRVEPAPDGTGWLLHATGGRELTGSAVVVATGHNHTPHLPDWPGRDAYTGELLHAGDYRNATPHAGRDVLVVGVGNTGAEIAVDLVEGGASRVRLAVRTAPHIVRRSTAGWAAQFTGIVVRRLPVRLVDLLAGPMARLSVPDLSAQGLPRPDTGLYSRVREGSIPVQDVGLIDAVRKGRVEIVAAVDGFEDGKVVLADGNRIGPDVVIAATGYARALEDLVGHLDVLDGRGRPTVHGARTPRTAPGLYFTGFTNPISGMFRELAIDAEKIAKAVAKALARTTARTPA

SEQ ID NO: 22539 - protein, 376 aa, Candida albicans
MSLSPKLEEIVSSIEKSFEIKDDFLVKATEYFIESMNVGLESPKPSKDVMPMIPTYVTSIPTGKEVGLYLAADLGGTNFRVCSIDLKGDHTFSMKQSKYRIPVDLMKAEKSNDLFGFLAKKVQSFLLENHSEACTAKNTEPLKLGFTFSFPVNQTALNRGTLIRWTKGFDIPDTVDRDVVELLQANLTILEVNVKVVAIANDTVGTLLTAAYSNDSAKTNRNTIIGCIFGTGTNGAYFESKIPKLSSSTGDNKGMVINTEWGSFDNGLKILPSTEFDEIVDSETANPGYHLFEKRISGMFLGEILRVALIHLFKKGLIFQELYKARGGSLPHRIEEPWLLDAEVLSYLQIDDSTDLKTSGLILQNVSQIGNQQGGT

SEQ ID NO: 22540 - protein, 181 aa, Photorhabdus luminescens
MSKPKHIVEVMISELEVKQRIAELGKQITEHYRDSGSDLVLVGLLRGSFIFMADLCREIQIPHQVDFMTASSYGSGMNSTRDVKILKDLDEDIRGKHVLIVEDIIDSGNTLNKVREILALREPKSLAICTLLDKPSRREVGVPVEWIGYSIEDKFVVGYGIDYAQLYRHLPYIGHVILLEE

SEQ ID NO: 22541 - protein, 183 aa, Photorhabdus luminescens
MVNFIMKHTVEVMISEQEVKQRIAELGKQITEHYCDSGSGLVLVGLLRGSFIFMADLCREIQIPHQVDFMTASSYGSGMNSTRDVKILKDLDEDIRGKHVLIVEDIIDSGNTLNKVREILALREPKSLAICTLLDKPSRREVDVPVEWIGYSIEDKFVVGYGIDYAQLYRHLPYIGHVVLLEE

SEQ ID NO: 22542 - protein, 160 aa, Arabidopsis thaliana
MATSASALLSPTTFSTAISHKNPNSISFHGLRPLRLGGSSSALPKLSTTGRKSSSAVVRAELSPSIVISLSTGLSLFLGRFVFFNFQRENVAKQGLPEQNGKTHFEAGDDRAKEYVSLLKSNDPIGFNIVDVLAWGSIGHIVAYYILATSSNGYDPSFFG

SEQ ID NO: 22543 - protein, 159 aa, Streptococcus pyogenes
MPNLYDFTVKAQNGNDLSLAAYKKKVVLIVNTATKCGLTPQYQALQALYDTYHDKGFEVLDFPCNQFLNQAPGDAEEINHFCSLTYHTTFPRFAKIKVNGKDADPLFTWLKEEKSGPLGKRIEWNFTKFLIGQNGQVIKRYSSKTDPKLIEEDLKALLG

SEQ ID NO: 22544 - protein, 512 aa, Trichodesmium erythraeum
MKVYIIGAGPGNKEYLTLKAHALITQGEVLIYDALIDDSILELAPENCLKIEMGKRGGKPSISQSEINSLLIEKYNLGKQVIRLKGGDPFIFGRATPEIQALIKAGCEFEIVPGISSTLAAPLLANIPLTDTVMSRAFVILTAHDIKVLDWETISKIETLVILMGAKNLGEIVHQLLKHQRKPQTPVAIIKNCATPKQQIWISNLSNIAKQTYAEYLSPCVIIVGEVVRLRDYLQYPNNMVREKSEAKTEIAPLANKTILVTRSAGQSSKFSELLKKQGAKVIEMPALVITPPSSWHDLDLGITNINSFDWLILTSTNGVDYFFERLAEKGKDSRALAGVKIAVVGKKTAESLKTCGLVPDFIPPNFVADSLVANFPEKLSGKKILFPRVETGGREVLVKELNSQGAEVIEVAAYESSCPENILPEALLALQNYHIDVITFASSKTVKNFCYLIGENKDKLPEDLLENICIASIGPQTSQSCHSLLGRVDVEAQEYTLDGLTKAIIEWVRVA

SEQ ID NO: 22545 - protein, 416 aa, Streptococcus pyogenes
MTDMRRLGQRAKQASLLIAPLSTQIKNRFLSTLAKALVDDTQTLLAANQKDLANAKEHGISDIMMDRLRLTSERIKAMAQGVQQVADLADPIGQVIKGYTNLDGLKILQKRVPLGVIAMIFESRPNVSVDAFSLAFKTNNAIILRGGKDALHSNKALVKLIRQSLEKSGITPDAVQLVEDPSHAVAEELMQATDYVDVLIPRGGAKLIQTVKEKAKVPVIETGVGNVHIYVDAQADLDMATKIVINAKTKRPSVCNAAEGLVIHEAVAARFIPMLEKAINQVQPVEWRADDKALPLFEQAVPAKAEDFETEFLDYIMSVKVVSSLEEAIFWINQHTSHHSEAIITRDIKVAETFQDLVDAAAVYVNASTRFTDGFVFGLGAEIGISTQKMHARGPMGLEALTSTKFYINGDGHIRE

SEQ ID NO: 22546 - protein, 273 aa, Streptococcus pyogenes
MMKRQFEDVTRIVIKIGTSSLVLPTGKINLEKIDQLAFVISSLMNKGKEVILVSSGAMGFGLDILKMEKRPTNLAKQQAVSSVGQVAMMSLYSQIFAHYQTNVSQILLTRDVVVFPESLANVTNAFESLISLGIVPIVNENDAVSVDEMDHATKFGDNDRLSAVVAGITKADLLIMLSDIDGLFDKNPTIYEDAQLRSHVAVITQEIIASAGGAGSKFGTGGMLSKIQSAQMVFENKGQMVLMNGANPRDILRVLEGQLLGTWFKQIEEVRHD

SEQ ID NO: 22547 - protein, 661 aa, Zea mays
GGSSPAKPGEGLRLDLSSLRSQGRKDQIAFFDKECSKVADHVYLGGDAVAKNRDILRKNGITHVLNCVGFVCPEYFKSDLVYRTLWLQDSPTEDITSILYDVFDYFEDVREQGGRVLVHCCQGVSRSTSLVIAYLMWREGQSFDDAFQFVKAARGIANPNMGFACQLLQCQKRVHAIPLSPNSVLRMYRMAPHSQYAPLHLVPKMLNDPSPATLDSRGAFIVHVLSSLYVWVGMKCDPVMEKDAKAAAFQVVRYEKVQGHIKVVREGLEPQEFWDAFSSMPPNSDSNTKISKDQIDSASKSDPGSRKNESYDADFELVYKAITGGVVPAFSTSGAGDETHLPARESSWSLLRHKFISRSLARVYSDSALMKDFDPRVQHLAAEASTSPPFLSPSSLSSDSSVSSKYSSDSPSLSPTTGSPPSFGLSPASSNLTHALVPSSRSPLSQSSNEGASKPSGMESIHSPSKTSSIAERRGGFTLLKLPSLQKDLVLPPRVPSIVLPPRAPSSIRRTEDASDNSTNGVKQLTSEFCSEKCTGNSLSSHSETRLIERTDSNSEVCSNAQLVVYQWPSMGKLTTFARKDLDPKSVLIFVTSNAIRRGEAVKMVYVWVGGENESSKSVDSVDWQQVTSDFLHLKGLSNVLPVKVFKEHEAENLLELLNVS

SEQ ID NO: 22548 - protein, 112 aa, Saccharophagus degradans
MKLITAVIKPFKLDAVREALSEIGVQGITVTEVKGFGRQKGHTELYRGAEYVVDFLPKTKLEVAVADNQVDSVVETISKAAHSGKIGDGKIFVSALEQVIRIRTGESGEDAL

SEQ ID NO: 22549 - protein, 944 aa, Myxococcus xanthus
MMRSERAFILVAGGRVADLASSAHAAIFEHSRDGVLVLDAGQRIVEVNRAAERIFGPRTRLVGQPVGLLLPGWRPPEPRAPADAALRETELAGHRPGGSGPAHYLRVVTLPLPGEGDGGWVLQLHDMTARLEVEASLRQQKEFFEAVVINSPVAIITITRQFRVLSWNPEATRLFGYSPAEALGKHIFELVATEPTVLPEAEQASREVVQRGRLRSVTRRVRKDGSVVDVELRALPVSVGGRQLGFIAIYHDITDLERARKAAEAANQAKSLFLATMSHEIRTPMNAIIGMTGLLLDRALTEEQRDFVATIRQSSEALLTLLNDVLDFSKIEAGRFEAELRPFDLRQCVESVLDLMAVRASEKGLDLGCDLAPPLPQMLVGDASRLRQVLLNLVGNALKFTEHGGAVVSVEGLALGGTEGAADWELTFSVQDTGLGIPDDRRTGLFQPFNQLDASVSRRFGGTGLGLAISKRLVEAMGGTIWVESEGVPGQGTTFRFTLRAQAAPQAYAVQPRQEQGLLQGRRVLVVDDNALFRRLLGRQLQAWGLVPVESASGMDALAQLEAGASFDAVLIDHHMPGLDGTALAERIRQREETRALPLVLVSTPGRRGNPPEGLFAGVLSRPLKDSQLYDALVSCFSQHLPQLPEPRQTRPSRAGPFPGERPGDTVPLDILLVEDNATNQKLALLVLERLGYRADVALNGRQALQALSQKRYDAVLMDLQMPEMDGLEATRRIRQELPPKAQPWVIAMTANAMDSDREQCFSAGMDDFLGKPIRVEALTAALLRCQPRRSEVAPERRVASGAVALTPLQTVMEGLPDAARIPGLESAALARLWAELGAQAAQILPELIDTALHSMPALLEDAYSALGRGHADDLGRAAHTLKSNAAWFGASALESQARDIELQADSGLLEDMPERLERCRAELEVTRLLLGRLRDSVLALSGA

SEQ ID NO: 22550 - protein, 157 aa, Ustilago maydis
MIISKENRKTIYASLFKEGVMVAPKNFTVQHPELEIPNLEVVKALQSLTSRGYVHTQFSWQWYFYTLTDEGVEYLREFLHLPAEIVPATHKRPARPARAPAGGRDGAYRAPRGDRDGGDRSEYRRRDGAAAGDKKDAAPSGEYRPRFAGVGRGAPRQ

SEQ ID NO: 22551 - protein, 112 aa, Saccharophagus degradans
MKLITAVIKPFKLDDVRNALSEIGVQGMTVTEVKGFGRQKGHTELYRGAEYVIDFLPKVKLELVLGDELIDQAVEAISKAAQTGKIGDGKIFITPCEEVIRIRTGETGPEAV

SEQ ID NO: 22552 - protein, 192 aa, Oryza sativa
MMPRMSKPAPASSASKPRRRASPSPSPSPGTAPKTAKNAVAGVGTIGGPYSSSSTWRRGVLGLLGGARKGVLGRDAKSGHGSNAKFRIEGVGARQRRNPLIPRPNGSKRHLQHQHQPNAAEKKTAATSNYFSIEAFLVLVFLTMSLLILPLVLPPLPPPPSLLLLLPVCLLILLVVLAFMPTDVRSMASSYL

SEQ ID NO: 22553 - protein, 452 aa, Geobacter sulfurreducens
MKILLIQPPSHYPLMDQVYLFEPLALEYLGAGARLEGHEVYLLDARLESDISRVLGEFRPDVVGVTAFTSQVTIAHRIAKEVRELLPDSFLVVGGHHATVRPADFNESAFDAVVIGEGVAALRELLAARERGAPLKDIAGLGVPSPAGMLFTPPRPYTPLDELPLPARDLTARYRAGYFSEWFTPLASIRTSLGCTARCTFCALWSITGGAYLRRDPDRVVEELKGIAEPNVFFCDDESMCDTKRMALLADRIRAAGIRKNYFLYARVDTIVRHPELFRAWADIGLKQVFVGMEDFSDARLAAMKKGVTTDQQARAATILRDLGVMMYASFMVDPDYSRDDFRALVAYVRKLRLTYATFTVMTPLPGTELHAAREAELLSTKPELYDMLHALLPTRLPLPEFYEEMAGLYGKAVPIHRSLPTLLKFGLHGLLLRMRLFGTFLARLRAAHLDY

SEQ ID NO: 22554 - protein, 455 aa, Debaryomyces hansenii
MVLPHEPEFQQAYNELVSALEDSTLFTEKPEYKKVIPVVSVPERIIQFRVAWENDNGDVEVNNGYRVQFNSALGPFKGGLRFHPSVNLSILKFLGFEQIFKNALTGLSMGGGKGGCDFNPKGRTDSEIRRFCVAFMRQLARYIGSDTDVPAGDIGVGSREVGYMFGAYKQMQNNWSGILTGKGLSWGGSLIRPEATGYGVVYFVEKMIEKATGGKESFKGKRVAISGSGNVAQYAALKVIELGSTVVSLSDSKGCIISQTGITPDQIKAIAAAKIHFKTLEEITKESASLFSGSNEVQYIAGVRPWTHCGQVDVALPSATQNEVSGEEAKALVEAGCKFVAEGSNMGSTKEAIDVFEANRSKAVWYAPGKAANCGGVAVSGLEMAQNSQRVTWAAEEVDEKLKNIMYTCFDNCYANAAKYSAEKDAENLPSLLKGANITGFIKVADAMFDQGEVF

SEQ ID NO: 22555 - protein, 595 aa, Dunaliella tertiolecta
MASVDCTLVSARGIKDVEIVGKQSPYAVLTVGPKTFKSGTANGGGSDPVWNQTFSFTNVTPDSSVKLEIFNSNVVLRDVAIGGCKAPMDKALSAGKDELTLPIITKKGKPHGEVKLILTLKPDATKQMVTSHKTRKAAGAWILPTYGNTDCWKDYEPGTLLGKGTFGTTYLATEKKTGQKCAVKVISKRKLTTPDEVDDVKKEVQIMHHLAGHPNVVGLKGVYEDKSNVCLAMEVATGGELFDSIVKRGHYSERDAAELIRTIVSVVAHCHNMGVIHRDLKPENFLLSDKSPRAQLKATDFGLSSFFQEGQVFTDIVGSAYYVAPEVLRRSYGKEADIWSCGIILYILLCGFPPFHGDSEKKIFEAIISKSVDFNTQPWPRISAPAKDCVKRMLQRDPKKRATANEIMQHDWMRENGVASDEPLEMEVVSRIKNFSGMNKLKKEALKVIAVNLPIDEISGMREMFMDIDKDKSGNITIDEFAAALHKKGQIVTEKEIEKIMKEADVDGDGTIDYEEFLAATINLGKLQREENLKTAFEHFDLDGNGEISHNELVQCLSKLGINDAHVKDIIKEVDADGNGQIDYNEFCIMMRNLD

SEQ ID NO: 22556 - protein, 605 aa, Citrus sinensis
MAAATTTSSLIDLGSCKDSCSSPSFSSSRARIAFSLKKPTEITCSLQTPSIFHFPKQSPKYPPSPAATPPPSSPPLTTKQQPKENDNFAPSKWNFLQKAAALALDAVENALVSQERQHPLPKTADPTVQIAGNFSPVPEKPVCQNLPTTGKVPDCIQGVYVRNGANPLHEPVAGHHFFDGDGMVHAVKFNKGSVSYSCRFTETNRFAQERSLGRPVFPKAIGELHGHTGIAMLLFYSRALFGLVDPSHGTGVANAGLVYFNNRLLAMSEDDLPYHVRVTPSGELKTVGRFDFSGQLKSTMIAHPKVDPVTGDLFALSYDVVKKPYLKYFQFSPQGIKSPDVEIPLEEPTMMHDFAITENFVVVPDQQVVFKLNEMIRGGSPVIYDKNKVSRFGILDKNATDASKMKWIDAPDCFCFHLWNAWEEPERDEVVVIGSCMTPADSIFNECDESLKSVLSEIRLNLKTGESTRRPIISEDEQVNLEAGMVNRNLLGRKTRFAYLALAEPWPKVSGFAKVDLLTGQVNKFIYGDQRYGGEPLFFSRDPNSENEDDGYILAFVHDEKEWKSELPIVNAMTLELEATVKLPSRVPYGFHGTFIGAKDLAKQA

SEQ ID NO: 22557 - protein, 371 aa, Unknown
  Synechococcus sp. CC9311
MSLRVVKVGTSLLRSTESRSTADAISALCLNLAQCLHRGDRVVLVTSGAVGLGCQRLGLKARPSTLRGLQAAAAIGQGHLMALYEDAMAVHGIPVAQVLLTRSDLADSRSYHNASATLHQLIEWKVLPVINENDTVSSAELRFGDNDTLSALVAAAINADDLILLTDIDRLYSADPRSDASARPISDVHHPAELQALQQGAGDGGRWGTGGMTTKLAAARIATASGITVHLADGRDQHMLETMLAGGRGGTVFHPHPQPLGHRKSWLAHALQPLGSLQIDRGACKALCNKGASLLLVGITDFKGEFQANQPVQILDQEGHEVARGLSSLSSETLRSLVKEPARTDRQGSSPVVVHRDVLVLSTPTIRQPDP

SEQ ID NO: 22558 - protein, 285 aa, Burkholderia vietnamiensis
MSTTLLFHPTPDAAYGFPNARRLAHVASPHQHIEVWDTPQLGRLFTLDGRPMTSVGDEYVYHECMTHPAALAHPCPKKALVLGGGDGGAARQLLKHACIERIVVAELDDEVVGMARRYLDDVHQGALDDPRVEVVIGDAAQFVASTVEHFDLVVFDLTPPDSPAAGLYTREFYARLKRILTPRAALSMHLGSPLFHAARIAALLDDLRASFAFVDPLSAHVPLYGSQWLMAIASDTLDAAALFAHDVDERLAARRVHGLRYYDARLHAALFALPRALRDTLGGRR

SEQ ID NO: 22559 - protein, 473 aa, Bacillus cereus
MQQPTNEKLHRTMKSRHLFMIALGGVIGTGFFLGSGYTINQAGPGGAILSYLVGGFIMYLTMLCLGELTVAMPVSGSFQKYATKFIGPGTGFMIGWLYWLGWAVTVGLELTSIGLMMKRWFPNVDVWVWCLVFGVILYASNAISAKSYAELEFWFSSIKVVTILAFVVLGGSALLGFISYDGKEAAPLFSNFVSDGGLFPNGLAAVLLTMITVNFSFQGTELIGIAAGESENPEKTIPRAIRNTVWRIMLFFILTMTILVGLISWKEAGVIESPFVVVFDKIGIPYAADIMNFVIITALLSVANSGLYAATRILWSLANEGMAPKSFQKVNKRGIPITALVVTIAVAALSLLTSFLAEDTVYMYLLSIAGLSAVSSWIIIALSQLRFRSQYIKGGGKLEDLKYRTPLYPIVPILALITNSIVVISLAFIPEQRMALYCGIPFIIFCYIYYYINKKRQKPMKVETTNETNNQTR

SEQ ID NO: 22560 - protein, 444 aa, Rubrobacter xylanophilus
MEHRELIEQGEALASEGLVEEALERFEQALQRAPDDPEVVEAVGRALLGLGRLEEAEASFLDALEMDPGWVAPRMGLAMVAMRRDEPFKIVHHLERAIEADPEQPDAYVELGRYYGLMGEPLLARATFERWLARHPDDADMLINAGLTLFDAGDYGPALEFFERAVEAAEDAEQRLGALTFRANALDMLGRYEEAVAAYEGVIAEEARWWEAHANLGICHARSGRPEEAEAAFRRGLEACPGSPEMRDELAAHLLAYGGDPREALALAEEAVALGSDEIRHLYTLGEARLANGDEEGAMDAYRRVLELDPENPEAHLELGILHDRRGERQRAEKHFLESLKADPSNPRALYSYANVYYTSGELETAEELLARALAADPGYSPALSALASIRARRGEYAASLEYLEKAVEAGERDVEHFKRALEFAPLRQDPRFRRLLSRMAEGD

SEQ ID NO: 22561 - protein, 194 aa, Magnetospirillum magnetotacticum
MSRLLPTNPLGSFVASVVAAIGLAGGVAWGATGDHLDWSSLPLPAIAGGQVPADAFKGKVVLVVNTASQCGFTPQYQGLEALWREYRGRGLVVLGVPSNDFGAQEPGSNPEVASFCEINYGVDFPLLEKQVVTGTGAHPFYRWAAERTGALGVPRWNFHKILVGRDGQLVDWFASTTAPDSARLRAAIDKALTP

SEQ ID NO: 22562 - protein, 142 aa, Unknown
  Oceanospirillum sp. MED92
MIVVCPTCFTSNRIPEEKDHTQGKCGKCKSDLHTFTPAELDDHSFEKFVGNSELPVIVDFWASWCGPCQMMKPIFDKTAAESEILLFAKVDTEKAQRTSANMNIRSIPTLIMFQNGQEIDRVAGALQEPQLKQWILQTLQKA

SEQ ID NO: 22563 - protein, 312 aa, Fusobacterium nucleatum
MIFKKNKELYIFFNEFFYFFSFSYTIKLKIKFNRRVFMLANSVIDLIGNTPLVKINNIDTFGNEIYVKLEGSNPGRSTKDRIALKMIEEAEKEGLIDKDTVIMEATSGNTGIGLAMICAVKNYKLKIVMPDTMSVERIQLMRAYGTEVILTDGSLGMKACLEKLEELKKKEKKYFIPDQFTNVNNPKAHYETTAEEILKDMNNKVDVFICGTGTGGSFSGTAKKLKERLPNIKTFPVEPASSPLLSKGYIGPHKIQGMGMSIGGIPAVYDGSLADNILVCEDDDAFKMMRELSFKEGILGGISTGATFQSCS

SEQ ID NO: 22564 - protein, 225 aa, Magnaporthe grisea
MASPRWAALARDTNETKVKLALSIDGGDLPPDTHPSLLEAAASGHASQSSSSQKISINTGIGFLDHMLHAFAKHAGFSLLLTCQGDLHIDDHHTAEDVCIALGDAFKTALGSAAGIARFGFAYCPLDEALSRAVVDVSNRPFAVVELGLRREKIGDLSCEMIPHCIMSFATAARLTIHVDCIRGENDHHRAESAFKALAVAVRTAVGKVAGREGEVPSTKGTLSV

SEQ ID NO: 22565 - protein, 508 aa, Xanthomonas oryzae
MVSGTEGGGMSLKWMPRGVAFLVGAASLVQEVLWVRLAGFATGGLPETFATILALYLLGIAVGAQLGRRLCVGRVLDIRRRASLVLLLSALVDIAAPFLFSWGIGFLPVTVAMLPLVIATAALKSALFPVVHHLGSNDAVAWKGGSFSKVYFANVAGCTLGPLIVTLWLMDVMVMEQLFVGVATVTAVAGMWLPGLRLVAVPAVVVAIAALVLQPALPALASRIVMATGGAQADWLLERKEGIIHTIADPQGNIVFGGNVYDGRINVDLRSNSNKIDRVYAAMAAVPNPKRVLVIGLGGGSWTRVIASFPTVDRVDVVEINPGYLELIAGHPQVAPILQDPRVHIHIDDGRRWLRAQGGARYDAIVVNSTFHWRSGATTLLSQEFFRLVGAHLSDSGVALVNATGSPEVLKTAASEFPQAYLFGNSVIMSRRDFRDTLRAGGEAIYATRMHGRPVFDPANASDAAAVRKVTAADLVGVDVVEERAGRPVEVNTDLRMLTEYKYGASSR

SEQ ID NO: 22566 - protein, 537 aa, Aspergillus oryzae
MTQSPSKPDYDILIVGAGFSGIFLLYQLRKLGYRCKIYETAPDLGGVWYWNTYPGARVDTESFVYQLSIPEAWKDWDWKERFPGRDELQAYFHHLDKVLDIKKDVEFETSVVGAQFDRDSALWKVKTDNGKTTTSRFFLPCVGTVTKQYVPDFPGLQSFQGEIYHSSAWPREGVDVQGKKLAVIGTGPSGVQIIQEWAKEADTLTVFQRTPNLALPMGQEIYTVEDQARIRSRYPQVFEDRAKTFSGNLEDFLPTKLFDVPTAERAALFEANWKKGGFSFILDNYSDILLDEKANRELYNFWAKKTRERIVDPRKKDLLAPLEPFHALGAKRSSLEQDYFEQFNRPNVDIVNLREVKIAEVKPTGIATSDGNFYPVDAIAIATGFDAVTGPITNMGLINTDGTSLAEEWKDGVHNYLGMASHGYPNMFWIYGVHGPTGLSNGPVAIELQGQWVIDAIQKIDKSGLSYVEPTVEAEQKWKELVTQITDMTLLPAVDSWYMGANIPGKKREHLNFPGGLALYEQQCRQALEGWEGFQTV

SEQ ID NO: 22567 - protein, 60 aa, Glycine max
EKVQELSVYEINERDRGSPVYLRLSYKSVNSLGDLVPFSNKLYTGDLQKRIGITSGICIL

SEQ ID NO: 22568 - protein, 359 aa, Pseudomonas putida
MPSLAAVARPWWPTHGYAISATRCTGSWACLKHSPCQTWPSRTNSAGSACTTPAATPYSGAIHEFARVAMSQDTPYIFDATDATFQQLVIENSFHKPVLVDFWAEWCAPCKALMPLLAKIAEGYQGELLLAKINCDVEQQVVAQFGIRSLPTVVLFKDGQPVDGFAGAQPESAIRAMLEPHVQMPAAPAASPLEQAKALFAESRFAEAEALLQVLLGEDNSNAEALILYARCLAERGELGEAQVVLDAVKTDEHKAALAGAKAQLTFLRQAASLPEVADLKSRLAQNPQDDEAAYQLSIQQLARQQYEAALEGLLKLFQRNRAYENGLPHKALLQVFELLGNDHPLVNVYRRKLFAAMY

SEQ ID NO: 22569 - protein, 564 aa, Medicago truncatula
MAASAFGFGGIRFSKTIPLSKYIPPLQPHHNNTFFSFFPSSSSSSSSSSSSSINFSTKPLPMSHHKHLTINGDEQNIIKPSPLFVDDYHNIDQQLLDNIAYDALVWASLHGLLMGDKSYQKSGMVPGVGLMHAPFSLFPTSFPESKWKQACDLAPIFNELVDRVSLDGKFLQESLSRTKQVDEFTSRLLDIHSKMLQLNKKEEIRFGLHRSDYMLDEQTKSLLQIELNTISSSFAGFSTLVTQLHRYILTCHGKLLGLDSEKVPANNAVSQNAEALAKAWSEYNNPRAVIMTVVQAEERNMYDQHFLSAVLRDKYPYHSLNTHGITIVRKTMAEVDQEGEILPDGTLSVNGQAVAVIYFRAGYTPVDYPSESEWRARLLMEQSSAVKCPSISYHLVGTKKIQQELAKPGVLERFLENKDDIAKMRECFAGLWSLDDSDIVKKAIERPELFVMKPQREGGGNNIYGDAVRDTLIKLQKTGSQEDAAYILMQRIFPNISAAVLMRNGGCHKDHAISELGIFGTYLRNKDRVVMNNQSGYLMRTKISSSDEGGVAAGFAVIDSVYLT

SEQ ID NO: 22570 - protein, 375 aa, Triticum aestivum
MEGCACIEQFRRTDELLIKYQYISDFFIALAYFSIPLELIYFAKKSGSFPYRWVLLQFSAFIVLCGATHLINLWTFTKHTQTVDIVMTVTKVTTAVVSCATALTLIHIIPDLLGVKTRELFLKKKADELDREMSLMRSQEDTGRHVRMLIHEIRSTLDRHTILKTTLVELGRTLGLEECAFWMPSRSGSSLELTHTMRHHIPTGSSVEINLPVVNQVLSTNRAIIVPHTSPLARIHPVQGRHVPPEVAAVRVPLLHLSNFHPELLAKSYAIMVLMLPSDSVRKWLAHELELIEVVANQVAVALSQAEILEESMRARDLLTEQNVALDLALREAEMAIHARNVNRVGVELVGPEDADNVATINSSASAAKVHNAEP

SEQ ID NO: 22571 - protein, 495 aa, Medicago truncatula
MSQQQLNLSSTTTNIEVEVVDNSPPMTLPSFNDYHQIDDKVLENIVYDALVFATLNGLLVGDKSVERSGRVPGVGLVHLPFSLLPPPLPETHWKQACDLSPLFNELVDRVSLDGKFLQQSLSKTKKADEFTSRLLDIHAKMLEMNKKEEIRMGLFRSDYMLDEKTKSLLQIEMNTISTSFSGVGVVMTELHRNILSHYGKLLGLDSERVPVNTADSRYAEALAKAWKEYNNPRAVIIVVVQGEERNMYDQHFVSAILREKYPFLKINQEGEILPDGTLSVDGQAVAIVYFRAGYTPVDYPSESEWRARLLIEQSSAIKCPNISYHLVGTKKIQQELARPNVLERFFENKEDIAKLRKCFAGLWSLEDSDIVNEAIAKPELFVMKPQREGGGNNIYGDDLRETLKRLQKPGSQEDAAYILMQRIFPANTASILMRNGFLHKDHVISEFGIFSTYLRNKDKVIVNNESGYMVRTKPSLSDEGGVLPGFGVIDSVYLT

SEQ ID NO: 22572 - protein, 476 aa, Unknown
  Sulfitobacter sp. EE-36
MNPGTEPSFRDSVDIMFNRAVALMDLSPGLEEKIRVCNATYTVRFGVRLRGGIQTFTGYRSVHSEHMEPVKGGIRYSPGVNQNEVEALAALMTYKCALVEAPFGGSKGGLCIDPRDYDEHELELITRRFAYELIKRDMINPAQNVPAPDMGTGEREMAWIADQYKRMNTTDINGVACVTGKPINAGGIHGRTEATGRGVQYALHAFFRDTKGMEKAGLGGELDGKRVVVQGLGNVGYHAAKFLSEEDGCKITAIIERDGALFDDRGLDVEEVHRWISMHGTIKGYPDAPLEEDGAKLLEADCDILIPAALEGVINLTNAHNIKAPLIVEAANGPVTAGADDILRAKGVVIIPDMYANAGGVTVSYFEWVKNLSHIRFGRMQRRNEESRHQLLVDELERLSADSGVGWQLSPNFKDKYLRGAGELELVRSGLYDTMSDAYRSMAEVWHSRDDVEDLRTAAYLVSIGKVAASYRAKGL

SEQ ID NO: 22573 - protein, 791 aa, Pisum sativum
MYSLSPPHTTTTSISHSTTHALINKTKLLELHNHNHSRISITISSKSNSNKTFAIGNRVGVETEIAVVEIHKPQFEVSRGFPSPFGATAQEDGVNFAIYSLNAHSATLCLFTLSDFKNNKVTEYIALDPLVNKTGCVWHVFLKGDFKDMLYGYKFDGKFSPQQGHYYDSSRVLLDPYAKAVISRGEYGAVGLDGNCWPQMAGMVPFDPEEFDWEGDLPLKYPQKDLIIYEMHVRGFTKHESSKTEFPGTYLGVVEKLDHLTELGVNCIQLMPCNEFNELEYYSYNAVQGDYRVNFWGYSTINYFSPMIRYSSAGTQNCGRDGINEIKFLIKEAHKRGIEVIMDVVFNHTAEGNEKGPIISFRGVDNSVYYMVAPKGEFYNYSGCGNTFNCNHPVVRKFIVDCLRYWVAEMHVDGFRFDLASIMTRGSSLWNGVNVFGTPIEGDMLTIGTPLSSPPLIDMISNDPILRGVKLIAEAWDAGGLYQVGIFPHWGIWSEWNGKYRDTVRQFIKGTDGFAGAFAECVCGSPSLYQGGRKPWNSINLVCAHDGFTLADLVTYNSKHNLPNGEDNNDGENHNNSWNCGEEGEFVSASVKKLRKRQMRNFFLSLMVSQGVPMIHMGYEYGHTKGGNNNTYCHDNYLNYFQWDKKEESSSDFFRFCSLLIKFRQECESLGLDDFPTSERLQGHGLFPVTPDWSETSRFVAFTLVDSVKGEIYIAFNTSHLPFTVTLPERPGYRWEPLIDTSKSAPYDFLTPDLPGRDIAIQQYAHFLDVNMYPMLSYSSIILLRTPDVNA

SEQ ID NO: 22574 - protein, 341 aa, Pseudomonas fluorescens
MTQQRPIAVLGGGSFGTAVANLLAENGHRVRQWMRDPEQAEAIRVNRENPRYLKGIKIHPAVEPVTDLLATLNDSDLCFVALPSSALRSVLAPHAELLRGKLLVSLTKGIEAQTFKLMSEILQDIAPQARIGVLSGPNLAREVAEHALTATVVASEDEELCQRVQAALHGRTFRVYASADRFGVELGGALKNVYAIIAGMAVALGMGENTKSMLITRALAEMTRFAVSQGANPMTFLGLAGVGDLIVTCSSPKSRNYQVGFALGQGLSLEEAVTRLGEVAEGVNTLKVLKVKAQELGVYMPLVAGLHAILFEGRTLNQVIELLMRGEPKTDVDFISTSGFN

SEQ ID NO: 22575 - protein, 258 aa, Lactobacillus acidophilus
MADVVTMKQLLEAGVHFGHQTRRWNPKMAPYIFTQRNGIYIIDLQKTIKMLDDAYNFMKAVAEDGGVFLFVGTKKQAQDSIAEEATRAGQYYVNQRWLGGTLTNWTTIQSRVRRLKQLKEMSEDGTFDVLPKKEVALLTKEMDKLERFLGGIEDMPRIPDVLFVVDPKKEKIAVHEANILGIPVVAMVDTNTDPDPIDVVIPSNDDAIRAIRLIAGAMADAIIEGKQGQDDEETLEVDFKENADGSEEIVSAEENPED

SEQ ID NO: 22576 - protein, 857 aa, Pisum sativum
MTNLLPAFSFSVTPHKYETKCSFFHTSFTCIQHQNQLVSKNLQDLKIPFSQNLTSKLCATSSRLSIEETGQKLISFTQSEDIKTALPYLFRTETGEGLVKVYVKKKKDTYFVYIEVSSLELSNVEGETFVLCWGVYSDDSSSLGSGKGMNVSPLVKNSLGKFSVELEFDVEQVPLYLSFLLRLSGSEITTHAEKKFLRACLVFLGVVHLRWGSPFLLTGLSILQFFRGMQQGVVLCLYDNNVDTGVKKPALELDLDPYVNRSGDIWHISLENAKSFVSYCYRFRGANRDNSYAECVVLDPYARIVGNSFPNGIGSVKNLGFLRKEPAFDWGDDYHLNLDMEKLVVYRLNVKHFTEHESSQLSGDLAGTFSGLAKKLQHFKDLGVNAVLLEPVFTFDEEKGPYFPCHFFSPVNLYGPSGDPESTINSMKEMVKTMHANGIEVIMEVVFSNTAEVGALQGIDDLSYYYANGVVGGLKVHSALNCNYPIVQNLILDSLRHWVTEFHIDGFSFVNASHLLRGYHGEYLSRPPLVEAIAFDPVLWKTKIIADCWDPNDMETKEIRFPHWMRWAEINTNFRSDVRNFLRGESLLSNLATRLCGSGDMYSDGRGPAFSFNYISGNFGLSLVDLVSFSNAGLEAELSWNCGEEGPTNSTAVLERRLKQIRNFLFILYVSLGVPILNMGDECGHSSGGSLANGNTKPFNWAALKTGFGKQTIQFISFLTSLRTRRSDLLQSRSFLKEENIEWRGIDEAPPKWEDPSCKFLAMTLKAERNEHQESSVSSDILGDLFVAFNADDCPETVVLPLPPEGMSWYRIIDTALPFPGFFLNNGDLVLEQMSGLSTYEMKSYSCILFEANISPS

SEQ ID NO: 22577 - protein, 736 aa, Pisum sativum
MQASGSKSSNSGRGSFSETREGLKVRTTNANAYGRAQEEVNKDEAFKVMETRPSWEVSPGQAFPLGVSQVDNGINFAIFSQHATAVTLCLVLPKRESIDTLDGGTIELALDPHLNKTGDIWHIRIEDLARSNVLYGYRIDGSQDWGKGHRFDRSIVLVDPYAKLVEGRRYFGDISKKFSKFLGTYDFDSLPFDWGENYKLPNVAEKDLVIYEMNVRAFTMDESSGLDNNIRGSYLGVIEKIPHLLELGINAVELLPIFEFDELELQRRPNPRDHMINTWGYSTINFFAPMSRYASAGGGPANASQEFKQMVKALHSASIEVILDVVYNHTNEADDPNPYTTSFRGIDNKVYYMLDDKGQLLNFSGCGNTLNCNHPVVMELILDSLRHWVTEYHVDGFRFDLASILCRGTDGSPLNAPPLIRAIAKDAVLSRCKIIAEPWDCGGLYLVGSFPNWDRWAEWNGKYRDDVRRFIKGDSGTKGSFATRVSGSSDLYRVNKRRPYHGINFVIAHDGFSLHDLVSYNLKHNEANGEGGNDGCNDNFSWNCGFEGETDDTSIRALRSRQMKNFHLALMVSQGIPMMLMGDEYGHTRYGNNNSYGHDSAINFLLWDQLDARKGDHFRFFSNVIKYRLGHKIFSHENFLSENEITWHEDNWDNYESKFLAFTLHDKSGGDVYLAFNAHDYFLKVLLPTPPTKRRWYRVVDTNLESPDDLVLDGVPGIGKTYSIAPYSSILLEAKF

SEQ ID NO: 22578 - protein, 414 aa, Glycine max
SRAESARDSQHQHSVTSISSTTDNNFGNPLAMTAVVVVPLGLLFFASGLIVNLIQAICYVVVRPVSKNLYRRMNRVVAELLWLELVWIIDWWAGVKVQVFTDPETFRSMGKEHALVISNHRSDIDWLVGWVLAQRSGCLGSTLAVMKKSSKFLPVIGWSMWFSEYLFLERSWAKDERTLKSGLQQLRDFPLPFWLALFVEGTRFTQAKLLAAQEYAASAGLPVPRNVLIPRTKGFVSAVNHMRSFVPAIYDVTVAIPKSSPAPTMLRLFRGKSSVVHVHIKRHAMKDLPEEDEAVAQWCRDMFVAKDTLLDKHIAEDTFSDQELQDTGRPIKSLVVVISWACVVVMGVVKFLQWSSLLSSWKGVAFSAFGLGVVTLLMHILIMFSQSERSTPTKVAPAKSKNSEQLEARDNKQD

SEQ ID NO: 22579 - protein, 249 aa, Rhodopseudomonas palustris
MSKLIESAPAAGRITLVGAGPGDADLLTLRAIKRLQAADVVLYDDLAGEDFMAYLHPDAELVAVGKRAGHPSPRQDEVSRLAISYALRGKHVVRLKAGDPTLFARADEELRAARDAGIAVEIVPGITTATAAAAAIGASLTKRGVARRVQFVTGHDVDGRLPRDLDLAALADATATTCVYMGKATFPALVAQLIARGLSAATPAVMVESLGTDATNVQRGSVSEIAARLTADRPSGPCMILYGAALEES

SEQ ID NO: 22580 - protein, 322 aa, Brassica napus
MASRIANDVTELIGNTPLVYLNNVAEGCVGRVAAKLEMMEPCSSVKDRIGFSMISDAEEKGLIKPGESVLIEPTSGNTGVGLAFTAAAKGYKLIITMPASMSVERRIILLAFGVELVLTDPAKGMKGAIAKAEEILAKTPNGYMLQQFENPANPKIHYETTGPEIWKGTDGKIDGFVSGIGTGGTITGAGKYLKEQNPNVKLYGVEPIESAILSGGKPGPHKIQGIGAGFIPSVLEVNLIDEVVQVSSDESIDMARLLARKEGLLVGISSGAAAAAAIKLAKRPENAGKLFVAVFPSFGERYLSTVLFDATRKEAESMTFEA

SEQ ID NO: 22581 - protein, 431 aa, Pantoea endophytica
  misc_feature (91)..(91): Xaa can be any naturally occurring amino acid
  misc_feature (228)..(228): Xaa can be any naturally occurring amino acid
  misc_feature (230)..(230): Xaa can be any naturally occurring amino acid
  misc_feature (367)..(367): Xaa can be any naturally occurring amino acid
  misc_feature (399)..(399): Xaa can be any naturally occurring amino acid
MAVMGRNLALNIESRGYTVSVFNRSRDKTEEVIAENPGKKLVPFYTVKEFVESLETPRRILLMVKAGAGTDAAIDSLKPYLEKGDIIIDGXNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELAETFTEWNKGELNSYLIDITKDXFXKKDEEGKYLVDVILDEAANKGTGKWTSQSSLDLGEPLSLITESVFARYISSLKEQRVAASKVLSGPQAKPAGDKSVFVEKVRRALYLGKIVSYAQGFSQLRAASDENNWDLNYGEIAKIFRAGCIIRASSCRKITDXYAENAGIANLLLAPYFKKIADEYQQALRDVVXYAVQNGIPVPTFSAAVAYYDSYRAAVLPANLI

SEQ ID NO: 22582 - protein, 917 aa, Pseudomonas chlororaphis
MLKKLGIKGRVLLLTLLPTSLMALVLGGYFTWMQQSDLQTQLLQRGEMIAEQLAPLVAPALAHKNIALLERIATQSLEQQDVRAVTFLAPDRTPLAHAGPSMLNQAPTGNGSQMLQRTGSDATRYLLPVFGRHRNLAGDLIPDESDRLLGWVELELSHNSMLLRGYRSLFASLLLIIAGLICTGLLALRMGRTINNPLSQIKHAVTQLKDGNLETRLPLLGSQELDELASGINRMAGTLQNAQEELQHSIDQATEDVRQNLETIEIQNIELDLARKEALEASRIKSEFLANMSHEIRTPLNGILGFTHLLQKSELTPRQLDYLGTIEKSADSLLGIINEILDFSKIEAGKLVLDSIPFNLRDLLQDTLTILAPAAHAKQLELVSLVYRDTPLSLVGDPLRLKQILTNLVSNAIKFTREGTIVARAMLEEEHEDSVQLRISIQDTGIGLSNQDVRALFQAFSQADNSLSRQPGGTGLGLVISKRLIEQMGGEIGVDSTPGEGSEFWISLRLPKTRDDAEDLPAPPLLGRRIAVLENHELARQALQHQLEDCGLEVTPFNTLEALTNGVTGVHQTEQAIDLAVLGITSNDMPPERLNQHIWDLEHLGCKVLVLCPTTEQTLFHLSVPNPHSQLQAKPACTRKLRRALADLVNPKVVRNEPSEPIASRPPRVLCVDDNPANLLLVQTLLEDMGAKVLAVDSGYAAVKAVQNESFDLVMMDVQMPGMDGRQSTEAIRQWESERNCTPLPVIALTAHAMANEKRALLQSGMDDYLTKPISERQLAQVVLKWTGLALRNQGPERTGEPSGNGLELQVLDHDEGLRLAAGKADLAADMLAMLLASLEADREAIRAARAANDHNALIERVHRLHGATRYCGVPQLRAACQRSETLLKQEDVKAFAALDELERAINRLATEARINA

SEQ ID NO: 22583 - protein, 431 aa, Pantoea endophytica
  misc_feature (7)..(7): Xaa can be any naturally occurring amino acid
  misc_feature (424)..(424): Xaa can be any naturally occurring amino acid
MAVMGRXLALNIESRGYTVSVFNRSRDKTEEVIAENPGKKLVPFYTVKEFVESLETPRRILLMVKAGAGTDAAIDSLKPYLEKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELAETFTEWNKGELNSYLIDITKDIFTKKDEEGKYLVDVILDEAANKGTGKWTSQSSLDLGEPLSLITESVFARYISSLKEQRVAASKVLSGPQAKPAGDKSVFVEKVRRALYLGKIVSYAQGFSQLRAASDENNWDLNYGEIAKIFRAGCIIRAQFLQKITDAYAENAGIANLLLAPYFKKIADEYQQALRDVVRYAVQNGIPVPTFSAAVAYYDSYRAXVQPANLI

SEQ ID NO: 22584 - protein, 126 aa, Ostreococcus tauri
MVAALTVEAEVGKIYRNCQVKKIVEFGCFVEFLPGMEGLVHISELDVSRVPNVSDVTAEGALLDVKVIEINNRGQTRLSRKEVLLEENPDIAVAAAAPRRNDGGGEDDRGRRGARGGKPKRDSGGF

SEQ ID NO: 22585 - protein, 431 aa, Pantoea endophytica
  misc_feature (32)..(32): Xaa can be any naturally occurring amino acid
  misc_feature (46)..(46): Xaa can be any naturally occurring amino acid
  misc_feature (149)..(149): Xaa can be any naturally occurring amino acid
  misc_feature (419)..(419): Xaa can be any naturally occurring amino acid
MAVMGRNLALNIESRGYTVSVFNRSRDKTEEXIAENPGKKLVPFYXVKEFVESLETPRRILLMVKAGAGTDAAIDSLKPYLEKGDIIIDGGNTFFQDTIRRNRELSAEGFNFIGTGVSGGEEGALKGPSIMPGGQKDAYELVAPILTKXAAVAEDGEPCVTYIGADGAGHYVKMVHNGIEYGDMQLIAEAYSLLKGGLNLSNEELAETFTEWNKGELNSYLIDITKDIFTKKDEEGKYLVDVILDEAANKGTGKWTSQSSLDLGEPLSLITESVFARYISSLKEQRVAASKVLSGPQAKPAGDKSVFVEKVRRALYLGKIVSYAQGFSQLRAASDENNWDLNYGEIAKIFRAGCIIRAQFLQKITDAYAENAGIANLLLAPYFKKIADEYQQALRDVVPYAVQNGIPVPTFSAAVAYYXSYRAAVLPANLI

SEQ ID NO: 22586 - protein, 431 aa, Pantoea endophytica
  misc_feature (40)..(40): Xaa can be any naturally occurring amino acid
MAVMGRNLALNIESRGYTVSVFNRSRDKTEEVIAENPGKXLVPFYTVKEFVESLETPRRILLMVKAGAGTDAAIDSLKPYLEKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELAETFTEWNKGELNSYLIDITKDIFTKKDEEGKYLVDVILDEAANKGTGKWTSQSSLDLGEPLSLITESVFARYISSLKEQRVAASKVLSGPQAKPAGDKSVFVEKVRRALYLGKIVSYAQGFSQLRAASDENNWDLNYGEIAKIFRAGCIIRAQFLQKITDAYAENAGIANLLLAPYFKKIADEYQQALRDVVPYAVQNGIPVPTFSAAVAYYDSYRAAVLPANLI

SEQ ID NO: 22587 - protein, 87 aa, Desulfovibrio vulgaris
MAADDHIEMEGVVEEALPGTLFRVVLENGHEVLAHLCGKMRKFRIRVLPGDKVTVHISPYDLTKGRIARRTTTPSGGPRPARSGNRR

SEQ ID NO: 22588 - protein, 179 aa, Unknown
  Nicotiana langsdorffii x Nicotiana sanderae
ISKDVMLNLLRDKFPGANDFGSEVIPGATSLGMRVQAYLYDGYWEDIGTIEAFYNANLGITKKPVPDFSFYDRSAPIYTQPRYLPPSKMLDADVTDSVIGEGCVIKNCKIHHSVVGLRSCISEGAIIEDSLLMGADYYETDADRRFLAAKGSVPIGIGKNSHIKRAIIDKNARIGDNVK

SEQ ID NO: 22589 - protein, 545 aa, Azospirillum brasilense
MKLAEALLRALKDRGAQAMFGIPGDFALPFFKVAEETQILPLHTLSHEPAVGFAADAAARYSSTLGVAAVTYGAGAFNMVNAVAGAYAEKSPVVVISGAPGTTEGNAGLLLHHQGRTLDTQFQVFKEITVAQARLDDPAKAPAEIARVLGAARALSRPVYLEIPRNMVNAEVEPVGDDPAWPVDRDALAACADEVLAAMRSATSPVLMVCVEVRRYGLEAKVAELAQRLGVPVVTTFMGRGLLADAPTPPLGTYIGVAGDAEITRLVEESDGLFLLGAILSDTNFAVSQRKIDLRKTIHAFDRAVTLGYHTYADIPLAGLVDALLEGLPPSDRTTRGKEPHAYPTGLQADGEPIAPMDIARAVNDRVRAGQEPLLIAADMGDCLFTAMDMIDAGLMAPGYYAGMGFGVPAGIGAQCVSGGKRILTVVGDGAFQMTGWELGNCRRLGIDPIVILFNNASWEMLRTFQPESAFNDLDDWRFADMAAGMGGDGVRVRTRAELKAALDKAFATRGRFQLIEAMIPRGVLSDTLARFVQGQKRLHAAPRE

SEQ ID NO: 22590 - protein, 431 aa, Pantoea endophytica
  misc_feature (418)..(418): Xaa can be any naturally occurring amino acid
  misc_feature (427)..(427): Xaa can be any naturally occurring amino acid
MAVMGRNLALNIESRGYTVSVFNRSRDKTEEVIAENPGKKLVPFYTVKEFVESLETPRRILLMVKAGAGTDAAIDSLKPYLEKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELAETFTEWNKGELNSYLIDITKDIFTKKDEEGKYLVDVILDEAANKGTGKWTSQSSLDLGEPLSLITESVFARYISSLKEQRVAASKVLSGPQAKPAGDKSVFVEKVRRALYLGKIVSYAQGFSQLRAASDENNWDLNYGEIAKIFRAGCIIRAQFLQKITDAYAENAGIANLLLAPYFKKIADEYQQALRDVVVYAVQNGIPVPTFSAAGGYXNSYRAAVLXANLI

SEQ ID NO: 22591 - protein, 129 aa, Debaryomyces hansenii
MAPKAEKKPASKAPAEKKPAAKKTATSGTKKRSKTRKETYSSYIYKVLKQTHPDTGISQKAMSIMNSFVNDIFERIAGEASKLAAYNKKSTISAREIQTAVRLILPGELAKHAVSEGTRAVTKYSSAAN

SEQ ID NO: 22592 - protein, 117 aa, Glycine max
  misc_feature (73)..(73): Xaa can be any naturally occurring amino acid
MAAENVVEFTDLPVKRPREEEEGTNGVSNDAVSALPNDPQYPGISAVIPGEAHSLKMEKILFQGKSDYQNVMXFQSSTYGKVLVLDGVIQLTERDECAYQEMITHLPLCSIPNPKKV

SEQ ID NO: 22593 - protein, 1009 aa, Aspergillus nidulans
MPEYTESRDSIKNIWGERTPYKHQWPTRCDSHLVDTPDTWVQSACVLCSNGCGLDIGVKEGKVVGVRGRTVDRVNKGRLGPKGLNGWVSINHPDRLTHPLIRRNGKLERASWDEAMSLIVERAKDIQTRLTNHGIAFYTSGQLLLEEYYVLAMVGKAGLNTLHMCATLNLSPSYRSQDAKPMNRDGNTRLCTATAAASMRESFGSDGQPGSYADIDYTDCLFLVGHNMAATQTVLWTRVLDRLEGPNPPKLIVVDPRTSDTAKKATVHVRPRLGTNVALLNGLQHLIIKNGWVNDQYVASHVCGLEELKKVVEKYTPEYVEKITGVPVAQLHETAEALALSGSLLSTALQGVYQSNQATAAACQINNINLLLGHIGKPGSGILQMNGQPTAQNNRETGCDGEFPGFRNHQNPNHIRDIARVWNINYEQVPHWSEPTHIMNMLNYIESGSIEMFWVSGTNPLVSLPHLYRVRQLLTKPDLFVVVQDLFLTETAAIADVVLPAAQWAEKTGCFTNVDRTMHLSRKAVDPPGEAKADLDIFLDFAQRMDFRNRDGGPLIPFTNPEEVFEEWKKMSYGRPLDCSDLTYEKLSGGSGIQWPCTKEYPFGKERLFDDGKFFTDTDYCESYGHDLETGTPLTKGQYEAMNPAGRAILKAAHYRKPWESPDEEFPFYLSTGRNVFHFHTRTKTGRSKRLQNADKDACLVICQADADELGVTNGEMVIVRSRRGQVELPVKTEGISKGHVFIPFHFGYWDSKDQRARAANELTIEQWDPVSKQPMFKSGAVRIEKCVQKENEPPISRERQSEAIQNVEANKANATETRKDGQDSRVRWLEMWLGATHESLEMLRQIYDKLIPQLVHDLEIQAGLGVMRRITADIIAKLEPIVHRYHESRVYGRRVCERLRKALFPMEDDKDNSYETLIVLQSLEMFLTYIDGHLTALSPASQALWDQEFVDAVSFAAQHIQRQKAWVNTHIKVKSPQTLLVPQRPPMEVDADRDEEAAENVLVREFYY

SEQ ID NO: 22594 - protein, 473 aa, Zea mays
  misc_feature (450)..(450): Xaa can be any naturally occurring amino acid
MEAADHGKLFVGGISWETSEDRLREYFGRFGEVTEAVIMRDRSTGRARGFGFVVFADAAVAERVTTEKHMIDGRMVEAKKAVPRDDHSIVTKSNASSIGSPGPGRTRKIFVGGLPSNVTEADFRRYFEQFGVITDVVVMYDHNTQRPRGFGFITFDSEDAVDKALHKSFHELNGKMVEVKRAVPKEQSPGPAARSPVGVGQNYAMNRVHSFLNGFNQGYNPNPIGGYGIRVDGRYGLISGARNGFSSFGPGYGMGMNVEGGLGGTFGASSGFISNSNGRQMGSYFNASSNRLGSPIGYLGLNDVPGSMLSSMSRNVWGNGSLNYPSNPTNMSAFASPRNGGQVSLPSDNWGGLPSAHGMDNISSLGSGNLGRGTGDNNFGLPSGSYGRNNSTGTIGEPFSAAGNTYEVNNRDTYGSSSIYGGTAWRFASSEVDMPSFVHDIGNVDPTIKXYMSASHMGNYPVNNNQPSRGISS

SEQ ID NO: 22595 - protein, 593 aa, Pisum sativum
METETETPNGSTPCPTSAPSAIPLRPSSCDGTMGRHLARRLVEIGVRDVFSVPGDFNLTLLDHLIAEPELNLVGCCNELNAGYAADGYGRAKGVGACVVTFTVGGLSILNAIAGAYSENLPVICIVGGPNSNDYGTNRILHHTIGLPDFSQELQCFQTITCFQAVVNNLDDAHELIDTAISTALKESKPVYISIGCNLPAIPHPTFARDPVPFFLAPRVSNQAGLEAAVEEAAAFLNKAVKPVIVGGPKLRVAKAQKAFMEFAEASGYPIAVMPSGKGLVPENHPHFIGTYWGAVSTSYCGEIVESADAYVFVGPIFNDYSSVGYSLLIKKEKSLIVQPNRVTIGNGLSLGWVFMADFLTALAKKVKTNTTAVENYRRIYVPPGIPLKREKDEPLRVNVLFKHIQALISGDTAVIAETGDSWFNCQKLRLPENCGYEFQMQYGSIGWSVGATLGYAQAATDKRVIACIGDGSFQVTAQDISTMIRCGQRSIIFLINNGGYTIEVEIHDGPYNVIKNWDYTGFVSAIHNGQGKCWTAKVRTEEDLTEAIATATGAEKDSLCFIEVFAHKDDTSKELLEWGSRVAAANSRPPNPQ

SEQ ID NO: 22596 - protein, 417 aa, Ralstonia eutropha
MNAPDNPHRRHTGGRRKFLQGAGALMAQATLGATAFDAFAATPAKVTMPFANGERELVAFPQKRPLILLTSRPPQLETPFSVFNEGVLTPNDAFFVRYHWSGIPTSIDPQTYRLRVGGHVKAPLELSLADLKTLADPVEIVAVNQCSGNSRGFFDPRVNGGQLGNGAMGNARWTGVPLRKVLEKAGVQPGAVQVTFNGMDKPPLEGGPDFVKALNIDHALDGEVMLAWAMNGADLPMLNGYPLRLVVPGHYGTYWVKHLSDIQVVDKVFDGFWMASAYRIPANPCACVAPGTAPSATTPIGRFNVRSFITSLTDGAKVPTGRETVVRGIAFDGGYGIGEVGFSADGGRSWQSAKLGQDLGRYSFREWTAVLRPPRRGNLDLRVRAVNRAGQSQPMEALWNPPGYMRNVVESTRVTAV

SEQ ID NO: 22597 - protein, 418 aa, Nicotiana tabacum
AADGYARARGVGACVVTFTVGGLSVLNAIAGAYSENLPLICIVGGPNSNDYGTNRILHHTIGLQDFSQEPRCFQTVTCYRAVVNNLEDAHELIDTAVSTALKESKPVYISIGCNLPGIPHPTFSREPVPFALSPRLSNMMGLEAAVEAAAEFLNKAVKPVLVGGPKMRVAKASDAFVELSDACGYAVAVMPSAKGLFPEHHSHFIGTYWGAVSTAFCAEIVESADAYLFAGPIFNDYSSVGYSLLLKKEKAIIVQPDRVTIGNGPAFGCVLMRDFLAALAKRLKHNPTAFENYHRIYVPEGHPLKCEPKEALRVNVLFQHIQNMLSGDSVVIAETGDSWFNCQKLKLPKGCGYEFQMQYGSIGWSVGATLGYAQAAPEKRVIACIGDGSFQVTAQDISTMLRCGQRTIIFLINNGGYT

SEQ ID NO: 22598 - protein, 249 aa, Elymus abolinii
LTGITGIVNGMNVSEWDPTKDKFLAVNYDVTTALEGKALNKEALQAEVGLPVDRKVPLVAFIGRLEEQKGPDVMIATIPEIVKDEDVQIVLLGTGKKKFERLLKSVEERFPGKVRAVVRFNAPLAHQMMAGADVLAVTSRFEPCGLIQLQGMRYGTPCACASTGGLVDTIVEGKTGFHMGRLSVDCNVVEPADVKKVATTLKRAIKVVGTPAYQEMVKNCMIQDLSWKGPAKNWEDVLLELGVEGSEPG

SEQ ID NO: 22599 - protein, 661 aa, Aspergillus nidulans
MATSYDATTTASELADHLSADIKGKVVLTTGPSPASIGAMFVESIARGLPALIILAGRSTTKLQQTAGAIAQAQPVVKVRLLHLDLGSLASVREAARELASWEDVPRIDVLVNNAGIMGTKFALSPEGVESQFTTNHLGHFLLTNLIIGKILKSDTPRVVNVSSDGHRLSPIRWADYNFQEGEIYNKWLAYGQSKTANMLMAVSLAEKLGSRGLLAFSLHPGVIISTSISGGLDNMDEDLAALKALDRMLGNAEGWRDFKVKTRQQGAATTVYAAFYPGLKESNGAYLQDCHVADPWTDTVKPWGTDKVEAERLWKLSEKLSMEWTVEAGLLAGGYGKSLQMCIQKPKTGDHYFHFVIYGENQLVPGNNTIRIPSVRMTMADDITHFRSIPWVSDLLNDPTFVTHPIPSRKIKASTEDSLFSTTLNSRSTISSCLLQYRILSSNATPLYRNAIPTNEVRIFCTLGSDLNGYPGILHGGIVATLLDEFMGLILSMSRAGGEPGMEGPVTAYLNTRFVRPVMTPGTVVVSGRIVEAKEERKWKIVGNIKDTSNKTSPAWPQYMPRISHATALLLSTATESFLKVELQMPALLILALALLLVCLSNMIGSYSSFAAAATFHLDSGIYFSGIGFEQPCFGNAGNCLERALGKGKPRGLKKNLGLI

SEQ ID NO: 22600 - protein, 405 aa, Pisum sativum
PVYISIGCNLPAIPHPTFSRDPVPFSLAPKLSNQMGLEAAVEAAAEFLNKAVKPVLVGGPKLRVAKASDAFVELADASGYALAVMPSAKGMVPEHHPHFIGTYWGAVSTAFCAEIVESADAYLFAGPIFNDYSSVGYSLLLKKEKAIIVMPDRVVIANGPAFGCVLMNDFLKALAKRLKHNNVAYENYHRIFVPDGTPLKSASKEPLRVNVMFQHIQKMLSSETAVIAETGDSWFNCQKLKLPEGCGYEFQMQYGSIGWSVGATLGYAQAVPEKRVIACIGDGSFQVTAQDVSTMLRCGQKTIIFLINNGGYTIEVEIHDGPYNVIKNWNYTGLVDAIHNGEGKCWTTKVFCEEELVEAIAKATGPKKDSLCFIEVIVHKDDTSKELLEWGSRVSAANSRPPNPQ

SEQ ID NO: 22601 - protein, 249 aa, Elymus abolinii
LTGITGIVNGMDVSEWDPTKDKFLAVNYDITTALEGKALNKEALQAEVGLPVDRKVPLVAFIGRLEEQKGPDVMIAAIPEILKDEDVQIVLLGTGKKKFERLLKSVEEKFPGKVRAVVRFNAPLAHQMMAGADVLAVTSRFEPCGLIQLQGIRYGTPCVCASTGGLVDTIVEGKTGFHMGRLSVDCNVVEPADVKKVATTLKRAVKVVGTPAYQEMVKNCMIQDLSWKAPAKNWEDVLLELGVEGSEPG

SEQ ID NO: 22602 - protein, 522 aa, Medicago truncatula
MQIPFFSFIYLLLIHCDTQLSFIHPLYIYIFIFFQSTCRVEMDPGKLFIGGISWDTNEDRLRQYFQNFGDVVEAVIMKDRTTGRARGFGFVVFADPSVAERVVMEKHVIDGRTVEAKKAVPRDDQNVFTRSNSSSHGSPAPTPIRTKKIFVGGLASTVTESDFKNYFDQFGTITDVVVMYDHNTQRPRGFGFITYDSEEAVEKVLHKTFHELNGKMVEVKRAVPKDLSPSPSRGQLGGFSYGTMSRVGSFSNGFAQGYNPSLIGGHGLRLDGRLSPANVGRSGYSLFSPSYGTGLNFEPPLNQNENENFTSNFIMGRALSSPYSASPSRYNNAMAYAAGSNVGNSSAISSTNQSLWGNGNLNYANNPASSDAFLGYGSENSSIGSFGNIGSLWSTSVGAANQAGTIGSGYGKSSLNYRLGDVILGSKAVGYGKNSESNVESDSSYAFSNGSYGEAYKSTFEAGPFYQDHTWRPTTSELEDSGPLSFGLENAVSDLMRKSSSSGHIGAYAAVANRQSNRGIAA

SEQ ID NO: 22603 - protein, 146 aa, Vibrio angustum
MEYLHTMVRVSNLDASLDFYCNKLGLVEIRRKESERGRFTLVFLAAPNQAETAKETQSPLLELTYNWDPESYTGGRNFGHLAFAVDNIYDLCAHLQNNDVVINRPPRDGHMAFVRSPDGISIELLQKGDALEAAEPWASMQNQGEW

SEQ ID NO: 22604 - protein, 324 aa, Triticum aestivum
MEAETAAKRARENEGAAAADGAGEQAGISAVIPGWFSEISPMWPGEAHSLKVEKVLFQGKSDYQDVLVFQSSTYGKVLVLDGVIQVTERDECAYQEMITHLPLCSIKDPKKVLVIGGGDGGVLREVSRHSSVEQIDICEIDKMVVDVSKQFFPHLALGFEDPRVSLHIGDGVAFLKNAPEGTYDAVIVDSSDPVGPAQELFEKPFFESVSRALRPGGVVCTQAESIWLHMHIIEDIVTNCRQVFKGSVNYAWTTVPTYPSGVIGFMLCSTEGPSVDFQHPVFSIEEDEYSTKSKGPLKFYNSEFHTASFCLPSFARRVIEAKAN

SEQ ID NO: 22605 - protein, 648 aa, Aspergillus oryzae
MVIPAWAAAAWTSLTTALILPGIPGAAAENKQALCLARHWSEVEAEFIQWPICVESRWERTAPRITQDTTRSPDQTVSVTVSEGAPSTTAIPAPGGQPDHELDTDSPLDNSNFLSFEDWKKQNLAKVGQSAENVRGNRHAAGKEDRRRPTGINNALDSLGEDTEIDLDFGGFGAEASDAAKPTSWGSSIPTAGITGTAAGASAGDMEAAVSADLRKGASRGKDAGTTCKERFNYASFDCAATVLKTNPECKGSSSVLVENKDSYMLNECRAKNKFLILELCDDILVDTVVLANYEFFSSIFHTFRVSVADRYPAKTDQWRELGVYEARNTREIQAFAVENPLIWARYVKIEFLTHYGNEFYCPLSLVRIHGTTMLEEYKHDGETNRGDEEAAAEALEPSPHPVDVEVKDVAQQPLTTVALPDEPTNGPTATIEAQGSCSHHETVRQDAAHESEIKSVSSPKEESSIPSESVRPSGTQPPSSNPTTQESFFKSVNKRLQMLESNSTLSLLYIEEQSRILRDAFSKVEKRQLAKTSTFLENLNVTVLNELRQFREQYDQVWKSVALEFEHQRIQYHQEIHSISAQLGVLADELVFQKRVSVIQSIMILFCFALVLFSRVPLGTYIDIPRKKNFEQSAANHSANSEAEMQK

SEQ ID NO: 22606 - protein, 206 aa, Triticum aestivum
  misc_feature (19)..(19): Xaa can be any naturally occurring amino acid
PGRPRVRDLSGSPVALASXVTPFVASPGTDRVSRSNPGAWLILRPAGDGAWEPWGRLECWRERGGAGSSDSLGYRFDLLVPGVDHAVPIADSTIAASKGGKFALDLTAAQPLSRGSTPGCSPRGSGDFSQWPLGNYRGFVMSASVEGEGRCSKPTVEVGVAHVGCAEDAAAFVALAAAVDLSMDACRLFSHKLRKELSHLRSDVLR

SEQ ID NO: 22607 - protein, 181 aa, Oenococcus oeni
MTDTDPRFSKILHDHREIETAAKRIGAQIDRDYAGKTPILVVVLKGAVMWAGDLFRNISIDVEMDFIDIASYHGGIASSNEITLRTDLTSDVKDRDVIIVEDIVDTGLSLRYLESLLSRRGARSVKTATMLNKQKGHKVDIRADYVGFEIDNEFVAGYGLDYQEIWRNLPFIGVVNPDIYS

SEQ ID NO: 22608 - protein, 423 aa, Burkholderia vietnamiensis
MDIDQYMTDLGRRARHASRAMARASTAAKNAALDAVARAIERDASALKEANARDVARARDKGLDAAFIDRLTLSDKALKTMVEGLRQVASLADPIGEISNLKYRPSGIQVGQMRVPLGVIGIIYESRPNVTIDAAALCLKSGNATILRGGSEALESNAALAKLIGEGLEAAGLPQDAVQVVATADRAAVGKLITMTEYVDVIVPRGGKSLIERLINEARVPMIKHLDGICHVYVDDRADLAKALTVCDNAKTHRYGTCNTMETLLVSSGIAAALLPPLGKLYRDKQVELRVDAAARAVLADAGVGPLVDATDADWHTEYLAPVLAIKVVDGLDAAIEHINHYGSHHTDAIVTEDHDRAMRFLREVDSASVMVNASTRFADGFEFGLGAEIGISNDKLHARGPVGLEGLTSLKYVVLGHGEGRQ

SEQ ID NO: 22609 - protein, 459 aa, Listeria monocytogenes
MNQNPVEEGQKFPLTIRRMGINGEGIGYFKKAVVFVPGAITGEEVVVEAVKVRDRFTEAKLNKIRKKSPNRVTAPCPVYEACGGCQLQHVAYSAQLELKRDIVIQSIEKHTKIDPTKLKIRPTIGMEDPWRYRNKSQFQTRMVGSGQVETGLFGANSHQLVPIEDCIVQQPVTIKVTNFVRDLLEKYGVPIYDEKAGSGIVRTIVVRTGVKTGETQLVFITNSKKLPKKREMLAEIEAALPEVTSIMQNVNQAKSSLIFGDETFLLAGKESIEEKLMELEFDLSARAFFQLNPFQTERLYQEVEKALVLTGSETLVDAYCGVGTIGQAFAGKVKEVRGMDIIPESIEDAKRNAEKNGIENVYYEVGKAEDVLPKWVNEGFRPDAVIVDPPRSGCDQGLIKSLLDVEAKQLVYVSCNPSTLARDLALLAKKYRIRYMQPVDMFPQTAHVETVVLLQLKDK

SEQ ID NO: 22610 - protein, 446 aa, Avicennia marina
MDVRGGEDVTGGSGAGRKVHSEDMAVEVPETAHQISNDSWLQAGFVLTTGVNSAYVLGYSGAVMVPLGWIGGVVGLILATLVSLHANALVAQLHEYGGKRHIRYRDLAGRIYGRRAYSVTWGMQYVNLFMINVGFVILAGNSLKAVYTLFRHDHVMKLPHFIAIAAIACGLFAISIPHLSAMRIWLAFSMFFSLVYIIVGFALSLKDGIEAPPRDYTLPEKGADKVFTIIGAAAELVFSFNTGMLPEIQATVRPPVIGNMMKALYFQFTVGVVPMYSIIFVGYWAYGSKTTSYLLNNVHGPIWLMTVANIAAFLQSVISLHIFASPMYEIWIPDLESKEVLWPIRNLSFRVVVRGGYVATTAFVSALLPFLGDFMSLTGAISTFPLTFILANHMYLVAKGNKLSPLHKTGLWLNIGFFGCLAVAAAVAALREIVVDSKTYHLFADI

SEQ ID NO: 22611 - protein, 431 aa, Pantoea endophytica
  misc_feature (415)..(415): Xaa can be any naturally occurring amino acid
  misc_feature (419)..(419): Xaa can be any naturally occurring amino acid
  misc_feature (431)..(431): Xaa can be any naturally occurring amino acid
MAVMGRNLALNIESRGYTVSVFNRSRDKTEEVIAENPGKKLVPFYTVKEFVESLETPRRILLMVKAGAGTDAAIDSLKPYLEKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELAETFTEWNKGELNSYLIDITKDIFTKKDEEGKYLVDVILDEAANKGTGKWTSQSSLDLGEPLSLITESVFARYISSLKEQRVAASKVLSGPQAKPAGDKSVFVEKVRRALYLGKIVSYAQGFSQLRAASDENNWDLNYGEIAKIFRAGCIIRAQFLQKITDAYAENAGIANLLLAPYFKKIADEYQQALRDVVPYAVQNGIPVPTFSAAXAYYXSYRAAVLPANLX

SEQ ID NO: 22612 - protein, 447 aa, Avicennia marina
MESQGREDVVGCSGAGGRVHSDGHIDIEIPETAHQISNDSWFQAGFVLTTGINSAYVLGYPGAVMVPLGWIGGVIGLILATVVSLHANALVAKLHDFGGKRRIRYRDLAGSIYGGKAYSITWGMQYVNLVMINVGYIILAGNSLKAVYLLFRDDHVMKLPHFIAIAGLACGLFAISVPHLSALRNWLAFSTLFSMIYIVGGIALAIKDGFKAPPRDYSIPGTKTSRIFTTIGASANLVFSFNTGMLPEIQATVRPPVVENMMKGLYFQFTVGVVPMYAIIFAGYWAYGSTTSSYLLNNVHGPIWLKTTTNISAFLQSVIALHIFASPMYEFLDTKYGIKGSALAVRNLSFRILVRGGYVAMTSLVSALLPFLGDFMSLTGALSTFPLTFILANHMYLVANRNKMSLLQKNWHWLNVVLFSCMAVAAAVAALRLIAVDSRTYHVFADI

SEQ ID NO: 22613 - protein, 265 aa, Unknown
  marine gamma proteobacterium HTCC2207
MRDMLQAGVHFGHQTRFWNPKMSKFIFGSRNKVHVINLEQTVPAFNEALEVLRKEAAKGNQILFVGTKRAAQKILKEEAERCGMPYVSHRWLGGMLTNYKTIRASIRRFRDLETQEANGTFERLTKKEVLMRTRMKEKLENSIGGIKDMNGLPDILFVIDVDHERIAINEANKLGIPVVGIVDTNSNPDGVDYVIPGNDDSIRAIKLYAASIANTVLEGKAQSAKVSSKDEFVEEAAPAAEEASEVAVEAPAAPEAPVTKEAAAE

SEQ ID NO: 22614 - protein, 426 aa, Pantoea endophytica
  misc_feature (9)..(9): Xaa can be any naturally occurring amino acid
  misc_feature (13)..(13): Xaa can be any naturally occurring amino acid
  misc_feature (32)..(32): Xaa can be any naturally occurring amino acid
  misc_feature (35)..(35): Xaa can be any naturally occurring amino acid
  misc_feature (279)..(279): Xaa can be any naturally occurring amino acid
  misc_feature (330)..(331): Xaa can be any naturally occurring amino acid
  misc_feature (346)..(347): Xaa can be any naturally occurring amino acid
  misc_feature (372)..(372): Xaa can be any naturally occurring amino acid
  misc_feature (408)..(408): Xaa can be any naturally occurring amino acid
  misc_feature (418)..(418): Xaa can be any naturally occurring amino acid
  misc_feature (425)..(425): Xaa can be any naturally occurring amino acid
RNLALNIEXRGYXVSVFNRSRDKTEEVIAENXGKXLVPFYTVKEFVESLETPRRILLMVKAGAGTDAAIDSLKPYLEKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELAETFTEWNKGELBSYLIDITKDIFTKKDEEGKYLVDVILDEAANKGTGKWTSQSSLDLGEPLSLITESVFARYISSLKXQRVAASKVLSGPQAKPAGDKSVFVEKVRRALYLGKIVSYAQGFSQLRAASXXNNWDLNYGEIAKIFXXGCIICREFLQKITDAYAENAGIANXLLAPYFKKIADEYQQALRDVVAYAVQNGIPVPTFSXAVAYYDSYRXAVLPANXI

SEQ ID NO: 22615 - protein, 605 aa, Pimelobacter simplex
MTQLDDRPVTTADTDPATAWFAAFEDALAARDIDRAAGLFAATSFWRDLIAFSWNLTTVENPDGVADLLAHTLDRVDPRGFRLTEPADTADGVTTAWFEFETAVGRGRGLVRVVDEDGPKAWTFLTTLYELKGHEEPRASRPRWRVHGATKERVTWLEQRQAEDAALGVDTQPYVLVVGGGQGGNRSARVRQLGVPALVIDKHPRPGDQWRNRYKSLCLHDPVWYDHLPYLKFPDNWPVFAPKDKVGDWLEFYTRVMEVPYWSNTVATKASYDESAGEWTVHLEREGKPLVLKPTHLVMATGMSGKANVPSYPGAEVFQGEQHHSSQHPGPDAYAGKKVVVIGSNNSAFDICGALWETGADVTMVQRSSTHIVKSDTLMDIGLGDLYSERAVENGVTTEKADLIFASLPYRIMHEFQIPLYDKMRERDRDFYDRMTAAGFDLDWGDDGSGLFMKYLRRGSGYYIDVGAAELVANGDVKLAHGQVDHLTETSVVLVDGTDLPADLVVYATGYGSMNGWAADLISQEVADRVGKVWGLGSDTTKDPGPWEGEQRNMWKPTQQENLWFHGGNLHQSRHYSLYLALQLKARHVGIDTPVHRLQEVHHLG

SEQ ID NO: 22616 - protein, 484 aa, Bifidobacterium longum
  misc_feature (358)..(374): Xaa can be any naturally occurring amino acid
MAENNTEVTKVAINDIGTEEDFIKAVDSTIKNFDDGDLVEGTVVKIDHDEVLLDIGYKTEGVIPSRELSIKKDVDPDEVVEVGDTIEALVVTKEDKEGRLILSKKRAQYERAWGDIEKIKEADGVVEGTVIEAVKGGLIVDIGLRGFLPASLVEMRRVRDLSPYIGQKIKAKILELDKNRNNVVLSRRQYLEETQSEVRETFLSQLKKGQIREGVVSSIVNFGAFVDLGGVDGLIHVSELSWKHIDHPSEVVKVGDKVTVEVLDVDLDRERISLSLKATQEDPWQRFARTHVPGQIVKGKVTKIVQFGVFISVEDGIEGLVHISELANRHVENPETVVKPGETVFVKVIDVDLDRRRXXXXXXXXXXXXXXXXXRRAGQLQVPRRLRPEHQRVDRWLREAARGVGVSVRRRSRAVGGAQGVRGQGAGERCRIRSRRRPGPEGREAGRGDLQLLFRCSDYRYPRRLRSARRPARPAARQVSLPRS

SEQ ID NO: 22617 - protein, 431 aa, Pantoea endophytica
  misc_feature (346)..(346): Xaa can be any naturally occurring amino acid
  misc_feature (388)..(388): Xaa can be any naturally occurring amino acid
MAVMGRNLALNLESRGYTVSVFNRSRDKTEEVIAENPGKKLVPFYTVKEFVESLETPRRILLMVKAGAGTDAAIDSLKPYLEKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELAETFTEWNKGELNSYLIDITKDIFTKKDEEGKYLVDVILDEAANKGTGKWTSQSSLDLGEPLSLITESVFARYISSLKEQRVAASKVLSGPQAKPAGDKSVFVEKVRRALYLGKIVSYAQGFSQLRAASDENNWDLNYGEXAKIFRAGCIIRAEFLQKITDAYAEKRRIANLLLAPYFKKIAXEYQQALRDVVAYAVQNGIPVPTFSAAVAYYDSYRAAVLPANLI

SEQ ID NO: 22618 - protein, 585 aa, Triticum aestivum
MCGILAVLGCADDTQGKRVRVLELSRRLKHRGPDWSGMHQVGDCYLSHQRLAIIDPASGDQPLYNEDKSIVVTVNGEIYNHEQLRAQLSSHTFRTGSDCEVIAHLYEEHGENFIDMLDGVFSFVLLDTRDNSFIAARDAIGVTPLYIGWGIDGSVWISSEMKGLNDDCEHFEIFPPGHLYSSKQGGFKRWYNPPWFSEVIPSVPYDPLALRKAFEKAVVKRLMTDVPFGVLLSGGLDSSLVAAVTVRHLAGTKAAKRWGTKLHSFCVGLEGSPDLKAAKEVANYLGTMHHEFTFTVQDGIDAIEDVIYHTETYDVTTIRASTPMFLMSRKIKSLGVKMVISGEGSDEIFGGYLYFHKAPNKEELHRETCQKIKALHQYDCLRANKATSAWGLEARVPFLDKEFINEAMSIDPEWKMIRPDLGRIEKWVLRKAFDDEEQPFLPKHILYRQKEQFSDGVGYSWIDGLKAHAESNVTDKMMSNAKFIYPHNTPTTKEAYCYRMIFERFFPQNSAILTVPGGPSVACSTAKAVEWDAQWSGNLDPSGRAALGVHLSAYEQEHLPATIMAGTSKKPRMIEVAAPGVAIES

SEQ ID NO: 22619 - protein, 133 aa, Staphylococcus aureus
MSIEVGNKLKGKVTGIKKFGAFVELPEGKSGLVHISEVADNYVENVEDHLSVGDEVDVKVLSIADDGKISLSIKKAKDRPRRQHTSKPSHQKPVQKAEDFEKKLSNFLKDSEDKLTSIKRQTESRRGGKGSRR

SEQ ID NO: 22620 - protein, 223 aa, Kineococcus radiotolerans
MLFGNPYKTTMVTADQALRGSATRRFEVPATHAVLGTPLEGPWPEGTEVISFAMGCYWGAERIFWRQPGVVTTAAGFQGGFTENPTYEESTTGRTGHAETVLVAYDPTATSAEQLLKIFWENHDPTQGYRQGNDRGTEYRSAVYTTTDEQWEAAQRTRETFQRELTEHGHGRITTEIRRASEAGPFWYAEDYHQQYLEKVPNGYCNHGPNGLTCQIGLVPAAE

SEQ ID NO: 22621 - protein, 264 aa, Unknown
  Nicotiana langsdorffii x Nicotiana sanderae
VDFGSIGGKSRISVAVVNAAADSGRGAKAETAATAVVVEEKPMMERRRFQVLPGKPLPFGATATDGGVNFAVFSSNATSATLCLITLSDLPQKRVTVQIFLDPLANKTGDVWHVFLKGDFENMLYGYKFDGKFSPEEGHFFDSSQIVLDPYAKVRINSRGEYGVLGPEDDCWPLMAGMVPSAADQFDWEGDLPLKFPQRDLVIYEMHVRGYTNHESSGIKFPGTYRGVVEKLDHLKELGVNCIELMPCHEFNELEYYSYNSVLV

SEQ ID NO: 22622 - protein, 305 aa, Methanosarcina mazei
MYDLIIIGGGPAGLTAGIYAVRYGLDTLILERNEISGQISMADIVENYPGFPSISGLELMERFRTHAQEVGVKTTITEVLSVRSEGTKKIITTDSGDLEAKAVIIATGANPKHLGVPGEKELISKGVSYCAICDGPFFRNKIVAVVGGGNSAVTDALFLSKVAQKVYLVHRRDHLKAARVLQDRVDGTPNIELILNSHVLEIVGTREGIKKVEKIILEDVNSRETRELSTNGVFIYVGIHPNTEFVDVEKDEGGFIKTDRWMETSEKGIYAAGDCRDTPIWQLVTAVRDGAIAATAAYEYIEKIR

SEQ ID NO: 22623 - protein, 645 aa, Zea mays
  misc_feature (426)..(426): Xaa can be any naturally occurring amino acid
MMGGGLMMDQSVVFPGVHNFVDLLQQNGDKNLGFASLMPQTSSGDQCVMGEGDLVDPPPDSFPDAVEDDSDDDVEDIEELERRMWRDRMKLKRLRELQQSRGKDPMASRWGALADGSSKPRQSQEQARRKKMSRAQDGILKYMLKMMEVCRAQGFVYGIIPEKGKPVSGASDNLRAWWKEKVRFDRNGPAAIAKYQADNAVPGAENELASGAASPHSLQELQDTTLGSLLSALMQHCEPPQRRYPLEKGVPPPWWPTGDEEWWPELGIPKDQGPPPYKKPHDLKKAWKVSVLTAVIKHMSPDIEKIRRLVRQSKCLQDKMTAKEISTWLAVVKQEEELYQKLNPGARPPASTGGIASAISFNTSSSEYDVDIIDECKGDEAGNQRTAVTDPTAFNLGAAILSDKFLVPTPMKEETADVEFIQKRTXPAAAEPELMLNNRLYTCNNVQCPRSDYSYGFLDRNARNSHQYTCKHKDPTPQSTENKPPSAPPQPQAFQPAFSQPNQALNSVDFSLPMDGQRSIAELMNMYDNNFVPNKNPSSDSVAVMERPNAMPQQRIQMDEGFFVQGNGAFDDVNSMMQQQQQQQHQAPVQQQQQFFIRDDTPFVSEMGDIAASAPEFRFGPGFNMSSGVDYSGAAQRNDGTNWFY

SEQ ID NO: 22624 - protein, 414 aa, Burkholderia pseudomallei
MKKIVVVGAGIAGLTLALTLHSRGLAVRVFEAAPRIEPLGVGLNIQPYAVRVLHELGLLETLARQSITTKEMVFFTRYGQRIYSLPLGKYGGHNFPQLSIHRGILQLALLKAATERLGPDFLVNGHSFVSCTQNRRSVNAVFSGAPGGADLVSVECDALIGADGVHSKVYRSLYPDGPRTKGNGVLMWRGVTIAPPFLTGASMVRMGVPSHGKLVVYPIRSDVNAQGDQLINWVAELDEAVYREGANAAPGNGKDFIRFFASRTFDWLDVPALLERAASPIIAMPMADRDPLPRWQTGRVTLIGDAAHPMVPVGSNGAGQAMLDAHSLGTRLAETADIEAALATYEHERRAYTSNIVLGDRLDLPDRLIQEVDCRSHGEPFSDIGEIIASDEASRLALPDYHGRPLAPTQAGGA

SEQ ID NO: 22625 - protein, 374 aa, Triticum aestivum
PRLRVVRCMAASEAAQLKSAREDIKEILKTTYCHPILVRLGWHDSGTYDKNIEEWPQRGGADGSLRFDPELSHGANAGLTNTLKLIQPIKDKYPGITYADLFQLASATTIEETGGPKLSMKYGRVDITAPEQCPPEGRLSDAGPRIPAEHLREVFYRMGLDDKEIVALSGAHTLERSRPDRSGWGKPETKYTKDGPGEPGGQSWTAEWLKFDNSYFKDIKEKRDQELLVLPTDAALFDDPSFKVYAEKYAEDQDAFFKDYAEAHAKLSNLGAKFDPPEGFSLDDDKGAAVTNEKVVADPAPASDTNGAGPQPEPFVAAKYSYKKRELSDTMKQKIRAEYEGLGGSPNKPMKSNYFLNIMIVIAGLAFLTSLVGN

SEQ ID NO: 22626 - protein, 426 aa, Pantoea agglomerans
  misc_feature (23)..(23): Xaa can be any naturally occurring amino acid
  misc_feature (25)..(25): Xaa can be any naturally occurring amino acid
  misc_feature (166)..(166): Xaa can be any naturally occurring amino acid
  misc_feature (227)..(227): Xaa can be any naturally occurring amino acid
  misc_feature (334)..(334): Xaa can be any naturally occurring amino acid
  misc_feature (362)..(362): Xaa can be any naturally occurring amino acid
  misc_feature (398)..(398): Xaa can be any naturally occurring amino acid
  misc_feature (426)..(426): Xaa can be any naturally occurring amino acid
RNLALNIESRGYTVSIFNRSREXTXEVIAENQGKKLAPFYTVEEFVESLEKPRRILLMVQAGEATDKTIASLTPHLDKGDILIDGGNTFYKDTIRRNKELSDQGFNFIGTGVSGGEEGALKGPSIMPGGQKEAYELVAPILDKIAARAEDGEACVAYIGPDGAGHXVKMVHNGIEYGDMQLIAEAYALLKGALGLNNEELAETFTEWNNGELSSYLIDITKDIFTKXDEEGKYLVDVILDEAANKGTGKWTSQSSLDLGEPLSLITESVFARYLSSLKTQRVAASKVLSGPQAKPSGDKAEFIEKVRRALYLGKIVSYAQGFSQLRAASEENNXDLHYGEIAKIFRAGCIIRAQFLQKITDXYAEDAGIANLLLAPYFKDIADQYQQALRDVVSYAIXNGIPTPTFSAAIAYYDSYRSEVLPANLX

SEQ ID NO: 22627 - protein, 556 aa, Unknown
  Nicotiana langsdorffii x Nicotiana sanderae
CFICFMPLDLKRRGADGKSSAIETPFVQGPSDKVTVELDFEASLAPFYISFYMKSQLVADVKSSEIRSHRNTSFVVPVGLTTGHPAPLGLSYQPDGTMNFALFSRSAKSVVLCLYDDISVENPSLEIDLDPYVNRSGDIWHAALDCSLPFKTYGYRCKVATSGKEELVLLDPYSKVIRSVIPRQGGSELRPKYLGELCKEPGYDWSGDVPPSLPMEKLIIYRLNVTEFTKDGSSKLPDDLAGTFSGITEKLSHFKHLGVNAVLLEPIFPFEEQKGPYFPSHFFSPGNMHGRSSDPLSVINSMEDMVKKLHANGKEIFLEVVFTHTAEDAPLMHVDNSSYCSIKGGDLNIQYALNCNYPIVQQMILGCLRHWVIEFHIGGFVFVNASSLLKGFLGEILSRPPLIEAIAFDPILSKVKIIADYWDALANDSKEILFPHWRKWAEINTRFCDDIRDFLRGKGLLSSLATRLCGSGDIFSGGRGPAFSFNYIARNFGLTLVDLVSFSSSEAALELSWNCGEEGPTTNNIVLETRLKQVRNFLFILFISLGVPVLNMGDEC

SEQ ID NO: 22628 - protein, 270 aa, Oryza glaberrima
MGRRACCAKEGMKRGAWTSKEDDMLASYIKSHGEGKWREVPQRAGLRRCGKSCRLRWLNYLRPNIKRGNIDDDEEELIVRLHTLLGNRWSLIAGRLPGRTDNEIKNYWNSTLSRKIGTAATAAAGSRGGSTPDTARATDAASSSSVVPPGQQQQPASRADTDTATAAAAATTTTVWAPKAVRCTRGFFFHDRETAPLAAAAPAPAGELGDGDDADCDYYCSGSSSAATTTSSSSFPAVVEPCFSAGDDWMDDVRALASFLDTDDAWNLCA

SEQ ID NO: 22629 - protein, 614 aa, Nicotiana tabacum
MDGSVAKGTSCIQDSQSSSVIANTDATLGRHLARRLVEIGIQDVFSVPGDFNLTLLDHLIAEPRLKNIGCCNELNAGYAADGYARARGVGACVVTFTVGGLSVLNAIAGAYSENLPVICIVGGPNTNDYGTNRILHHTIGLPDFSQELRCFQTVTCYQAVVNNLDDAHEQIDRAISTALKESKPVYISISCNLPAIPHPTFSRDPIPFSLSPRLSNKRGLEAAVDAAVTFLSKAVKPVMIGGPKLRVAKACDAFVELADSSGYAMAVMLQPKGLVAEQHPHFIGTYWGAVGTSYCAEIVESADAYLFAGPIFNDYSSVGYSLLIKKEKSIIVQPDRVVIGNGPAFGCVLMKDFLSELAKKIKKNETAYENYRRIFVPEGTPLKSEPNEPLRVNVLFQHIQKMLSDETAVIAETGDSWFNCQKLKLPEGCGYVTNNSLSAWYPFYLQTLEEKSSCCRYEFQMQYGSIGWSVGATLGYAQSVPKKRVISCIGDGSFQVTAQDVSTMIRCEQKNIIFLINNGGYTIEVEIHDGPYNVIKNWNYTGLVDAIHNGEGNCWTMKVRTEEELTEAIATATGEKKDCLCFIEVIVHKDDTSKELLEWGSRVCSANGRPPNPQ

SEQ ID NO: 22630 - protein, 512 aa, Xanthomonas axonopodis
MWWMVWRPRGCAHRAGGAGPFCAGKQQALQDRKQIDRAKGLLMEKRGLSEADAYAALRQQAMKQGVKLTEVARRIVAMAEYSRGWVVLHAACERAPDAMWMDRLVAALHLPAGADVLEYCDLRRGPMRRVGWRMHDGHRHIDGVLLTAAQPSDANRSLLATALAGKPWRGARLSVFTHTHSAWRSDRVHLHACLGRSDARRHRRRRHVAQLKQRGGCRSTPQEFICRLMRRYALQGRRVVRVKGDDALLFGHAGEEIAFLRRAGVGVQVIDGVSAAFAAVAALDVSLTHRSHCHGITFVTAHTHDHGEPNWGALAASGTTLGIYMGLRRADALAAALLAGTPAAIVQAATRPEQQRRLTALGDLGTTAAALPPGLPTLLLVGDALSEAAAACDDRDGPMAVQAVGWGQHTTDDAAAGQGHSGSRFPCDMMRAHPEDSLPSLWASRIRAWTACMRNGYGLVSTSAGGTGLHTTAKSFAGCIDVATEGASVRVQIRAQLCVRALPVSTCGCAAV

SEQ ID NO: 22631 - protein, 249 aa, Elymus caninus
LTGITGIVNGMDVSEWDPTKDKFLAVNYDITTALEAKALNKEALQAEVGLPVDRKVPLVAFIGRLEEQKGPDVMIAAIPEIVKEEDVQIILLGTGKKKFERLLKSVEEKFPGKVRAVVRFNAPLAHQMMAGADLLAVTSRFEPCGLIQLQGMRYGTPCACASTGGLVDTIVEGKTGFHMGRLSVDCNVVEPADVKKVATTLKRAIKVVGTPAYQEMVKNCMIQDLSWKGPAKNWEDVLLELGVEGSEPG

SEQ ID NO: 22632 - protein, 155 aa, Zea mays
  misc_feature (72)..(72): Xaa can be any naturally occurring amino acid
MQVAATAVRFSAVLPVKGRPAAKSTVVVRVPASRRSVRAAAVVAAEAAEIDYNSSFSVFPMEACDLLGGDAXSAQMYPETKLASAAAAASRRVEEVERDYLSYDEPRTVFPGEACDDLGGEFCEAPYQAGVSRELAARLKTLIHPFLSTTLCTYV

SEQ ID NO: 22633 - protein, 325 aa, Xanthomonas axonopodis
MPLFPLFANLQGRAVLVIGGGEVATRKVLALLKAQAHIRLYAHALSPELAQLLQAGRFEQMTGEFDPGWIDTVWLVVAATDDVELNQRVAAAAGARQRLVNVVDDAELSTYQVPAIVDRDPLVVAISSAGAAPMLARRLRERLERELHASVGTLAALFAQHRERIRQQLPDMNRRRRWFDQVIDGQVPQLLQAGDTAAAEAAFAAALEAVDSVPARGSVQWVGAGPGDPGLLTLNALRALNLADVLLLATDVPTAVVELARRDAQRRAWPQTLGAQQAVVVELVGAGLQVVVLRMGSGDAIPAELEAALHAQGILSVGVPGLPLR

SEQ ID NO: 22634 - protein, 577 aa, Aspergillus parasiticus
MEGETLPLAQYLFKRLLQLGVDSIFGVPGDYNLTLLDHVVPSGLKWVGNCNELNAGYAADGYSRIKDIGAVVTTFGVGELSAINAIAGAYAEKAPVVHIVGTPMRASQESRALIHHTFNDGDYQRFDAIQEHVTVAQVSLSDHRTAPSEIDRILLQCLLHSRPVRIAIPVDMVPVLVPVAGLSSKIQIPPAVRQPQAEEAALNAVLKRIYSSKKPMILVDGETRSFGMLQRVNHFIQTIGWPTFTSGFGKGLVDETLPNVYGVCTLHQKAFVDSCDLVLVFGPHFSNTNSYNYFLKPADEKSVLFSPNSIQVNKDVFRDLPVGYFIEQLTQQLDISRIPTHKHDLVHPSLRTLPEVSPTDLVTQTGGFWKRFSPFLRTGDIILGETGTPGYGVNDFILPPQTRLFKPATWLSIGYMLPAALGASHAQRDLVASDQYHSLSNPRTILFIGDGSFQMTVQELSTIIHQKLNVIIFLINNDGYTIERCIHGRNQAYNDVAPWRYLKAAEFFGADQDGEYKASTWEVRTWADLDRVLNDSQLADGKGLRMVEVFMERLDAPDVLMGLLNNQVLRENAQSRL

SEQ ID NO: 22635 - protein, 249 aa, Elymus caninus
LTGITGIVNGMDVSEWDPTKDKFLAVNYDVTTALEGKALNKEALQAEVGLPVDRKVPLVAFIGRLEEQKGPDVMIAAIPEIVKDEDVQIVLLGTGKKKFERLLKSVEEKFPGKVRAVVRFNAPLAHQMMAGADVLAVTSRFEPCGLIQLQGMRYGTPCACASTGGLVDTIVEGKTGFHMGRLSVDCNVVEPADVKKVATTLKRAIKVVGTPAYHEMVKNCMIQDLSWKGPAKNWEDVLLELGVEGSEPG

SEQ ID NO: 22636 - protein, 370 aa, Unknown
  uncultured archaeon GZfos1D1
MDISQTIFEEYADDLGPEKIIHIYEPVAKLRAIVVIDNVAAGPVIGGVRMAPNLTTTEIMRLARAMTLKNAAAGLPHGGGKAGILADPKTEGKEHLIRVFARTIEHLHDYIPGPDMCTDESCMAYIFDEIKRAVGLPRVLGGIPLDEIGATGFGVAECAEVAKEYIDLDLNGARLVVEGFGNVGKNTARFLEEKGASLVAASDTSGTVYNMDGIDVSGLIRVKEEKGSVIYHEDAEKLKTGDLLKIPGDIFVPAARPDVIDERNVSTLDTKLVIQGANIAITLGAEKALHERGVLSVPDFIANAGGVIAAAVEYRHGDEKEAFSEIKSKIRANTKKILDKTYSEGLYPRDAAEMIAKERVLSAMSYRRCI

SEQ ID NO: 22637 - protein, 471 aa, Rubrobacter xylanophilus
MLGNLIRDKGRPGRRGYTLPRPDVEPVSPEEVVPERLLRRERPRLPEADEPTVVRHYTNLSRRNWGIDTSFYPLGSCTMKHNPRANEAAAAHPGFAGLHPLQPEEQVQGALQVMYELQGFLAEISGFPAVSLQPLAGAQGELTSILMIRDYFRDAGDTGRRVVLIPQTAHGTNPATAAMAGFEAREIGLDARGCVDVGELRRLADESTAALMITNPNTCGVFERNMEEIAGILHSVGAFLYMDGANMNANMGRMRPADAGVDIMHFNLHKTFSTPHGGGGPGSGAIACSERLAPFRPDPVVERRGEGYRFARPEKSIGRVAAFHGNFGPMLRAWNYIRMHGPELREVTDLAVLNANYVRARLKGTYRLPYEGPCKHEVVVQPPKGIRALDVAKGLIDHGFHPPTIYFPLVVKEAMLIEPTETESKETLDDFVGAMLELAEAKPEELEEAPTRAPTRRLDEARAARNLKARW

SEQ ID NO: 22638 - protein, 249 aa, Elymus ciliaris
LTGITGIVNGMDVSEWDPTKDKFLAVNYDITTALEGKALNKEALQAEVGLPVDRKVPLVAFIGRLEEQKGPDVMIAAIPEILKDEDVQIVLLGTGKKKFERLLKSVEEKFPGKVRAVVRFNAPLAHQMMAGADVLAVTSRFEPCGLIQLQGMRYGTPCACASTGGLVDTIVEGKTGFHMGRLSVDCNVVEPADVKKVATTLKRAVKVVGTPAYQEMVKNCMIQDLSWKAPAKNWEDVLLELGVDGSEPG

SEQ ID NO: 22639 - protein, 429 aa, Rubrobacter xylanophilus
MARFTPHTEADIREMLDAIGVGSVDELFEDVSPRFEGELGLPPALSEYEALREVERLAARNRAGLPVFLGAGAYDRITPAAVGAIISRGEFMTSYTPYQPEVSQGHLQAIFEFQSVISELTGLEVANASVYDAASAVAEAALMTARLTKRDPKVALSAGLNPRYREVLETYGVEVAGLPFEGGATDFSGVPRDASGVIVQSPNFFGVVEDVGAAAEAAREVGALAVAVCDPIALAVLEPPGRLGADIAVGETQPLGVPLMFGGPYAGYMATRQRFVRQLPGRIAGETVDREGRLAYVLTLRAREQDIRRARANSNICTNQALTALAATIYTALLGPEGLREVAELSISKAHYLAGRLGEAGLRLRYPEAPFLWEFAVEMPDVKGANEALLEAGIVGGLDLGDGAMLVAVTEKRTKEELDAFVEVVANAG

SEQ ID NO: 22640 - protein, 957 aa, Klebsiella pneumoniae
MTKPVLVLVGHGMVGHHFLEQCVSRDLHQQYRIVVFCEERYAAYDRVELTEYFAGRSAESLSLVEGDFFTQHGIELRLSESVASIDREARVVRDAFGHETHWDKLVLATGSYPFVPPVPGHNLEGCFVYRTLDDLDQIAARAATARRGVVIGGGLLGLEAANALKQLGLETHVVEFAPNLMAVQLDNGGAAMLREKISELGVGVHTSKATTEIVRNEQGLQLNFRDGSSLATDMLVFSAGIRPQDALARSGGLSVGERGGICIDNQCRTSDPDVLAIGECALWENKIYGLVAPGYQMAARRAATLAGEAGSFSGADMSTKLKLLGVDVASFGDAQGRTPGCQSYQWTHGPQQVYKKIVVSADGKNLLGGVLVGDAGDYATLLQMMLNGMALPKHPESLILPALEGSRPKALGVAALPDGAQICSCHNVSKGDICQAVSGGAGDMAAIKSRTKAATGCGGCSALVKQVMEYQLAEQGVEVKKDICEHFPWSRQEIYHLVRVNHIRTFEQLIARYGQGHGCEVCKPLVASVLASCWNEYLLKPAHLPLQDTNDRYFANIQKDGTYSVVPRMAAGEVTPDGLIAIGQIAKRYQLYSKVTGGQRIDLFGARLEQLPAIWRELAEAGFETGHAYGKSLRTVKSCVGSTWCRYGVQDSTGLAVTLEHRYKGLRAPHKIKMAVSGCTRECAEAQGKDIGVIATEKGWNLYVCGNGGMKPRHADLFASDLDEATLIRSIDRLLMFYIRTADRLQRTSTWMDNLEGGVDYLREMILEDSLGIGEELEQEMARVVESYQCEWQTTLNDPQRLALFRSYVNSDEPDETVQRQTLRGQPQLAPFAAQGEPALPSRPWQAICDLDAIPQQAGIGARLGERQIALFRFGDQVYALDNLEPGSEANVLSRGLLGDAGGEPIVISPLYKQRIRLRDGRQCDGGEQAVRAWPVKVENGKVWVGNQQLLARAEAS

SEQ ID NO: 22641 - protein, 492 aa, Debaryomyces hansenii
MGKFNLYPSISNNIKRTVLNSIKPKSASRLGLFQSVQSKLQTRAFHSSRNVLINFDPYLTLGVEKSASAKDIKKAYYQLVKKYHPDVNKEKDAEKRFHKIQESYELLSDKEKRSQYDQFGAAAFDSNGNANPFAGGNPFGGSHGGNPFGGGAGGNPFGGMGFDFEDLFKQAFNGGAGGRGGGGGQFVTEHVGDNIEVLKTIGFKESIFGTKVEINYKAVDSCNTCKGSGMKKGKKKTTCSTCHGTGQSTHILGGFHMSSTCNSCHGTGVTIPSSDQCTSCKGNGVEEVPKSTSVDLPCGIADGTRLRIPGAGDAPFITKDPYNQTRNGDLIIRVHVSKDPVFTRSNNKIVVNQDIIMTTAALGGEIVVPTIDGQSIKLKLRPGVQNGKTLTIPEKGVPINRNIQNRGDMEVKINVKTLIPETPIQTALLEALADAFDDKNAKRTDAHWKLDLNEDEKDVKETFDEKDLHPSKLNRIGKFLGKFFNMKDEDKK

SEQ ID NO: 22642 - protein, 439 aa, Zea mays
PRVRSRVAPPDLDEFKTRAIAERGPGISSQPGNIIHRREPSGKLYNYAAASKGAKVLDFNKEAKGASNILDKDKDKYLRNPCSAEGKFVIIELSEETLVDTIAIANFEHYSSNPKEFELLSSLTYPTENWETLGRFTAANAKLAQNFTFLEPKWARYLKLNLVSHYGSEFYCTLSVLEVYGMDAVEKMLENLIPVENKKTEPDDKTKEPIEKIYLKDPAGGKEFSQETLDEDEFELEDDKPNGDSLKNGANDPVSEARTLQAGRIPGDTVLKVLMQKVQSLDVSFSVLERYLVELNSRYGQIFKDFDADIDSKDVLLEKIQSELKNLESSKDNIMNEVDGFLSWKLVASSQLNQLVLDNALLRLEFEIFRQKQTDMENRSLAVIFLSFVFACLALAKLSIGIMSRFCRFYNFEKFHNVRSGWLVLLLSSCVISTILIIQ

SEQ ID NO: 22643 - protein, 312 aa, Pseudomonas putida
MIGAPAVRIVKYAMTLQYPTIADCVGNTPLVRLQRIAGETSNTLLLKLEGNNPAGSVKDRPALSMITRAELRGQIKPGDTLIEATSGNTGIALAMAAAIKGYKMILIMPDNSTAERKAAMTAYGAELILVTKEEGMEGARDLAEKLQAEGRGLVLDQFANGDNPIAHYNSTGPEIWQQTQGSITHFVSSMGTTGTIMGCSQYLKEQNPAVQIIGLQPMEGSAIPGIRRWPEEYLPKIFDATRVDRVVDMSQQEAEDTTRRLAREEGIFCGVSSGGAVAAMLRLSREVENAVMVAIICDRGDRYLSTGLFDPS

SEQ ID NO: 22644 - protein, 221 aa, Kluyveromyces marxianus
MTYPERKAFVSRITNETKIQIAISLHGGHISIPNSILDRPESDVAKQATGSQIIDIQTGIGFLDHMIHALAKHSGWSLIVECIGDLHIDDHHTTEDWGFGSRTGFKEALGHVRGVRRFGTGFAPLDEALSRAVVDLSNRPFAVIDLGLKREKIGDLSCEMIPHFLESFAEAARVTLHVDCLRGFNDHHRSESAFKALAVAIREAISSNGTNDVPSTKGVLM

SEQ ID NO: 22645 - protein, 425 aa, Leifsonia xyli
MSVAGWVETVRDQKKVQFVVLRDESGAVQLVNPRTVNEDGTVAADEPALTVSGLSQGSFVRATGELKHDERVKLGGIEIKLSALDVETAAIPETPIAADSGIDKRMDWRFLDLREPKHNLIFRVQTTFENALRHYWVDNGFIEIHTPKLMASASESRAELFELPYFETTAYLAQSPQIFKQMAQAAGFGKVFEIGPAFRADPSFTSRHATEFTSVDTEISWIESHEDVMKVHEDLLVAGFTAVKEKHGAEIEALFGVEITVPTTPFPRIPLAEAKRIVAERGYEVPRHDDDMDPEGERQISAYVKETFGHEFVFLTDYAASIRPYYHMRHSEDRSITKSYDLIFNGVEISTGAQREHRVETIEQQAREKGLSVEELEDVLAFFRYGVPPHGGFGMGLARVLMLMLHLSNLRETTYLFRGPTRLTP

SEQ ID NO: 22646 - protein, 917 aa, Pseudomonas putida
MLDRLGIRSRVLLLALLPAGLMALVLGSYFTWLQQNDLRTQLLQRGKMIAEQLAPLAAPAMARLAPAQLERIAAQTLEQADVRAVAFLAPDRTRLAHAGPSMLNLPPSGGTGTQLLQRSGNDATRYLMPVFGHHRDLATDAVPAEAERLLGWVEIELSHDGTLLRGYRNLFTSLLLIFACLVLSGLLALRMSRTINDPIERIKHAVNQLKDGHLEERLPAMGSHELDELARGINRMAETLQNAHEELQHSIDQATEDVRQNLETIEIQNIELDMARKEALEASRIKSEFLANMSHEIRTPLNGILGFTHLLQKSEMTPRQLDYLSTIEKSADNLLGIINEILDFSKIEAGKLVLDSIPFNLRDLIQDTLTILAPAAHAKQLELLSLIYRDTPSSLIGDPLRLKQILTNLVSNAIKFTREGTIVVRAMLDDEHEDHAQLRISVQDTGIGLSPQDVRTLFQAFSQADNSLARQPGGTGLGLVISKRLIEQMGGEIGVDSTPGEGSQFWISLNLPKAHDDVEELPLQPLLGRRAAIVDGHELARQALEHQLEDCGLSVSLFASYDQLLHGVQAASQAGLPFEFAVLGANLGNLSPEQLGHYHQQLERYHCQCVVLCPTTEQALYHPYLPNGHGQLLSKPTCTRKLRRLLLELVQPRRPLAEVNNVNGQRQPKILCVDDNAANLLLVQTLLEDLGAEVLAVDNGYAAVQAVQDEPFDLVLMDVQMPGMDGRACTEQIRLWENTQSGNPLPIVALTAHAMANEKRALLHGGMDDYLTKPISERQLAQVVMKWTGLSLGAPHQAQAELPANGDELKVLDPEEGLRLAAGKADLAADMLSMLLASLDADREAIRAAREANDREGLIEQVHRLNGASRYCGVPQLRAACQRSETLLKQDNPQAQQALDELDSAIGRLAAQARLSA

SEQ ID NO: 22647 - protein, 605 aa, Unknown
  Marinobacter sp. ELB17
MTETKMTENKVTATQQARQWLDSFEETLNSDNPAQAADLFEDGGFWRDLVTMTWNIKTMEGRGAIRDMLSATAKRTQPANWQVSEEATEQDGVIDAWVTFETVDAIGKGHLRLRNGHAWTLLTTMQELKGFPEKRKFHRAKGAEHGASKSRKSWLETLQDEQQELGYSRQPYCVIIGGGQGGIALAARLKQLDVPTIVIERSAKAGDSWRNRYKSLCLHDPIWYDHLPYLPFPDHWPVFAPKDKIGDWLEMYTKIMELNYWSSTECTAARYDEASKEWVVDVVRDGEKVTLRPQQLVLATGMSGIPNIPDIPGMDTFEGEQHHSSRHPGGEAFKGKKCVILGANNSAHDICAALWENSADVTMIQRSSTHIIKSDTLMDDVLGGLYSEQAVADGMTTEKADLTFASVPFRIMPDFHIPVYQQVAEKDADFYGRLRKAGFMLDFGDDGSGLFMKYLRRGSGYYIDVGASELVADGEIKLKSGVSIEHINPRSVTLTDGTELPADLIVYATGFGSMNGWAAHIISEEVADKVGKCWGMGSDTTKDPGPWEGELRNMWKPTQQKALWFHGGNLHQSRHYSLYLALQLKARKEGLDTPVYGQESVHHLS

SEQ ID NO: 22648 - protein, 502 aa, Nocardia farcinica
MKGHPPREGVAAVATDNTAAHVPVVIIGAGIAGIALGVELRAAGLTDFVVLERAEGLGGTWRANTYPGCACDVPSQLYSYSFAPNPDWSRTYGTQPEILGYLERVATEHGVVAHMRFGTELRDARWDEDAEVWRVSTSRGDYTAGVLISAVGPFSEASIPDLPGRASFAGTQFHSLHWDHEHDLRGERVAVIGTGASAVQFIPEIQPLVGQLTVFQRSAPWIVSRLDRSTTGVERALLRRLPALGKAIRSAYYTGIESFGLVGFVDKRFRHPFETLAKLQLLRQVRDPRLRRILTPDYVIGCKRAIFSDAYYPALTQPNVEVVTAGIAEIRPHSIVTVDGAEYPIDTLIWGTGFGVPPAIFQRVHGVDGRSIADIYRERPSSYLGAAIGGFPNFFCTLGPFGAAGNQSAIFMIEAQARYIVDALKTMRAQRVTRVAVRPEVQRAFLDDVNARSRDTAWLTGGCRSYYQTADGANSGLYPNWSFEYARRTRHFDADSYEMRTR

SEQ ID NO: 22649 - protein, 229 aa, Arabidopsis thaliana
MSMSSMSSPSSAVCSPDHFSPSDHLCYVQCNFCQTILAVNVPYTSLFKTVTVRCGCCTNLLSVNMRSYVLPASNQLQLQLGPHSYFNPQDILEELRDAPSNMNMMMMNQHPTMNDIPSFMDLHQQHEIPKAPPVNRPPEKRQRVPSAYNRFIKEEIQRIKAGNPDISHREAFSAAAKNWAHFPHIHFGLVPDNQPVKKTNMPQQEGEDNMVMKEGFYAPAAANVGVTPY

SEQ ID NO: 22650 - protein, 121 aa, Glycine max
  misc_feature (83)..(83): Xaa can be any naturally occurring amino acid
  misc_feature (88)..(89): Xaa can be any naturally occurring amino acid
  misc_feature (107)..(107): Xaa can be any naturally occurring amino acid
PGCRTGGGLPPKGLAPTGAAETNEEGGRHSPSSAGPTPFLGRVVFFNFQRENVAKQVPEQNGLTHLEAGDTRAKEYVSLLNSXDPGGXXHVDVLAWGSIGHVVAYYXLATTSNGYDPAFFG

SEQ ID NO: 22651 - protein, 259 aa, Oryza sativa
MISPDAARNVVGIIGNVISFGLFLAPVPTFWRICKRKDVEEFKADPYLATLLNCMLWVFYGIPVVHPNSILVVTINGIGLLVEGTYLLIFFLYSPNKKRLRMCAVLGVELVFMLAVILGVLLGAHTHEKRSMIVGILCVFFGSIMYFSPLTIMGKVIKTKSVEYMPFFLSLVCFLNGVCWTAYALIRFDIYVTIPNGLGALFGAIQLILYACYYRTTPKKTKAAKDVEMPSVVVSGTGAAAAAGGGNTGGGSISVTVER

SEQ ID NO: 22652 - protein, 697 aa, Aspergillus oryzae
MESARKEQGQGYFSHNSSGGSGATRNPSTPNEGQRSHLRQNSSIDGLTMGSLPPNSPVIRIIYTGGQTKVLNIKHCKTADEIILCVLKKLQLPEHQYRNYCFYVLDGLEPDPSNCRRLADHELMEICESNHKSERGRLILRKIHAGEPDTDELRRASQLAIDESQATHINALNSSNPRTQFKIQQLTGEPWHNIKQPISPMSARHQNSSEHDLQVLNTERHAVSKLRSFFGARPPSEMIIHEITSYFPSHHREDIEKTMRMSIRRSQRLSRAASRLSVVSNTSYASSLRDAPPIPSIADTWLNTGAQPTRASRPLSVSKFSLPQATYRDSIASSSLQPLQEESPIEPNRKSYVSFDSGSDDPSTSRQSLVDENASVAATDGGSLNERLSVLVAEDGEEEDDGLNDFLAGNNFAPKNWMKGSLIGEGSFGSVFLALHAITGELMAVKQVEIPSATKGTEFDKRKNSMVTALKHEIELLQGLHHKNIVQYLGTAADDQYLNIFLEYVPGGSIATMLKQYNTFQEPLIKNFVRQILAGLSYLHSRDIIHRDIKGANILVDNKGGIKISDFGISKRVEASTVLGSRASGTGGGHLHRPSLQGSVYWMAPEVVRQTAHTKKADIWSLGCLVVEMFIGAHPFPDCSQLQAIFAIGSNKARPPAPEHASKDAVAFLDMTFQVDYEQRPSADELSKCQFLATPIA

SEQ ID NO: 22653 - protein, 440 aa, Avicennia marina
SAPAHSGCDRGLCSDDHVAVEIPDTAHQISQDSWFQVGLVLTNGVNSAYVLGYSGAIMVPLGWLGGVVGLILATAISLYANALVAELHEFGGRRHIRYRDLAGFIYGRAAYNLTWGLQYVNLFMINVGYIILAGNALKAMYVLLLDDHLIKLPHFIGIAGLACGLFAMAVPHLSAMRVWLVFSTLFSLVYIVIAFALSLKDGVEAPPRDYSIMATTASRIFTAIGASANLVFAFNTGMVPEIQATVRPPVIGNMMKGLYFQFTAGVLPMYALTFIGYWAYGFEASTYLLSNVHGPVWLKAVANVSAFLQSIIALHIFASPMYEYLDTRYGIKGSALAFSNLCFRVVVRGSYLGMTTFVSALLPFLDDFMSLTGALSTFPLTFILANHMYLVAKKHELTSLQKSWHWFIVCFFGCMSVAAAAAGLRLIVVDSSHYHVFADL

SEQ ID NO: 22654 - protein, 217 aa, Dunaliella salina
  misc_feature (209)..(209): Xaa can be any naturally occurring amino acid
  misc_feature (217)..(217): Xaa can be any naturally occurring amino acid
TMSALLMNKSVASGASLKASTRSVGRITPAPARRSVAAQAAREMWYPGATPPAHLDGSMLGDYGFDPLRLGTNPDRMKWFREAELTNGRWAMAAVVGILFTDLVGLPKWWEAGAQTYPIDNQTLAIIEIAVFAFLEAKRYEGYKKTGGTGIRFLLPLRPHGHAQPREGAEGAEERPPGHACLPGLCLHRSCERPGPIESLQTTWLTRPXNISPPLLX

SEQ ID NO: 22655 - protein, 307 aa, Geobacillus kaustophilus
MKLYDSILDLIGGTPIVKLQRLPDPDGADVYMKLESFNPGGSVKDRPAWEMIRRAEAEGKIAPGKSTIIEPTSGNTGIGLAMVCAARGYRCIITMPDNATVERVKILKAYGAEVYLTPAEKRMQGAIDEANRLAGEIPDSFIPMQFENPANPDAHRHTTAVEIYEAFDGRLDAFVLTAGTGGTVTGTGEELKKRIPNLRIYVVEPYGSPVLSGGKPGPHKIPGTGPGFIPKILNRSIYDDIFLIKDEDAQQMARELAAKEGILVGASAAASAYYAIKVAKQLPKGARVLCMAPDSGERYLSSDLFAD

SEQ ID NO: 22656 - protein, 131 aa, Vibrio angustum
MSDAMKALLNLRSLRALSREYTLEQLEEALEKLTTVVQERAQAEEEEQAKENERNEKLAQYREMLLADGIDPEELLASLSKAPKAKRAARPAKYKFIDENGEEKTWTGQGRTPSALKQALENGKSLEEFEI

SEQ ID NO: 22657 - protein, 428 aa, Burkholderia vietnamiensis
MSSQLQSIPSYLHADDLGPWGNYLQQVDRVAPYLGSLSRWLETLKRPKRILIVDVPIELDNGTVAHFEGYRVQHNVSRGPGKGGVRYHQDVTLSEVMALSAWMSVKNAAVNVPYGGAKGGIRVDPRKLSRGELERVTRRYTSEIGIIIGPNTDIPAPDVNTNEQVMAWMMDTYSMNQGQTSTGVVTGKPISLGGSLGRKEATGRGVFVVGCEAAKKKGLEIEGARIAVQGFGNVGGIAAKLFQEAGAKVIAVQDHTGTIYQPAGLDANKLLDHVARTGGVAGFEGTEPMPNDEFWTVETDILIPAALENQITEKNASKIRTKIIVEGANGPTTTAADDILSANGVLVIPDVIANAGGVTVSYFEWVQDFSSFFWTEDEINHRLERVMREAFAGVWAVAEEHNVSVRTAAFIVACKRILMAREMRGLYP

SEQ ID NO: 22658 - protein, 430 aa, Pantoea oleae
  misc_feature (157)..(158): Xaa can be any naturally occurring amino acid
  misc_feature (379)..(379): Xaa can be any naturally occurring amino acid
  misc_feature (381)..(381): Xaa can be any naturally occurring amino acid
MAVMGRNLALNIESRGYSVSIFNRSREKTDEVVAENQGKNLVAHYSVEDFVDSLEKPRRILLMVQAGEATDKTIASLTPHLDKGDILIDGGNTFYKDTIRRNKELSEQGFNFIGTGVSGGEEGALKGPSIMPGGQKEAYELVAPILTEIAAVAEGEXXVAYMGPDGAGHYVKMVHNGIEYGDMQLIAEAYSLLKNALNLGNEELAKTFSEWNEGELSSYLIDITKDIFTKKDEEGKYLVDVILDEAANKGTGKWTSQSSLDLGEPLSLITESVFARYLSSLKTQRVAASKVLSGPTVQRGGDKAEFVEKVRRALYLGKIVSYAQGFSQLKAASDENNWDLHYGEIAKIFRAGCIIRAQFLQKITDAYADNANIANLLWXPXFKNTADEYQQALRDVVAYAVQNGIPTPTFSAAIAYYDSYRSAVLPANLI

SEQ ID NO: 22659 - protein, 695 aa, Arabidopsis thaliana
MDKSQKNPTSQIGTSTPKSKFEDSPVFNYISNLSPIESVKSISTAQTFSSLSFTSPPPVFTSPHVISHRESRFFRCHNSVDRSKHLESLDGSAVKGEVVVPLVEDLNKEASLEDEEETSVETSSELPQIMKFDSQTSEHSDSPCTEDVVIEASSDPPRGDNGSSSEDVTMGLQNMLVVREGNDTPGCGRLISDATELLVFRSPNDSEAFRCLVDKISSSERRFCAGVKSTKRPDINKDIPANGSSNENQPLAVLPTNESVFNLHRGGMRRRCLDFEMPGKRKKDIVDDQQSVCDNNVAGESSSSCVVPGIGLHLNAVAMSAKDSNISVIHGYSISGEIQKSFSGSTTPIQSQDTVQETSDQAENEPVEEVPKALVFPELNLGSLKKKMRKSEQAGEGESCKRCNCKKSKCLKLYCECFAAGVYCIEPCSCIDCFNKPIHEETVLATRKQIESRNPLAFAPKVIRNADSIMEASDDASKTPASARHKRGCNCKKSNCMKKYCECYQGGVGCSMNCRCEGCTNVFGRKDGSLLVIMESKLEENQETYEKRIAKIQHNVEVSKEVEQNPSSDQPSTPLPPYRHLVVHQPFLSKNRLPPTQFFLGTGSSSFRKPNSDLAQSQNEKKPLETVTEDKTEIMPEILLNSPIANIKAISPNSKRVSPPQPGSSESGSILRRRGNGRKLILRSIPAFPSLNPNQ

SEQ ID NO: 22660 - protein, 184 aa, Pseudomonas aeruginosa
MKPRVLLSALALAGLPLSGWAADCPELLQGQLTKLRSKESIDLCQRYAGKPLVVVNTASHCGFTPQFKGLEALYQRYKGQGLEVLGVPSDDFKQEAADTAETAKICYGNYGVTFAMTQPQHVRGDEAIPLFRQLAEQSGQAPRWNFYKYVVDRQGRVVAQFSSKTTPDDPQLQAAIEKAIASQP

SEQ ID NO: 22661 - protein, 431 aa, Pantoea agglomerans
  misc_feature (48)..(48): Xaa can be any naturally occurring amino acid
  misc_feature (74)..(74): Xaa can be any naturally occurring amino acid
  misc_feature (139)..(139): Xaa can be any naturally occurring amino acid
  misc_feature (159)..(159): Xaa can be any naturally occurring amino acid
  misc_feature (170)..(170): Xaa can be any naturally occurring amino acid
  misc_feature (369)..(369): Xaa can be any naturally occurring amino acid
MAVMGRNLALNIESRGYTVSIFNRSREKTDEVIAENQGKKLAPFYTVXEFVESLEKPRRILLMVQAGEATDKTXASLTPHLDKGDILIDGGNTFYKDTIRRNKELSDQGFNFIGTGVSGGEEGALKGPSIMPGGQKEAXELVAPILDKIAARAEDGEAXVAYIGPDGAGXYVKMVHNGIEYGDMQLIAEAYALLKGALGLNNEELAETFTEWNNGELSSYLIDITKDIFTKKDEEGKYLVDVILDEAANKGTGKWTSQSSLDLGEPLSLITESVFARYLSSLKNQRVAASKVLSGPQAKPSGDKAEFIEKVRRALYLGKIVSYAQGFSQLRAASEENNWDLHYGEIAKIFRAGCIIRAQFLQKITDAYXEDAGIANLLLAPYFKDIADQYQQALRDVVSYAIQNGIPTPTFSAAIAYYDSYRSEVLPANLI

SEQ ID NO: 22662 - protein, 437 aa, Bartonella henselae
MTKQGNDTQKRFFNDNLQTVDVAIFDAIRGEFERQQHEIELIASENIVSRAVLEAQGSVLTNKYAEGYPGKRYYGGCQFVDVIENLAIERAKKLFGADFANVQANSGSQMNQAVFLALLKPGDTFMGLDLNSGGHLTHGSSVNMSGKWFKSISYGVRKEDQLLDMEAVERLAKEHKPKLIIAGGSAYSRLWDWKKFREIADEIGAYLLVDMSHIAGLVAGGVHPSPVPHAHIVTTTTHKSLRGPRGGLILTNDEILAKKINSAIFPGLQGGPLMHVIAAKAVAFEEALQPVFKDYSANVVANAKTLAKTLQSNGFDIVSGGTDNHLLLVDLRSKKVTGKCAELALGRAHITCNKNSIPFDLETPFITSGIRLGSPAATTRGFAENEFIEIAHMISEILDNLGMAKSDEDNSAVEMVVRKKVEDMTNKFPLYSYLHTC

SEQ ID NO: 22663 - protein, 461 aa, Geobacter sulfurreducens
MRLLLVSANRERSPYPVFPLGLACLVPSLEAAGHELRALDLCFEADPEEAVTAALADFTPQAVIISVRNIDNVTWPGSRSYVAGVKAIVDRCRGIATTILGGSGFSLMPAELLAFTGGDLGVAGEGEEILPELLACIERGESPAGLPGVVAGAGAFAPPRPVERIAAPDRRLFALARYRREGGMANIQTKRGCPFGCIYCTYPLLEGRRMRLRPTAEIVAELRELADAGIDYVYFVDDIFNYPPDFAEELCRAMIASGLTMGWSAFINPQFITPRLMESMVAAGCDAVEFGTDSGSPAMLRNLGKSFGVAQIRESSRICRELGVDFAHYILFGGPGETPATIAESFALMDEVAPTAVIAMTGIRIFPGTPLFERAVAEGMVTPDEPLLEPTFYLAPAIRDVLGELVTDGAMTRRNWVAPGLEINMSDAMLEAMRHFPVRGPLWKLIKRLGRSHAKPLSQPQ

SEQ ID NO: 22664 - protein, 431 aa, Pantoea agglomerans
  misc_feature (11)..(12): Xaa can be any naturally occurring amino acid
  misc_feature (378)..(378): Xaa can be any naturally occurring amino acid
  misc_feature (421)..(421): Xaa can be any naturally occurring amino acid
MAVMGRNLALXXESRGYTVSIFNRSREKTDEVIAENQGKKLAPFYTVEEFVESLEKPRRILLMVQAGEATDKTIASLTPHLDKGDILIDGGNTFYKDTIRRNKELSDQGFNFIGTGVSGGEEGALKGPSIMPGGQKEAYELVAPILDKIAARAEDGEACVAYIGPDGAGHYVKMVHNGIEYGDMQLIAEAYALLKGALGLNNEELAETFTEWNNGELSSYLIDITKDIFTKKDEEGKYLVDVILDEAANKGTGKWTSQSSLDLGEPLSLITESVFARYLSSLKTQRVAASKVLSGPQAKPSGDKAEFIEKVRRALYLGKIVSYAQGFSQLRAASEENNWDLHYGEIAKIFRAGCIIRAQFLQKITDAYAEDAGIANLXLAPYFKDIADQYQQALRDVVSYAIQNGIPTPTFSAAIAYYDSXRSEVLPANLI

SEQ ID NO: 22665 - protein, 335 aa, Oryza sativa
MPIPEKDGVEDNQEDDTFSRLQLLAQQRHAMEKFWRMSQEQIEESAGNEELILPISRVKNIIHAKEGGMMLSADTPAFVTKLCELFVQELILRAWVCANSHNREIILGTDIAEAITTTESYHFLANVVHGHQALGSNIPEIGVSAWKRHKLDEMTSLCHPPQAVQVTDLANHPPNIPVCPPIGQSGTQHTTSTHVLMMQGESIHKASKEKSPLKEVMVPTNKVGMTNSSYGVPNGGGATSSKVVIDSPKGETAQVFSSQHACPSLEDNYVIPIPAGHGDSFRTLDEANIPQLHQEQKNFISQDAIVGENIPLNESLEKSKHKDEDLLFPDKDLPE

SEQ ID NO: 22666 - protein, 192 aa, Rhodopirellula baltica
MSRFLLLTLALGCLMNAPQPVSAADSTADHECVLAHEAKTIEGKEVDLHDYEGKVVLIVNVASKCGYTKQYAGLQSLYEAHKDDGLVILGFPCNQFGSQEPGTNADILEFCSARYNVTFPMMGKVDVNGDDASPLYKQLTSVEAKPAGKGPISWNFEKFLIGRDGQVVGRYKSKVAPSDEELVSAIKSALKG

SEQ ID NO: 22667 - protein, 249 aa, Elymus dentatus
LTGITGIVNGMDVSEWDPTKDKFLAVNYDITTALEAKALNKEALQAEVGLPVDRKVPLVAFIGRLEEQKGPDVMIAAIPEIVKEEDVQIVLLGTGKKKFERLLKSVEEKFPGKVRAVVRFNARLAHQMMAGADLLAVTSRFEPCGLIQLQGMRYGTPCACASTGGLVDTIVEGKTGFHMGRLSVDCNVVEPADVKKVATTLKRAVKVVGTPAYQEMVKNCMIQDLSWKGPAKNWEDVLLELGVEGSEPG

SEQ ID NO: 22668 - protein, 2143 aa, Colletotrichum lagenarium
MSIVYNSIVFCLPSSSTFSTFSVVTTSPTFASAPRGALSPASTTSNVSPFRDHRLSDFANYRRDLAVLETSSGRLPTIQQQPPTATPSSTSQVAPWMSPSNGGATAHAHPHAHPHTSQSQLHTTFFNDSSDNLSVSSQLSPGFRPPTNRIAPQSSGSQDSPDGAYFGDERRPSLASITTLSSQGSKASMRRGGLQKLQGFFGEEFPGRDGSESSLHSSSGKDRSRSYSHSRPTRDRNYSNATDHARDREGSPSSSRPRTPVPAPEVVPFLYQEADDIARYGEAPVRDILSGPDRERYMNNENPNNPQNPPKTSSSGRSGHSIVHLPGHHHRHNKSIDDGKALRPTVSREDSQASLQVQQHPRERGGSAATVMYGSNRSRAQSPTPSGGYFSSKHNPSVDGSTSPGGQSHHHSHTKRGILHRFKRNRDKDDAASKLREMPGSTRSLASKPSHSNFARPEPAPNTFPLNYADTEPRSNQDPRLAAYNQRSHQPFNNKFPFSSKGKARHQQRTDVPEEHIGPTDRQGGNVFVLDTNLNDMEGILTKPQPLTPMDSAFIASVEPDKDAPPVPAKPDAQNGINGNGAWNAPDSWAVRRGTEDTTYQAPDMDDVGSPPRPEEKNLAYCIRIFKSDGTFATVSMLLDSTVTDVVSQLVKKSYTGDGMENYHIILKKHSLVRVLAAPERPLLIQKKLLEQLGYDKRDKIEDIGREDNSYICRFMFLSSRESDFHSVTNDLGLGRIQKFNHVDLSGRNLITIPISLYSKAAEIITLNLSRNLSLDLPRDFIQSCQNLRDIKFNNNEARRLPPSLGNAAKLTYLDVSNNRLEQLEHAELHGLQGILKLNVANNLLKTLPQYFGAYKALRNLNISSNFLDHFPLFLCDVGSLVDLDISFNNIKSLPDEIGKLQNLEKFVITNNSLNNSLPDTIRGLSGLRELDIKYNCISNIDSISRLPKLETLSAEHNSISQFVGTFDCVRNLKLNSNPITKFELSAPVPSLKMLNLSACQLASIGETFNNMLNLERLVLDKNYFVSLPAQIGNLSKLEHFSIANNNVAELPTSIGCLTELRVLDVRRNNIRKLPMELWWANKLETLNASSNILENFPKPASRQPRPAGEEVQTPGAVNKANPMNVLPQAMDDGLDSRRPSQNSSSTLLSVGPSPAPGADRKGSVVSVYGKGGRKTSVVSRSTSQGTVATMTPPSTRKDSTLSSRLNTTFAGSLRNLYLAENKLDDEVFDQITMLNELRVLNLSWNYINDMPQRSIKSWPQMVELYLSGNELTTLPADDLEDASLLQVLHINGNKFTNLPADISRAKKLAVLDCGSNSLKYNISNVPYDWNWNLNPNLRYLNLSGNKRLEIKQTSTGPATSNREAYHEFNRLSNLRVLGLMDVTLISPTIPDQSEDRRVRTSGSLAGHLPYGMADTMGKNEHLSTIDLVVPRFNSSDTETLLGLFDGQALSSGGSKVAKYLHENFGFHLAQELKALKTRDNETPADALRRAFLSLNKDLVTVAVQHTTDDRSERSAQKTHRLPSVASPVILSREDLNSGGVATVVYLSHTELYVANVGDAQAIIIATDGTHKVLTKKHDPAEPSERLRIRDAGGWVSRNGRLNDLLEVSRAFGYVDLMPAVQAAPNVSHRTINEHDDIIIIATKEFWEYLDPALVVDFARQERTDLMRASQKLRDLAIAYGATNKIMVMMISVADLKRRVERSRLHRGQSMSLYPSGVPDDLQQLPRRGKRNKGDVDVLDSNLQRLEAEIPAPTGNVSIAFTDIKNSTTLWEMYPAAMRSAIKLHNEVMRRQLRRIGGYEVKTEGDAFMVSFPTATSALLWCFAVQTSLLEVNWPAEVLNSVSCQPVFDKDNALIFKGLSVRMGIHYGEAVSEMDPVTRRMDYFGPMVNKASRISSVADGGQITVSSDFISEIQRCLETYQDTDRSGSTGSEDTFDDDEGFAFTIRKDLRSLSSQGFEVKEMGEKKLKGLENPEVVYSLYPHSLAGRIEAHQQPEARIEVDKPAMLQAGSELAFDTESIWALWRVSLRLEMLCSSLENVSGRGLQPPETELLERMKHRGGEVTERFLLNFMEHQVSRIETCVTTLSLRHIVMGKPPLNQLDDLRMPITSILDQVGEQMAELARYKALYGELSESDQGSDTVQE

SEQ ID NO: 22669 - protein, 97 aa, Synechococcus elongatus
ATYKVTLVRPDGSETTIDVPEDEYILDVAEEQGLDLPFSCRAGACSTCAGKLLEGEVDQSDQSFLDDDQIEKGFVLTCVAYPRSDCKILTNQEEELY

SEQ ID NO: 22670 - protein, 152 aa, Striga asiatica
LSSGARAGTHDKLSKTGGPFGTMRLEAELAHGANNGLDIAVRLLQPIKDQFPILSYADFYQLAGVVAVEVTGGPEIPFHPGRKDELEAPVEGRLPDATQGSDHLRDVFIKQMGLTDKDIVALSGGHTLGRAHKERSGFEGPWTENPLIFDNS

SEQ ID NO: 22671 - protein, 249 aa, Elymus mutabilis
LTGITGIVNGMDVSEWDPTKDKFLAVNYDITTALEAKALNKEALQAEVGLPVDRKVPLVAFIGRLEEQKGPDVMIAAIPEIVKEEDVQIILLGTGKKKFERLLKSVEEKFPGKVRAVVRFNAPLAHQMMAGADLLAVTSRFEPCGLIQLQGMRYGTPCACASTGGLVDTIVEGKTGFHMGRLSVDCNVVEPADVKKVATTLKRAVKVVGTPAYQEMVKNCMIQDLSWKGPAKNWEDVLLELGVEGSEPG

SEQ ID NO: 22672 - protein, 430 aa, Arabidopsis thaliana
MSLTLEFLLLLIVLILSHHAHSGSIVKFLPGFEGPLPFELETGYIGIGEEEEVQLFYYFIKSEKNPEEDPLLLWLSGGPGCSSLTGLLFENGPVALKFEVYNGSVPSLVSTTYSWTKMANIIFLDQPVGSGFSYSRTPLVDKISDTGEVKRIYEFLQKWLSKHQQFFSNPFYVGGDSYSGMIVPPLVQEIGKGNYQINLQGYILGNPITDTESEQNYQIPYAHGMALISDELYKSMERICKGNYVKVDSLNTKCYKLIKDYQKCIHKLNKYHILLPDCDITSPDCFLYRYTLITFWANNKSVREALQVNKGSIGKWVQCNYKNISYNYDIKSSVAYHMKNSIDGYRSLIYNGDHDMMVPFLATQAWIRSLNYSITDDWKPWMINDQIAGYTRSYSNKMTFATIKGSGHTAEYKPKETSIMFKRWISAQPL

SEQ ID NO: 22673 - protein, 249 aa, Elymus mutabilis
LTGITGIVNGMDVSEWDPTKDKFLAVNYDVTTALEGKALNKEALQAEVGLPVDRKVPLVAFIGRLEEQKGPDVMIAAIPEIVKDEDVQIVLLGAGKKKFERLLKSVEEKFPGKVRAVVRFNAPLAHQMMAGADVLAVTSRFEPCGLIQLQGMRCGTPCACASTGGLVDTIVEGKTGFHMGRLSVDCNVVEPADVKKVATTLKRAIKVVGTPAYHEMVKNCMIQDLSWKGPAKNWEDVLLELGVEGSEPG

SEQ ID NO: 22674 - protein, 302 aa, Daucus carota
MDNSCATLQEGCLVVQQQNTTAAATMATVDHSSSSTKAPVTRNSRWSLAGMTALVTGGTRGIGHAIVEELAELGACVYTCSRNEQELNERLEEWRAKGFDVTGSVCDVSSVTEREQLFQRISSCFGGKLHILINNVGTNIRRATENYTAEQYSIVMATNLEAPYHACQLAYPLLKASGSGCIVFNSSVAGLVHLGTPGSVYGAAKGAINQLTKNLACEWAKDNIRTNCVAPGYIKTPPVEKLFERKNFLDRLVSRTPLRRPGETEEVSSLVAYLCMPAASYITGQIIAIDGGLTVNCFERVV

SEQ ID NO: 22675 - protein, 223 aa, Torulaspora delbrueckii
MSERKAFVSRITNETKIQIAISLNGGHIEIKDSILCKKQQENGSDVAAQTTKSQVIDIQTGVGFLDHMIHALAKHSGWSLIVECIGDLHIDDHHTTEDCGIALGQAFKEALGQVRGVKRFGTGFAPLDEALSRAVVDLSNRPYAVIDLGLKREKIGDLSTEMIPHFLESFAEAARLTIHVDCLRGFNDHHRSESAFKALAVAIRESLAPNGTNDVPSTKGVLM

SEQ ID NO: 22676 - protein, 353 aa, Prunus avium
MTKSNSSVGRGPSLISIVVLLGQLVVASLATNKHTKVHAGAPIGVCNGMVGDDLPPQAEVVALYKKNNIPRMRLYDPNPAALEALRGSNIKLLLGVPNENLQYIASSQANANAWVQNNVRNYANVKFQYIAVGNEVKPSDSFAQFLVPAMRKIQKEISLAGLAKKIKVSTAIDTGVLGETFPPSIGSFKSEYDALLHPIIRFLVNHKSPLLVNLYPYFAYSGNTQDIRLDYALFTAPSIVVQDGKFGYRNLFDAMLDGVYAALEKAGGGSLKVVISETGWPSAAGTATTIDNARTYISNLIQHVKEGTPRRPGRPIETYIFAMFDENRKTPELEKHWGLFSPTKQPKYQSSFN

SEQ ID NO: 22677 - protein, 207 aa, Brassica napus
  misc_feature (194)..(194): Xaa can be any naturally occurring amino acid
MLASPSYSRAASRFPPALHSSGNVFTGFIPIRRVTGVQVCTRRSTLKVTCRRARERVIEEESSQMAETNKQSFKVSSGEKSPLGVSQVDKGINFALFSHNATSVTLCLSLPQSDKEDDVDVVELVLDPSINKTGDTWHICVEDLPLRNVLYGYRVDGSGEWNQGHRFDRSILLLDPYAKLVKGRSFFGDSSQKXAQFYGTYDFETLH

SEQ ID NO: 22678 - protein, 359 aa, Oryza sativa
MASCGFEGFEKRLELVFELPASGGEVARHGLRLLPAEALREVLDAAQCAVVSAAGNAAADAYVLSESSMFVYPGRVVLKTCGTTPLLRAVPVLLRAAAALRLRLRSCRYSRGEYLFPEAQPFPHAHFADEVAYLDAALPRELLRFRRSAVMPSSSSSSPGASHRWHVYSASSSASSSDADGAARLTAEVCMTELDRGMAARFYQRPGDGRTSHAIGDEMTAASGIGGVVDENDPRSLVCAYAFAPCGYSMNALDGARYATVHVTPEDGHCYASFECATDDAAAALAAIRRAVAAFRPATVSVSISHTSSAASSLCTPVAEALEPLGLACHCRAAEVFPGAGTVTYQTFTAPATKHEHDN

SEQ ID NO: 22679 - protein, 332 aa, Mycoplasma mycoides
MKKNITIIGSNAYSIALANILADNHHNVIIYSENELDVNNINFNHSYNISTQLKINNKIVATTDLVASLENVEILILTSLNKQLLSTINQIKKYLKNEIILISTIKGFDENNLDLLSNLIINQFSKTNLLKEFVCLYGPNNPSQIILKKPTTAMIISKNLSICKQLVKIFSNEYFLCYSNNDLITSELVVYFKDLINLSLGILEGLGAESNTKASLITIVINLIYQIAKNYNAKLETFFNFATLATLIENILDKNNKYFLLGIDIVKLKNITKALEKNNLTIDQIQVVRIAYLLCDKYEIHNEFINTLYRILYNNIRPIALLNHSFKGVWLV

SEQ ID NO: 22680 - protein, 843 aa, Zea mays
MGTMVAAVALRGGSSDSGGFDKVPGMDSGKYVRYTPEQVEVLERLYIDCPKPSSSRRQQLLRECPILSNIEPKQIKVWFQNRRCRDKQRKESSRLQAVNRKLTAMNKLLMEENERLQKQVSQLVHENAHMRQQLQNTSLANDTSCESNVTTPPNPIRDASNPSGLLAIAEETFTEFLSKATGTAIDWVQMPGMKPGPDSVGIVAISHGCRGVAARACGLVNLEPTKGIEILKDRPSWFRDCRSLEVFTRFPAGNGGTIELIYMQMYAPTTLVPARDFWTLRYTTTMEDGSLVVCERSLSGSGGGPNAASTQQFVRAEMLPSGYLVRPCEGGGSIVHIVDHLDLEAWSVPEVLRPLYESSRVVAQKMTTVALRHLRQIAQETSGEVVYALGRQPAVLRTFSQRLSRGFNDAISGFNDDGWSVMGGDGIEDVVIACNSTKKIRNTSNAGITFGAPGGIICAKASMLLQSVPPAVLVRFLREHRSEWADYNIDAYLASSLKTSACSLPGLRPMRFSEGQMIMPLAHTVENEEILEVVRLEGQPLTHDEALLSRDIHLLQLCTGIDEKSVGSSFQLVFAPIDEHFPDDAPLISSGFRVIPLDVKTDGVSSGRTLDLASSLDVGSAAPQASGDASPDDCSLRSVLTIAFQFPYEMHLQDSVAAMARQYVRSVISAVQRVSMAISPSQSGLNAGHRMLSGFPEAATLARWVCQSYHYHLGMELLNQSDGAGEALLKMLWHHPDAVLCCSFKEKPMFTFANKAGLDMLETSLVALQDLTLDKIFDESGRKALFSDISKLMEQGYAYLPSGVCMSGMGRHVSFDQAVAWKVLGEDSNIHCLAFCFVNWSFV

SEQ ID NO: 22681 - protein, 294 aa, Alkalilimnicola ehrlichei
MAPLRVALVQQRCGPDPDDNLHRTLTAIAEAAGRGAGLVLLQELHRGRYFCQQEDPACFDQAEPVPGPTTDALGTAAREHGVVVVGSVFERRAPGLYHNTAVVLDADGSLAGRYRKMHIPDDPGYYEKFYFTPGDLGFEPVQTRVGRLGVLVCWDQWFPEAARLMALAGAEVLLYPTAIGWTPDDRPDEQARQREAWMLAQRGHAVSNGLPVLACNRTGEEPDPEHPDQGIRFWGGSFVCGPQGEILAQAATDEECVLTVDVDLQAVEQVRRIWPFLRDRRIDAYSDLLKRFRD

SEQ ID NO: 22682 - protein, 279 aa, Zea mays
MDPSQSGTPSLFPVMDIPVAYPPAAYPPCEVAVAAAAYPRLLYAPPDAAAAQQAAAAQQQQQLLGAPVVCPPAAYPPGEVAVAAAAYPPQLYAPPDAAAAQQATAAQQQLLGAPVRVAYAPPDAAAVQQAAAAQKHKHQLQMLWLELRREIEATTDFKKHNIPLSRIKKIMRADPDVCAITAEVLVVFPWACEMFILELTRHGWAHAEANKRRMLQKSDIVAAIARTDVFDFFRDTVLHDDAKEGADAAPAAAAAAEKAHPAAGAPATDPLANYPMPQQ

SEQ ID NO: 22683 - protein, 72 aa, Alkalilimnicola ehrlichei
MAKEESIKMNGTVIETLPNTMFRVELENGHVVTAHISGKMRKHYIRILTGDKVTVELTPYDLSKGRITYRAR

SEQ ID NO: 22684 - protein, 168 aa, Oryza sativa
MARTKQTARKSTGGKAPRKQLATKAARKSAPATGGVKKPHRFRPGTVALREIRKYQKSTELLIRKLPFQRLVREIAQDFKTDLRFQSSAVAALQEAAEAYLVGLFEDTNLCAIHAKRVTIMPKDIQLARRIRGLHPCLEQKMSLATCLISLAPNCSLLRFTSNFCKDA

SEQ ID NO: 22685 - protein, 306 aa, Geobacillus kaustophilus
MKRARIIYNPTSGRELFRRHLPDVLVRLEKAGYETSCHATEGPGDATKAARQAVEREFDLVVAAGGDGTINEVVNGIADQPYRPKLGVIPVGTTNDFARAIGVPRSIEGACEVIATGEPVPIDIGCVTNEDKTRYFINIAGGGRLTELTYEVPSKLKTMLGQLAYYLKGIEMLPSIKATEAQIEYDGKLFEGEIMMFLVSLTNSVGGFEKLAPDSSLNDGLFDFIIVKKTNLAEFIRLVTLAARGEHINDPHIIYTKANRVKVRSPMQLNLDGEFGGMLPGEFVNLYRHLEVIMPKDKAEQVRTGR

SEQ ID NO: 22686 - protein, 249 aa, Methylobacillus flagellatus
MSVTMRQMLEAGVHFGHQTRYWNPKMAPYIFGERNKIHIINLEKTLPLFEDALKYVRQLSANKGRILFVGTKRQARDIIKEEAQRAGCPYVNHRWLGGMLTNFKTVKQSIKRLTEYEALLQDGGIEKFGKKEALGYKREVEKLERSIGGIKEMGGLPDAIFIIDVGHESGAVTEAAKLGIPVIGVVDTNNSPEGVAYVIPGNDDSSRAIRLYARGIADAVLEGRNQSINEIVKAASEEEFVEVEEVAAE

SEQ ID NO: 22687 - protein, 457 aa, Geobacillus kaustophilus
MTKQQAPVAKNEYYDVTFTDLTHDGLGVAKVDGFPLFVKHALPGERAKVKAIKVKKGYGYGRLVELYEPSPDRVEPPCPVYRQCGGCQLQHLSYEGQLKAKEKQVKEVLARIGKLDGVTVHPVIGMKNPWRYRNKAQVPVGEREGGLVAGFYKERSHEIIDMDACLIQQEKNDDVVQAVKRIVERYGIPSYDELAHRGVLRHIVARYGAATGEVMVVLVTRTNHLPHEQEIVRSIVREIPDVKSIVQNVNPERTNVIFGAKTRVLWGSEFITDRIGGIQFAISARSFYQVNPEQTKVLYDKALEYAELTGRETVIDAYCGIGTISLFLARKAKHVYGVEIVPEAIEDAKRNAELNGIQNVTFEVGAAEDVIPRWYEEGVRADCLVVDPPRKGCDAALLETIIAMKPPRVVYVSCNPATLARDLRILEDGGYETIEVQPVDMFPHTAHVECVAKIRLR

SEQ ID NO: 22688 - protein, 547 aa, Chlamydomonas reinhardtii
MAEKPATVNAELVKEMDAAPKKYPYSLDSEGKANYCPVWRFTQPHMMAFHLSWICFFMSFVATFAPASLAPIIRDDLFLTKSQLGNAGVAAVCGAIAARIFMGIVVDSIGPRYGAAATMLMTAPAVFCMALVTDFSTFACVRFFIGLSLCMFVCCQFWCGTMFNVKIVGTANAIAAGWGNMGGGACHFIMPLIYQGIKDGGVPGYQAWRWAFFVPGGIYILTATLTLLLGIDHPSGKDYRDLKKEGTLKAKGAMWPVVKCGLGNYRSWILALTYGYSFGVELTVDNVIVEYLFDQFGLNLAVAGALGAIFGLMNLFTRATGGMISDLVAKPFGMRGRIWALWIIQTLGGIFCIVLGKVSNSLSSTIVIMIVFSIFCQQACGLHFGITPFVSRRAYGVVSGLVGAGGNTGAAITQAIWFAGTAPWQLTLSKADGFVYMGIMTIGLTLPLFFIWFPMWGSMLTGPREGAEEEDYYMREWSAEEVASGLHQGSMRFAMESKSQRGTRDKRAAGPARVPQQLRLGARCCQARGGLIRCVLAQSLGATGCSD

SEQ ID NO: 22689 - protein, 293 aa, Nostoc punctiforme
MLSQLGATSHLSPHLTFGTISTRTVYQSTKALAEQLKTQPKAEFSLKAFRDRLRWHDSFTQRLYFHPEIAYTNRYREFDKLYTPETLSGAKQELYQAWQQGMTGFPLVDASMRQLQTMGWMNFRMRAMCATFLTINCGVSWHHGAKHYMNYLVDGDLAIDNWQWQMQAGVTNPLSDTFRIYNPSKNIAEKDPLGEFIYHWIPELRGYSLLEIEQEKYIETSNYPKVILDWSKTRKVNGKIVSDLRKQTKQRLLSQGGDEYDSAIAAKETVDKYWQHKDKEYKEYQQKLTELQE

SEQ ID NO: 22690 - protein, 350 aa, Unknown
  Rhodococcus sp. RHA1
MVLVGGQGTRLRPLTLSAPKPMLPTAGLPFLQHLLARIGAAGIRHVVLGTSFKAEVFEEYFGDGSKLGLEIDYVTETEPLGTGGGIRNVLPKLRGDHAMVFNGDVLGGTDLGAILDTHRNRDADVTLHLVRVGDPRAFGCVPTDADGRVTAFLEKTQDPPTDQINAGCYVFKREIIERIPEGRPVSVEREVFPSLLAEDARIYGHVDSSYWRDMGTPEDFVRGSADLVRGIAPSPALDGPRGESLVHPGAGVAPGALLIGGTVVGRGAEVGAGARLDGAVLFDGAVVEAGATVERSIIGFGARIGPRALVRDAVIGDGADIGARCELLRGARVWPGVTLPDGGVRFSTDV

SEQ ID NO: 22691 - protein, 239 aa, Chlamydomonas reinhardtii
AYLFDQFGLNLAVAGALGAIFGLMNIFSRATGGMISDLIAKPFGMRGRLWVLWITQTLGGIFCIIMGKVSNSLTATIVIMIIFSIFCQQACGMHFGITPFVSRRAYGVVSGLVGAGGNVGAAITQAIWFSGTATWQINLSRPDSFVWMGVQAVALTVAVMFIWFPMWGSMFTGPREGVEEEDYYLREWSAEEVAQGLHQGSMRFAMESKSQRGYKDKRMLDAVGETASADVAAVKATVA

SEQ ID NO: 22692 - protein, 356 aa, Vibrio angustum
MSKEKILFIDRDGTLIVEPPVDFQVDRLDKLKFEPNVIPALLALQNAGYKLVMVTNQDGLGTDSYPQADFDAPHNMMMEIFESQGVIFSDVLICPHFDNEGCSCRKPKLGLVKEYLQQGRVDFETSAVIGDRITDLQLAENMAIRGIQYNPEIMNWMQILTDLTTQPRIAEVVRTTKETDIRVKVNLDQTGGNTISTGLGFFDHMLDQIATHGGFQMTLTVDGDLHIDDHHSVEDAALALGEALKKALGDKRGIGRFGFSLPMDECLAQCALDLSGRPYLKFDAQFSRDQVGDLSTEMVPHFFRSLTDTLACTLHLSSTGNNDHHIVESLFKAFGRTLRQAIKVEGNELPSSKGVL

SEQ ID NO: 22693 - protein, 250 aa, Solanum tuberosum
MGKSYPTVSEEYLKAVDKCKRKLRALIAEKNCAPIMLRLAWHSAGTYDVCSKTGGPFGTMRFKAEQAHGANNGLDIALRLLEPIREQFPTLSHADFHQLAGVVAVEVTGGPDVPFHPGREDKPEPPVEGRLPDATKGCDHLRDVFVKQMGLSDKDIVALSGAHTLGRCHKERSGFEGPWTANPLIFDNSYFTELLSGEKEGLLQLPSDKALLCDPAFRLLVEKYAADEDAFFADYAKAHLTLSELGFAEA

SEQ ID NO: 22694 - protein, 412 aa, Unknown
  Frankia sp. CcI3
MPSPRVLGLVLAGGAGRRLAPLTADRAKPAVPFGGLYRLIDFVLSNLVNAGYLRIAVLTQYKSHSLDRHITTTWRMSNLLGNYVTPVPAQQRLGPRWFAGSADAIHQSLNLVYDDAPDIVVVFGADHVYRMDPRQMVAQHLDSGAGVTVAGLRVPRSEGRAFGVIQTAPDGRTIEAFLEKPADPPGLPGSPEETFASMGNYVFSTDVLIDALRKDAADEDSVHDMGGNIIPMLVAQRAAAVYDFAGNVVPGTTVRDRGYWRDVGTVDSYFEAQMDLCALDPVFNLYNREWPILTSIPSLPPAKFVHDGLQRTGTAVNSIVSNGVIISGGTVRSSVLSPGVRVSSWAEVDHTVLMDNVLVGRGAVVRDAILDKNVHVPAGAQVGVDKDRDRARGYTVSEQGITVVGKGVTIAD

SEQ ID NO: 22695 - protein, 430 aa, Geobacter sulfurreducens
MKILFVAPGWPRGRLWGELGFKFPSLALAALAAVTPPEWDAALCDESRETIDFNAPCDLVAITAMTPQAPRAYEIAAGFRARGKTVVMGGFHASNLPDEALGHVDAVVVGEGELSWPLLLADFQAGRLQRLYRSPGLLPMASIPVARREIFAGKGYLLTNTLQTTRGCPFDCEFCSVTAFYGRKYRERPVEAVLAELETLRKANSFAFFVDDNLVADRRYALPLFRGMKGMGFKWLSHAPIDFAGDEELMRAAGESGCIGMFVGFESLDQEALAAMGKVTNSSSAFLDQARKFRDHGIGILGSFVLGYDGDTPDSFGRILRFCEEARIEAAIFPILTPYPGTAVRRRLEAEGRITSNDWRDYDMGHVTFRPTGMTARELQDGHDWLNRSFYSFGSMWRRIGKLHRSVQVFGPMNLGFRSAIRKSDKTKAS

SEQ ID NO: 22696 - protein, 443 aa, Arabidopsis thaliana
MRNLSFIVLFLLTLFFIHHLVDASLLVKSLPGFEGPLPFELETGYVSIGESGDVELFYYFVKSERNPENDPLMIWLTGGPGCSSICGLLFANGPLAFKGDEYNGTVPPLELTSFSWTKVANILYLEAPAGSGYSYAKTRRAFESSDTKQMHQIDQFLRSWFVKHPEFISNPFYVGGDSYSGKIVPGAVQQISLVTHSYIIEQGYVLGNPVTDKNIETNYRVPFAHGMGLISDELFESLERSCGGKFFNVDPSNARCSNNLQAYDHCMSEIYSEHILLRNCKVDYVLADTPNIRTDRRRTYRYFLSAFWANDENVRRALGVKKVPTGKWNRCNSQNIPYTFEIFNAVPYHVNNSLKGFRSLIYSGDHDSMVPFSSTQAWIRALNYSIVDDWRPWMMSSNQVAGYTRTYANKMTFATIKGGGHTAEYTPDQCSLMFRRWIDGEPL

SEQ ID NO: 22697 - protein, 317 aa, Bacteroides thetaiotaomicron
MMAKIANKLTDLVGNTPLMELSGYSGKYGLNQNIIAKLEAFNPAGSVKDRVALSMIEDAEARGALKPGATIIEPTSGNTGVGLAMVATIKGYHLILTMPETMSLERRNLLKALGAQIVLTDGLGGMAASIAKAQELRDSIPGSVILQQFENPSNAAVHERTTGEEIWRDTDGEVAVFVAGVGTGGTICGVARALKKHNPDVHIVAVEPASSPILAGGQAASHRIQGIGANFIPKLYDASVVDEVIGVPDDEAIRAGRELAATEGLLAGISSGAAVYAARQLAQRPEFRNKKIVALLPDTGERYLSTELFAFDAYPLD

SEQ ID NO: 22698 - protein, 238 aa, Unknown
  Nostoc sp. PCC 7120
MTDPMIVSGTANDIDSLRQRLIAGSIQVQQQIILQLADVGNEGLDVLMEFLLKRRENPATWIDGKAYQVLYESDAPQAQEFLQNNFPEGIVTLKSSCGINYNPLQQLLAQQDFQAADLLTIETMCEIAGPMAVKRKWLYFTDVDSFPTDDLQTINQLWIVHSEGKFGFSVQRDIWLSLGKNWDNFWPKIGWKSGNNWTRYPNSFTWDLTAPRGHLPLSNQLRGVRVLASLFAHPAWSK

SEQ ID NO: 22699 - protein, 546 aa, Oceanicola granulosus
MIDLWYKNAVVYCLDVETFMDADGDGVGDFRGLADRLDHLEGLGVTTVWLNPFYPTPNRDNGYDVTDFYGIDPRLGSAGDFVVFLRAARDRGMRVLVDLVANHTSIDHPWFRSARASTDSPYRDWYVWSEEEPEDLTEGIIFPGVQEAVWTWDETAQAWYLHRFYAHQADLNIANPAVREEILRIMGYWLELGVSGFRVDAVPFLVEYKGLKEEPDREPLLLLSEMRDFLSWRRAEAILLAEANVERDRAPLYFGGRAFGEDERMQLLFDFPLNQALWLAFVRHDPAPVVAALRSRPEEDGLQAQWAVFLRNHDELSLDKLGEAEREEVFAACAPDEGMRLYDRGIRRRLAPMLGGDARRVALAQSLLFALPGTPVMWYGDEIGMGEDLDLPERDPVRTPMQWSDEPHGGFSDAAETVRPAVAEGPLGYHETNVTAQEGRPASLLGQVQALVRARRACPAIGWGSWRVIEGLPEGVLGLACAWRGSEVVTLHNFTDRDVQVPLSELGTEPLAQIVGPPDTEPGPVDGHLALRPYDYRWLRAGRTRK

SEQ ID NO: 22700 - protein, 351 aa, Nelumbo nucifera
MACLGGACRLLPAASRAKAYSLPLLSRPPSISLSSVKCLRSSPSAFPLFLNRKFQSRSLVHPPSAGGAVGSPTCFASNPDQLKSAREDIKELLKTKFCHPILVRLGWHDAGTYDKNIEEWPRQGGANGSLRFEIELKHAANAGLVNALKLLQPIKEKYSTVTYADLFQLASATAIEEAGGPKIPMKYGRVDVSDLISRPDQCPPEGKLPDAGPPSPATHLRDVFYRMGLNDKEIVALSGAHTLGRSRPERSGWGKPETKYTKDGPGAPGGQSWTVQWLKFDNSYFKDIKEKRDLDLLVLPTDAVLFEDPSFKVYAEKYAEDQETFFKDYAEAHAKLSNLGAKFDPPEGFST

SEQ ID NO: 22701 - protein, 428 aa, Geobacter sulfurreducens
MSRSPRLLLIYPATHKLGWARYFQLPSHSLQMVAAATPRHWEVILADEVHDEVPFDGTFDLVGITAMTHQATRAYEIADRFRARGVPVVMGGIHPTVLPDEALEHADAVVVGEAEPVWAHLLDDLLAGRLAPVYRAPVPTDEILSAPWPRREILAGRRYLTTQTVQASRGCPYDCSFCTVTPYFGRTFRYRDPDDILAEIRSFRRKLVVFLDDNLLGDPAKARPILRGLAEMNVRWGSQTNLRFAEDPELLKLVADSGCIGLFVGIESVTGAHANMAKSGTRYSQADLMKRVRDAGIILETSIIFGFDDHDESVFETTVRFLEECSPSVPTFHILTPYPGTALFRQFQEEGRLLTTDWSRYDHSTVVFRPRLMSPERLHRGWLEARREAYSWRAIATRVMRNPGRRLTNFAYNMLRKGPNDLLEDGAP

SEQ ID NO: 22702 - protein, 384 aa, Saccharomyces cerevisiae
MTAHTNIKQHKHCHEDHPIRRSDSAVSIVHLKRAPFKVTVIGSGNWGTTIAKVIAENTELHSHIFEPEVRMWVFDEKIGDENLTDIINTRHQNVKYLPNIDLPHNLVADPDLLHSIKGADILVFNIPHQFLPNIVKQLQGHVAPHVRAISCLKGFELGSKGVQLLSSYVTDELGIQCGALSGANLAPEVAKEHWSETTVAYQLPKDYQGDGKDVDHKILKLLFHRPYFHVNVIDDVAGISIAGALKNVVALACGFVEGMGWGNNASAAIQRLGLGEIIKFGRMFFPESKVETYYQESAGVADLITTCSGGRNVKVATYMAKTGKSALEAEKELLNGQSAQGIITCREVHEWLQTCELTQEFPIIRGSLPDSLQQRPHGRPTGDD

SEQ ID NO: 22703 - protein, 189 aa, Bradyrhizobium japonicum
MMNRRTMLIAALAGAVAPVTRAVAGGGMSRISAYAFSFPALSGDDIRLAAFTGKPLLVVNTASLCGYTPQYAGLQELWSEFGERGLTVIGVPSNDFGGQEPGGTSEITETAHHQYGVTFPIAAKATVIGARAHPFYKWAADARPKDVPRWNFHKYLIGRDGYIAEVFASNIEPTDTRIKTAIAKTLADT

SEQ ID NO: 22704 - protein, 195 aa, Ralstonia eutropha
MRVAEVTRNTSETQIRVSLNLDGTGRQKLASGVPFLDHMLDQIARHGMFDLEVEATGDTHIDDHHTVEDVGITLGQAVAKAIGDKKGITRYGHSYVPLDECLSRVVIDFSGRPGLEFHVPFTRARVGSFDVDLTIEFFRGFVNHAGVTLHIDNLRGINAHHQCETVFKAFGRALRMAVELDPRAANTIPSTKGTL

SEQ ID NO: 22705 - protein, 524 aa, Bordetella bronchiseptica
MAPPDHVVPSPANGHRHDARPATRLPEPTSLRRTLSARHLTMIAVGGSIGTGLFVASGATIAQAGPGGALLAYLLVGIMVYFLMTSLGELAASMPVAGSFSTYGAKYVDEGFGFALGWNYWYNWAVTVAVDLVAAQLVMAYWFPEMPGVLWSAAFLALIVGLNALSARGFGEAEFWFALIKVIAVLAFIAMGVLMLLGIIRGGEHGGLAYWTLDDAPFAGGFAALIGVAMVVGFSFQGTELIGIAAGESKDPARNLPRAVRQVFWRILLFYVLAIAVIGLLIPYTDPQLLRNEVSDVSVSPFALIFERAGLLAAASIMNAVVLTSVLSAGNSGMYAATRMLYSLARDGKAPARFGRLSRSGVPLWALLATTAVAALCFLSFLFSPKAVYIWLLNTSGMTGFIAWLGIAISHYRFRRGYVAQGNNLADLPYVSPFFPFGPLFAFVLCLVITLGQNYHAFLQDRIDWTGAAATYVGIPLFLAIWAGYRLVRGSRFVRYRDMQFPDLRMRNRELNAMLSGDCAEPRR

SEQ ID NO: 22706 - protein, 665 aa, Geobacter metallireducens
MCGITGFMDFSLQCGPDAMRANARRMADALMHRGPDDSGAWCDQGAGVGLAHRRLSILDLTPAGHQPMESRSGRFTIVFNGEIYNHQALRKELAAFEPWRGHSDTETLLAGFEAWGIEATLKRTVGMFALAVWDNAERTLTLARDRMGEKPLYYGWNQGVFLFASELKALRAYPGFDAEINRDAIALLMRHSCIPTPHSIYRGIYKLWPGTILTLRNTGRGIAPWDAADPPFKLFQGEGVSLRPYWSLLEAAEQGHARPFEGTESEAIGELERVLTEAVLAQQISDVPLGAFLSGGVDSTAIVALMQAHSSRPVKTFTIGFHEDDCNEAKYAGEIASRLGTDHTELYVSPGDSLAVIPRLPQLYDEPFSDPSHIPTFLVSLLAREHVTVSLSGDGGDELFGGYVRHTLLHRIWNNIGWCPLPMRKALSDKIRFLSPGQLQAVLRNLPFIDRVHAPVYKAYRLAELIRADSPASMYEICISHWQQDDPVVVGGQSPFHASSGRMPRQLDSFSLPEKIMLMDSVTYLPDDILVKIDRAAMGVSLETRVPFLDHRVVEFAWRLPLGLKIRGGQSKWILRQVLNRHIPKELVERPKHGFGIPLGTWLRGPLREWAEELLNESRLLREGFLDPRPVRQKWLEHVSGRRDWEFHLWDVLMFQSWLEQERRP

SEQ ID NO: 22707 - protein, 198 aa, Triticum aestivum
  misc_feature (69)..(69): Xaa can be any naturally occurring amino acid
  misc_feature (110)..(110): Xaa can be any naturally occurring amino acid
  misc_feature (114)..(114): Xaa can be any naturally occurring amino acid
  misc_feature (136)..(136): Xaa can be any naturally occurring amino acid
  misc_feature (141)..(141): Xaa can be any naturally occurring amino acid
  misc_feature (145)..(145): Xaa can be any naturally occurring amino acid
  misc_feature (149)..(149): Xaa can be any naturally occurring amino acid
  misc_feature (152)..(152): Xaa can be any naturally occurring amino acid
  misc_feature (154)..(156): Xaa can be any naturally occurring amino acid
  misc_feature (161)..(161): Xaa can be any naturally occurring amino acid
  misc_feature (173)..(174): Xaa can be any naturally occurring amino acid
  misc_feature (176)..(176): Xaa can be any naturally occurring amino acid
  misc_feature (186)..(187): Xaa can be any naturally occurring amino acid
  misc_feature (190)..(190): Xaa can be any naturally occurring amino acid
IFPGAQPAPHRSFSEEVAALNRYFGGLKSGGNAYVIGDPARPGQKWHVFYATEYPEQPMVNLEMCMTGXLDKKKACVFFKTNADGNTTCAKEMTKLSGISGNIPRDGICXFDFXPCGYSMKCIQWSCILHIHVTPXDGSTXRNYXVMGXDAXLXXXDLSKXLRCFGPKISVPXXFXGVASGMGKDXXKAXLVDKTLKG

SEQ ID NO: 22708 - protein, 410 aa, Unknown
  delta proteobacterium MLMS-1
MSGFAELFEQEGVGGQQLEPGRKIKARVVEVGREWIFIDLGGKSEGSVAKAEFTDPEGNCTVAAGDELEVFFLADKKNEKIFTTKVGGAAAQAHLEEAFHGKVPVEGTVESETKGGFLIRIGGSSRAFCPYSQMDLRRAANPEEYLGQSFSFLIMEFREGGKNILLSRRQLLEQERQELKEQLRQSLKVGDLVTGTVTSVRDFGAFVDIGGIEGLIPISEIGWGRVEDIHSHLEPGRQVEVAVKSLDWDKDRYSLSLKDTLPDPWEQAAVSFPEGSTQRGRVARLTDFGAFVTLAPGVDGLVHISKLGAGRRLNHPREVVQVGDELEVRVEAVDVEQKRISLAVAPPTGSAEPETPDAIPADAPLAAATDKRPAAGDQGGQRPAAAKSQPAMGTLGELLQAKMQDKEGKK

SEQ ID NO: 22709 - protein, 226 aa, Oryza sativa [sequence omitted]

SEQ ID NO: 22710 - protein, 475 aa, Helicobacter pylori
MEHQNTTQKQGELKRDMKMRHLLMIAFGGAIGTGLFVGTGGNIASAGPLGTLIAYCFGGLVVYCIMLSLGELASVYPTTGSFGDYAAKFIGPGTGYMVFWMYWLGWVITVALEYIAIGMLMQRWFVNIPIHYWVISCIALVFLLNFFSVKIFAEGEFFFSLIKVLAVIAFISIGVIGIIYQIYLHGFSSIFDNFHFGDKGFFPNGSEAVFSAMLAVIFAFTGTEVIGVAVGETKNASEVMPKAIKATLWRIVFFFLGSVFVISVFLPMSDSSIAQSPFVSVLERINLPFIGMGIPYVADIMNAVIITAMFSTANSGLYGASRMIYGLSKQKMFFKVFSQLNRQGTPTYAMFFSLSFSLIGLLVQIYAKENVVEALINVISFTVIIVWVSVSISQYSFRKQYLKAGHSLEDLPYKAPFLPFLQLIGITGCIIGVIGSAMDKDQRIGMILTIVFAVVCYIGYYFTQKANENNKKDLI

SEQ ID NO: 22711 - protein, 622 aa, Magnaporthe grisea
MGCIPLDLQTDASNRLYGKLPWWKDAVFYQVYPASFVDSNGDGWGDIPGLVTKLDYLANLGVDCVWLSPVFDSPQADMGYDVSDYQSIYAPYGTVADVDALLAGCHARGMKLILDLVVNHTSVEHSWFKEGRSSRASSKRDWYIWRPARYDPITGGRLPPTNWRGYFAGSTWTWDEQTQEYYLHLYAPEQPDLNWDNEDCRMAIYKDTMNFWLDRGVDGFRIDTVNKYSKRDYVDVPVTDPSSYTQPAPDMWCNGPCIHEYIREMAAETLHRYPGAVSVGELSNMTKGPSQVLEYVSASRSELDMVFEFSAIRLGTGDGFGAKYIYTPFPLSHLKRITETWQAFIEGTDGWTTAFVENHDNGRAVSRFGDDRSPEAWRASARCIALWQATLTGTLFLYQGQEIGMTNMPENWDIDEYKDVESQGFYKEAVGSGDVDSIKKTMHGLRILARDHSRLPMRWDGGAPNAGFGQSTDGCKPWMRVVQDAECRGGGAEVSVAAQTGRKESVLEFYRLVLALRKKHRELMVHGSFRLLDPEDEYIFAYVKEASQGVNAKENDRTVKKCVVVLNFSGEAQECVDVAAAMGCGLTDVRLLVDTIVGEPEDGRVISIPALGAWEGRVYVNF

SEQ ID NO: 22712 - protein, 317 aa, Oryza sativa
MSVQQASESKVAVKPLDLESANEPPLNTYKPKEPYTATIVSVERIVGPKAPGETCHIVIDHGGNVPYWEGQSYGIIPPGENPKKPGAPHNVRLYSIASTRYGDSFDGRTTSLCVRRAVYYDPETGKEDPSKNGVCSNFLCNSKPGDKVKVTGPSGKIMLLPEEDPNATHIMIATGTGVAPFRGYLRRMFMEDVPKYRFGGLAWLFLGVANTDSLLYDEEFTSYLKQYPDNFRYDKALSREQKNKNAGKMYVQDKIEEYSDEIFKLLDGGAHIYFCGLKGMMPGIQDTLKKVAEQRGESWEQKLSQLKKNKQWHVEVY

SEQ ID NO: 22713 - protein, 471 aa, Coccidioides immitis
MPTYALSQAHKDQLEKSLVETDPEVSEIMKREIQRQRESIVLIASENVTSRAVFDALGSPMSNKYSEGYPGARYYGGNQHIDEIEILCQQRALKAFNLDPEKWGVNVQCLSGSPANLQVYQALMRPHDRLMGLDLPHGGHLSHGYQTPQKKISAVSTYFETFPYRVNLDTGIIDYDTLEANAQLYRPKCLVAGTSAYCRLIDYARMRKIADSVGAYLIVDMAHISGLIAAGVIPSPFEYADVVTTTTHKSLRGPRGAMIFFRKGVRSVDPKTGKEIMYDLENPINFSVFPGHQGGPHNHTITALAVALKQAATPEFRQYQEQVVKNAKAVETEFKRLGYKLVADGTDSHMVLLDLRPKALDGARVEAVLEAINIACNKNSIPGDKSALTPCGIRIGAPAMTSRGMGEEDFKRITGYIDRAINICKDIQAGLPKEANKLKDFKAKVATGTVPEIVDLKKEISEWASSFPLPV

SEQ ID NO: 22714 - protein, 705 aa, Mycobacterium smegmatis
MEIWRGKAYPLGATYDGSGTNFALFSEVAERVELCLFDDDGDGGLRETRITLPEVDGFVWHGFIPNIEPGQRYGYRVHGPYDPAAGHRCNPNKLVLDPYAKAIDGQFDWGQPLFSYNFGDPDSRNDDDSAPNMPKSVVINPYFDWGVDRPPSHDYADTVIYEAHVKGLTQTHPDIPDNIRGTYAAVAHPAIVEHLQNLGINAIELMPVHHFANDSTLIDKGLSNYWGYNTIGFLAPDSKYSSSPNPGGQVQEFKAMVRTLHEAGIEVILDVVYNHTAEGNHMGPTLSFRGIDNAAYYRLVDDDKRYYMDYTGTGNSLNVGHPHALQLIMDSLRYWVIEMHVDGFRFDLASTLAREFYDVDRLATFFELVQQDPVVSQVKLIAEPWDVGPGGYQVGNFPPLWTEWNGKYRDTVRDYWRGEPATLDEFASRITGSADLYEQTGRRPFASINFVIAHDGFTLRDLVSYNEKHNEANGEDNNDGESHNRSWNCGAEGPTDDPEVNALRSRQQRNFITTLLLSQGVPMLAHGDELGRTQQGNNNVYCQDSELSWIDWESADTELLEFTQKVSALRSAHPVFRRRRFFNGRPVRRPGEPRLPDIGWYAPDGSEMTDEDWDAGYAKSMAVYLNGQGIPDRDERGQRIVDDSFYMCFNAHYEPIEFVLPPSDFAEQWVEVINTAADCGTDPIEAGTRVTVESRAMLVLQAHHD

SEQ ID NO: 22715 - protein, 87 aa, Arabidopsis thaliana
AGVLYAPGKASNAGGVATSGLEMSQNAMRLTWTRAEVDQKLHGIMKSIHAACVQHGKRADGTVSYIDGANIAGFVKVAEAMLAQGVL

SEQ ID NO: 22716 - protein, 449 aa, Alkalilimnicola ehrlichei
MAARLDEKLEPIFQDVLRRNPGESEFHQAVHEVLETLGPVLVKYPELAERKIIQRICEPERQIIFRVPWQDDRGETHINRAFRVEFNSALGPYKGGMRFHPSVYLGIIKFLGFEQIFKNALTGLPIGGGKGGSDFDPKGKSEDEIMRFCQSLMTELYRHLGEYTDVPAGDIGVGQREVGFLFGQYKRITNRYESGVFTGKGLSWGGSRARKEATGFGTVYFLEEMLKARNDGLEGKTCVVSGSGNVAVYAMEKIYELGGKVIACSDSSGIVVDEKGIDLDRVKRIKEVERRRISTYADEVKHAKYIEDGNIWAVPCEAALPCATQNELNGKDAKKLLQNGCIAVAEGANMPSTPEAIRLFLESGIAYGPGKAANAGGVATSALEMQQNASRDSWTFEHTEQRLHEIMKNIHRNCYETADEFGAPGNYVTGANIAGFLKVSQAMEAMGLI

SEQ ID NO: 22717 - protein, 461 aa, Glycine max
  misc_feature (118)..(118): Xaa can be any naturally occurring amino acid
MEGGGRRITVSPRPCCGRRVVAKKRPRLVDGFVNSVKKLQRREISSNRDRAFSMTDAQERFRNIRLQEEYDTHDPKGPSSAVLQFLRKRSKIIEIVAARDIVFALAQSGVCAAFSREXNERICFVNVRPSGQASDNYSSLKCRSTRIEYIRRVKPDAGFALFESESLKWPGFVEFDDVNGKVLTYSAQDSIYKVFDLKNYSMLYSISDKNVQEIKISPGIMLLIFTKSSSHVPLKILSIEDGTVLKSFNHLLHRNKKVDFIEQFNEKLLVKQENENLQILDVRTSELTEVSRSEFMTPSAFIFLYENQLFLTFRNRTVAVWNFRGELVTSFEDHLLWHPDCNTNNIYITSDQDLIISYCKADSDDSLSEGNAGSINVSNILTGKCLAKIRASNSFPVDNNCSCSDKPSRSYCCNSKKRKHGSKMRSTVAEALEDITALFYDEERNEIYTGNRLGLVHVWSN

SEQ ID NO: 22718 - protein, 508 aa, Haemophilus influenzae
MNAFKKSLIVAASFASLSLFNSATAELVYKPLEQPVEPAKPDLKIESVNEKFAEKYPNQYNSWRSTANGDGENIIYADEENPRLIVLWGGYAFAKEYNAPRGHFYAVTDVRNILRTGAPKTANDGPQAMACWTCKGPDVPRLIAEWGEKDYFNAKWAKGGPEIVNSIGCADCHDTTSKDFAEGKPALRIARPHVLRALDALEKATAEKDKAEGRPHNNLSFNTAARTEKRAEICANCHVEYYFAGDIKQVTFPWDNGQTVDDIEKYYDDIGFTDWTHSLSKAPMLKAQHPDFEIWSLGMHGKNGVTCVDCHMPKVQGADGKVYTDHQIQNPFEAFDSTCANCHDQSKEKLRDIVTSRKKEVKDVMGRLEDQVVKAHFEAKEAWDAGATKKEMEAALMDIRHAQWRWDYTAASHGGHMHAPEVVLRVLASGLDKVADARTKLAVILTKHGVKTPVQIPDISTADKAWKVMGIDIEKERKAKEEFLKTVVPQWEQQAREKGLLVDPPAQK

SEQ ID NO: 22719 - protein, 260 aa, Pyrobotrys stellata
MAALVANKAALGFRAPAQARRSVVARAEQRASWFPGNPAPEYLKGELAGDYGFDPLGFGDEPRRLEWMVQAELVHCRWAMLGAAGILLPEIGNKTGMQSAAPGLAFPHWWEAGKVVAESGPWSMGSLTFTMFLLMGWAEHKRLYDFVKPGSQAVGWAWAPLGLGSITGVEEPLVAKENGYPGGIFDPFQMSKNEAKYKWYKQSEVTNGRLAMTAMFGFVSQHIAYPGKGPIDNLVDHVSNPTKVTFATNGVSVPHFIEYH

SEQ ID NO: 22720 - protein, 186 aa, Pennisetum glaucum
MAKCYPTVSAEYQEAVEKARRKLRALIAEKSCAPLMLRLAWHSAGTFDVSTKTGGPFGTMKNPAEQAHGANAGLDIAVRMLEPVKEEFPILSYADLYQLAGVVAVEVTGGPEIPFHPGREDKPQPPPEGRLPDATKGSDHLRQVFGKQMGLSDQDIVALSGGHTLGRCHKERSGFEGPWTRNPLVF

SEQ ID NO: 22721 - protein, 592 aa, Oryza sativa
  misc_feature (547)..(547): Xaa can be any naturally occurring amino acid
MEETPLPSGKNFRSQLAAAARSINWTYAIFWSISTSRPGVLTWKDGFYNGEIKTRKITNSMNLTADELVLQRSEQLRELYDSLLSGECGHRARRPVAALLPEDLGDTEWYYVVCMTYAFGPRQGCVWLPGKSFASNEFVWLTNAQSADRKLFHRALIAKSASIKTIVCVPFIMHGVLELGTTDPISEDPALVDRIAASFWDTPPRAAFSSEAGDADIVVFEDLDHGNAAVEATTTTVPGEPHAVAGGEVAECEPNADNDLEQITMDDIGELYSLCEELDVVRPLDDDSSSWAVADPWSSFQLVPTSSPAPDQAPAAEATDVDDVVVAALDSSSIDGSCRPSPSSFVAWKRTADSDEVQAVPLISGEPPQKLLKKAVAGAGAWMNNGDSSAAAMTTQGSSIKNHVMSERRRREKLNEMFLILKSVVPSIHRVDKASILAETIAYLKELEKRVEELESSSQPSPCPLETRSRRKCREITGKKVSAGAKRKAPAPEVASDDDTDGERRHCVSNVNVTIMDNKEVLLELQCQWKELLMTRVFDAIKGVSLXCPLGAGINIGWSPWTEDTSQVCLICCRRTWDDYRSSPESYSKLAS

SEQ ID NO: 22722 - protein, 1087 aa, Pseudomonas fluorescens
MCAERRFRQPGNRRYYMKRMLINATQPEELRVALVDGQRLYDLDIESGAREQKKANIYKGRITRIEPSLEAAFVDFGSERHGFLPLKEISREYFKKAPEGRVNIKDVLSEGQEVIVQVEKEERGNKGAALTTFISLAGRYLVLMPNNPRAGGISRRIEGEERNELREALNGLVAPADMGLIVRTAGLGRSSEEMQWDLDYLLQLWTAIKEASLDRSAPFLIYQESNVIIRAIRDYLRQDIGEVLIDSVEAQDEALTFIRQVMPQYASKIKLYEDSVPLFNRFQIESQIETAFQRVVELPSGGSIVIDPTEALVSIDINSARATKGSDIEETALQTNLEAAEEIARQLRLRDIGGLIVIDFIDMTPAKNQRAVEEKVRECLEADRARVQIGRISRFGLLEMSRQRLRPSLGESSGIVCPRCNGTGIIRDVESLSLAILRLIEEEALKDRTAEVRAQVPIPVAAFLLNEKRNSITKIELRTRARIVILPNDHLETPHFEVQRLRDDSPEANTNQSSYEIAAAAAEAEEVQPTAATRTLVRQEAAVKTAPARANAPVPTEVVAAPVAAPAPVAEPSLFKGLVKSLVSLFATKEEPAAPVVVEKPVTERPARSNEEQRRNGRQQSRNRNGRRDEERKPREERAPREERAPREERQPREVREAREEVQAVAREERAPRAPREERQPRAPREERKPRGEREERVRELREPLDAAPAAAAATAAVVAEERPARQPREERQPRAPREERQPRAEQAQAAAASEEEALPNEEQLQEDGQDNAEGERPRRRSRGQRRRSNRRERQRDANGNVIEGSEENAEEPSSADLAAGLAVTAAVASTAISANAEAEAHQQAERATAAVEDKAPEAPVVEATTPVEAPVVPAVEVAPVAEEQAQVEVAAEPAVVVEAQPVVAEQPAAEPVAQAPVVEEKAIEPVQEAPAPAPVAEPALVVEEPVAAQQPAQVEEPAPVAAPVVAEEPAPAVEAEAAPVSTLTSNGRAPNDPREVRRRKREAERLQKEAELAAAAPAEAVVTAEPAPVEAPEVVEAAPAPAEETAPAPVAEPAVKESAPVAEQAPRAVEHAVHAEEEQHEPKPLV

SEQ ID NO: 22723 - protein, 1045 aa, Cellulomonas fimi
MLRQVPRTLVAGGSALAVAVGVLVAPLATGAAAAPTYNYAEALQKSMFFYQAQRSGDLPADFPVSWRGDSGLTDGADVGKDLTGGWYDAGDHVKFGFPMAFSATMLAWGAIESPTGYSKAGSLDELKDNLRFVSDYFVKAHTAPNELYVQVGDGEADHKWWGPAEVMTMARPSHKISASCPGSDVAAETAAALASSAIVLKGDDPAYAATLVSHAKQLYTFADTYRGAYSDCVTAASAYYKSWSGYQDELVWGAYWLYKATGDATYLAKAEAEYDKLGTENQSTTRSYKWTIAWDNKQFGTYALLAMETGKQKYVDDANRWLDYWTVGVNGQKVPYSPGGQAVLDSWGALRYAANTSFVALVYSDWMTDATRKARYHDFGVRQINYALGDNPRSSSYVVGFGANPPTAPHHRTAHGSWLDSITTPAQSRHVLYGALVGGPGSPNDAYTDSRQDYVANEVATDYNAGFTSALARLVEEYGGTPLASFPTPEQPDGDQLFVEAMLNQPPSGTFTEVKAMIRNQSAFPARSLKNAKVRYWFTTDGFAASDVTLSANYSECGAQSGKGVSAGGTLGYVELSCVGQDIHPGGQSQHRREIQFRLTGPAGWNPANDPSYTGLTQTALAKASAITLYDGSTLVWGKEPTGTTTDTTPPTTPGTPVATGVTTVGASLSWAASTDAGSGVAGYELYRVQGTTQTLVGTTTAAAYILRDLTPGTAYSYVVKAKDVAGNVSAASAAVTFTTDTTGETEPPTTPGTPVASAVTSTGATLAWAPSTGDPAVSGYDVLRVQGTTTTVVAQTTVPTVTLSGLTPSTAYTYAVRAKNVAGDVSALSAPVTFTTAAPPVDTVAPTVPGTPVASNVATTGATLTWTASTDSGGSGLAGYEVLRVSGTTQTLVASPTTATVALAGLTPATAYSYVVRAKDGAGNVSAVSSPVTFTTLPVTSTPSCTVVYSTNSWNVGFTGSVKITNTGTTPLTWTLGFAFPSGQQVTQGWSATWSQTGTTVTATGLSWNATLQPGQSTDIGFNGSHPGTNTNPASFTVNGEVCG

SEQ ID NO: 22724 - protein, 218 aa, Medicago sativa
MDHDAIIFEEECDYLFKAVLIGDSGVGKSNLLSRFAKDEFRLDSKPTIGVEFAYRNIKVRDKLIKAQIWDTAGQERFRAITSSYYRGALGALLVYDITRRSSYESVGRWLVELREFGGEEMVVILVGNKCDLGESREVEEEEAKGFAEAEGLCFMETSALKNLNVEQVFLQMITTIFDITNQRSLDAKMDETPINLSNGKEIHIADEVTATKQAPCCS

SEQ ID NO: 22725 - protein, 442 aa, Ostreococcus tauri
MTDVLTSDAPRAQGLRAYYDAKIEQLEVALRDKTMNLRRLEAQRNALNGRGASWARDDAYIVRATSFVGRARAMGEREGEFLGDRAERRLTSLREELHMLQEPGSYVGEVVKVMGKKKVLVKVHPEGKYVCDMDKSIDVTKLTPGTRVALRNDSYTLHVILPSNIDPLVSLMKVEKVPDSTFDMIGGLDQQVKEIKEVVELPIKHPELFDSLGIAQPKGVILYGPPGTGKTLLARAVAHHTDCCFIRVSGSELVQKYIGEGARMVRELFVMAREHAPSILFMDEVDSIGSARDSGGGGGGGDSEVQRTMLELLNQLDGFEATNQIKVIMATNRLDILDQALLRPGRIDRKIEFPNPSEESRVDILKIHSRKMNLVRGIDLKKIASKMGGASGAESKAVCTEAGMFALRERRVHVTQEDFEMAVSKVMKKDSEKNISIKKLFS

SEQ ID NO: 22726 - protein, 111 aa, Arabidopsis thaliana
MDVRGDHNRKNTSFRGSAPAPIMGKQELFRTLSSQNSPRRLISASYFSLESMVVLVGLTASLLILPLILPPLPPPPFMLLLIPIGIMVLLMVLAFMPSSNSKHVSSSSTFM

SEQ ID NO: 22727 - protein, 166 aa, Sulfurospirillum barnesii
ACWSCKSPDVPRLIEEDGELEYFTGKWAKYGSQVVNSIGCANCHDDKTAELKATVPQLNRALVAAGLKPFEESTHQEKRSLVCAQCHVEYYFKKTEWKDAKGVDKTAMVVTYPWANGIGKEENSGTEGMIKYYDEIGFSDWTHNISKTPMLKAQHPDYEFWKTGIH

SEQ ID NO: 22728 - protein, 272 aa, Sorghum bicolor
GVFQDVDWALLIGAKPRGPGMERAALLDINGQIFADQGKALNAVASRNVKVLVVGNPCNTNALICLKNTPNIPAKNFHALTRLDENRAKCQIALKAGVFYDKVSNVTIWANHSTTQVPDFLNAKIDGRPVKEVIQDTKWLEEEFTMTVQKRGGVLIQKWGRSSAASTAVSIVDAIKSLVTPTPEGEWFSTGVYTTGNPYGIAEDIVFSMPCRSKGDGDYQLATDVSMDDFLWERIKKSEAELLAEKKCVAHLTGEGDAFCDLPEDTMLPGEN

SEQ ID NO: 22729 - protein, 179 aa, Sulfurospirillum barnesii
ACWSCKSPDVPRLIEEDGELEYFTGKWAKYGSQVVNSIGCANCHDDKTAELKATVPQLNRALVAAGLKPFEESTHQEKRSLVCAQCHVEYYFKKTEWKDAKGVDKTAMVVTYPWANGIGKEENSGTEGMIKYYDEIGFSDWTHNISKTPMLKAQHPDYEFWKTGIHGQKGVSCADCHMP

SEQ ID NO: 22730 - protein, 741 aa, Haloarcula marismortui
MNEVQLEVAKAYPNDSGRGIARLDPDTLLHLKLSPGDIIEIEGSDTTAAKVWRADRQDWNTDTVRIDGFTRQNADVGIGERVTIRKAEAEKADKLVLAPPEEASVQFGSDAAGMVKRQILKRPVVERDIVPVMSSTNHPFMRSPGQAIPLIAVETEPEGVCLITEDTEVELREEPISGFEKTGGGITYEDIGGLQNEIQRVREMVELPMKHPQIFKKLGIEPPQGVLLHGPPGTGKTLLAKAVANETSASFFSIAGPEIISKYYGESEQQLREIFEDASEESPSIIFIDELDSIAPKREDVTGEVERRVVAQLLTMMDGLESRGQVIVIAATNRVDSVDPALRRPGRFDREIEIGVPDEVGREEILQIHTRGMPLSDDVNLAKLATDTHGFVGADIESLTKEAAMKALRRYLPEIDLDEEDIPPSLIDRMIIKRDDFKGALNEVSPSAMREVLVELPKMSWDNVGGLSGPKEQVQEAVEWPMNSPEKFERMGVTPPSGVLLYGPPGTGKTLMAKAVANETDANFISVRGPQLLSKWVGESEKAIRQTFRKARQVAPTIIFFDELDSLAPGRGGEMGSNVSERVVNQLLTELDGLEEMEDVMVIGATNRPDMIDPALIRSGRFDRLVMIGEPDIEGREQILKIHTDDTPLSPDVSLRELAEVSDGFVGSDLESIAREAAIEALREDDNAEEVEMRHFRQAMDSVRPTITDDIREYYEQMEEEFRGGSSPQRQAGTGGRIGFQ

SEQ ID NO: 22731 - protein, 167 aa, Desulfovibrio vulgaris
MMEWFPESGDGFWAKDVNEFRDKIDMKDHTIGCATCHDPQTMELRITSVPLTDYLVSQGKDPKKLPRNEMRALVCGQCHVEYYFNGPTMGVNKKPVFPWAEGFDPADMYRYYDKHGDLQVKGFEGKFADWTHPASKTPMIKAQHPEYETWINGTHGAAGVTCADCHM

SEQ ID NO: 22732 - protein, 919 aa, Neisseria meningitidis
MKRMLFNATQAEELRVAIVDGQNLLDLDIETLGKEQRKGNIYKGIITRIEPSLEACFVDYGTDRHGFLPFKEVSRSYFRDYEGGRARIQDVLKEGMEVIVQVEKDERGNKGAALTTFISLAGRYLVLMPNNPRGGGVSRRIEGEERQELKAAMAELDIPNGMSIIARTAGIGRSAEELEWDLNYLKQLWQAIEEAGKAHHDPYLLFMESSLLIRAIRDYFRPDIGEILVDNQEVHDQVAEFMSYVMPGNVGRLKLYQDHTPLFSRFQIEHQIESAFSRSVSLPSGGAIVIDHTEALVSIDVNSARATRGSDIEDTAFKTNMEAAEEVARQMRLRDLGGLVVIDFIDMENPKHQRDVENVLRDALKKDRARVQMGKLSRFGLLELSRQRLKPALGESSHVACPRCAGTGVIRGIESTALHVLRMVQEEAMKDNTGEVHAQVPVDVATFLLNEKRAELFAMEERLDVNVVLIPNIHLENPHYEINRIRIDDVEEDGEPSYKRVAEPEEDESAKPFGSEKAKASRPEPAVKGVRHTQPAPTVAPEKKASWWDSFKAWLKRIFGGSETQAAPAAETSEKRSTANRSGSRANNRRQNPRRSKREGSKVEVREVAGKTAGQEARADKAETRNNGNRRRNERGDRAAGRADEAEIQDRNIQPAATVADAAPSETEVQTGKRRRNGSRSERGQTAPETATVAETTVQTAENTPSEPHTAEDKGSKPKSERNRRERDSRDAKERRERNNQRDRRQNGKKRNIPSAAKIEQYLNIHDTADKVRSAAAHVFGETDANAPITVSIADPVAERDLPTASPAVSNGDAPVYDAAEKIRRATAAILPEGATPKAEAQEMPSETATFTAAAEQARETAQTGGLVLIETDPAALKAWAAQPEVQAGRGLRRSEQPKPSEVATVPAEEMIQVETRQG

SEQ ID NO: 22733 - protein, 169 aa, Streptococcus agalactiae
MERAIFAGGCFWCMVQPFEELDGIESVLSGYTGGHVENPTYKEVCSKTTGHTEAVEIIFNPEKISYANLVELYWAQTDPTDAFGQFEDRGDNYRPVIFYENEEQRQIAQKSKDKLQASGRFDRPIVTSIEPADTFYPAEDYHQAFYRTNPARYALSSARRHAFLEENWH

SEQ ID NO: 22734 - protein, 317 aa, Unknown
  Marinobacter sp. ELB17
MSTSTHSRLIILGSGPAGYTAAVYAARANLKPTLITGIEVGGQLTTTTDVDNWPGDNDGVQGPELMQRMLKHAERFETKIIYDTVNEVDLNQRPFRLKGDSGEHTCDALIISTGASAMYLGLESEEKFKGQGVSACATCDGFFYRNQKVAVIGGGNTAVEEALYLSNIAAEVTLVHRRDSLRAEKILQDKLFEKAANGNVRIIWDHTLDEVLGDGTGVTGMRIRSMKDDSKQDMDLSGVFIAIGHKPNTSLFEGQLEMTNGYLHIRSGLDGMATQTTVPGVFAAGDVADHVYRQAVTSSGFGCMAALDAERYLDQLS

SEQ ID NO: 22735 - protein, 476 aa, Mycobacterium tuberculosis
MVLRSLASPAALTDPKRCASVVGVAAFAVRREHAPDALGGPPGLPAPRGFRAAFAAAYAVAYLAGGERRMLRLIRRYGPIMTMPILSLGDVAIVSDSALAKEVFTAPTDVLLGGEGVGPAAAIYGSGSMFVQEEPEHLRRRKLLTPPLHGAALDRYVPIIENSTRAAMHTWPVDRPFAMLTVARSLMLDVIVKVIFGVDDPEEVRRLGRPFERLLNLGVSEQLTVRYALRRLGALRVWPARARANTEIDDVVMALIAQRRADPRLGERHDVLSLLVSARGESGEQLSDSEIRDDLITLVLAGHETTATTLAWAFDLLLHHPDALRRVRAEAVGGGEAFTTAVINETLRVRPPAPLTARVAAQPLTIGGYRVEAGTRIVVHIIAINRSAEVYEHPHEFRPERFLGTRPQTYAWVPFGGGVKRCLGANFSMRELITVLHVLLREGEFTAVDDEPERIVRRSIMLVPRRGTRVRFRPAR

SEQ ID NO: 22736 - protein, 204 aa, Desulfovibrio vulgaris
MKKYRDHYFLKAKQENYPARSVYKLKEIDNRFKIFRQGMKVLDLGAAPGSWSLGAAEKVGPRGRVLACDLQETDTVFPDNVTFMQENVFERSEAFENLLDEIAPFDVVISDMAPRTTGTRFTDQARSLELCLEALAVADRCLIKGGSFVVKIFMGPDVQELVQAMRQRFSAVKSFKPKSSRAESKETFYVCLGYRGVETSDTDK

SEQ ID NO: 22737 - protein, 223 aa, Triticum aestivum
PSGNACGDIQLQVLSTEKNVRSKFLNGITSAKVAGQIMDNALRFADSSSLRSSDPGKDLLVVAQTTADRKCKSSALENNAVMENNLSENSKGTATGHAESCPSHFVEINLEKQHHLNGYTNHKLNEKDIFNHSNSSAFSRYGNKRIESSAQRPFPPSFRVVHQQPVYDKNPQSSRVLLSCEHNTRESTVQAQVPLDRSTEGAAILCSSSVREDAGTSSSSPRK

SEQ ID NO: 22738 - protein, 166 aa, Clusia uvitana
GNPCNTNALICLKNAPNIPAKNFHALTRLDENRAKCQLALKAGVFYDKVSNMTIWGNHSTTQVPDFLNARINGLPVKEVIKDHKWLEEEFTEKVQKRGGVLIQKWGRSSAASTAVSIADAMKSLVNPTPEGDWFSSGVYTNGNPYGIEEDIVFSMPCRSKGDGDYE

SEQ ID NO: 22739 - protein, 72 aa, Unknown
  Marinobacter sp. ELB17
MAKTDVIEMEGVIIDTLPNTMFRVELSNGHVVTAHISGKMRKNYIRILTGDKVKVELTPYDLSKGRIVYRAR

SEQ ID NO: 22740 - protein, 334 aa, Arabidopsis thaliana
MDAKETSATDLKRPREEDDNGGAATMETENGDQKKEPACFSTVIPGWFSEMSPMWPGEAHSLKVEKVLFQGKSDYQDVIVFQSATYGKVLVLDGVIQLTERDECAYQEMITHLPLCSIPNPKKVLVIGGGDGGVLREVARHASIEQIDMCEIDKMVVDVSKQFFPDVAIGYEDPRVNLVIGDGVAFLKNAAEGSYDAVIVDSSDPIGPAKELFEKPFFQSVARALRPGGVVCTQAESLWLHMDIIEDIVSNCREIFKGSVNYAWTSVPTYPSGVIGFMLCSTEGPDVDFKHPLNPIDESSSKSNGPLKFYNAEIHSAAFCLPSFAKKVIESKAN

SEQ ID NO: 22741 - protein, 181 aa, Lactobacillus sakei
MLEQDIERILYTREDIQRVNEKLGKQITADYQGKNPLMIGILKGAIVFMTDLIREIDLHVEIDFMDVSSYGDGTISSGEVKIIKDLDTSVQGRDIIIVEDIVDTGRTLNYLMAILKTRQANSIKVCTLMDKPSRRVVPVHSDYVGMEVPNEFVVGYGLDYAERYRNMGTIGVLKPEIYSGK

SEQ ID NO: 22742 - protein, 147 aa, Lactobacillus sakei
MAVEVGSKVPGKVTGITNFGAFVDLGEGKTGLVHISEVSDSYIKDIHDVLTVGDEVTVKVMSDQNGKIGLSIRKAVDQPKVQEHTRPQSSRPNNNRGGYRKPEHTSAPKKEGFDDLLSGFLKDSEDRLSTIKRNTEGKRGGRGGRRS

SEQ ID NO: 22743 - protein, 905 aa, Colwellia psychrerythraea
MSDLLPTSPLTSPVIKTGEPSLIQSTCAYCGVGCGVDIGVADGKATSLVGSAAHPSNYGRLCVKGSNLLNTIDLTGRLLSPEIAGEQVSWDKATDYVAEQFNDIIKKYGKDSVAFYVSGQLLTEDYYIANKLMKGYIGSGNIDTNSRLCMSSAVSAYKRAFGEDVVPCTYQDLEETDLLLLTGSNAAWTHPVLYQRIERAKKINPAMKVVVIDPRKTATCELADNFIQLKPGTDAAFFNGLLHFLSENQGLDTDYIAQHTEGFEQALTQATSWTVTKVAEFCQVSIEELTTVYQLFCSSEKAITFYSMGINQSSSGVDKCQTIINCHLASGKIGKAGSGPFSITGQPNAMGGREVGGLANQLAAHMDIDNPQHQDKVQRFWQSPTIANKQGAKAIDLFDKLASGEIKAVWIMATNPVVSLPNRAKITAALKKCELVVVSDCVEQNDTLAFADVKLPATPWLEKNGTVTNSERRISRQRNAVLPAGQAKHDWQIIQDVATKMGFSGFDFDDVSDVFKEHAQLTQFENDGERLLDLSGLSQLTAKEYNELAPIQWPVNDANPEGCARVYADGKFNTPSGKAKFIPVKPQLPLQKTSAEFPFVLNSGRLRDQWHTMTRTGKTNKLSKHTDKPYLYLHPTDAKALAVQNDDMLSITASTGQAIAHVKVDAKQRLGECFMPIHWNQNYASHGNVSDLYQSIVDPLSGQAESKQGAVALGKKTYKQYISVHTTSKITLSADFWVKSTTAYGDSYQVALDEPTIDALLLCQQISGLSGEWLTFIQDNQSYVVCLQAGKLAFLGYFSATWPEIEQSWLEHVFGSKTLEFATIQSLLLGISSDEFNQGKQVCSCYSVGEKTINEAIAQGCGSVEALGEKLQCGTKCGSCKPELASLISQYNADPIETAIVLAED

SEQ ID NO: 22744 - protein, 246 aa, Triticum aestivum
  misc_feature (52)..(52): Xaa can be any naturally occurring amino acid
  misc_feature (73)..(73): Xaa can be any naturally occurring amino acid
  misc_feature (133)..(133): Xaa can be any naturally occurring amino acid
  misc_feature (184)..(184): Xaa can be any naturally occurring amino acid
  misc_feature (193)..(193): Xaa can be any naturally occurring amino acid
  misc_feature (222)..(222): Xaa can be any naturally occurring amino acid
MARRPARCYRYCKNKPYPKSRFNRGVPDPKIRIFDLGRKRAKVDDFPLCIHXVSNEYEQLSSEALEAARICAXTSTFVKVRPERRGFPPMRNPAHPLSTVWSRYSTKDCCSLPPWLPGLELADLGIAVGAWGXKPQRALVARLFNLARILLSVRTRDSNRAIALEALRRSMYKFPGRQKIIISXNWGFTPLRXREEYLEKKAAGRVKVDGAYVQFLRHKGKXAENMRRSPALWPRPSKEAPYAFLR

SEQ ID NO: 22745 - protein, 462 aa, Geobacillus kaustophilus
MTDSGKQSFITDIHQLDKKGAGQAVVWQEEEGRRKKLKLTVPSTLPGEKVRVLIDWPKRRRAHARVEEVIEPHPERLAPSCPHFDRCGGCVWQHWRYEGQLRHKTEHVKTLLKEHGFDPGVVRDTIGMEHPWHYRNKMEFTFSPEGLLGLHERGNFRQVISLETCLIAGEKIVKAAMEVARWARDHRLPGYHKDTHEGLLRHLMVRESFATGEVMVALFATEAPEGDLKEAAADLTERITKMLPQVKSLLWLENRAWADRTQAEQTHVLAGRDFIYDELCGFRYRLWFDTFFQTNPVQAAKLVELALEMGKPQPHENMIDLFCGVGTFSLPFAKRVKALAGIEIVETSIESAKRNAKDNGIDNTYFLARDARRGIDEVLEQFGRPELLLLDPPRSGAGGKVMRKIGRARPERVVYVSCNPETFASDITELVSFGYTLKTVQPVDMFPHTAHVECCALLVRGS

SEQ ID NO: 22746 - protein, 291 aa, Staphylococcus aureus
AVYASRANLKTVMIERGIPGGQMANTEEVENFPGFEMITGPDLSTKMFEHAKKFGAVYQYGDIKSVEDKGEYKVINFGNKELTAKAVIIATGAEYKKIGVPGEQELGGRGVSYCAVCDGAFFKNKRLFVIGGGDSAVEEGTFLTKFADKVTIVHRRDELRAQRILQDRAFKNDKIDFIWSHTLKSINEKDGKVGSVTLTSTKDGSEETHEADGVFIYIGMKPLTAPFKDLGITNDVGYIVTKDDMTTSVPGIFAAGDVRDKGLRQIVTATGDGSIAAQSAAEYIEHLNDQA

SEQ ID NO: 22747 - protein, 85 aa, Escherichia coli
DVREALSSIGIQGLTVTEVKGFGRQKGHAELYRGAEYSVNFLPKVKIDVAIADDQLDEVIDIVSKAAYTGKIGDGKIFVAELQRV

SEQ ID NO: 22748 - protein, 189 aa, Aspergillus nidulans
MRRQSKLSPTQLEELQKATHFDKKELQQWYKGFLKDCPSGQLTKEEFQDIYRKFFPFGDPSSFANYVFRVFDSDNSGMIDFKEFICALSVTSRGRMEDKLDWAFQLYDIDGDGKITYDEMLAIVEAIYKMVGSMVKLPEDEDTPEKRVRKIFRMMDKDENGSLDMEEFKEGSKRDETIVSALSLYDGLV

SEQ ID NO: 22749 - protein, 189 aa, Lactobacillus acidophilus
MSKGDNINDIIDHKLFSEKDIHEMCVRLGKQLTEDYAGKKPLVVGALKGAIYFLTDLTRQMDVAHQLDFLDVSSYGDGFESSGKIKVVTDLAADVKDRDVLIVEDIVDTGLTLKFMKDLIKERGAKSVKCCAMLNKEARRNVDVDVDYFGSEVGNEFVVGYGLDFLNMYRNLPYVGVLKSEVIQKYVNK

SEQ ID NO: 22750 - protein, 136 aa, Shewanella oneidensis
MSQLLHTMIRVGNLERSIAFYTQVLGMKLLRTSENPEYKYSLAFVGYGEESTGQAVIELTYNWGTEKYDLGTGFGHIAIGDDDIYARCEAIAAAGGKVTRAPGPVAGGTTEIAFVEDPDGYKIEFIQMKSATQGLG

SEQ ID NO: 22751 - protein, 300 aa, Mycobacterium smegmatis
MTGRVTVLTNPMSGHGNAPHAAERAVVRLQQRGVDVTAIVGRDARHARELVREHLDRGTDALVVVGGDGVIGLALQELAGTDVPLGIVPAGTGNDHAREYRIPTGDPEAAADVIADGHTRTVDLGRIDADDGTRRWFGTVVATGFDSLVSDRANRMSWPHGRMRYNLAMVAELSKLRLLPFRLSFDGGDAEDHALTMTAIGNTRSYGGGMLICPGADPTDGLLDITMIASASRSRLIRLFPTVFKGTHVNLDTVTTRRARSVRVECPGINAYADGDFAAPLPATITAVPGALKILTSAPG

SEQ ID NO: 22752 - protein, 321 aa, Triticum aestivum
RPGRGSHVRATQTKRLVRPFLSLPPPPIDQGQLALSLVGGMQEPGRRPFAGAVDLRRPKGYPAPLAAQAQAEAVAELATGEAHGDPCPRCESRDTKFCYYNNYNTSQPRHYCKSCRRYWTKGGTLRNVPVGGGSRKSSSSSSSSSSSPKRAKNSKRRRVAPAAPLEPEAEPGADAPAAVATTTKEAAATEDVTTAGDTAAAPAADGCFAFTAGEPDAPPAADRCFTFTSGEPDAPPAADGDGCFAFTAGEPDVPPAAKGDGGLAFTDHPSVALGLGVADDAGGKELADPSPFEWPSGCDLGSYWVAGVFADTDPALFLSPP

SEQ ID NO: 22753 - protein, 426 aa, Clostridium thermocellum
MHKKEIIALLLAGGQGSRLGVLTKNIAKPAVLYGGKYRIIDFSLSNCVNSDIDTVGVLTQYQPLELNAHIGIGKPWDMDRINGGVTILSPYLKAEIGEWYKGTANAVFQNIHYVDKYSPKYVIILSGDHVYKMNYSQMLDFHKENNADATISVINVPWEEASRYGIMNTYENGKIYEFEEKPQNPKSNLASMGVYIFNWEVLKEYLIRDDQNEESAHDFGKNIIPMMLKEGRSMWAYKFNGYWRDVGTIQAYWESNMDLISRVPEFNLFDPAWKIYTPNPVKPAHYIGPTGSVKKSIVAEGCMIYGSVRNSVLFPGVYVSEGAEIVDSIVMSDSVIGENTQIYKCIIGEEVKVGKNVRMGIGENIPNELKPHLYDSGITVVGEKAVVPDGCQIGKNVVIDPYITAEEFPSLNIESAKSVLKGGETE

SEQ ID NO: 22754 - protein, 373 aa, Clostridium thermocellum
MKSTMGIILTGGKNDRLKELAEMRSSTAVPIGGKYRVIDFVLSNMVNSGIKNIGVLTQYSFRSLMDHLGSGKEWDLDRRNEGLFIFPPYLAGEHSGWYQGSADAMYHNITFLKRSYEEYVLVAQGNCVYKMLFDDMLDYHIKKNADITIAYRDMSDFPREELSFMGVMTMDENRRVVDFKEKHKNPESTICSMGIYILKRELLIALLEECNSHGKYDFVKDVIINKLPTLNIYGYKFEGYWRNLNSINAYYRINMEMLNPEIRYQLFEQHGKVYTKVKDEPPAKYNEEAEVRNSIIADGCIIEGTVINSVLFRGVTIKRNAVVKDCIIMQDSVIEEDVDIESLIIDKNVYLSKGIRLKGMVNFPITIGKNAVI

SEQ ID NO: 22755 - protein, 435 aa, Bdellovibrio bacteriovorus
MSKVTLFWFRRDLRLDDNAGLYHALKERSAVLPLFIFDSEILENLDDPADARVTFIYEQIQDMKQQLNAKKSDLIVRHGKPLEVLKTLSDEMAVEAIYANHDYEPAARKRDEKVAAWAAKAGIEFLTFKDQCLFEKDEILTDARKPYTVYTPYRNKVLANLSEFYLKSYPNDLYESSYAKVKKAEPLLTLKSLGFERSNIEFPPMDLSTKMLKTYHATRDFPADEKGTSHLGLHLRFGTLSVRELAREAKKYSPVWLSELIWRDFFMQILWHFPQVENQSFRPEYDKIAWRKSKADFQKWCEGRTGYPLVDAGMRELNATGYMHNRVRMVVASFLCKHLLIHWYEGERYFAKKLLDYDLSANNGNWQWAAGSGCDAAPYFRIFNPQTQFEKFDPDGKYVQKWVPEYGTDEYPQPMVDHNEARGRCLQAFTKVLKK

SEQ ID NO: 22756 - protein, 174 aa, Desulfovibrio salexigens
  misc_feature (126)..(127): Xaa can be any naturally occurring amino acid
ACWTCKSCDVPRIMERDGELQYFTGKWARMGSEIVNPIGCADCHNSQTSQLEISRPYLKRGLEASGRKLEDLTFQDMRSLACAQCHSEYYFKKTPYTDEAGNKQVAAVVTFPWAKGLAAENMEEYXXEYGFKDWTHGLSKTPMLKAQHPGYEIFTTGIPLKRGLSSAECHMPKS

SEQ ID NO: 22757 - protein, 201 aa, Triticum aestivum
  misc_feature (162)..(162): Xaa can be any naturally occurring amino acid
MVLRDQPHVAYQEMITHLPLCSIKDPKKVLVIGGGDGGVLREVSRHSSVEQIDICEIDKMVVDVSKQFFPHLALGFEDPRVSLHIGDGVAFLKNAPEGTYDAVIVDSSDPVGPAQELFEKPFFESVSRALRPGGVVCTQAESIWLHMHIIEDIVTNCRQVFXGSVNYAWTTVPTYPSGVIGFMLCSTEGPSGDSSIPSSAS

SEQ ID NO: 22758 - protein, 159 aa, Desulfovibrio fairfieldensis
RRPKMMIWIKQYGDSFWAKDVNEFRGKDMIDAKEESISCSTCHDPKTMELRLYSEPLRIGLKKTGKDWNNISRNEKRTLVCAQCHVEYYFTHPDNGPAMRPVFPWDNGFNPEDMYQYYKGHGKKDADAPPGPFSDWVHAASKVPLIKMQHPDFETFQDG

SEQ ID NO: 22759 - protein, 681 aa, Arabidopsis thaliana
MSGSVSGCGSGGCSIVWFRRDLRVEDNPALAAAVRAGPVNALFVWAPEEEGHYHPGRVSRWWLKNSLAQLDSSLRSLGTCLITKRSTDSVASLLDVVKSTGASQIFFNHLYDPLSLVRDHRAKDVLTAQGIAVRSFNADLLYEPWEVTDELGRPFSMFAAFWERCLSMPYDPESPLLPPKKIISGDVSKCVADPLVFEDDSEKGSNALLARAWSPGWSNGDKALTTFINGPLLEYSKNRRKADSATTSFLSPHLHFGEVSVRKVFHLVRIKQVAWANEGNEAGEESVNLFLKSIGLREYSRYISFNHPYSHERPLLGHLKFFPWAVDENYFKAWRQGRTGYPLVDAGMRELWATGWLHDRIRVVVSSFFVKVLQLPWRWGMKYFWDTLLDADLESDALGWQYITGTLPDSREFDRIDNPQFEGYKFDPNGEYVRRWLPELSRLPTDWIHHPWNAPESVLQAAGIELGSNYPLPIVGLDEAKARLHEALSQMWQLEAASRAAIENGSEEGLGDSAEVEEAPIEFPRDITMEETEPTRLNPNRRYEDQMVPSITSSLIRPEEDEESSLNLRNSVGDSRAEVPRNMVNTNQAQQRRAEPASNQVTAMIPEFNIRIVAESTEDSTAESSSSGRRERSGGIVPEWSPGYSEQFPSEENGIGGGSTTSSYLQNHHEILNWRRLSQTG

SEQ ID NO: 22760 - protein, 649 aa, Ostreococcus tauri
MALSHVAFSGRRASLDMCGIFAVLRLTGDARKNRRRVYDLAKRLRHRGPDSYGMEVRVDERSGAQTFMVHKRLSIVAPGKSGDQPLYTDASRKTTFIANGEIYNHAELREKYGIVSENKSDCQVIGHLYEQHGPGFVSELDGMFAFVIEDRENDVIVAARDHMGKIPMYMANGKDGSVWFSSEMKTLHDDPGVASYEIFPPGHVYVKKGDEPATIERWFNPQWIAEESYVPTTPADLPALRECVVDAVTKRLMADVPYAVLLSGGLDSSLITSIAVRQRKLAKNTYGADEPVHSFSIGIKGAPDLVAARKVAEQLGTIHHEVHFTPEEALDALPDVIWHLETFEQVRASVPMYLLSRHIKSLGFKMVLSGEGADELFGGYLYFHKAPNPTEFHAECRRKTMRLHQWDVLRANKSTMSWGIEVRTPLLSQQVIDMAMNMRPEDKMIDVNKKDADGHPFLEKYILRKAFDTPEDPYLPQEVLWRQKEQFSDGVGYDWVDGLAAHAELEVSDEMFAKRAERFPLHPPTTKEYYLLRSIFEEHFVTGFENGDCAYATCPFGKSIACSTPEAVSWDPEWEKSVGDISGRAVKNVHVAADKFDVKKEKANETVAASLVGRGKASCSSESAVTFASLACVRRLSRGFYFCRAPPCL

SEQ ID NO: 22761 - protein, 599 aa, Clostridium perfringens
MLYPIITESRQLIDLSGIWKFKLNEGNGLTEELSKAPLEDTIEMAVPSSYNDLVESQEVRDHVGWVWYERNFTIPKTLLNERIVLRFGSATHEAKVYLNGELLVEHKGGFTPFEAEINDLLVSGDNRLTVAVNNIIDETTLPVGLVKEVEVDGKKVIKNSVNFDFFNYAGIHRPVKIYTTPKSYIEDITIVTDFKENNGYVNYEVQAVGKCNIKVTIIDEENNIVAEGEGKEGKLTINNVHLWEPMNAYLYKLKVELLDDEEIIDTYFEEFGVRTVEVKDGKFLINNNPFYFKGFGKHEDSYVNGRGINEAINIKDFNLMKWIGANSFRTSHYPYSEEIMRLADREGIVVIDETPAVGLHLNFMATGFGGDAPKRDTWKEIGTKEAHERILRELVSRDKNHPCVVMWSVANEPDSDSEGAKEYFEPLIKLTKELDPQKRPVTVVTYLMSTPDRCKVGDIVDVLCLNRYYGWYVAGGDLEEAKRMLEDELKGWEERCPKTPIMFTEYGADTVAGLHDTVPVMFTEEYQVEYYKANHEVMDKCKNFVGEQVWNFADFATSQGIIRVQGNKKGIFTRERKPKMIAHSLRERWTNIPEFGYKK

SEQ ID NO: 22762 - protein, 344 aa, Bradyrhizobium japonicum
MTKYKLEYIWLDGYTPTPNLRGKTQIKEFASFPTLEQLPLWGFDGSSTQQAEGHSSDCVLKPVAVFPDAARTNGVLVMCEVMMPDGKTPHASNKRATILDDAGAWFGFEQEYFFYKDGRPLGFPTSGYPAPQGPYYTGVGFSNVGDVARKIVEEHLDLCLAAGINHEGINAEVAKGQWEFQIFGKGSKKAADEMWMARYLMLRLTEKYGIDIEFHCKPLGDTDWNGSGMHANFSTEYMRTVGGKEYFEALMAAFDKNLMDHIAVYGPDNDKRLTGKHETAPWNKFSYGVADRGASIRVPHSFVNNGYKGYLEDRRPNSQGDPYQIASQILKTISSVPTEKKAVA

SEQ ID NO: 22763 - protein, 143 aa, Triticum aestivum
MVHGTLEVLLVGAKGLENTDFLCNMDPYALLKCRSQEQRSSIASGKGSNPEWNESFVFTVSDQATELVIKLMDSDSGTSDDFVGEATIPLEAVYTEGSIPPTVYNVVKGEHYCGEIKVGLTFTPEDGRQRGLPEDFGGWKQSH

SEQ ID NO: 22764 - protein, 384 aa, Zea mays
MAPRRLPGPGPGPGPGPPLIYGVASKPKTLAGRRQTRLLARRPSPTPTPQPPPARTAPPSRAQGFGMEAEAAAKRTRESGEDAAAAGISAVIPGWFSEISPMWPGEAHSLKVEKVLFQGKSDYQNVMVFQSSTYGKVLVLDGVIQVTERDECAYQEMITHLPLCSIKDPKKVLVIGGGDGGVLREVSRHSSVEQIDICEIDKMVVDVSKQFFPHLAVGFEDPRVSLHIGDGVAFLKNAPEGTYDAVIVDSSDPIGPAQELFEKPFFQLVARALRPGGVVCTQAESIWLHMHIIEDIVVNCRQVFKGSVNYAWTTVPTYPSGVIGFMLCSTEGPAVDFQHPVFNIEEDEHPMKSKGPLKFYNSEIHTASFCLPSFAKRVIESKAN

SEQ ID NO: 22765 - protein, 185 aa, Unknown
  uncultured marine gamma proteobacterium EB000-45B06
MKHYINGLNLLEDYIQDNNKILFGAGCFWGVERKFWDIPGVNITTVGYAGGDTDNPTYEDVCYKNTNHAEVVEVVYDVNKISLKELLKVFWECHDPTQGMRQGNDKGTQYRSVIYCSSNEDLEISLKSKIQYQETLQANGYGDITTEIVLSPKYFLAEEYHQQYLAKNPNGYCGLGGTNCSFPND

SEQ ID NO: 22766 - protein, 423 aa, Bradyrhizobium japonicum
MSKMDSPQQSRRSFLAAGAGVAASVLAKPALAGGGNPANQPPNVPEWTKSLGEGVAVRPYGKPSKFEKDVVRRDVEWLTASRESSVSFTPLHELEGIITPNGLCFERHHGGIAEVDPADHRLMIHGLVERPLILTLEELKRYPRVNRIHFMECAANSGMEWRGAQLNGCQFTHGMIHCVQYTGVSLRTLLEEAGVKTNGKWLLVEGADAAAMDRSLPIEKALDDCIIAYKMNGEALYPEQGYPMRLVVPGWQGNLWVKWLRRIKVGDQPWHTREETSKYTDLMPNGKARRFTWSMDAKSVITSPSPQAPIRHGKGFTIVSGLAWSGNGKVRRVDVSLDGGRNWWPARLDGPVLDKALTRFYYEFDWNGEPLLLQSRVQDETGYVQPSKAELRKIRGVNSIYHNNGIQTWHVQANGEVENVEVA

SEQ ID NO: 22767 - protein, 108 aa, Unknown
  Marinobacter sp. ELB17
MSANIVNVTDVSFEQDVLQSDVPVLVDYWAEWCGPCKMIAPVLEEIAEEYAGKLKVCKLNIDENEQTPPKFNIRGIPTLMLFKNGNVDATKVGALSKSQLAAFLDSNL

SEQ ID NO: 22768 - protein, 160 aa, Unknown
  Marinobacter sp. ELB17
MAGIYDFEVADIRGNAQSMAVYQGKVLLIVNTASKCGFTPQFEGLQSLYSDLADRGLEVLGFPCNQFMNQDPGSNDSIGQFCSLNYGVSFPMFAKVEVNGDNTHPLYRYLKHEASGLLGSKQVKWNFTKFLVNRDGEVLKRYPPTTKPAEIRADIEKALG

SEQ ID NO: 22769 - protein, 603 aa, Aspergillus nidulans
MAIPTAQQATNGHAETISNGQTNGGTADAPNYARGTLGLSAEATPTPHPCSVPLNPQYGYTPRKLRVITIGAGFSGLLMAHKLQHRFSELQEFVTHKIFEMRSDVGGTWLVNTYPGVQCDVPAHIYAFPFDPNPNWSRFYSSGPEIQRYIKDTAAKWHLDRDVYLNTKVVGARWIETEGVWRVTVEHNGVARDEYAEILISGQGVLCHPSWPSIPGLHDFKGKIVHSAEWDHEFDYSHKRIAVIGNGSSGIQITPQMAQLPGTEVVNYMRSAAWIYYRVPPSKHLGRETDEVNPAYAEEDKRKFQDPHVHREYRKGIINRTNKAFKLFLKGENNEEAVRFGTEQMASKLNYDPELCRKLIPKWEVGCRRVTPGPGYLESFSRPNCSLSDSPITKITSNAVHTADGKVFECDVVVCATGFDVSHRPRFPLIGLNGANLAEKWADEPESYLSVATAGFPNYFIFTGPNSLGGHGSLVEALNWTGDYFVKWIKKIATEDIKSVVPKKSAEEAFVRYGDEVHKTIVWTGGCKSWYKRNKTNGRVTALFGGSALLFNRLISELRPEDFEIEYRSVNRFRFLGNGFMEYETDPESDLAWYVELPEPLRA

SEQ ID NO: 22770 - protein, 83 aa, Arabidopsis thaliana
  misc_feature (66)..(66): Xaa can be any naturally occurring amino acid
MEDDIVGLRHMLATAFHPAFAGFMIVPLITHVTITAVGSGPDDSCSLAVYLTGFHQVAIRMETMIXMPVSGNLSDRYRIKRIL

SEQ ID NO: 22771 - protein, 523 aa, Nocardia farcinica
MRAGTRTRNPVAPSPVRARTARIALLLIAFVCAACGLVYELSLVTLGSYLLGDTAAQASITLSVMVFAMGIGALIAKPLRGHAAAAFVAVELALALLGGLSVLLLYAAYAWLNLYTTALIAAASVIGMLVGAEIPLLMELLQRIRRQAPGAAVADLFAADYVGALLGGLAFPFLLLPVFGQIRGSLLVGVLNAAAGLALVFVLFRDRLTRPARLLFTALTALVALVLGGSYVYADRFEATAQQALFAHPIVRHEQTRYQSIVLTESLSPFATPDVRLYLNGDLQFSSVDEYRYHEALVHPVLAGPRARVLVLGGGDGLALREILRYPDVAEVTLVELDPGMIHLARTEPRLLALNRHAFDDPRVRVINEDAFAWLRGQSGRFDAIIVDLPDPDQTSIAKLYTKEFYAMVAQVLAPGGTVAVQSGSPFFAPRSFWCIAATIRAGGLRVLPYHVDVPSFGDWGFVLATRDVEPVLRLDPPAPPRSIDAESLRAAAVFAPDRRDPGAPVSTLMHPVIVDLELREWR

SEQ ID NO: 22772 - protein, 530 aa, Lactobacillus sakei
MKFSELGLSEPIMKAISRAGFEEATPIQGETIPLALAGKDVIGQAQTGTGKTAAFGLPILQNLDLDNPDIQALIISPTRELAIQTQEELYRLGRDRKAKVQVVYGGADIRRQIRSLKDHPQILVGTPGRLLDHINRRTVKLDHVKTLVLDEADEMLDMGFVDDIESIIKQVPEKRQTLLFSATLPAPIMKIGKSFMTNPEMIKVKSKELTADLIDQYYVRAKDFEKFDIMTRLFDVQSPELTLIFGRTKRRVDELTRGLKARGYNAEGIHGDLSQQKRMSVLKSFKAGRLDVLVATDVAARGLDISGVTHVYNYDIPQDPDSYVHRIGRTGRAGKSGVSVTFVTPNEMEYLRIIEELTKKRMLPLQPPSEKEAFKGQLAAAVADINSMIEKGQLAKYNEEAEELLKQFSDVELASVLLKTISKEAVPVKITPERPLPSRKKGGNRGGNRGGSRGGNSGNRRGGNGGGYRGGNRRSSGDGKRRGNDSSKDGRRSSSNGDSSKRRSNDNRGDSRKKTDGRSKRNFTIRTNDK

SEQ ID NO: 22773 - protein, 393 aa, Cryptococcus neoformans
MSAASTAPSSPEVVQQFSDLDIGSTVTTPAVTRPSSPSPPSLPPSPLSSGKHKIAVIGSGSWGTALAKIAAENAWRRKEDFHSEVRMWVREKIVNGKPLTHVINKTHLNSRYLPDVVLPRNLVAVPHLKDVVKDATLIVFVVPHQFLHTVLNELARPGVLLRGAKAVTAIKGVEVNGTDIQTFASLIEAKVGLPCSALSGANIALEVAMGQFCETTIGCPTPDQSLLWHAVFNSPSFRVNTVEDVSGVSLAGALKNVVALAAGMVDGLGLGGNTKAAIMRIGLKEMTQFCLEFFEGVRPETFSNESAGVADLTVTCFSGRNRKCAEEFVRSGQPFDVVEKKLLNGQKLQGTATAEEVNAFLFARKRAHAYPLFEKVYKIAFEGMPPKNLVVGL

SEQ ID NO: 22774 - protein, 135 aa, Glycine max
MSAAEGAVVFSEEKEALVLKSWAIMKKDSANLGLRFFLKIFEIAPSARQMFPFLRDSDVPLETNPKLKTHAVSVFVMTCEAAAQLRKAGKITVRETTLKRLGGTHLKYGVADGHFEVTRFALLETIKEALPADMW

SEQ ID NO: 22775 - protein, 262 aa, Wolinella succinogenes
MWVTRQDSVNFQQEYLIENKILDARSEKNTLEIFKSPAFEEIALLNQKQLLLKTLLSQESELLAHVPLCVHPTPKRVLIAGSFNLEVAFEALRHEETQVDFLQKDEKILHSLISFFPHFQETLHHPRFRVIEEIDSLKSYEVIIHTSLLSLEEIAPLFASLSLDGIFITRLENLLLHTESMRRYLLGIAHHFSIAMPFVSPFSLNADSHFLFASRRFHPQADLLLQRADMLEGLHCYHAELHESAFVLPKFLADSLQGSIKN

SEQ ID NO: 22776 - protein, 511 aa, Triticum aestivum
MESLLAALPAGGGGAVAAAAAAVGGLAAAAALAAKAGVVGTGRTNAPPAVPGLPLIGNLHQLKEKKPHKTFAKWSDIYGPIYTIKTGASSVAVLNSSEVAKEAMVAKYSSISTRKLPKALSVLTRDKTMVAISDYGDFHKMVKRLVMSAMLGSSAQRQFRDTRDMMMDNMLSTFHTLVTDDPHSPLNFREVFKDELFRLSLIQSLGEDVGSVYVKEFGREISKDEIYQITVVDMMMCAIDVDWRDFFPYLSWIPNKGFETRVRTTESRRTAVMQALIHQQKKRIARGEARASYLDFLLAEKALTDEQLMMLVWEAVIEAADTTLVTTEWAMYELAKNPEKQDRLYQEIREVCGDETVTEDHVPRLPYLSAVFHETLRFHSPVPLVPPRFVHETTKLAGYDVPAGTEIVINLFGCNMNKKDWEEPEDWRPERFMDGRFEAADMYKTMAFGAGRRSCAGSLQATTISCAAIARFVQDFAWRLKEGDEDKVDTVQLTSYKLHPLYVYLSPRGRK

SEQ ID NO: 22777 - protein, 467 aa, Haemophilus influenzae
MSKVASIVDVLQGKVAIGETVTVRGWVRTRRDSKAGLSFLAVYDGSCFDPIQAIINNDIENYESEILRLTTGCSVIVTGKVVESPAEGQAVELQAEKVEVTGFVEDPDTYPMAAKRHSIEYLREVAHLRPRTNIIGAVARVRHCLSQAIHRFFHEQGFYWVATPLITASDTEGAGEMFRVSTLDLENLPRSENGKVDFSQDFFGKESFLTVSGQLNGETYACALSKIYTFGPTFRAENSNTTRHLAEFWMVEPEVAFATLADNAKLAEDMLKYVFRAVLAERKDDLQFFEKHVDKDVITRLENFVNSDFAQIDYTDAIDVLLKSGKKFEFPVSWGIDLSSEHERFLAEEYFKSPVVVKNYPKDIKAFYMRLNDDEKTVAAMDVLAPGIGEIIGGSQREERLEVLDKRMEEMGLNPDDYWWYRDLRKYGSVPHSGFGLGFERLIVYVTGVQNIRDVIPFPRAPRNANF

SEQ ID NO: 22778 - protein, 431 aa, Triticum aestivum
  misc_feature (23)..(23): Xaa can be any naturally occurring amino acid
VSSGDGAGGGAGDAVPGGRAGQXAVPARQPAGRVWGVRRTARATSGFKVLALGPETTGVIQRMQQLLDMDTTPFTDKIIAEYIWVGGSGIDLRSKSRTISKPVEDPSELPKWNYDGSSTGQAPGEDSEVILYPQAIFKDPFRGGNNILVICDTYTPQGEPIPTNKRHMAAQIFSDPKVTAQVPWFGIEQEYTLMQRDVNWPLGWPVGGYPGPQGPYYCAVGSDKSFGRDISDAHYKACLYAGIEISGTNGEVMPGQWEYQVGPSVGIDAGDHIWASRYILERITEQAGVVLTLDPKPIQGDWNGAGCHTNYSTLSMREDGGFDVIKKAILNLSLRHDLHIAAYGEGNERRLTGLHETASISDFSWGVANRGCSIRVGRETEAKGKGYLEDRRPASNMDPYTVTALLAETTILWEPTLEAEALAAKKLALKV

SEQ ID NO: 22779 - protein, 131 aa, Pseudomonas aeruginosa
MRILHSMLRVADLEAALEFYTRALDMRLLRRRDYPEGRFTLAFVGYQDERAAAALELTHNWDRDGYTQGDGYGHLAIEVEDAAVTCARARALGYRVTREAGPMQHGRSVIAFLEDPDGYKVELIQKGTQFD

SEQ ID NO: 22780 - protein, 491 aa, Bacteroides thetaiotaomicron
MANQNKTDIGLIGLAVMGENLALNMESKGWHVSVYNRTVPGVEEGVVDRFMNGRAKGKNIEGFTDIKAFVESIATPRKIMMMVRAGSPVDELMDQLFPLLSPGDILIDGGNSNYEDTNRRVKLAESKGFLFVGSGVSGGEEGALNGASIMPGGSEKAWPEVKPVLQSIAAKAPDGTPCCQWVGPAGSGHFVKMIHNGIEYGDMQLIAEAYWVMKNLIDLTNEEMADVFARWNEGKLRSYLIEITSNILRHKDKSGGYLIDKILDAAGQKGTGKWSVINAMELGMPLGLIATAVFERSLSAQKELRHLASKQFLCKHTLPIYNKAELVKEIFSALYASKLVSYAQGFAVLQRASDSFGWNLDLASIARMWRGGCIIRSIFLNDIAAAFEAADKPKHLLLAPYFREEIKSLLPGWKNLVAEAMKEELPVPAFSSALNYFYSLTSDNLPANLVQAQRDYFGAHTFERKDELRGQFFHENWTGHGGETKSGTYNV

SEQ ID NO: 22781 - protein, 453 aa, Listeria monocytogenes
MEASLLKKNQSIELTIEDLTHDGSGVGKIDGYPLFIPNTLPGEKVTAKIIKLNKNYGFARMENIETVSADRVEPPCAVYSKCGGCSLQHLSYDGQLEFKRNQVEETMKRIGKLNVEVPETLGMENPWRYRNKSQVPVGFVNGKLTAGFYQKRSHAIIDMSTCLIHNEQGDFAVQKTREILAKYGTEPYDEQTGKGDIRHIMTRFAHTTGQLMIVLVTTKERMPFKEEIVRELVEQLELTSIVQNINPHKTNVIFGDRTKTLWGKDIIEDTIHGIRFAISARSFYQVNPIQTEVLYQQAIDAAELTGEETVIDAYCGIGSISLCLAKKAKHVYGVEIVDQAIQDARANAELNELANTTFETGKAEEVIPAWYKAGIVADVLVVDPPRKGCDEKLLETILAMKPKKVVYVSCNPGTLARDMKILTDGGYVAKKVQPVDMFPMTTHIEAVTVLHLN

SEQ ID NO: 22782 - protein, 236 aa, Brassica napus
  misc_feature (226)..(226): Xaa can be any naturally occurring amino acid
SLFLLFLSQVTVTESRTHLSVFTHPREKNREREREEVEMEGRRREVVVSSLQFACSDDISSNVASAERLVREAHAKGANIVLIQELFEGYYFCQAQREDYFQRAKPYKDHPTIARMQTLAKELGVVIPVSFFEEANTAHYNSIAIIDADGTDLGIYRKSHIPDGPGYQEKFYFNPGDTGFKVFQTKFAKIGVAICWDQWFPEAARAMVLQGAEVLFYPTAIGSEPXDQGLDSRDHW

SEQ ID NO: 22783 - protein, 986 aa, Clostridium stercorarium
MRKFYSFAIIISLLVTGLFIHTPKAEAAGYNYGEALQKAIMFYEFQRSGKLPENKRDNWRGDSGLNDGADVGLDLTGGWYDAGDHVKFNLPMAYSQTMLAWAAYEAEEALERSGQMGYLLDAIKWVSDYLIKCHPSPNVFYYQVGDGHLDHSWWGPAEVMQMDRPAYKVDLANPGSTVVAEAAAALASAAVVFADRDPAYAATCIQHAKELYNFAEITKSDSGYTAASGFYDSHSGFYDELSWAGVWLYLATGDETYLNKAEQYVAYWGTEPQTNIISYKWAHCWDDVHYGACLLLAKITGKQIYKEAIERHLDYWSVGYNGERVHYTPKGLAWLDSWGSLRYATTTAFLASVYADWEGCSREKAAIYNDFAKQQIDYALGSSGRSYVVGFGVNPPKRPHHRTAHSSWADSMSVPDYHRHVLIGALVGGPGKDDSYTDDINNYINNEVACDYNAGFVGALAKMYEDYGGSPIPDLNAFEEITNDEFFVMAGINASGQNFIEIKALLHNQSGWPARVADKLSFRYFVDLTELIEAGYSASDVTITTNYNAGAKVTGLHPWNEAENIYYVNVDFTGTKIYPGGQSAYRKEVQFRIAAPQNTNFWNNDNDYSFRDIKGVTSGNTVKTVYIPVYDDGVLVFGVEPEGGSGENNSSISITNATFDKNPAKQENIQVVMNLNGNTLNGIKYGNTYLREGTDYTVSGDTVTILKSFLNSFDTSTVQLIFDFSAGRDPVLTVNIIDTTTSASIVPTTADFDKNPDASRDVKVKLVPNGNTLLAVKKDGEALVLGRDYSIDGDEVTIFREYLADQPVGRVTLTFDFDRGTDPVLTINITDSRQVETGVIQIQMFNGNTSDKTNGIMPRYRLTNTGTTPIRLSDVKIRYYYTIDGEKDQNFWCDWSSVGSNNITGTFVKMAEPKEGADYYLETGFTDGAGYLQPNQSIEVQNRFSKADWTDYIQTNDYSFSTNTSYGSNDRITVYISGVLVSGIEP

SEQ ID NO: 22784 - protein, 562 aa, Vibrio cholerae
MSSSTQSMPWWKTAAIYQIYPKSFCDSGAKGVGDLQGIISKLDYLQKLGIEAIWLTPIYQSPMVDNGYDIADYYAINPDFGTMQDFEQLLKEAHRRGMRIIMDIVVNHTSTEHAWFQSALGDRNSPYRDYYIWRKPVNGGVPNNWQSKFGGSAWALDEATGEYYLHLFAKEQADLNWENPQVREEVKNIIGFWAEKGVDGFRLDVINLISKQQDFTNDDIGDGRRFYTDGPRVHEYLQEISRDVFQRYGSVTVGEMSSTTLEHCQQYSALDGRELSMVFNFHHLKVDYPNGEKWTKAPFDFLQLKQIFNHWQTGLNGKGWGALFWCNHDQPRIVSRLGDDQQYRVESAKMLAATIHLMQGTPYIYQGEEIGMTNPGFTSIKQYRDVESINIHQIMVQQQGVSESDMLAILAQKSRDNSRTPMQWDASLNAGFTRGEPWIEVAHNYPEINAQAALEDPHSVFYFYRRLLSLRKKVAVITDGDYTDLLPEHKEIFAYQRRNQKQVLICLNNYYGHEAECVLPELPLDDALYLLGNYPGIELQRVLAHQVLRPYETRIILIESPL

SEQ ID NO: 22785 - protein, 310 aa, Listeria monocytogenes
MQKHARVIYNPTSGREIIKKNLADVLSILEQAGYVTSAHATTAEPDDAKHAAEEAVRDRFDLVVAAGGDGTINEVINGIAEKEYRPKVGIIPTGTTNDFARALHVPRDVIKATKIIAAGQSVAMDIGKANETYFINIGGGGRLTELTYDVPSRLKTMLGQLAYYLKGIEMLPSLKATKVKVEYDQGVFEGEVMFFLLGLTNSIGGFEKIAPDAKLDDGKFSLIIVKKVNLAEFIRLVTLALRGDHIKEPNVIYVKSEKVIVNSEDKMLINLDGELGGETPMEFRNLRQHIEFFASVDDIPATDLFIKENS

SEQ ID NO: 22786 - protein, 291 aa, Gibberella zeae
MQFTNYSRPTAMTNVDTSLPPEPTGAAANFAAQHSEEHPLKLYGGWFCPFVQRSWITIHEKRIPHQYVEINPYKKEPHFLALNPRGLVPTLAVPFDVQGKEQKALFESNIVCEYLDEAFFDESKHGPRLLPTEPYEKARCRIWIDHISTRIIPAWYKLMQHTPDKAFSLEDAREELKGHIKSFVEEMDSEGPWFLGSTLSLVDICFAPWAKRLFLIDYYKEGGHGIPTTGEGEDGDVWNRWNKWYKAILKRDSVNETWSADERYIIAYKRYAEDTTNSEVGQATRSGKRLP

SEQ ID NO: 22787 - protein, 107 aa, Zea mays
MTEKKNSREKKNPREAKVTFEGLVTEALPNGMFRVRLENDTIILGYISGKIRSSSIRILMGDRVKIEISRYDSSKGRIIYRLPHKDSKRTEDSKDTEDLKDTKDSKD

SEQ ID NO: 22788 - protein, 208 aa, Boechera stricta
MATIEESSDLEAIQKHLFEDLMVSDGFMGDFDFDASFVSELWCIEPQVPKQEPDSPVFDPDSFVNEFLQVEAKSSPELNSSSSTYETDLSVKKAERFEEEEEEEEEEARHYRGVRRRPWGKFAAEIRDPAKKGSRIWLGTFESDVDAARAYDCAAFKLRGRKAVLNFPLEAGKYEAPANSGRKRKRSDVKEELQRTQSNSSSSSCDAF

SEQ ID NO: 22789 - protein, 587 aa, Gibberella zeae
MSAGDGTSTPGVGGSNASEFVRKLYRMLEDPAHQDVARWGKDGDTFVVVENEKFTRSILPKHFKHSNMASFVRQLNKYDFHKVRQTNDSGSAANGANTLEFKHPNFRVGSKDDLDNIRRKAPAPRRTQATEDFTTSHHISVMTEQLTATQQQVQQLQELFTEVSQTNRLLVNEVLTLQKMLNAQKQSQHEMLNFLSPSTNRHQQTMHLNVGTSPLDGSDDSAPELRRARELLSSVTPDQIADRELERLQGVYGSPADSAVVIPQASMPMMHDPMNDINRYPVYPVGQTVGIDPFHSDHIHKIPYAMPNDSSANAMQEVAAPQPINIQTHGNSNSSANSALTWASRKPRIFLVEDDPTCAKIGIKFLKSMGCEVEHAQNGADAYSRITGVARDHFDMIFMDIIMPKLDGVSTTMYIRQDCPAIPIVAMTSNIRSDEVHCYFEHGMNGVLAKPFTKSGMQKIVENHLSYLLKGYDPSTQQESGSGYVVGGAGYMNPPSNLNTPGGTAFKFETTPTPPATGATWSPGQMPQQSPLTTGMDQGYGMVNGANQYGLTPTSASRASFPGNISQNNQGRMDGQSPPEKRQRTYV

SEQ ID NO: 22790 - protein, 574 aa, Triticum aestivum
MAALVTSQLATSGTVLGITDRFRRAGFQGVRPRSPADAALGMRTVGASAAPTQSRKAHRGTRRCLSMVVRATGSGGMNLVFVGAEMAPWSKTGGLGDVLGGLPPAMAANGHRVMVISPRYDQYKDAWDTSVVSEIKVVDKYERVRYFHCYKRGVDRVFVDHPCFLEKVRGKTKEKIYGPDAGTDYEDNQQRFSLLCQAALEVPRILNLDNNPYFSGPYGEDVVFVCNDWHTGLLACYLKSNYQSNGIYRAAKVAFCIHNISYQGRFSFDDFAQLNLPDRFKSSFDFIDGYDKPVEGRKINWMKAGILQADKVLTVSPYYAEELISGEARGCELDNIMRLTGITGIVNGMDVSEWDPTKDKFLAVNYDITTALEGKALNKEALQAEVGLPVDRKVPLVAFIGRLEEQKGPDVMIAAIPEILKEEDVQIVLLGTGKKKFERLLKSIEEKFPSKVRAVVRFNAPLAHQMMAGADVLAVTSRFEPCGLIQLQGMRYGTPCACASTGGLVDTIVEGKTGFHMGRLSVDCNVVEPADVKKVVTTLKRAVKVVGTPAYHEMVKNCMIQDLSWKGPAWKVSR

SEQ ID NO: 22791 - protein, 640 aa, Unknown
  Oceanobacter sp. RED65
MTPKTGLSLYARTLLLGLGPALIISIMLGGYFINARIQDVNIEMQNKGELIAVQLAATSDYFVLTGNPSIINPLTRVLLEDKDVELIEIEDISGGLLFSESDTEFELSQASRESLNWYQADIIQYDVLQEEDDWFATGRNRARVLGQVRVGLSQAFVEQRQQEILIHAMLIVVVAMTVCALIAWLSGARLVRPIKKLSDVVDQLSHRVYDTRTEETASGEVGQLQVGVNKLANELQKAEKVQHHYVKDLIRAREASESANKAKSEFLAVMTHELRTPMNGVLGMLQLLQGTQLSKEQNEYVDVAINSGDHLLGLINDILDFSKIEQGRIDLDEQYFDLVESLKSLCDSFTPIAQKKGLQFNVHFMTHTNLWVKTDQTRLKQVLLNLMGNAVKFTDTGSINLSLQDLSIEDDEVELSIVVQDTGKGINQAQLSRIFDAFQQEDASISRQYGGTGLGLAISKQLVEKMGGKLEVQSEKDRGSTFICRFCWPINVANEQSDVTQDANEQESFNGRVLLVEDNDVNQKVAMKMLTNLGVSVDLAEDGEVAVQRCKENTYDLVLMDLQMPNMDGYEATKVIRSEPGGNRHVPIIALTANAFYDVKTQCMQAGMSDFLAKPYKKATLMQVLSRWLHQGDASIGLLK

SEQ ID NO: 22792 - protein, 447 aa, Glycine max
NSPPLWGGIGAPPPPLGLSLVAPPPPQFFICGIDNKFITACPQLRRPPPHTTSFRGIDNKVYYMLDNNGQLLNFSGCGNTLNCNHPVVMELILDSLRHWVTEYHVDGFRFDLASVLCRGIDGSPLNAPPLIRAIAKDAVLSRCKIIAEPWDCGGLYLVGSFPNWDRWAEWNGKYRDDVRKFIKGDSGVKGSFATRVAGSSDLYSVNNRRPYHGINFVIAHDGFTLRDLVSYNFKHNEANGEGGNDGSNDNFSWNCGLEGETDDASVRALRSRQMKNFHLALMISQGTPMMLMGDEYGHTRNGNNNSYGHDTAINNFLWDQLDARKSDHFRFFSNMIKYRHAHEVFNHESFLSKNDITWHEDNWDNHDSKFLAFTLHDKSGGDIYLAFNAHDYFVKVLLPAPPKKRNWFRVVDTNLKSPDDFVLDGVPNVGNTYNIAPYSSILLEAKF

SEQ ID NO: 22793 - protein, 413 aa, Methanosarcina barkeri
MSEDSSIGSSLEDIKTRVEFQLESGKINAEDVKSLLTEIEIMRVQNENMKARLLEASVATGRHLQEINKLKAHLEQLTEPPLFIATILEVNGEIALIRQHGNNQEVLTQIPEECIGKIEPGMRVAVNGAYSIISVVSRAADVRAQVMELINSPGVDYSMIGGLDDVLQEVRESVELPLTEPQLFEEIGIEPPSGVLLHGAPGTGKTLIAKAIASHAKATFIRMSGSDLVQKFVGEGSRLVKDIFQLARDKSPSILFIDEIDAVGSMRTYDGTSGSAEVNRTMLQLLAEMDGFDPKGNVKIVAATNRIDLLDPALLRPGRFDRSIEVPLPDEKGRAEILKIHTRKMNLADDVDFEKLARVMTGMSGAEISVIVKEAGIFVLRRRGKQITMADFLKAHEKVVSTEEPKIPQAMFV

SEQ ID NO: 22794 - protein, 407 aa, Prosthecochloris aestuarii
MTDHKVLPVTDDVTWIGVLDPGLVTFDIVMETKYGTTYNSYFINAEKKAVVETTKAKFWPTYLEKIKQVTDPSEIEYIIVDHTEPDHSGNIGNLLEVAPDATVVGSANAIKFLRDLVGREFRSLTVKHGDTLDLGNKTLHFINALNLHWPDSIYTWIEEDKVLFTCDSFGSHYCNEAMYDDLCGDFDDAFTYYFDAILRPFSKYMLDAIERIKDLDIKVICPGHGPILRSDWKKYVALSKKYAQGAIALPNEKNILIAYVSAYENTSLMAEKIAEGIRPACNFNVEVCDIEAMHFSKIEEKIAHSSALIVGSPTINQNIVPQIYQFFGAINPIRDRGKLSAAFGSYGWSGESTKIIETNFTNLKLKVFDKNMKVKFKPHEKELNECIDFGREFAKSLIEKNNLVCDM

SEQ ID NO: 22795 - protein, 605 aa, Solanum lycopersicum
MMMFEEMGFCGDLDFFPAPLKEVEVAAPQTEAEQVVDDDYSDEDIDVDELEKRVWRDKMKLKRLKEMNQGMEDVDSVKRRQSQEQARRKKMSRAQDGILKYMLKMMEVCKAQGFVYGIIPEKGKPVGGASDNLREWWKDKVRFDRNGPAAIAKYQAEHAIPGKNDVSNPVGPTPHTLQELQDTTLGSLLSALMQHCDPPQRRFPLEKGVSPPWWPTGQEDWWPQLGLQKDQGPPPYKKPHDLKKAWKVGVLTAVIKHISPDIAKIRKLVRQSKCLQDKMTAKESATWLAIINQEEALARELYPDRCPPLSSAGGSGTFTVNDSSEYDVDGAQDECNFDVQEQKPHHLNLLNVTVERFNERQPLQQQSHPIKDEIITSLDFTRKRKQSNEQTVTMAQIYTCEILQCPYSELRHGFQDRSARDNHQLVCPYRNTSQFGVSKFPMNEVKPVVLPQQYIPSTSVALPVNPSPPPFDLFGVGVPEDGQRMIDDLMSFYDCNIQGNKSQNTGNVAVTKEQQPHQQPRVDQVNYLHSRGMMEGNIFKDINVSASQSMQPQGNLVDQCKILNSSDNLQFMFGPPFNLQSTNYPGSLPGIGCDTTPKQDIPIWY

SEQ ID NO: 22796 - protein, 111 aa, Zea mays
  misc_feature (21)..(21): Xaa can be any naturally occurring amino acid
  misc_feature (61)..(61): Xaa can be any naturally occurring amino acid
  misc_feature (81)..(81): Xaa can be any naturally occurring amino acid
KGLEQHSNGDTIAAATTTGAXRLYPPTAAAPHQAPTPGRAREKNRAAPAPARRTKAERAEXSTAPGNSPSTGATHTPSRTXQHNKQRENEAKQEPEQNGKTHNNTHNERAK

SEQ ID NO: 22797 - protein, 377 aa, Unknown
  uncultured archaeon GZfos22D9
MEDIFRFADELGPAKVIHVYEPSVGLKAVLVVDNVARGPAIGGLRIAPDVSPEECFRLARAMTLKNAAADLPHGGGKSVIYGDPKMPTKEKEKLIRALASSLREIQEYIFAPDMGTDEECMAWVKDEIGRVVGLPSDFGGIPLDEIGATGWGLSHATEVALEYCDFDMEGAQVVVQGFGAVGKHTARFLTEKGAMLVGVADSRGTIYNPQGLDVLALIELKKAGKSVADYPDGKKLDRDAVINIECDIWIPAARPDVIDKNNVNLLKTKLVIEGANIPITEGAEKHLHEKGVLYVPDFIANAGGVICAAMEYQGADQSAAFHAIEEKLCRNTRLVLDEAASRGILPREAAVDLAVQRLKKSMSYRRWSLFSSAPGFV

SEQ ID NO: 22798 - protein, 325 aa, Spinacia oleracea [sequence omitted]

SEQ ID NO: 22799 - protein, 523 aa, Yarrowia lipolytica
MSEWKESLNVPKKDTRHKTEDVTATKGTGFEDFFLKRELLMGIFEAGFENPSPIQEEAIPIALAGRDILARAKNGTGKTAAFVIPALQQVNPKVNKIQALIMVPTRELALQTSQVCKTLGKHLGIKVMVTTGGTNLRDDIMRLEDTVHVLVGTPGRVLDLAGRKVADLSESPMFIMDEADKLLSPDFTPIIEQVLHFFPWTTRQILVFSATSPLTVKAFMDRNLHKPYEINLMDELTLRGITQYYAFVDEKQKLHCLNTLFSKLDINQSIIFCNSTVRVELLARKITELGYSCYYSHAKMIQSHRNRVFHEFRNGTCRNLVCSDLLTRGIDIQAVNVVINFDFPKNAETYLHRIGRSGRFGHLGIAINLINWNDRYNLYKIEQELGTEIKPIPAQIDKNLYVAESSENIPRPFPIADMPRGKESKRNEQFQPQQNQNQQQQQDGQNQHSLGPYLPRVPPQGIPGPGYGYPPPQGFPQGMPPQGMPPQGAGGYMPPTPYGYQQQGFPPQPPQGFNNGQPQQPSQ

SEQ ID NO: 22800 - protein, 529 aa, Coccidioides immitis
MRSWRRCLSTSTPKLNSAPPGPLALRCAQLFEASQPSLSDNTSLDHREVVVRGLVRSVRKQKHWAFAEISDGSTIQPVQAILSPEQAADLTTGGAVEISGVWTPSPGRNQSHELKATDVKLVGEADPQTYPIQKKYHSQDFLRTIPHLRFRTPFNSLLSRFRSECIYQATNVFHSRPGLNFIQVQPPLITSSDCEGAGEVFRVSPREAAAEGEDEEYFRAPKYLTVSSQLHLEAYAADLGNVWTLSPTFRAEKSDTPRHLSEFYMLEAELNFVNDLDELTKFVESFIRELTEKLYNTPVARELFTAKRSGESGRTVVNSEVTERWKGLMGAATWPRITYTEAIELLQNASMKSDKVEFKSCPSWPAGIQVEHEKYLVSTVGNGAPIFITDYPKALKPFYMAPSGTQSTDPEKETVACFDLIMPKVCEVVGGSLREHRLENLIQNMREHEMLRARPNEGSSVASDDMTYPFLRPDEDLGSLRWYADLRRWGSAPHGGFGLGFDRFLSYLAGVGSIRDVVPFPRYFGKADC

SEQ ID NO: 22801 - protein, 252 aa, Oryza sativa
MGSDASSAADAMGVLRAAVPLQADADLVLATGGGGERGQVVGLVLVDVSNGFCTVGAGNLAPVTPNKQIEKMVDEAARLAKVFCERNWPVFAFLDTHYPDKPEPPFPPHCIIGSGEENFVPALEWLEKDPNVTIRRKDCIDGYLGAFEKDGSNVFSDWVAKFQIKTVLVLGICTDFCVLDFASSALAARNIGRVPPLEDVVIYSEGCATYNLPVEVARSMQGTLAHPQDLMHHMGLYMAKSRGAKVVDRIII

SEQ ID NO: 22802 - protein, 141 aa, Brassica napus
MLQLCSTLRPQLLFSPQIRFTDGVLIPRLNFGSSSSVVSFRPVIRCQRVSGGRGGANRSKPAKPPVKEGSNKTVIEGLVTESLPNGMFRVDLENGDNVLGYICGKIRKNFIRILPGDKVKVEMSVYDSTKGRIVFRMSSRD

SEQ ID NO: 22803 - protein, 583 aa, Clostridium thermocellum
MKTIIIGINSKYIHSSLAAWYLKASCDEQCGEVKVMEFTINDNSEYVLSRIYAEGCDVAAFSCYIWNIGFVLKLAENLKMVLPDVKIILGGPEVSFDPHDILRSNRFVDYVMAGEGEGAFGLLLRSFTDEGINPDAIEGLSYRKNGEIHASTSFRLVKELDTVPSPYTPEMLEAIGNRIIYFESSRGCPFSCSYCISSTFEGVRYFSMDRVKSDLLTLIDARVKLVKFVDRTFNCNRQRAKEIFSFIIENAKETSFHFEAAADLFDDEMFDILSRAPKGLIQFEIGIQSTNEAALEAIRRKTDLKKVFENIKKLKELGNVHIHVDLIAGLPFEDYNSFLNSFNETYKLYPHQLQLGFLKLLKGSGIRREYQKYGYKFRQYPPYEVLSNAYLSFGDIIKLKKIEELLERYYNSGRFQRTLKYLIEGFFPSPAAFFEEFSKYYEAAGCYDRSISSRELYTILLDFASSLDMEVNLVLLNEILKFDFLVSDNTNNLPKGLERLYIDNFGERCFEFLKNRENVEKFLPEFSDTPAKKIYNKVHFEAFRFNVADETLAQDEDTTVILFDYSQKDSITGHYRFYKIQLP

SEQ ID NO: 22804 - protein, 321 aa, Zea mays
  misc_feature (241)..(241): Xaa can be any naturally occurring amino acid
MRLDEQALLVICGLLRLPALLVSRGIHRSLSSDAARKIELQLHFVDTVVGIEMNESAVSDAHRNALINGIKNCRFVCGKAEDVMGPLLTEYLGSPQQQAAASKSNSEIDDTRKTEDMIGCASYDGENIDSSKQRHDNAEGQQPMDTSVDHPTCASEVDGMDVVDCNHDENNVASGEQNCREASLINGKPIETSSDNSLEQGKACKDGSSSPNNNVLAANACQFKNVVAIVDPPRVGLHPTXYISCNPDSLVANGIELCTPTPENQEKTKGNRGWRSMSSAGLARQRTKSMPNSEPFIPKRAMAVDLFPHTPHCEMVMLFER

SEQ ID NO: 22805 - protein, 467 aa, Bacteroides fragilis
MEKISRTKIVDLMKREDFGAMVNVKGWVRTRRGSKQVNFIALNDGSTINNVQVVVDLANFDEEMLKQITTGACLSVNGVLTESVGAGQKAEVQAREIEVLGTCDNTYPLQKKGHSMEFLREIAHLRPRTNTFGAVFRIRHNMAIAIHKFFHEKGFFYFHTPIITASDCEGAGQMFQVTTMNLYDLKKDENGSIVYDDDFFGKQASLTVSGQLEGELAATALGAIYTFGPTFRAENSNTPRHLAEFWMIEPEVAFNEIQENMDLAEEFIKYCVRWALDNCADDVKFLNDMFDKGLIERLEGVLKEDFVRLPYTEGIKILEEAVAKGHKFEFPVYWGVDLASEHERYLVEDHFKRPVILTDYPKEIKAFYMKQNEDGKTVRAMDVLFPKIGEIIGGSERESDYNKLMMRIEEMHIPMKDMWWYLDTRKFGTCPHSGFGLGFERLLLFVTGMSNIRDVIPFPRTPRNADF

SEQ ID NO: 22806 - protein, 566 aa, Bartonella henselae
MSQYNPTTADFEALLMQSFQTNDLNEGSVVKGRVIAIEKDMAIIDAGLKVEGRIPLKEFGAKGKDGSLQIGDEVEVYIERIENAMGEAVLSREKARREESWIRLEEKFNAGARVDGVIFSQVKGGFTVDLDGAVAFLPRSQVDIRPIRDVSPLMHNSQSFEILKMDRRRGNIVVSRRTVLEESRAEQRSEIVQNLEENQIVEGVVKNITDYGAFVDLGGIDGLLHVTDMAWRRVNHPSEILTIGQTIKVQIIRINQDTHRISLGMKQLESDPWESISARYPVGKKITGAVTNITDYGGFVEIEPGIEGLIHVSEMSWTKKNVHPGKILSTSQEVEVVILEIDPSKRRISLGLKQTFENPWVAFANKFPVNSQIEGEVKNKTEFGLFIGLEGDVDGMVHLSDLDWNRPGEQVIDTYNKGDIVKAVVLDVDIEKERISLGIKQLSSDKVGEAAASGELRKGAVVTCEVTAVNDNGIDVKLTDHNLETTIRRTDLARDRDEQRPERFSIGQRVDARITAFDKKTRKLSVSIKALEIAEEKEAVAQYGSTDSGASLGDILGAALKKQEQD

SEQ ID NO: 22807 - protein, 838 aa, Nostoc punctiforme
MATVTVQFTYFTGFRRAIFNNPRLIGSWDENGRYSQQWRSQQMQPIIAEDGCPGFQTTVELDDSQIGWLFRWGVMLDSPAGNNLWGIPTEINDRNSSDRYRSFTLQSPNNNQPQQERYYLVYSRRLGAQLYHFPGQSQPGLRFAVWAPNARNVEVVFGNRSSGYIADDVFREDPDFGMDPNLGPFPMSRTEEGIWQTDVTVSSELADFSRFDHIPYMFRIVNEGGRVVYRTDLYSRCQIGKGNINPDGKPFSNRYSDTQDRPFSGNYQDLDGTKSCSVVINPDTVTRHFQEPVWPELEFIPEEEFWSNEFSLERPVPQRVEDLVIYELHVGALGYGQNRPGNFEDAIALLPYLVQLGVNAVELLPMSEFRDEVNWGYETSHYFALEYSAGGRDQLKHFIRECHCYGIAVILDVVYNHFNPDGERAEWAYDSDLPEHNIYYWYEGNSGDYFYPDGRRFPEGGYLDNVSTGFAPRFYEEMVRKMFISSAVTLMEEFHVDGFRVDQTTSIHSYNALHLDGRPMGNANIFGAKFLREWTRTMKLIQPNAILIAEDHSDWEPVTESPDVGGLGFDAAWYANFYHHLIGDARQGTEYAKLIPTAGYGTNEPLAMDYFAGALGWSGHHKVVYHESHDEAGNAYFEEGGHRVESRRTIAEAVNSAPLIGETRRYAEARCRFAVGVSILSAGTPMFLMGEEIGAQKPYRYSDFIDNREDLIGDRQTNGQRLFRFYQDLIQLRHNYSGLRSHLIDILYVHNANRVIAFKRWDVSGEFLIVASLNNHPFRSGYTINNSRIGDGQWREIFNSDASLYGGDSIGNYGINISATNGYINPIVPANGFVVFQG

SEQ ID NO: 22808 - protein, 716 aa, Oryza sativa
MASVDPSRSFVRDVKRVIIKVGTAVVSRQDGRLALGRVGALCEQVKELNSLGYEVILVTSGAVGVGRQRLRYRKLVNSSFADLQKPQMELDGKACAAVGQSGLMALYDMLFNQLDVSSSQLLVTDSDFENPKFREQLTETVESLLDLKVIPIFNENDAISTRKAPYEDSSGISWDNDSLAGLLALELKADLLILLSDVDGLYSGPPSEPSSKIIHTYIKEKHQQEITFGDKSRVGRGGMTAKVKAAVLASNSGTPVVITSGFENRSILKVLHGEKIGTLFHKNANLWESSKDVSTREMAVAARDCSRHLQNLSSEERKKILLDVADALEANEDLIRSENEADVAAAQVAGYEKPLVARLTIKPGKIASLAKSIRTLANMEDPINQILKKTEVADDLVLEKTSCPLGVLLIVFESRPDALVQIASLAIRSGNGLLLKGGKEAIRSNTILHKVITDAIPRNVGEKLIGLVTTRDEIADLLKLDDVIDLVIPRGSNKLVSQIEASTKIPVLGHADGICHVYIDKSADMDMAKHIVMDAKIDYPAACNAMETLLVHKDLMKSPGLDDILVALKTEGVNIYGGPIAHKALGFPKAVSFHHEYSSMACTVEFVDDVQSAIDHIHRYGSAHTDCIVTTDDKVAETFLRRVDSAAVFHNASTRFSDGARFGLGAEVGISTGRIHARGPVGVEGLLTTRWILRGRGQVVNGDKDVVYTHKSLPLQ

SEQ ID NO: 22809 - protein, 587 aa, Citrus unshiu
SWGKSQILNPFSSSLVDMGFPTKSIALKKKPNKSLKVESALHSPSVLHFPKQPYQNPVITRQDSTAKPENKSNKSQGQTQQSQWNPLQRAAAMALDMAENALVSRERQHPLPKTADPRVQISGNFAPVPEWPVRHGLPVTGSIPECINGVYLRNGANPLFEPVAGHHFFDGDGMVHAVTIGNGSASYACRFTETQRLMQERELGRPVFPKAIGELHGHNGIGRLLLFYARGLFGLVDHKQGTGVANAGLVYFNNRLLAMSEDDLPYQVRITPSGDLETVGRYNFNHQLKSTMIAHPKVDPVSKELFALSYDVVQKPYLKYFRFSADGDKSPDVEIHLPVPTMMHDFAITENFVVIPDQQVVFKLQEMITGGSPVIYDKNKKSRFGILAKNAKDSNDIIWIESPDTFCFHLWNAWEEPETDEVVVIGSCMTPADSIFNECDESLKSVLSEIRLNLKTGESTRRPILSESDQVNLEAGMVNRNSLGRKTQFAYLAIAEPWPKVSGFAKVDLSSGEVKKYFYGDNKYGGEPFFLPRDANNSENEDDGYILAFVHDEKTWKSELQIANAMNLQLEASIKLPSRVPYGFHGT

SEQ ID NO: 22810 - protein, 833 aa, Saccharomyces cerevisiae
MNNAANTGTTNESNVSDAPRIEPLPSLNDDDIEKILQPNDIFTTDRTDASTTSSTAIEDIINPSLDPQSAASPVPSSSFFHDSRKPSTSTHLVRRGTPLGIYQTNLYGHNSRENTNPNSTLLSSKLLAHPPVPYGQNPDLLQHAVYRAQPSSGTTNAQPRQTTRRYQSHKSRPAFVNKLWSMLNDDSNTKLIQWAEDGKSFIVTNREEFVHQILPKYFKHSNFASFVRQLNMYGWHKVQDVKSGSIQSSSDDKWQFENENFIRGREDLLEKIIRQKGSSNNHNSPSGNGNPANGSNIPLDNAAGSNNSNNNISSSNSFFNNGHLLQGKTLRLMNEANLGDKNDVTAILGELEQIKYNQIAISKDLLRINKDNELLWQENMMARERHRTQQQALEKMFRFLTSIVPHLDPKMIMDGLGDPKVNNEKLNSANNIGLNRDNTGTIDELKSNDSFINDDRNSFTNATTNARNNMSPNNDDNSIDTASTNTTNRKKNIDENIKNNNDIINDIIFNTNLANNLSNYNSNNNAGSPIRPYKQRYLLKNRANSSTSSENPSLTPFDIESNNDRKISEIPFDDEEEEETDFRPFTSRDPNNQTSENTFDPNRFTMLSDDDLKKDSHTNDNKHNESDLFWDNVHRNIDEQDARLQNLENMVHILSPGYPNKSFNNKTSSTNTNSNMESAVNVNSPGFNLQDYLTGESNSPNSVHSVPSNGSGSTPLPMPNDNDTEHASTSVNQGENGSGLTPFLTVDDHTLNDNNTSEGSTRVSPDIKFSATENTKVSDNLPSFNDHSYSTQADTAPENAKKRFVEEIPEPAIVEIQDPTEYNDHRLPKRAKK

SEQ ID NO: 22811 - protein, 478 aa, Prosthecochloris aestuarii
MTLRDIYRKGELVELTIADIAEKDQCFGTLDNGAGVLVRGMLAVGDRVSAKVLKVKPRYLEAVLDELLEPSEDRVEPVCSVFGVCGGCKWMHVSYDAQLHYKKKKVADALEHIGGMHDIAVQPVLPAPEAFHYRNKVEFSCSSKRYLLPHELSMETLDKSKDFALGFHAPGNFEKVLEIDTCYLAKPSMNEALSATRAFALDRGLEPYAARAHTGFLRNLMLRYSEEHDELMVNIVTSWYDRELMEAYRDHLLERMKGRRMTIVNNVTTRKNTVSTGEKEYVVYGDGTLRERLGDLHFRISANSFFQTNTRQAEALYEGIMRMAGLKQDDVVYDLYCGTGTITLYLAERCRQAVGLEVVESSIIDAAENAGANGIENAAFYQVDLKDFHTLVPTLEQYGMPRVIVTDPPRAGMHPKALETLLRLQPETIVYVSCNPANLARDGKEIVQQGYRLEEVQPVDMFPHTSHVETLACFRRTV

SEQ ID NO: 22812 - protein, 587 aa, Citrus limon
SWGKSQILNPFSSSLVDMGFPTKSIALKKKPNKSLKVESALHSPSVLHFPKQPYPNPVITRQDSTAKPDNKSNKSQGQTQQSQWNPLQRAAAMALDIAENALVSRERQHPLPKTADPSVQIGGNFAPVPELPVRHGLPVTGSIPECINGVYLRNGANPLFEPVAGHHFFDGDGMVHAVAIGNGSASYACRFTETQRLMQERELGRPVFPKAIGELHGHNGIGRLLLFYARGLFGLVDHKQGTGVANAGLVYFNNRLLAMSEDDLPYQVRITPSGDLETVGRYNFNHQLKSTMIAHPKVDPVSKELFALSYDVVQKPYLKYFRFSADGDKSPDVEIHLPVPTMMHDFAITENFVVIPDQQVVFKLQEMITGGSPVIYDQNKKSRFGILAKNAKDSNDVIWIESPDTFCFHLWNAWEEPETDEVVVIGSCMTPADSIFNECDESLKSVLSEIRLNLKTGESTRRPILSESDQVNLEAGMVNRNRLGRKTQFAYLAIAEPWPKVSGFAKVDLSSGEVKKYFYGDNKYGGEPFFLPRDANNSENEDDGYILAFVHDEKTWKSELQIVNAMNLQLEASIQLPSRVPYGFHGT

SEQ ID NO: 22813 - protein, 121 aa, Listeria innocua
MSGLTKIEIITRPNRFHLFQKELAKIGVSGLTVTKALGTGLEKGFIELYRGTKKESNVHERMKIEIVVSTVPVEDVLRVVKETLRTGEPGDGKVFIYPLAEVVKISTGETGIDALQDKPAK

SEQ ID NO: 22814 - protein, 569 aa, Citrus unshiu
GSCKDSCSSPSFSSSRARIAFSLKKPTEITCSLQTPSILHFPKQSPKYPPSPAASPPPSSPPLTTKQQPKENDNFAPSKWNFLQKAAALALDAVENALVSQERQHPLPKTADPTVQIAGNFSPVPEKPVCQNLPTTGKVPDCIQGVYVRNGANPLHEPVAGHHFFDGDGMVHAVKFNKGSVSYSCRFTETNRFVQERSLGHPVFPKAIGELHGHTGIARLLLFYSRALFGLVDPSHGTGVANAGLVYFNNRLLAMSEDDLPYHVRVTPSGDLKTVGRFDFSGQLKSTMIAHPKVDPVTGDLFALSYDVVKKPYLKYFRFSPQGIKSPDVEIPLEEPTMMHDFAITENFVVVPDQQVVFKLNEMIRGGSPVIYDKNKVSRFGILDKNATDASKMKWIDAPDCFCFHLWNAWEEPERDEVVVIGSCMTPADSIFNECDESLKSVLSEIRLNLKTGESTRRPLISEDEQVNLEAGMVNRNLLGRKTRFVYLALAEPWPKVSGFAKVDLLTGQVNKFIYGDQRYGGEPLFFPRDPNSENEDDGYILAFVHDEKEWKSELQIVNAMTLELEATV

SEQ ID NO: 22815 - protein, 361 aa, Pyrococcus furiosus
MQAVVLAGGKGTRLLPLTVYRPKPMIPFFNRPIMEYIVESLVKFGVDEIIVLVGYLKERIFEYFGNGEEFGVEIKYSNGENLKLGTAGALKKAEKLIQDTFLVVSGDILTNLDFRSLVEYHKKKGGPATIALTKVEDPSAYGVAVLDKEGRISYFKEKPKREEAPSNLVNAGIYVFEPEIFDLIPKGKNFDFSLDLFPKMLNENIPIYGYPFDEYWNDIGRPSTYLQATEDVFLGKLRLPQINVGSLKGNIEKGGSLFTGSRCILRRPRIIGFAVLGNNVEISKDVTIERSVIFSNVTIEEGAEIREAIIGENVYIGKGVVIEPGSVIGDNSIIEDFSKVGANVKIWADSRIGKESIILPD

SEQ ID NO: 22816 - protein, 385 aa, Populus tomentosa
MAIDCIKTMPSITTPQHHPKDQDQCKDDGKSFVFDAQILRHQTNIPQQFVWPDHEKPNINAPELQVPLVDLGDFLSGNPVAAVEASRLVGEACKKHGFFLVVNHGVDKTLIAHAHNYVDTFFKLPLSEKQKAQRKIGESCGYASSFTGRFSSKLPWKETLSFRYTAEENSSKHIEEYFHNRMGEDFAEFGTVYQDYCEAMSTLSLGIMELLGMSLGVSREHFREFFNENDSIMRLNYYPPCQKPDLTLGTGPHCDPTSLTILHQDQVGGLQVFVDNEWRSINPNFDAFVVNIGDTFMALSNGIYKSCLHRAVVNGQTPRKSLAFFLCPKNDKMVTPPHELVDTCNPRIYPDFTWPMLLEFTQKHYRADMKTLEVFTNWLHQRSFT

SEQ ID NO: 22817 - protein, 503 aa, Plantago major
MGELSGIENGNKAIGEEAIPVWKFVLVASLAAGIQFGWALQLSLLTPYIQMLGLPHGAASFIWLCGPVSGLLVQPLAGYFSDRCKSRFGRRRPFIMSGACLVAAAVILIGFAADIGHSAGDDMTKKTKPRAVVVFVVGFWILDVANNMLQGPCRAFLADLSAGDEKKMTHAMSFFAFFMGIGNVLGYAAGSYNNLHRLLPFTRTDACEIFCANLKTCFLIHICLLMCLTITALSVVKEPLVNVVDDERKGGSLMVFVELFGALKNLSKPMWILMLVTCLNWIAWFPFLLYDTDWMGREVYGGKVNQSVYDMGVRAGAIGLMLNSVVLGITSILLYFFSKGAKAAKTWWLGVNIVLAVGLAGTVWVSYHAKSVRQLGASGEALPPSFEVKASALAIFAILGIPLAVTFSVPFALAAIYCSRNTNTGGAGQGLSLGVMNLSIVIPQIIVSLSSGPLDKAFGGGNLPAFIMGAVGAVFSGVLAFILLPAPKVDNGVNPFAVGGGGH

SEQ ID NO: 22818 - protein, 386 aa, Zea mays
  misc_feature (83)..(83): Xaa can be any naturally occurring amino acid
  misc_feature (99)..(99): Xaa can be any naturally occurring amino acid
  misc_feature (246)..(246): Xaa can be any naturally occurring amino acid
  misc_feature (321)..(321): Xaa can be any naturally occurring amino acid
MATAAASSLLKSSFAGSRLPAATRTTPASLVVATGPRGAGAGPICASMSMSSSNPPYDLTSFRFSPNEEAIAMREMTQLYMRXLISYRDTRRSACAGGXSVGVSCAHDLAKDPGASIAIADQFVSPGGVPRLGGQLFSCMVVRKPAHLILDELGVAYDEGEDYVVIFFAALFTSTVMSLLLARPNVKLFNAVAVEDLIVREGRVDGVVTNWALVSMNHDTQSCMDPNVMEAKVVVSSCGHDGPFGXATGVKRLQDIGMISAVPGMKALDMNTAEDEIVRLTREVVPGMIVTGMEVAEIDGAPRMVSSEEDNTHVIAILTEXMRNMSKIVCWLLQGPTFGAMMISGQKAAHLALKALGRPNAVDGTMSPPLREELMIAYKDDEVVDA

SEQ ID NO: 22819 - protein, 296 aa, Saccharomyces cerevisiae
MITTPLVHVASVEKGRSYEDFQKVYNAIALKLREDDEYDNYIGYGPVLVRLAWHISGTWDKHDNTGGSYGGTYRFKKEFNDPSNAGLQNGFKFLEPIHKEFPWISSGDLFSLGGVTAVQEMQGPKIPWRAGRVDTPEDTTPDNGRLPDADKDAGYVRTFFQRLNMNDREVVALMGAHALGKTHLKNSGYEGPWGCANNVFTNEFYLNLLNEDWKLEKNDANNEQWDSKSGYMMLPTDYSLIQDPKYLSIVKEYANDQDKFFKDFSKAFEKLLENGITFPKDAPSPFIFKTLEEQGL

SEQ ID NO: 22820 - protein, 401 aa, Streptococcus pyogenes
MNEFEDLLNSVSEVNPGDVVTAEVLTVDNGQANVVIEGTGVEGVLTLRELTNDRDADINDFVKAGDTVEVLVLRQVVGKDTDTVTFLVSKKRLEARKAWDKLVGREGEVVTVKGTRAVKGGLSVEFEGLRGFIPASMIDTRFVRNTEKFVGQEFDAKIKEVDAAENRFILSRREVIEEAAKEARAEVFSKISEGAVVTGTVARLTSFGAFIDLGGVDGLVHVTELSHERNVSPKSVVSVGEEVEVKVLSIDEEAGRVSLSLKATTPGPWDGVEQKLAQGDVVESKVKRLTDFGAFVEVLPGIDGLVHISQISHKRVENPKDVLSVGQEVTVKVLEVNAADERVSLSIKALEERPAQAEGDNKEEKRQSRPRRPKRESRRDYELPETQTGFSMADLFGDIEL

SEQ ID NO: 22821 - protein, 978 aa, Bacillus anthracis
MAEQTVRVTVDGKEFSASGEKTILQLFNESNLEHPQICHVPEVDPIQTCDTCIVEVDGKLMRACSTQIENGMHIERQSQRAKEAQTEAMDRILENHLLYCTVCDNNNGNCKVHNTVHMMGIEEQKYPYEPKVSACEVDMSHPFYRYDPNQCIACGQCVEVCQNLQVNETISIDWSLDRPRVIWDHGVSINDSSCVSCGQCVTVCPCNALMEKSMLGEAGFMTGLKPDVLDPMIDFVKDVEPGYSSILAVSEVEAAMRKTKVNKTKTVCTFCGVGCSFEVWTKDRHILKVQPVSDAPVNGISTCVKGKFGWDFVNSEDRITKPLIRQGDMFVEASWEEALEVVASNMQHIKSAYGSDAFGFISSSKVTNEENYLMQKLARQIYGTNNVDNCSRYCQSPATDGLFKTVGMGGDAGTVKDIAEAGLVIIVGANPTEGHPVLATRVKRAHKLHEQKLIVADLRKHEMAERADLFIHPRQGTDYVWLAGITKYIIDQDWHDKKFIAENVKNFDEYSKMVEKYTLDYTEKITGISKENLKEMARMVYEADGTCVLWGMGVTQNTGGSTTSAAISNLLLVTGNYRRPGAGAYPLRGHNNVQGACDMATLPNWLPGYQAVSDDTLRAKFEKAYGTTIPKAPGLNNIAMLLAAEEGKLRGMYVMGEEMALVDSNANHVQHILANLDFLVVQDMFLSKTARFADVILPAAPSLEKEGTFTNTERRIQRLYEVLKPLGDSKPDWWILQKVARALGGDWNYESPSEIMDEIASLAPLYSQATYDRLEGWNSLCWGSHDGSDTPLLYVDGFNFPDKLARLSLDEWIPPVVAPDEYDLLLNNGRMLEHFHEGNMTNKSAGILSKVSEVFVEISPELAIERNVKDGGLVELASPFGKIKVQALITDRVTGKELYLPMHATINEEAINILTGTATDLYTCTPAYKQTMVKMRVLREKGNRPLPPSNPRDKNRNPQNGVEIEQKWQRKQYVSLVD

SEQ ID NO: 22822 - protein, 450 aa, Clostridium symbiosum
MSKYVDRVIAEVEKKYADEPEFVQTVEEVLSSLGPVVDAHPEYEEVALLERMVIPERVIEFRVPWEDDNGKVHVNTGYRVQFNGAIGPYKGGLRFAPSVNLSIMKFLGFEQAFKDSLTTLPMGGAKGGSDFDPNGKSDREVMRFCQAFMTELYRHIGPDIDVPAGDLGVGAREIGYMYGQYRKIVGGFYNGVLTGKARSFGGSLVRPEATGYGSVYYVEAVMKHENDTLVGKTVALAGFGNVAWGAAKKLAELGAKAVTLSGPDGYIYDPEGITTEEKINYMLEMRASGRNKVQDYADKFGVQFFPGEKPWGQKVDIIMPCATQNDVDLEQAKKIVANNVKYYIEVANMPTTNEALRFLMQQPNMVVAPSKAVNAGGVLVSGFEMSQNSERLSWTAEEVDSKLHQVMTDIHDGSAAAAERYGLGYNLVAGANIVGFQKIADAMMAQGIAW

SEQ ID NO: 22823 - protein, 112 aa, Burkholderia vietnamiensis
MKRITAIIKPFKLDEVREALAEVGLTGLTVTEVKGFGRQKGHTELYRGAEYVVDFLPKMKIEVVVAEAQVDQVIDAVIGAARTGKIGDGKIFVSDVERVIRIRTGEENEAAV

SEQ ID NO: 22824 - protein, 595 aa, Unknown
  Rhodococcus sp. RHA1
MTATLDAPVDTNIPQPGDIARRWLAGFGATLERGDARGAAQHFLVDGWWRDLLSFTWDLHTTHGRADIESRLADSVPVHEPRHLVLSPAHPAEAVADPEGDWIQAFFTFETTLARSRGFVRLRRDDDGEWRAWTLISAMEEIKGHEEKKGHRRVQGTNHGAHRGKINWLDRRTAKGEFETEQPAVVIVGAGQGGLALAARLGQLGVDTLLVERNDRIGDSWRKRYHSLVLHDPVWYDHLPYLNFPDHWPVFTPKDKLANWFEFYADAMELNVWTGTEFTGGSYDDATGEWTVTVARDDGSTRTLHPRHVVLATGMSGVPNIPRIAGADTFEGTIEHSSWFVGGREMQGKKALVVGCCNSGHDIAQELNEQGADVTILQRSSTYVMSSKHGIPGLFGGVYEEGGPAVQDADLIFASLPYPLLAGIHAGATEAIAEKDAEMLDGLRKAGFKVDFGEDGSGLFMKYLRRGGGYYIDVGASELIASGEVSVKQGTEIDHFTPDGVVFADGTEMPVDVVVLATGYKNMRESARKFLGDAVADRCQDVWGLDAEGELRTVWRRSGHPGFWFMAGNLHQSRHYSKYLAFQIKAQEEGLQPIR

SEQ ID NO: 22825 - protein, 363 aa, Shewanella oneidensis
MNPVFTPNVAQKILFIDRDGTLIEEPVTDKQVDNLAKLVFEPQVIPALLRLQKAGFRLVMVSNQDGLGTPSFPQEDFDAPHNMMMQILSSQGVKFEDVLICPHFNDENCSCRKPKLGLVKDFLTQGFIDFTQSAVIGDRHTDVELGNAMGIISFQYQRGSLGWNAIADALLNKGRSATVVRTTKETDIRVTVDLDNASKGTINTGIGFFDHMLDQIATHGNFKMEVNVDGDLEIDDHHSVEDTALAIGDALRQALGDKRGIARFGFSLPMDEAKGECLLDLSGRPFIKFAAQFEREKVGEMATEMVPHFFRSFADGLRCTLHVAAEGDNDHHKVEALFKVLGRALRQAVKVEGDVLPSSKGVL

SEQ ID NO: 22826 - protein, 335 aa, Nepenthes khasiana
MLIALLLGILFATINTRASQIGTCFGMMANNLPPLPDVVAQYNQYSIERMRIYGPVSSLSQALSGSGIELVLGVPNQDLQAIASSQSNANSWVQDNIGAYPNVNFRYLAVGNEIRPNLNNGAAQYAQCVLPAMQNLQNAINQMGYGGRVKVSTAVEMGVAINTYPPSAGQFDPSISYFINPIVRFMRDNGSPLLLNCYPYFAYAYSSNIDLSYALFTSPGTVVQDGQYAYQNLFDAMVDSIYSALEKADCGSVVIVVSESGWPTMGGKGTSIDNAKTYNNNLIQNVKKGTPKRPGAYLETYILDMYDEDLKSSELEQHWGLFTANGDLKYPVNFN

SEQ ID NO: 22827 - protein, 459 aa, Debaryomyces occidentalis
MIKNGLPHEPEFQQAYNELVSALEESTLFTEKPEYKKVIPVVSIPERIIQFRVAWENDNGDVEVNNGFRVQFNSSLGPYKGGLRFHPSVNLSILKFLGFEQIFKNALTGLSMGGGKGGCDFNPKGRSDGEIRRFCVAFMRQLARYIGADTDVPAGDIGVGGREIGYLFGAYKQMQNNWYGVLTGKGLTWGGSLIRPEATGYVSFTTLKKMIEKATNGKESFKGKRVELSGSGNVAQYAALKVIELGGIVVSLSDSKGSIVSKNGIVPEQVLEIAAAKLKFKSLEEITKESVKLFSGENSVEYLAGVRPWAKVGHFDVALPSATQKEVSGEEEAKALVEAGCKYIAEGSNMGSTKEAIDVFEANRSNNVWYAPGKAANCGGVAVSGLEMAQNSQRVQWSAEEVDAKLKNIMYTCFDNCYDPAIKYSAEKNADGLPSLLKGANIASFIKVADAMFDQGDVY

SEQ ID NO: 22828 - protein, 233 aa, Brassica napus
  misc_feature (148)..(148): Xaa can be any naturally occurring amino acid
HTKHMSFLDKAAIITEQDNLKPGQIPNPWRLSTVHRVEELKSVIRMGPIGASGILLITAYAQQGTFSLQQAKTMNRHLTESFQIPAGSMSVFTTVAMLSTIVFYDRVFVKIARKFTGLERGITFLHRMGIGFVISIVATLVAGFVEIXRKRVAIDHGLLDKPHTMVPISFLWLVPQYSLHGIAEAFMSIGHLEFFYDQAPESMRSTATALFWMAISIGNYVSTLLVTLVHRFS

SEQ ID NO: 22829 - protein, 562 aa, Pseudomonas fluorescens
MCVCFEVSDREARFMQTAYTVLILLMLVSLSRLVGRVIPLPLPLVQIAAGALLAWPTLGLHVALDPELFLFLFLPPLLFSDGWRMPKREFWRLRGPILTLAVGLVLFTVVGAGYFIHWLLPSIPLPVAFALAAVLSPTDAVAVSAISQNRLPTPLMHMLQGEALMNDASGLVTFKFALAAAVTGVFSLANASLTFVLVAVGGLAVGVALSWLVGRLRAWMIARGWDDPATHVVFMLLLPFAAYVLAERLGASGILSAVAAGMMQSWLDLLPRQTSTRLLNRSVWSLLEFAFNGLIFLLLGLQLPDIIKAVVSHETSLWPILFYRCLDVVAIFLVLLVLRFIWVQSIWRLSGLLRRWRGKGELTLVPTARSCWLLTVGGVRGAVTLAGVMSVPLFLGAGEAFPERDLLIFIAAGVILLSLVAACIALPLLLRGIVKSPDDKRRGEVRDAWRKTAEAAIHALEAEEVADTGETPDAAQAALATELKGRLMAEYRHQLEVYNDSAEAQALAFQMDLLERRLRIKALRAQRLELYRLSRQHQIGDDVLREVLADLDMSEANLGQVK

SEQ ID NO: 22830 - protein, 561 aa, Bacillus subtilis
MSEWWKEAVVYQIYPRSFYDANGDGFGDLQGVIQKLDYIKNLGADVIWLSPVFDSPQDDNGYDISDYKNMYEKFGTNEDMFQLIDEAHKRGMKIVMHLVVNHTSDEHAWFAESRKSKDNPYRDYYFWKDPKSDGSEPNNWGSIFSGSAWTYDEGTGQYYLHYFSKKQPDLNWENEAVRREVYDVMRFWMDRGVDGWRMDVIGSISKYTDFPDYETDHSRSYIVGRYHSNGPRLHDFIQEMNREVLSHYDCMTVGEANGSDIEEAKKYTDASRQELNMIFTFEHMDIDTEQNSPNGKWQIKPFDLIALKKTMTRWQTGLMNVGWNTLYFENHDQPRVISRWGNDGKLRKECAKAFATDLDGMKGTPFIYQGEEIGMVNRDMPLEMYDDLEIKNAYRELVVENKTMSEKEFVKAVMIKGRDHARTPMQWDAGKHAGLTAGDPWIPVNSRYQDINVKESLEDQDSIFFYYQKLIQLRKQYKIMIYGDYQLLQENDPQVFSYLREYRGEKLLVVVNLSEEKALFEAPPELIHERWKVLISNYPQERADLKSISLKPYEAVMGISI

SEQ ID NO: 22831 - protein, 175 aa, Streptococcus thermophilus
MVREDAMERAIFAGGCFWCMVQPFEEQEGILSVRSGYTGGHVPNPTYEEVCSKTTGHTEAVEIIFDPEIISFADLVEIYWAQTDPTDAFGQFEDRGDNYRPVIYYFDERQKKIAEQSKDNLQASGRFDRPIVTKIEPAETFYEAEAYHQGFYKTNPERYAQSSAIRHQFLEENWK

SEQ ID NO: 22832 - protein, 396 aa, Bacteroides thetaiotaomicron
MAEKRDYYEVLEVTKTATVEEIKKAYRKKAIQYHPDKNPGDKEAEEKFKEAAEAYDVLSNPDKRSRYDQFGHAGVSGAAGNGGPFGGFGGEGMSMDDIFSMFGDIFGGRGGGFSGGFGGFSGFGGGGGGSQQRRYRGSDLRVKVKMTLKEISTGVEKKFKLKKYVPCNHCHGTGAEGDGGSETCPTCKGSGSVIRNQQTILGTMQTRTTCPTCNGEGKIIKNKCKECGGDGIVYGEEVVTVKIPAGVAEGMQLSMGGKGNAGKHNGVPGDLLILVEEEPHPDLIRDENDLIYNLLLSFPTAALGGAVEIPTIDGKVKVKIDSGTQPGKVLRLRGKGLPNVNGYGTGDLLVNISIYVPEALNKEEKSTLEKMEASDNFKPSTSVKEKIFKKFKSFFD

SEQ ID NO: 22833 - protein, 182 aa, Novosphingobium aromaticivorans
MPDTLAAIPLTRIDGTADSLANHAGKVLLVVNVASKCGLTPQYEGLEALYKARKDEGLEVLGFPANDFGAQEPGSHEEIAEFCKLNYGVSFPLFAKADVTGPGKQPLYAALTEAAPTKQGPAQEFRDRLKGYGMTPTEDPEVLWNFEKFVIGRDGEVAARFAPGVTPDDPALLAAIDAELAK

SEQ ID NO: 22834 - protein, 245 aa, Pseudomonas fluorescens
MSQVNMRDMLKAGVHFGHQTRYWNPKMGKYIFGARNKIHIINLEKTLPMFNEALTFVERLAQGKNKILFVGTKRSAGKIVAEEAARCGSPYVDHRWLGGMLTNYKTIRASIKRLRDLEVQAEDGTFAKLTKKEALMRTRDLEKLDRSLGGIKDMGGLPDALFVIDVDHERIAITEANKLGIPVIGVVDTNSSPEGVDYIIPGNDDAIRAIQLYMGSMADAVIRGRNNVAGGTEVFEEAAAPAAEA

SEQ ID NO: 22835 - protein, 546 aa, Magnaporthe grisea
MNGTHNPDRAVNGVHRSNGTNGTNGTRANGVNGTMTHEDYDVVIIGAGISGINSAYRLREAFPDLKFAVLERRNVIGGTWSFWKYPGIRSDSSLSVFGFSWHPWPHEVDFAPAHLITEYIEDAAKTQGLDKHIRFGYDVQSSSWSSDEQKWTLEAEVHHQRQGGDDDDDDVRHVTIKTGWVFMCSGYYDYSRAREVDIPGLERFQGEVVHPQFWPEETDCTGKRVVIVGSGATAITIMPDIVDKAAQVTMLQRSPSYVLALPKRDRIRNLLRRILGIRLASKIDFWRRCLLEVIFAQGFLLNFPEAGRRYLNMEAKKNLPSDYPVDVHFNPRYNPFEQRLCMSPDGDFWQALKRPNCQVVTATIDSCDEGGLVLKQGPKGVHTPERLDADMIITATGLYVQMLDGKSPVVDGKVKPTNESYIWRSCMLDGVPNACSIQGYVAGSWTPGADVRIKTVLAVMKHQRRVGATSATPYMTPEERRSMPKRPVIPNSSTYLKEARSRLPLVGDRDPWRYGSNVAADMWQYYTGSVTKGMKYAMSGNKEHED

SEQ ID NO: 22836 - protein, 814 aa, Burkholderia thailandensis
MRKMKLVMVGNGMAGVRTLEELLKLAPDLYDVTVFGAEPHPNYNRILLSPVLAGEQTLEQIVLNDYAWYESHGITLHVGKKIVKIDRVKRVVIADDGTEAAYDRLLLATGSNPFMLPIPGADLDGVLGYRDIADTQAMIDAAARHTHAVVIGGGLLGLEAANGLKLRGMDVTVAHLAPTLLERQLDAKAGGLLRASLEARGLTFLMPKETQALVGDENGRVRAVRFKDGDTCKADLVVMAVGIRPNTALAESAGLYCNRGIVVNDTMQTYDPRIYAVGECVSHRGIAYGLVAPLFEQAKVAANHLAQFGIGRYAGSVTSTKLKVTGIDLFSAGDFLGGGDTEDITLSDPIAGVYKKLVIKDDKIVGACLYGDTADGAWYFKLLREGRNIADIRETLMFGETSLGDTGHSGATRATAMADDAEVCGCNGVCKGTIVAAIKEKGLFTLDDVRKHTKASASCGSCTGLVEQILMSTVGGDYSASPKAKPICGCTDHTHAEVRMAIREHKLLSVPDAMRFLEWRTPNGCASCRPALNYYCISTWPHDAKDDPQSRFINERAHANIQKDGTYSVVPRMWGGVTSADELRRIADVVDKYAIPTVKVTGGQRIDLLGVKKEDLPGVWRDLGMPSGHAYAKALRTVKTCVGSEWCRFGTQDSTLMGQQLERALWRMYAPHKVKLAVSGCPRNCAESGIKDVGVIGVDSGWELYVGGNGGIKTEVAQFFCKVKTHEEVLEYAGAFLQLYREEGWYLERTVHYLERVGLDHVKARVLDDAENRRALWERLQFALKDEPDPWRDTQDAKVDLRQFIPIAVAPADA

SEQ ID NO: 22837 - protein, 569 aa, Citrus limon
SSCKDSCSSPSFSSSRARIAFRLKKPTEITCSLQTPSILHFPKQSPKNPPSPATSPPPSSSPLTTKQQPKENDNFAPSKWNFLQKAAALALDAVENALVSQERQHPLPKTADPTVQIAGNFSPVPQKPVCQNLPTTGKVPDCIQGVYVRNGANPLHEPVAGHHFFDGDGMVHAVKFNEGSVSYSCRFTETNRFVQERSLGRPVFPKAIGELHGHTGIARLLLFYSRALFGLVDPSHGTGVANAGLVYFNNRLLAMSEDDLPYHVRVTPSGDLKTVGRFDFSGQLKSTMIAHPKVDPVTGDFFALSYDVIKKPYLKYFRFSPQGIKSPDVEIPLEEPTMMHDFAITENFVVVPDQQVVFKLNEMIRGGSPVIYDKNKVSRFGILDKNATDASKMKWIDAPDCFCFHLWNAWEEPERDEVVVIGSCMTPADSIFNECDESLKSVLSEIRLNLKTGESTRRPIISEDEQVNLEAGMVNRNLLGRKTRFAYLALAEPWPKVSGFAKVDLLTGQVNKFIYGDQRYGGEPLFFPRDPNSENEDDGYILAFVHDEKEWKSELQIVNAMTLELEATV

SEQ ID NO: 22838 - protein, 444 aa, Candida albicans
MPPKEDWDKYIPPSEEETSEKITPLTEGDIQVLKTYGTAPYADSLKEIEKDLKTIEERIKTNQGIKESDTGLAPPHLWDVLGDKQRMQEEQSLQVARCTKIIEASQPQQPTGLQNADTKSKYVINIKQIAKFVVGLGERLSPTDIEEGMRVGVDRHKYEIQLPLPPRIDPSVTMMTVEEKPDVTYSDVGGCKEQIEKLREVVELPLLSPERFVKLGIDPPKGILLYGPPGTGKTLCARAVANRTDATFIRVIGSELVQKYVGEGARMVRELFEMARTKKACIIFFDEVDAIGGARFDDGAGGDNEVQRTMLELITQLDGFDPRGNIKVMFATNRPNTLDPALLRPGRIDRKVEFSLPDLEGRANIFRIHSKTMSVEKDIRWELISRLCPNATGAELRSVCTEAGMFAIRARRKVANEKDFLKAVDKVIKGNLKFSSTSQYMQYN

SEQ ID NO: 22839 - protein, 282 aa, Brassica oleracea
MAENADLVEWPKKDKRRFLHVVYRVGDLDRTIQFYTECFGMKVLRKRDVPEEKYSNAFLGFGPETSNFVVELTYNYGVSSYDIGTGFGHFAISTQDVSKMVEAVRAKGGNVTREPGPVKGGGSVIAFVKDPDGYTFELIQRGPTPEPLCQVMLRVGDLDRAVKFMEKALGMRLLRRIERPEYNTIGMMGYAEEYESIVLELTYNYGVTEYTKGNAYAQIAIGTDDVYKSAEVVKIVNQELGGKITREAGPLPGLGTKIVSFLDPDGWKQVLVDNEDFLKELE

SEQ ID NO: 22840 - protein, 544 aa, Bordetella bronchiseptica
MSLARVGIAQINACVGDLAGNAARVLQAARQAAGQGADVLVTPELVLTGYPPEDLLLRPRFIQEQQAVFERLCQDLAGLAGLHVVIGHVLARQDRLYNAATVVCEGRVLGSYCKRELPNYSVFDEQRYFSAHGEAFGFTVKGVRFGLNICEDIWFERAPRAAAADGAQVLLVPNASPYNTGKQEERLSVARRSVQDTGCALIYANLVGGQDELVFDGASFALDAQGRMSARLPDFTEGVNVLEVDARGTVRPVTEQAAVQPYGLEEQVWNALVLGVRDYLGKNGFPGAIIGLSGGIDSAVVLAVAVDAVGADNVRAVMMPSRYTADISLTDAADMARRLGVQYDVIAIGEVVDRFEAALAPQFAGLPVDATEENIQARARGTLLMALSNKTGRLVLTTGNKSEMTTGYCTLYGDMAGGFAVIKDVPKTLVYRLANWRNRRQPIIPERIITRPPSAELRPDQTDQDSLPPYDILDGIIERYMEHNASAADIVAAGFPREAVGQVVRLIRINEYKRRQAPPGPRITPRAFGRDWRYPVTNGFRETV

SEQ ID NO: 22841 - protein, 185 aa, Solanum lycopersicum
MASESKDSPSNNPGLHATPDEATKGYFLQQTMFRIKDPKVSLEFYSKVLGMSLLKRLDFPEMKFSLYFMGYEDTASAPSDPVERTAWTFSQKSTLELTHNWGTESDPNFTGYHNGNSEPRGFGHIGVTVDDVYKACERFESLGVEFVKKPLDGKMKGIAFIKDPDGYWIEIFDTKIIKDAAGSAS

SEQ ID NO: 22842 - protein, 963 aa, Triticum aestivum
MPMPMRTMLLRHLSPAPALPNPRRSSASSPQRRPARARPPPLHSARATALRARRTPMAAGETGASVSVSAAEAEAEATQAFMPDARAYWVTSDLIAWNVSEQEAASVYLYASRTAAMGLSPSNGGIQGYDSKVELQPESAGLPETVTQKFPFISSYRAFRVPSSVDVASLVKCQLVIASFGADGKHVDVTGLQLPGVLDDIFAYTGPLGAVFREDSVSLHLWAPTAQDVSVCFFDGPAGPVLETVQLKESNGVWSVTGPREWENRYYLYEVDVYHPTKAQVLKCLAGDPYARGLSANGARTWLVDINNETLKPASWDELADEKPKLDSFSDITIYELHIRDFSAHDGTVDSDSCGGFRAFAYQASAGMQHLRKLSDAGLTHVHLLPSFHFAGVDDIKSNWKFVDECKLATFPPGSDMQQEAVVAIQEEDPYNWGYNPVLWGVPKGSYASDPDGPSRIIEYRQMVQALNRIGLRVVMDVVYNHLDSSGPCGISSVLDKIVPGYYVRRDTNGQIENSAAMNNTASEHFMVDRLIVDDLLNWAVNYKIDGFRFDLMGHIMKHTMMRAKAALQSLTRDAHGVDGSKIYLYGEGWDFAEVARNQRGINGSQLNMSGTGIGSFNDRIRDAVNGGNPFGNPLQQGFNTGLFLEPNGFYQGNEADTRRSLATYADQIQIGLAGNLRDYVLITHTGETKKGSEIHTFDGLPVGYTSSPIEIINYVSAHDNETLFDVISVKTPMNLSVDERCRINHLASSMMALSQGIPFFHAGDEILRSKSIDRDSYNSGDWFNKLDFTYETNNWGVGLPPSEKNEDNWPLMKPRLENPSFKPAKGHILAALDSFVDILKIRYSSPLFRLSTASDIKQRVHFHNTGPSSVPGVIVMGIEDARDEKPEMAQLDANFSYVVTVFNVCPHEVSMDIPALASMRLELHPVQVNSSDALVGKSVYEAATGRFTVPRRTVSVFVEPRC

SEQ ID NO: 22843 - protein, 554 aa, Pseudomonas fluorescens
  misc_feature (446)..(446): Xaa can be any naturally occurring amino acid
MAYYRTPHDVTALPAWQALNDHRKAMQDFSMREAFNADPQRFTQFTLSSCGLFLDYSKNLINAQTRDLLVGLANEVDLKGAIKSLFEGEIVNASENRPALHTALRRPVGDKLLVNGVNVMPDVHKVLNQITDLVGRIHDGLWRGYTEKPITDVVNIGIGGSFLGPELVSEALLSYAQKGVRCHYLANIDGSEFHELTMKLRAETTLFIVSSKSFNTLETLKNAQAARAWYLAQGGSEAELYRHFIAVSSNNAAAVAFGIREENIFPMWDWVGGRYSLWSAIGLPIALAIGMSNFKELLSGAYSMDQHFQSAPFEQNMPVLLALLGVWYGNFWGAQSHAILPYDHYLRNITKHLQQLDMESNGKSVRQDGTPVSTDTGPVIWGGVGCNGQHAYHQLLHQGTQLIPADFIVPIVSFNPVSDHHQWLYANCLSQSQALMLGKTRAEAEXELRDKGASEEEVQKLASHKVIPGNRPSNTLVVERISPRRLGALVALYEHKVFVQSVVWGINAFDQWGVELGKELGKGVYNRLVGSEESLAEDASTQGLINYFRGRHRG

SEQ ID NO: 22844 - protein, 461 aa, Fusobacterium nucleatum
MITVKDIFRHGEDYLDKEIELFGWVRKIRDQKKFGFIELNDGSFFKGVQIVFEEGLENFDEVSRLSIASTIKVKGTLVKSEGSGQDLEVKAKKIEIFQKADLEYPLQNKRHTFEYLRTKAHLRARTNTFSAVFRVRSVLAYALHKFFQENNFAYVHAPIITGSDAEGAGEMFRITTLDLNKVPKKENGEVDFSKDFFGKSTNLTVSGQLNLETFCAAFRNVYTFGPTFRAEYSNTARHASEFWMVEPEIAFGDIFALMELAEAMVKYIIKYVMDNCPEEMEFFNSFIEKGLFDKLNNVLNNDFGRVTYTEAIEILEKSGKKFEFPVKWGIDLQSEHERYLAEEYFKKPVFVTDYPKDIKAFYMKLNEDNKTVRAMDLLAPGIGEIIGGSQREDNYELLTKRMKELGLNEEDYEFYLDLRRFGSFPHSGYGLGFERMMMYLTGMQNIRDVIPFPRTPNNAEF

SEQ ID NO: 22845 - protein, 681 aa, Leifsonia xyli
MTDPVSSPYPLGVTLLSGGANVAVYSERADRVTVCVFGEDGAETRTELTDRTGHVFHGVVPGMATGARYGLRVDGPWDPTGGQRFSPAKVLLDPHARAVVGAWDLSQADFGHQLRHPHRRDDTDGSGHVALGVATGPGFDWGDDRPPRIPLGETVIYEMHVKGFTQRMPGVPEELRGTYAGLANEAAIDYLKGLGVTAVELLPVHQFVQDLHLLEKGLRNYWGYNSIGFFAPHNEYAATGAIGQQVDEFKGMVKALHAAGIEVILDVVYNHTAEGNHLGPTLSFKGIDNPSYYRLVEGDERHYFDTTGTGNSVNVSHPAALQLILDSLRYWVEEVHIDGFRFDLATALTRQGGDASLHSAFLTLVQQDPTLKPVKLIAEPWDVAGYQLGGFPADWSEWNGRFRDDVRDFWRGTEGMLATLSQRVLGSPDIYEDSRRTPLSSVNFVTAHDGFTLADLTSYEQKRNEDNGEDNQDGESDNRSANYGAEGPTDAPGILAVRLRQRKNFLATVLLSAGVPMILGGDEIGRTQRGNNNAYCQDGEISWFDWAAADEELRAFTERLIRLRRAEPALRPEWYRRAPEAGGRDVVRILRADGEPFAAEDWEEPDARSIAFELRHEGADTFLLLLNAAANGVEFTLPATVDGPWSLELSSDPGLELGDGESVIAGEISFALLRSALREGL

SEQ ID NO: 22846 - protein, 505 aa, Nocardia farcinica
MSGAQRPLDVAVIGAGFAGLGAAIRLRRRGITDIAILERDTRVGGTWRDNTYPGAACDIPSRLYSYSFAPNPDWSRTYSGSAEILGYIEAMVERFGLRRHLRFGHNVTGLVYDESAGEWSITVDGHERPLRARAVVLASGPLSNAGLPDIDGIDTFEGHMMHSARWDHDYDVTGKRVAVVGTGASAVQIIPELVDRAAAVTVYQRTPGWVLPRVDRGTGELTRALYRRIPFTQKLAREAWFWGHESVALGVVWNSPLTKVVEQVSRLHLRAQVRDPWLRRQLTPEFRAGCKRLLMSNDYYPALQAPNCELITWPIVRIVPGGIRTAEGIEHRADCIVFATGFEVSKSGAPIPVTGRDGRSLDEEWRRGPYAYKSVAVAGYPNLFLTFGPNSGPGHNSALVYMEAQIDYIARAVDLLLTRDLHSLEVDRHRQDRYNAALQRRLAATTWNSGCRSWYLTEDGFNATMYPGFGTQYVRQLARLDLDDWIVTPRANTPAVTGAALSSLG

SEQ ID NO: 22847 - protein, 242 aa, Bacillus clausii
MAVISMKQLLEAGVHFGHQTRRWNPKMDRYIFTERNGIYIIDLQKTVKKVETAYNFVRDLAADGGKILFVGTKKQAQDSVRDEAIRCGMYYINQRWLGGTLTNFETIQKRITRLKNLEKMQEDGTFDVLPKKEVILLKKEMDRLEKFLGGIKDMNGVPDALFVIDPRKERIAIAEAHKLNIPIVAIVDTNCDPDEIDYVIPGNDDAIRAVKLLTGKMADAVIEATAGESEEEVDVEEETTTA

SEQ ID NO: 22848 - protein, 530 aa, Mycobacterium smegmatis
MSERVRRTPPLAGLAAAAVALGVAGIVAVPFGPAADSRTAVGSAVIDLTPGPVKEWAITTFGTADKLLLTVLIIAIIATLAAVTAPLETRRRPVGSIVIGLAGVLGCVAVLSRPGAGWVAILPTVIGAVCGIAALRLLTSDRFRDEQAVAEDRADQRADRYADDHADDTVDPGRRWSLVALGLLTTGVVTGAAGAVLSRLASSVAGDRDAFTLPRAARAAAPIPPDVQPAGVSLPSFITPTPKFYRIDTALTVPQLTRDEWQLRIHGMTDREVTYRFEDLDRFEVVEKVVTLTCVSNFVGGDLISNATWTGYRVRDLLEEAGVSTDSDMALSTSIDGFTAGSPIEALTDDRDALLAIGMNGEPLPAAHGYPARLVVPGLYGYVSATKWVVDLELTRFDRAEAYWTKLGWSAHGPIKTQSRIDVPREGQQVPRGPVRFGGVAWAQHRGIRAVEVKIDGPSDPGEWQQAQLGAAYSDDTWRLWSVDWTAADPGEHTITVRATDNTGETQTPDLADPVPDGATGWHYVTFDVT

SEQ ID NO: 22849 - protein, 350 aa, Glycine max
  misc_feature (188)..(188): Xaa can be any naturally occurring amino acid
MASSTITSSFLTSHPSSLFNKSSSSSFPSFHATPTLRPHRPRASMSAAAPPPYDFGSFRFEPIRESIVSREMTRRYMTDMVTHADTDVVVVGAGSAGLSCAYELSKNPSVNIAIVEQSISPGGGAWLGGQLFSAMVVRKPAHLFLDELGLEYDEQDNYVVIKHAALFTSTIMSKLLARPNVKLFNAVXAAEDLIVKNGRVGGVVTNWALVSMNHDTQSCMDPNVMEAKVVVSSCGHDGPFGATGVKRLKSIGLIDSVPGMKALDMNKAEDAIVKLTREVVPGMIVTGMEVAEIDGAPRMGPTFGAMMISGQKAAHLALRSLGLPNALDSVGNVHPELVLAAAESAEIADA

SEQ ID NO: 22850 - protein, 474 aa, Unknown
  delta proteobacterium MLMS-1
MVKRVRTAIIVMGFSGLVAEILLLRELLIVFAGNELSIGIILANWLILEAFGCYFAGGRAAESPRRVEVFTVITILFSLFLVAAVVATRLLKEMLGVSIGENVGFLPMFYSSFLILLPVSVLHGALFTSGCRIYADCAPAAGPDASPAGRVYVYETVGTIIGGIACTYLLIPYLDAMHTTAWLALLNFVVCLALLAPHRRRRRLTGMVAAALGGLILLTGTLLATGQVERLHWYTVAGQWQNLNVVEYRNSPYGNICVIENEGQYIYFLDGIATILTPIPDIPFVEEFVNVPLLTHRQPEKILILSGGAGGIINEALKHPSLAAVEYAEQDPLLFELLRKFPTELTESELDDPRVKIHHTDGRLLLQTTPRQYDLIFIGILEPSSLQTNRYFTREFFTLARERLNPGGILVFGLPGSMTYLNDELKNLNSSVFHTVKSVFPHVRVIPGDGHNLFLSSDAPDVAAVDAHQIMARL

SEQ ID NO: 22851 - protein, 140 aa, Glycine max
VIMDKSEQTQQQHQHGMGVATGASQMAYSSHYPTAPMVASGTPAVAVPSPTQAPAAFSSSAHQLAYQQAQHFHHQQQQHQQQQLQMFWSNQMQEIEQTIDFKNHSLPLARIKKIMKADEDVRMISAEAPVIFAKACEMFI

SEQ ID NO: 22852 - protein, 883 aa, Arabidopsis thaliana
MPWWSKSKDEKKKTNKESIIDAFNRKLGFASEDRSSGRSRKSRRRRDEIVSERGAISRLPSRSPSPSTRVSRCQSFAERSPAVPLPRPIVRPHVTSTDSGMNGSQRPGLDANLKPSWLPLPKPHGATSIPDNTGAEPDFATASVSSGSSVGDIPSDSLLSPLASDCENGNRTPVNISSRDQSMHSNKNSAEMFKPVANKNRILSASPRRRPLGTHVKNLQIPQRDLVLCSAPDSLLSSPSRSPMRSFIPDQVSNHGLLISKPYSDVSLLGSGQCSSPGSGYNSGNNSIGGDMATQLFWPQSRCSPECSPVPSPRMTSPGPSSRIQSGAVTPLHPRAGGSTTGSPTRRLDDNRQQSHRLPLPPLLISNTCPFSPTYSAATSPSVPRSPARAEATVSPGSRWKKGRLLGMGSFGHVYLGFNSESGEMCAMKEVTLCSDDPKSRESAQQLGQEISVLSRLRHQNIVQYYGSETVDDKLYIYLEYVSGGSIYKLLQEYGQFGENAIRNYTQQILSGLAYLHAKNTVHRDIKGANILVDPHGRVKVADFGMAKHITAQSGPLSFKGSPYWMAPEVIKNSNGSNLAVDIWSLGCTVLEMATTKPPWSQYEGVPAMFKIGNSKELPDIPDHLSEEGKDFVRKCLQRNPANRPTAAQLLDHAFVRNVMPMERPIVSGEPAEAMNVASSTMRSLDIGHARSLPCLDSEDATNYQQKGLKHGSGFSISQSPRNMSCPISPVGSPIFHSHSPHISGRRSPSPISSPHALSGSSTPLTGCGGAIPFHHQRQTTVNFLHEGIGSSRSPGSGGNFYTNSFFQEPSRQQDRSRSSPRTPPHVFWDNNGSIQPGYNWNKDNQPVLSDHVSQQLLSEHLKLKSLDLRPGFSTPGSTNRGP

SEQ ID NO: 22853 - protein, 241 aa, Arabidopsis thaliana
MATKQEALAIDFISQHLLTDFVSMETDHPSLFTNQLHNFHSETGPRTITNQSPKPNSTLNQRKPPLPNLSVSRTVSTKTEKEEEERHYRGVRRRPWGKYAAEIRDPNKKGCRIWLGTYDTAVEAGRAYDQAAFQLRGRKAILNFPLDVRVTSETCSGEGVIGLGKRKRDKGSPPEEEKAARVKVEEEESNTSETTEAEVEPVVPLTSSSWMGFWDVGAGDGIFSIPPLSPTSPNFSVISVT

SEQ ID NO: 22854 - protein, 144 aa, Nicotiana tabacum
MASISGTMVSTSFLPRKPVVTSLKAIPNVGQALFGLKSERGGRITCMASYKVKLITPEGTVEFDCPDDVYILDQAEEEGHELPYSCRAGSCSSCAGKVTGGNVDQSDGNFLDDDQMAGGFVLTCVAYPQSDVTIETHKEEELTG

SEQ ID NO: 22855 - protein, 721 aa, Prochlorococcus marinus
MEGQNKSITFDGREIRLTTGLYAPQANGSVMIECGDTSLLVTATKTTKKEVSDFLPLICDYEEKLYAAGRIPGGFMRREGRPPERATLISRLIDRPMRPLFPSWMRDEIQIVASCLSLDERVPADILAVTGASIATLLGEIPFYGPMAAVRVGLIGDDFILNPSYREIEKGDLDIVVAGSKEGIVMIEAGANQLSEQDTIEAIDFGYEAVSELIKSQEDLLKDLGIKQVKPSEPEEDKTLPSFLEKNCTKPIELVLKKFDLSKEERDLELEKIKVETQGKIESLKDDNQLKVLLSENDKLLSSDFKKLTKKLMRSQIINDGKRVDGRDLDEVRKISASAGILPKRVHGSALFQRGLTQVLSTTTLGTPSDAQEMDDLNPSTEKTYLHHYNFPPYSVGETRPMRTPGRREIGHGALAERAIIPVLPGKETFPYVLRVVSEVLSSNGSTSMGSVCGSTLSLLDAGVPLKAPVSGTAMGLIKEGKEVRILTDIQGIEDFLGDMDFKVAGTDKGITALQMDMKITGLPVSIISDAIKKARPARLHILEKMQEAIEKPQETLSPHAPRLLSFRIDPELIGTVIGPGGRTIKGITERTNTKIDIEDGGIVTIASHDGAAAEEAQKIIEGLTRKVHEGEIFPGVVTRIIPIGAFVEILPGKEGMVHISQLSEARVERVEDVVRQGDEVTVRVREIDSRGRINLTLRGVGQNGGMSYPEPTPTPVAPLS

SEQ ID NO: 22856 - protein, 644 aa, Aspergillus nidulans
MRVFPVLSFLSLALIPPSLGVPSPQLRDVELPPTQQALTINLKPQQTSTRDLVSLDGLWSFALEDATNSTSAPWTAALPKGLECPVPASYNDIFVDRTIHDHVGWVYYQRTVTVPRGWADQRAFLRLESATHHGRVYVNEHLVAEHVGGYTPFEADITSLVQPGESFRLTIGVDNQLTHETIPPGDLVTSEYTGKKQQSYQHDFYNYAGLARSIWLYSVPKDQFIKDITVVPDVDWDGDAETGVVSYTVQTSNATSGPIRISILDEEGNEVATASGATGTATIPSVNLWQPGAPYLYSFTVSILSASQRLIDTYTLPIGIRTVAVGNGTILVNNEPVYLTGFGKHEDSPIRGKGHDIAYLVHDFQLLDWIGANSFRTSHYPYAEEVMEFADRQGILVIDETPAVGLAYSIGAGISTDTSRVTFAPDGINNNTRAAHAQALRELIARDKNHPSVIMWSIANEPASDEPGARAYFEPLTRLARSLDPAHRPITFANLGLATYETDTISDLFDVLCLNRYFGWYSYTGDLESAGKALHEELDGWVAKYPTKPIIISEYGADTMAGLHSVLGLIWSEEFQIELLDVYHGVFDQFQNVVGEHVWNFADFQTKEGIQRVDGNKKGVFTRDRRPKGAAFALRKRWMNMMSS

SEQ ID NO: 22857 - protein, 289 aa, Arabidopsis thaliana
MSTALINSITYFLSEHPYIVGFRWSNSQSWGSTWSFLFTSISLYIAVSSSLHILLSAVRRSNRSVPLGHIPEIHSLLMSILSATIFAGILLSAAAEIRDTRWLWRRSKTATPLQWLLCFPLGTRPSGRVFFWSYVFYLTRFLHMFRTIFAVLRSRRLAVSQLFCNSVMAFTSFLWLEFSQSYQILAILSTTLVYSVVYGYRFWTGFGLPGSAFPSFVVNCQLVLVGCNLVSHAGVLTMHLFKGGCNGIGAWGLNSVLNGAILLLFLNFYVRMHSPMRRHINKMNSQRNA

SEQ ID NO: 22858 - protein, 772 aa, Novosphingobium aromaticivorans
MADAATEARTEGRTVRLQVAGARQEESGHGIARISRHVMSQLGVTEGDVIEIVGKRATAARVIQPYPEDEGLELIRLDGLQRANADVGSGEHVEVRKIDSRPAQRVVFAPAQKDLRLQGPAVALKRNFAGRPLVTGDLVATAGQQQVNRTDMPPQLRQMLNAPAFALTQIRLTVVSTSPKGVVHIDENTEVELRPEYEEPRSSRADVNYDDVGGMGDTIRQLREMVELPLRYPELFTRLGVDPPKGVLLHGPPGTGKTRLARAVANESDASFFTINGPEIMGSAYGESEKRLREVFEEATANSPSIIFIDEIDSIAPKRSEVHGEAEKRLVAQLLTLMDGLHSRSNLVVIAATNRPDAIDEALRRPGRFDREIVVGVPDESGRREILGIHTRGMPLAEDVDLQELARTTHGFVGADLAALAREAAIEAVRRIMPRLDFEQQTIPQDVLDSLRVERDDFLEALKRVQPSAMREVMVQAPTIGWADIGGLDEAQEKLREGVELPLKNPEAFHRLGIRPAKGFLLYGPPGTGKTLLAKAVAKEAEANFIAIKSSDLLSKWYGESEQQIARLFARARQVAPCVVFIDEIDSLVPARGSGQGEPNVTARVVNTILAEMDGLEELQSVVLIGATNRPNLVDPALLRPGRFDELVYVGTPSMSGREHILGIHTRNMPLAPDVDLALVARATDRFTGADLEDVVRRAGLNAIRRGGGNVDQVKASDFDEALEDSRATVTEQMEEEYGRMKGELKKRAMNPGPLGFIVPGMVQPTRESKHG

SEQ ID NO: 22859 - protein, 291 aa, Triticum aestivum
MATGSEAGKPAEVVLEWPKQDKKRMLHAVYRVGDLDRTIKCYTECFGMKLLRKRDVPEEKYTNAFLGFGPEDSNFALELTYNYGVDKYDIGAGFGHFAITHEDVYKLAETIKSSSCCKITREPGPVKGGSTVIAFAPDPDGYMFELIQRGPTPEPLCQVMLRVGDLDRSIMFYEKALGMKLLRKKDVPQYKYTIAMMGYAEEDKTTVLELTYNYGVTEYNKGNAYAQVAIGTDDVYKSAEAVELVTKELGGKILRQPGPLPGLNTKITSFLDPDGWKVVLVDHADFLKELH

SEQ ID NO: 22860 - protein, 476 aa, Xylella fastidiosa
MTANVLFPLFANLHDRAVLVVGGGKVAERKTEALLKVGALPIIGAPSLTASLQRWAETGRITWRQGTFEDSWLQEDIWLVIAATDQPEVNHAAARAAHAQRLFVNVVDDIALSNVQVPAVVERGPLRIAISSGGGAPMVARYLRQQLESLIDDSWGRLTTLFAQRRDTIRARYPNIEARRRFFETQLVGPLQRLLRKQRHAEAEAVLEAALAETPPTESGSVTLVGAGAGDAGLLTLNALRALNEADIILYDRLVSDTVLQMARRDAEQIEVGKSATGHSVRQEDIHTLMLQHARAGQRVVRLKGGDPFVFGRGGEELEFLRTHGIPYEVIPGITAALACAAYAGIPLTHRDHTQSLCLITAHCQSSLDTLNWVALAQERQTLAFYMGVAGLPTIQQRLCEAGRAETTPFALIENGARAQQRVLTGTLKTLAHTAQTYAVRPPALLILGEVTALAEHLHWFGTTPLSAPCPHARIL

SEQ ID NO: 22861 - protein, 435 aa, Vibrio cholerae
MESLCGFFAISVNLSQEIQMLKRDMNIADYDPELYAAIQEETLRQEEHIELIASENYTSPRVMQAQGSQLTNKYAEGYPGKRYYGGCEYVDKAEALAIDRACQLFGCEYANVQPHSGSQANSAVYMALLNPGDTVLGMSLAHGGHLTHGSPVNFSGKHYNVIPYGIDEAGQINYDEMEALALEHKPKMIIGGFSAYSQIVDWKRMREIADKVGAYLFVDMAHVAGLIAAGVYPSPVPFAHVVTTTTHKTLAGPRGGLILSNAGEEMYKKLNSAVFPGGQGGPLMHVIAAKAVAFKEAMEPEFKEYQARVVKNAKAMVAQFQERGYKIVSNSTENHLFLVDLIDKNITGKEADAALGAANITVNKNSVPNDPRSPFVTSGIRVGTPAITRRGFTEQDAKDLANWMCDVLDNINDQGVIEATKQKVLAICQRLPVYA

SEQ ID NO: 22862 - protein, 688 aa, Streptococcus thermophilus
MHLSLALLVLLFSLILSNVINRIFPRLPLPLIQIIFGVGIGFLLKGEVFELETELFLAFIIAPLLFREGEESDITSILRNWRLILFLIFPVIFVSTLGIGYLAKAVLPASVPLSACLALGAALGPTDFVAYSAISKRFSFPKWISYILQGEGLLNDASGLVAFRVAVTALTTGSFSLLDASWNLVISVIGGFLVGLITALLNRLFLTILDNMDAADVTGALLLELVLPISSYFVAEEIHVSGIIAVVVAGISLASRFKKITVFDAKLDSVSHTIWGTITFVLNGMVFFLLGTELPTLATPVLSSSTYDTLWMLLAIVLLTAIMFGIRFVMISAVFAQRAWRTKRSLKKIWKVATILTFSGVKGTVSIATILLLPVANMTALEHSLLTFTVAGVTLLSFLIGILILPRLATGPAHTTNHYMQIAILNDVVRELEKDLKQSANQGAVYATIDNYNQRLEDLILEQESNDVKEELANIRIMIMEIESEGLEYAYKKGKISELEYNLYQRYIKGLERRINRGFVSSLSYASAVFVLGLRRILHLAFTFKFRFEQEENRRGPQLTEENRDHMTELYLTNTEQVLEALSNLEGVYHSDLLSYLKRSRIREAEIIQSGAFVERVITHLNPDYVDEMLRGYFLERKIIIEYEQAGRISSRYAKQLRKEVNTLENYSLKETSNTLIYDMINLARRGA

SEQ ID NO: 22863 - protein, 942 aa, Yersinia pseudotuberculosis
MTKYSLRARMMILILAPTLLLGLLLSTSFMVNRYNELQNQIVSAGTNIIEPLAVASEYGMSFRNRDTVRQLINLLHRRHSNIVRSISVFDVDNKLFVTSNYNYNSSQLRLPPGEPVPDSLMLSYRGDSLILRMPIVSESNLSSEQASGQGESDQILGYIAIDLDLQSVRLKQYKEIFISTLLLLFCMCVAILFAYRLMRDVTGPIRNMVNTVDRIRRGQLDSRVEGHMLGELNILKNGINSMAMSLAAYHEEMQQNIDQATSDLRETLEQMEIQNVELGLAKKRAQEASRIKSEFLANMSHELRTPLNGVIGFTRQTLKTSLTPTQTDYLQTIQRSANNLLCIINDVLDFSKLEADKLILEHIPFSLRGTLDEVIILLAHTAHEKGLELTLHINNDVPDQVLGDAMRLQQIVTNLLGNAIKFTEEGNIDILVVVKAIASQQVTLMVEIHDTGIGISESQQAQLFQAFRQADASTSRRHGGTGLGLVITERLVKEMGGNISFQSQMSCGSIFRFHLTLELNESIPYRQPDMAHLEGKQLAYIERNSTAARATINILNTTPLQVTHRQSLAQLPEQHYDFLLVGVPIPFRNNMAIHQDKLLTALKIADHVILALPSQSQVEAEQLKQIGAKGCLLKPISSIRLIPLLLAEDTHSKVPSEEQPRKQPKLPFRVMAVDDNPANLKLIGTLLEEQIEETVLCDSGAMAITYAREHTLDIILMDIQMPEIDGIRASEIIHQIPHHQETPIIAVTAHAVKGQQEQLLRLGMADYLAKPIDEARLLQVLSRYQSDNPPLSTASTASTASTASTASTASTASTASTAESLPLPVPKGAGVIDWAQAVRQAANKEDLARDLLTMLLEFMPQITARVQAILAGADDGDILNLVHKFHGSCACSGVPRLRQLCMTIELQLRQQVNLQDLEPEWLELLDEIENVSEAAKTYLRTE

SEQ ID NO: 22864 - protein, 309 aa, Geobacter metallireducens
MAQIYENLTDLIGKTPLLRLRKVAAGIEADIVAKLESFNPGGSVKDRIGVSMIRDAEGRGLINKDTVIIEPTSGNTGIALAFVCAARGYRLVLTMPDTMSVERRNLLKAYGAELVLTRGAEGMKGAINKAEELAADIPNSFIPQQFRNPANPHIHRFTTAEEIWTDTDGKVDVFVAGVGTGGTVTGVGEVLKKRNPGVKIIAVEPFDSPVLSGGHPAPHKIQGIGAGFVPEVLNREAIDEIFTVRNEEALETARRLAREEGLLVGISAGAAAFAALEVARRPENKGKRIVVVLPDTGERYLSTVLFQDQ

SEQ ID NO: 22865 - protein, 500 aa, Saccharomyces cerevisiae
MSFENLHKVNAEALEDAVVEICSSLQVDAAKLDELTAYFIECMEKGLNNTSVGEEKTVDKGLPMIPTYVTSLPNGTERGVLLAADLGGTHFRVCSVTLNGDGTFDMQQLKSKIPEEYLNDKDVTSEELFSYLGRRTRAFVRKHHPELLKSTGENIKPLKMGFTFSYPVDQTSLSSGTLIRWTKSFKIEDTVGKDVVRLYQEQLDIQGLSMINVVALTNDTVGTFLSHCYTSGSRPSSAGEISEPVIGCIFGTGTNGCYMEDIENIKKLPDELRTRLLHEGKTQMCINIEWGSFDNELKHLSATKYDIDIDQKFSPNPGYHLFEKRISGMYLGELLRNILVDLHARGLILGQYRNYDQLPHRLKTPFQLCSEVLSRIEIDDSTNLRETELSFLQSLRLPTTFEERKAIQNLVRSITRRSAYLAAVPIAAILIKTNALNKRYHGEVEIGFDGYVIEYYPGFRSMLRHALALSPIGTEGERKIHLRLAKDGSGVGAALCALVA

SEQ ID NO: 22866 - protein, 416 aa, Unknown
  Synechocystis sp. PCC 6803
MKKSHYSVIIVGGGQAGLAISYLLKQESIDHVIFEKNQIGHAWRNQRWDSFCLVTPNWQCRLPGFPYAGGDDQGFMLKDEIVQYLEDYAASFQAPILEGVEVSKLSQRTDAFEVITSQGIYTADQVVVATGGYHTPKIAAIAKKLPPHIVQLHSVDYKNPETLPDRILLVGTGQSGCQIAEDLHLAGKTVHLATGSAPRSPRRYRGRDVVEWLELMGHYDLPIDEHPQKEMVRHKTNHYLTGRDGGREIDLRQFALEGMHLYGRLKDIDGNQILFADNLKENLDQADATAARIKQSIDEYIAKNQLDAPIEAPYQPVWEPTSIPLTLNIDEIDAVIWSTGFNFNYAWVDVPVFNSMGEPLHNRGVTNVAGLYFLGLPWLYTWGSGRFSGVARDAEYLAEKIRETLPANQINPCTVA

SEQ ID NO: 22867 - protein, 423 aa, Zea mays
MAQAVVPAMQCRVGVKAAAGRVWSAGRTRTGRGGASPGFKVMAVSTGSTGVVPRLEQLLNMDTTPYTDKVIAEYIWVGGSGIDIRSKSRTISKPVEDPSELPKWNYDGSSTGQAPGEDSEVILYPQAIFKDPFRGGNNVLVICDTYTPQGEPLPTNKRHRAAQIFSDPKVAEQVPWFGIEQEYTLLQKDVNWPLGWPVGGFPGPQGPYYCAVGADKSFGRDISDAHYKACLYAGINISGTNGEVMPGQWEYQVGPSVGIEAGDHIWISRYILERITEQAGVVLTLDPKPIQGDWNGAGCHTNYSTKTMREDGGFEEIKRAILNLSLRHDLHISAYGEGNERRLTGKHETASIGTFSWGVANRGCSIRVGRDTEAKGKGYLEDRRPASNMDPYIVTGLLAETTILWQPSLEAEALAAKKLALKV

SEQ ID NO: 22868 - protein, 491 aa, Solibacter usitatus
MIEKVSQHLSQNEPLIFERSSPGKKAYQLPELDVPPVDAAEALGAENVRREIDGFPEVSEVEAIRHFTRLSTWNYAIDYGMYPLGSCTMKYNPRINEQVARTEGLAWAHPYQPEALSQGCMEIMWSLEQALAEICGMDAVTLQPAAGAHGELTGILLIRALLEKRGNPRKKILIPDSAHGTNPATAAIAGYAVENIKSSETGGVDLATLEQLVTDDVAALMVTNPNTLGVFENNIARVAEILHQKGAMLYMDGANMNALVGIARPGDFGVDVMHLNLHKTFSTPHGGGGPGAGPVAVKKVLEPFLPTPRLKRSGKKLAFDYKRKQSIGRVKAYYGNFGVLIRALAYTLAHGGPGLKNATMDAVLNAIYIRKALEPYFDLPYTSPSMHEVVFSDDRQAKLGVRTGEIAKRLIDYGFHPYTVSFPMIVHGALMIEPTETESKDEIDLFINAMISIAKEIETDPQMVKGAPYNTRTSKVDEVTAARKPVLRWKP

SEQ ID NO: 22869 - protein, 343 aa, Unknown
  Oceanobacter sp. RED65
MTDLNSNKAAVLGGGSFGTAVANILAANGFQVDLWMRNEKTIEDIKQERENKQYLPGVKLHDNIQATGDLESAIKDSQVLFYAVPSKSFRELVERTQGLVVPEQMLISTTKGIEPEGFNLMSDILKGTFPSNPIGVISGPNLAKEIGQGQPAATVIGSKDKRVRDFIQKSLSCNFFRVYANADMYGVELGGALKNIYAVITGMAAALGFGENTKATLITRSLAEMSRFAVSQGANPMTFLGLAGVGDLVATCVSPLSRNYRVGYAVGKGETLEQAVEALGEVAEGVNTVRYIYHEANEQGIYMPLASALYAVLFEGAEVSQLANSLMTGEYNTDVEFSLPRGA

SEQ ID NO: 22870 - protein, 449 aa, Solibacter usitatus
MRYLPKSESERRQMLEACGVSTPEELFAHLPDAVRLNRPLNLAPGISEYEIVQYFRERAEQNANGYASFLGAGVYNHYRPVLVDTVVSRGEFLTSYTPYQAEIAQGTLTTIFEFQTMICQLTGMDVANASMYDGSTAVPEAAMMAVRATGKGRVLISRTVHPEYREVLGTYAKHQGMPVQEFGYVAESGGLDLEDLERKMDDLTGAVIIQTPNFFGIVEQVKAAAEIAHKRGALLVVIFTEAVSLGLLEPPADADIVAGELQSFAISPSYGGPYAGIIAVKEKYIRQVPGRLVGQSLDSRGNRAFCLTLSTREQHIRREKATSNICTNQALIALMATVFMTVYGKQGLRELAEQNLAKAHYLASKLKPRFTGKFFNEFVVRAEGQTPEELNKQLLKKKIIGGLPLGRFYPELADSYLVCATEMTRRADMDALVAATTAQPATETVEVTA

SEQ ID NO: 22871 - protein, 693 aa, Aspergillus nidulans
MCGISAVLSLSEGSICPQALASQMNESLQLIKHRGPDARGQWLSSDYRVGLGHARLSVIDLNPAGNQPFHDPEGTVHAVVNGEIYDHKKYRAKLAHQYEFRSNSDCEIVTALYRHYGISFLNKLRGEFALVLWDAKRKLFLAARDRYGIKSLYYTVVNNRLLVATEIKSFLPFGWQPEWSIENLLRKGWLWDTEMYFKGVHRLEPGQYMVSQNYKFPVVKTYWDMDYPDKRTPFPQTEEQIVLELRKRMLESVRLRLRADVGVGFYLSGGLDSSAIAGMAKYLIQQGEPLGNDSSGDISKMSCYTIRFGEGSGVDESGIKDTFVPEVSDRRLTKSELYPVTLTEEDIASRFEDTVWYTETPIPDVNGMGRVAVGELAHSHGKKVILTGEGSDEHFGGYPDMLSKMFVEPDLSWHPPPFKMPNSSKVFEAGREAVPAAVESLASTKRMLNNSSIFARVDSFYMFPLASATVESEEPDPETAFAESLGAQTLSNISENWHPLNSASYQWTKSILANYILRYIGDGADMVYQIETRPPFLDHHVTEYANRIPPSLKIRYDPVKNDLREKYILREAMRPFITDEVMNRTKRAYLGPSNYREDGPLHRVVKSLLTEDNVNKLGFVDWDRLQEHIVKGFRDGDPRYFRSSLFVAQLVVLSQRFGVKVATTTDALPVTSEILDRTQNNDNMTTVQDRSRL

SEQ ID NO: 22872 - protein, 440 aa, Prosthecochloris aestuarii
MSIEILQKQDKEIFDAISNEVLRQTETLELIASENFASKAVMEACGSVMTNKYAEGYPGKRYYGGCEFVDVAEDLARERAKKLFGCQYVNVQPHSGSSANMGVLFSVLKPGDTIMGLDLSHGGHLTHGSSVNFSGQLFDAHSYGVDRETGLIDMDRVEDMALSVRPRLIICGASAYSQGFDFKAFRQIADKVGAFLMADIAHPAGLIAAGLLNDPMPHCHFVTTTTHKTLRGPRGGMIMMGEDFENPMGITIKTKAGRRTKMMSEVIDAEIMPGIQGGPLMHIIAAKAVAFGEALQPEFKEYAVQVRANAAAMAQKFISLDYNIVSGGTKNHLMLIDLRNKNVTGKVAENLLHEAGITVNKNMVPFDDKSPFVTSGIRIGTPAMTTRGMTESHAEAIVSLIDRVIGAAGSPDAGTVCGEVRSEIKAMCGTLPLNDFSPTL

SEQ ID NO: 22873 - protein, 271 aa, Wolbachia endosymbiont
MKNYKFSTKVLIIGSGAAGYAAAIYAARANLEPIVVTGMQPGGQLTITTDVENYPGFVSIQGPELMEQMRLHAEKVGAKIIDDEIKSVVQLEDSNEYRFRSSGNTNDYYSDAIIIASGAQAKWLGLKSEKEFQGYGVSACATCDGAFFRNKVVAVIGGGNTAVEEAIFLTRFAKEVILIHRRDKLRAEKVMQDRLFKNDKIKVMWNHTVEQILGEENPKRVAGIAIKSAETQELKVDGVFIAIGHAPNTGIFKGFVEMDEQVTSLQNLEQL

SEQ ID NO: 22874 - protein, 466 aa, Xylella fastidiosa
MTVASVEQMFSGKIQVGSEVTVRGWVRTRRDSKAGLSFVSVSDGSCFAAIQVVTPAHLPNYETEVRKLTTGCAVIVIGTLAPSLGQGQQFEIQAQSIEVVGWVEDPETYPIQPKQHSLEFLREVAHLRPRTNLFGAVARIRHCLSQAVHRFFHENGYYWITTPIITTSDAEGAGQMFRVSTLDLVNLPRTETGGIDFSHDFFGKETFLTVSGQLNVEAYALALSKVYTFGPTFRAENSHTPRHLAEFWMIEPEIAFADLVEDARVAEQFLKFLFKTVLEERADDLAFITERVEKTTISKLEGFIKSPFERIEYTDAIKLLEKSEKKFDFPVEWGLDLQTEHERWLTEKHIGRPVVVVNYPEHIKAFYMRLNDDGKTVAAMDVLAPGIGEIIGGSQREERLEMLDIRMAQFGMDPAHYQWYRDFRRYGSVPHAGFGLGFERLVVYVCGLSNIRDAIPYPRAPGSAEF

SEQ ID NO: 22875 - protein, 449 aa, Unknown
  uncultured archaeon GZfos13E1
MSKISKLVIIGCAGVGGPAAMTAKRMEPSLDVTLIREEENFLTRCAVPYISVEKATVEASVKDDGMFHAVGTKLVNVKATSIDRKEKTVTTAGGAVYPYDKLILATGGRAIVPPVPGVDLEGVFTICTSWDAVSIRDWINEKGARNAVVYGAGAVGLEMASVFAEKGLKVTMVIRSYIGEKVGLDLDMSSELEKYFEDKGTVIRSKEVITKIEGEQEVEAVELSSGDKIETNMVILSAGVHPNVELAEDAGLEIGEYGLEVNEYLQTSDPDIYAGGNLIEYEHMVTRKPILAQMRPNAVIGGRIIAKNALGYKIKFPRLLNSFASKLFDKSIASVGVTEAIAKEEGFDILVTKQAAKSKHVMMEGGKPYTVKLIFDRDTKKVIGAQIIADDERSVRYIDVIALAIRNGWTALDLTTLRCAGQPELSPEPSAEPIAVAAEGAFKELYPLA

SEQ ID NO: 22876 - protein, 199 aa, Brassica napus
MEKSTRTLMIITIVITSMLVGFGSSDLDQDREECTDQLIALSPCLPYVGGNAKAPTKDCCGGFDQVITKSEKCVCILVKDKDDPNLGLKFNATLAAHIPTLCHITAPNITKCISLLHLSPNSTLAKEFESLGRIEYEGKTNSTSPSHNVKDGTGGGKAESVKSDGGKKKKSWLAVELLIFALFSHLLLVISSFTSSSFI

SEQ ID NO: 22877 - protein, 130 aa, Triticum aestivum
CDVLVPCALGGVLNKDNAPDVKAKFIIEAANHPTDPEADEILAKKGVVVLPDIYANSGGVVVSYFEWVQNIQGFMWAEEKVNDELEKYMSSAFQHMKAMCKSLDCDLRMGAFTLGVNRVARATLLRGWEA

SEQ ID NO: 22878 - protein, 229 aa, Betula pendula
LEFLMADAVAQGADCVITIGGIQSNHCRATAVTAKYLNLDCYLILRTSKVLVDQDPGLTGNLLVERLVGAHIDLISKEEYAKIGSESLTNLLKEKLLNEGRRPYVIPVGGSNSLGTWGYIEAIREIEQQLQTGTGEIKFDDIVVACGSGGTIAGLSLGSWLSTLKAKVHAFSVCDDPDYFYDFIQGLLNGLEAGVDSRDIVNIHNAKGLGYAINTSEELKFVKEVAAAT

SEQ ID NO: 22879 - protein, 604 aa, Wolinella succinogenes
MCSICGGTIKPSLIQKASDTMRHRGPDARSFWSDGKISLAHNRLSILDLSEAGNQPFGDERYRLIFNGEIYNFQELSSDYGLRLQSSSDTEVLWRLLILEGERILPRLNGMFSFLFYDGHKGEILMARDRFGKKPLFYFHEGKELGVASEIKALRAILGEKGALDQGALLDYLSYLAPCGEKSFFPTIHKLPAGCLARFSLSEGRLEKSSFYSLPSAPSRENIEEKEALRKIEELLVESVRYRLLSDVPVASFLSGGIDSSLISALYARLSPCSIETFSIGYDEYKHYDELPYAREVASHIGSIHHEKIATRKDFLEAFEEVLPILDEPLGDPAIIPTYLLSKEVAKSGFKVVLSGEGSDEIFFGYDGYFDSLKLLWLENSLGLKEKAILLDYHRKSEHGGKEWERLRRLLMDEKPYFRGINESWTPGQRARLFKQEPAWRDPILETFQDFPSKEGEGWYSYIDLKHWMAEVLMSKMDRMSMAHSLESRAPFLDYQLVDFVLSLPSSLRTGEITKNLLKKIALAYLPDSIVNRRKKGFSSPMFEWYFEAYQGRILEDYQRVNRELGWFEDSYLKFLYEKGRMGEYKSQNWGMILFSRWFLIHCG

SEQ ID NO: 22880 - protein, 372 aa, Corynebacterium efficiens
MSSSEKNGSLDASAGASVDVDAVILVGGKGTRLRPLTNNTPKPMLPTAGHPFLKHLLARIKAAGITHVVLGTSFKAEVFEDYFGDGSDLGLEIEYVVEDQPLGTGGGIRNVYDKLRHDTAVVFNGDVLSGADLGDILATHREKEADLTMHLVRVANPRAFGCVPTDADGRVLEFLEKTEDPPTDQINAGCYVFQRELIASIPADRVVSVERETFPQLLQEGRRVYGHVDTSYWRDMGTPQDFVRGSSDLVRGIAFSPLLEGQTGEELVDPSAGVRDGVILLGGTVVGRGTEIGAGCRLDGTVVFDGVTIEPGAFIENSIISSGVRIGANAHISGCVIGEGAQIGARCELSSGMRVFPGVVIPDGGIRFSSDQ

SEQ ID NO: 22881 - protein, 319 aa, Xylella fastidiosa
MTIYNTILDTIGHTPVVKLNRIAPAHVDLYIKVESFNPSGSVKDRLALAIIIDAEQQGLLKPGDTIVEATSGNTGVALAMIAAARSYTFVATMVETFSIERRKLMRAYGAKVILTPAAERGSGMVRKAKELAEQHGWFLASQFSNPANPAYHRNTTAAEILRDFAGRRLDHFVSGWGTGGTLTGVGEVLKIARPDIKITASEPASAALLQGKEWQPHKIQGWTPDFVPEVLNRSVPHHILSVTDDDAITVARRLAAEEGVFSGISGGASVATALQIAQQAEQGAVILAMLPDTGERYFSTPLFADINEHSDDAWLASLG

SEQ ID NO: 22882 - protein, 606 aa, Wolinella succinogenes
MCGILGYLRKGSAGQSQLSCEQFNQILSKIAHRGPDHQDFVWFNEPEYQLYLGHVRLSIIDLDERASQPMLFKDRYLLVFNGEIYNYRELKEKLLLQGYGFATQSDSEVLLAAYDFWGETCVEHFNGMWAFAIYDKKRHSLFCSRDRFGVKPFYFYENEEIFVFASEIKALLPFFKEAKLNPKVILPYLARGFLDGGSETFFDGVYRLEASSNLFYDLRGKQKSFQTYYSILLNPLSAKEREIPSSAKELLSLLRQSVSLRLRSDVRVGACLSGGLDSSGVAALASQQYDFGEKLVAIHAKSSLKESDESSYAIEVANHLGLDLHMVEPSFEDFCESLDDLFYTQEEPFGSTSMFMQYFVMKKAKELGCKVMLDGQGADEVFLGYEHYFHNIFKDLRDRKFFLENDFFKDLKTFRYTKEQILEELKKADDAGVAWDVIKNRGNICSRYLCREWLDSYIAPVKTIQEFQKREIFYNHLPSLLRYEDRDSMRFGIETRLPYLDYRIVEWVLALPTEVKFQQGYLKFALREALEISGLLPKSIVWRYNKMGFESPQKLWIDRYRFEMMKVIEGSEIIRDIFFKVDIRRDDFLWKLFSIAKWEKMFNVKL

SEQ ID NO: 22883 - protein, 139 aa, Arabidopsis thaliana
  misc_feature (28)..(28): Xaa can be any naturally occurring amino acid
HENGLKSSAAFPATRKANNDITSITSNXGGRVNCMQVWPPIGKVRKVRGTSLERPTRMPSKPARPLAKLRRRATALLDKANDAAAAAGASAQQVGKSISDAAVRGANFPKDKTGLHNVPIPANSRTPNFPSPNSFAGIL

SEQ ID NO: 22884 - protein, 434 aa, Picea abies
IHSQCSGVLHRAGYGGSQGARSAACCQAQIQIGCEIYQTRPRLDLGGLWSSLCQGYEGVYSGALLSQEIGGPQACQGRRGCSHGGIHIQCLYQTRRNRKALGGEEISVSCGIQQYHQDCFWEKICERRREDGSTRCGVQGNCCNQGCSWGLPSSMAEPPFPIFFRWMFSHYKRVRSPSMGARRDNVTKAIMEEHTLARQTSGAKQHFVDALLTLQEKYDLSEDTIIGLLWDMITAGMDTTAITVEWAMAELVRNPRIQQKAQEEIDRVVGRDRVLNETDFPHLPYLQCITKEALRLHPPTPLMLPHKATQNVKIGGYDIPKGSNVHVNVWAVARDPAVWKDPVTFRPERFIEEDVDIKGHDYRLLPFGAGRRICPGAQLGINLVQSMLGHLLHHFEWAPPEGMKAEDIDLTENPGLVTFMAKPVQAIAIPRCRS

SEQ ID NO: 22885 - protein, 321 aa, Thermoanaerobacter tengcongensis
MKTIGILTSGGDAPGMNAAIRAVVRTGIYYGLKVKGIMRGFAGLVEDEVIDLGLSSVGDIIQKGGTILRTARCEEFKQKEVRKKAYETLQKHGIEGLVVIGGDGSFRGAQLLSEEWNVNTICIPGTIDNDIPCTDYTIGFDTACNTVIDAINKIRDTATSHERANIIEVMGRNSGYIALYAGVAGGAEMIILPEVEWSIDELCDKITYGIKRGKLHHIIVLAEGVMSAPELAKMIKERLPKLDLRYTILGHIQRGGAPTVMDRVLASQMGARAVELLLENKTKRVISIRNNQIVDDDIDEALSMKKEFNRKLYELSKILSI

SEQ ID NO: 22886 - protein, 219 aa, Lilium longiflorum
VEQFSPVPYLATLLNCMLWVVYGLPLVHPHSTLVLTINGLGLIIELTYVLLFLLYSNGRARIRVLAMLLTEIVFVGLITVIVLSTAHTLVTRSLIIGVLCVFFGTMMYAAPLSVMKLVIQTKSVEYMPLFLSVASFLNGICWTTYALIRFDLFITIPNALGTMFAVAQLILHAMYYKSTKIQMEAQKRKLEMGFEEVMAPVENTEKIRGASQTGKYPPV

SEQ ID NO: 22887 - protein, 154 aa, Glycine max
VPPLVVWTCSLFDYIQGKNNYKQKIEMTAPVITEVSPSDGPFCKSSFVVSFFVPKLNQANPPPAKGLHVQRWNNMYVAARQFGGHVNDSNVAVEAAVLRASIDGTKWSGAIDKNQKAGHASVYTVAQYNDPFEYQNRVNEILFLFEMESERHAI

SEQ ID NO: 22888 - protein, 105 aa, Unknown
  Nostoc sp. PCC 7120
MTEKKQFNSFEEMLSGSDLPVLVDFYADWCGPCQMMGTILQQVNNQLKDRIRIVKIDTEKYTELATQYQIAALPTLVLFKQGKPVDRIEGVLQTPDLVRRLQSFV

SEQ ID NO: 22889 - protein, 340 aa, Bartonella henselae
MHAVSMTIIGAGSYGTALAIVLARNGHHVLLWGYNPQHIRELQEYRCNQAFLPDVQFPDNLCPEDSLETAIKASRNILIAVPSHVFHQVLYNIRPYLDQHSRIIWATKGLEHGTGRLLQEVAREILGDKIPLAVFSGPTFAKELAIGLPTAITIAASDTEFSEELQQLFHFDKSFRVYKNSDMIGVQLGGAVKNVIAIGAGISDGMGFGANARIALITRGLAEISRLGIAMGAELSTFMGMTGLGDLVLTCTDNQSRNRRFGMLLGQGVDIEEAKKQIDQIVEGYLNTKEVHMLAQRIRVEMPITEQIYHVLYCGKSVSEAANALLSRQLKDEMYDTVRF

SEQ ID NO: 22890 - protein, 311 aa, Zea mays
MERARRHASRALLRRLLAAAAASPAASPATSSRGISTLSPPPPAAGKQQRRCCPPPRGAHQHAQARAVSVSALQPSDTFPRRHNSATPAEQEAMASACGFGGVDALVDATVPPAIRAPPMRFPGRFDAGFTESQMLDHMRRLASMNRDFKSFIGMGYYGTHVPAVVLRNLMENPAWYTQYTPYQAEIAQGRLESLLNYQTMVADLTGLPMSNASLLDEATAAAEAMAMCSAILRGKKRTFLIASNCHPQTIDVCRTRSDGFGIRVVVADAKDLDYGGGDVCGVLVQYPGTEGEVLDYAEFVRDAHAHGVKV

SEQ ID NO: 22891 - protein, 472 aa, Yersinia pseudotuberculosis
MDYLPLFADLKQRPVLIVGGGEVAARKIELLHRAGAQVWVVAQTLSSELEQQYQDGRIHWLAQDFLPEQLDNVFLVIAATNDTVLNAAVFAAADQRCILANVVDDQPLCSFIFPSIVDRSPLVVAISSSGQAPVLARILREKLEALLPTRLSDMAAIAGRWRGRVKQHMASMGERRRFWEHAFSGRFASLISRGQLTEAENELQLSLEGQHRALGEVALVGAGPGDAGLLTLRGLQVMQQADVVLYDHLVSPEVLDLVRRDAERICVGKRAGAHSVTQEATNQLLVTLAQQGKRVVRLKGGDPFIFGRGGEELQVVAQAGIPFQVVPGVTAAAGATAYAGIPLTHRDHAQSVTFITGHCRPDGDDLDWQALARGRQTLAIYMGTVKAAAISQQLIAHGRSSTTPVAVIGRGTRVDQQVLIGTLAQLESLAQQAPTPALLVIGEVVNLHHQIAWFGQQPQTESAISPSVVNLA

SEQ ID NO: 22892 - protein, 348 aa, Unknown
  Frankia sp. EAN1pec
MTAQGKDQAGQAAGAERSGERVLDVVIIGSGPAGYTAAIYTARANLKPVVFEGAVSAGGALMTTTEVENFPGFPEGIQGPELMENLRAQAERFGAELIADDVTEVDLAADPKVVKVGDETYLARSVIVATGSAYKKLGVEHEDRLLGRGVSACATCDGFFFRDQDIAVVGGGDSALEEATFLTRFAKSVTIVHRRDRLRASAIMQERAFANPKVRFRWNAVVEEVLGEDKVTGVRLRDTVTDKTDELAITGLFVAIGHLPRTDLIHDQLELDGEGYIKVTHPTTQTNIAGVFACGDVVDHTYRQAITAAGTGCSAALDAERYIAGLEGAADSAAEAPRVPAPELAATT

SEQ ID NO: 22893 - protein, 202 aa, Solanum lycopersicum
GKNGNDLPSTIDVVSLYLANNITKMKTYDPINETLPALKGSEIEVILDIPNSQLQSLGDPQQADSWVTSNVVNYVQQVKIKYINVGNEVSPVNNGTSQFVPFLLPALTNVQQSITKSGLQDQVKVTTAIETGLLATTYPPSESAFREDTIGFIKPIIELLKQNNAPLQANIYPYFGYIGDPAHVTLPYALFTQEQPDPSGYT

SEQ ID NO: 22894 - protein, 162 aa, Triticum aestivum
STVIAFAQDPDGYMFELIQRAETPEPLCQVMLRVGDLERSIKFYEKALGLKLLRKKDVPDYKYTIAMLGYADEDKTTVLELTYNYGVTEYSKGNAYAQVAIGTNDVYKSAEAVELATKELGGKILRQPGPLPGINTKIASFVDPDGWKVVLVDNTDFLRELH

SEQ ID NO: 22895 - protein, 481 aa, Halobacterium salinarum
MQLFWHRRDLRTTDNRGLAAAAPGVTAVDGGHDQGPVAAVFCFDDEVLAHAAPPRVAFMLDALAALRERYRDLGSDLIVRHGDPAAVLPAVANDLDATRVVWNHDYSGLATDRDAGVRDALDAAGVAHAQFHDAVHHRPGEIRTNAGDPYSVYTYFWRKWQDREKNPPAPEPEPADLAADTALADTSPLPSVQELGFAEPEAAVPDAGTAAARSLLDAFRESGDIYRYEDRRDYPHEEPTSRLSPHLKFGTIGIRTVYEAARAAKSDADTDDERENVAAFIGQLAWREFYAQVLYFNQNVVSENFKAYEHPIEWRDDPAALQAWKDGETGYPIVDAGMRQLRAEAYMHNRVRMIVAAFLTKDLLVDWRAGYDWFREKLADHDTANDNGGWQWAASTGTDAQPYFRVFNPMTQGERYDPDADYITEFVPELRDVPADAIHSWHELSLSERRRHAPEYPDPIVDHSQRREDAIAMFERARGDE

SEQ ID NO: 22896 - protein, 240 aa, Oryza sativa
MQQPSVSLAPNTSCHPQHAGSAAGSSRRSHGHLGVLLHVDHSDGRRAGALYAATNLRSLEAIPATGPTLRSLEEAIAAPNLLSHEAVISANNTYQDAKPRARKFFELEMTVQDCDLDQYGVVNNTVYPSYIERAREELISGLGMSRTSIACTGNAMALTELNIKYFTPLKRGEKFVVRLSLGRIKGARIYAEQYIERLPDRKLVVESTATIICLNRKHRPTRVWPELSSKLLDYFSSQED

SEQ ID NO: 22897 - protein, 405 aa, Solanum demissum
MLPSRTALFSLFILSLLTGILPSTAVPDTGGTTTIGFTYSPVVDNSPPPEHVVTALQSLNIPAVRLLNPSPTLIRAFSYSNISLLLTVPNYLVGAFAANRSAATLWVYNNVLPFHPRARISLISVGSDVISSTGGPGVSDPTTALVPAMQNLHHALIDLGIRTVSVSTTFSFINVITTAFPPSSAEFQEPVNSLVIRPVLEFLEETNSSLLMNVYPYNVYRLHGEIPISFALFQEGPFNFRDDVVTGVRYHNLFDMMVDAVIAAMAVSGYENVPLILTETGWPSNDEHMNAEESQIYAEKYLQGLISHLKSGLGTPLRKEGAAQAYIYQLFDDGPESNSKKNNLSSDGGETVHQYWGVMYHNMTMKYNIKFDNAHQISTMLGLLVPSIYFLWLLYHFFFCLFGLD

SEQ ID NO: 22898 - protein, 196 aa, Arabidopsis thaliana
MESADSGRSDPVKGDDPGPSFVSSPPATPSRYESQKRRDWNTFLQYLKNHKPPLALSRCSGAHVIEFLKYLDQFGKTKVHVAACPYFGHQQPPSPCSCPLKQAWGSLDALIGRLRAAYEENGGRPDSNPFAARAVRIYLREVRESQAKARGIPYEKKKRKRPPTVTTVRVDVASSRQSDGDPCNVGAPSVAEAVPP

SEQ ID NO: 22899 - protein, 316 aa, Coxiella burnetii
MVLDNILQVIGKTPVVRLHRIGQSLPCELYGKCEFLNPGGSVKDRIGAAMIESAEKQGKIKPGDTLIEPTSGNTGIGIALAGAVKGYRVIITMPEKMSHEKQVVLEALGATIYRTPTEAAYDDPESHISLAKRLNQEIPNSYILDQYSNAENPDIHYQTTGQEILDDMGENLSMVVMGVGTGGTIIGVAKKLKEVNPSIQIIGVDPIGSILGGGDEIKPYLVEGIGYDFIPEVLDNNLIDEYIKINDKDSFLMARRLIREEGLLVGGSSGSAVWAACQAAQRLKEGERCLVILPDAIRNYLTKFVDDAWMKAQGFL

SEQ ID NO: 22900 - protein, 425 aa, Exiguobacterium sibiricum
MNGGIQMEQTPLTYLKQQDEELFSAMRKELKRQRDNIELIASENFVSQAVMEAQGSVLTNKYAEGYPGRRYYGGCEFVDLAENLARDRAKAIFGAEHVNVQPHSGAQANMAVYFTILNQGDTVLGMNLSHGGHLTHGSPVNFSGVQYNFVEYGVDPETEMIDYDVVAKLAEEHKPKLIVAGASAYPRVIDFKRFREIADSVGAYLMVDMAHIAGLVAAGLHPNPVEHAHFVTTTTHKTLRGPRGGMILCKEEHAKAIDKSIFPGIQGGPLMHVIAAKAVAFAEALAPEFKDYIEQVVANAKVLGEELTARGLRIVSGGTDNHLLLVDLQPLGITGKLAEHALDEAGITVNKNTIPFDPASPFVTSGIRIGTAAMTSRGFKEAEMKQIAELIELVLKNPEDQETLTSAHKQVLALTGRFPLYPERG

SEQ ID NO: 22901 - protein, 285 aa, Sporobolus stapfianus
MASGSDAVLEWHKQDKKRMLHAVYRVGDLDRTIKCYTECFGMKLLRKRDVPEEKYTNAFLGYGPEDKNFALELTYNYGVDKYDIGEGFGHFAIATEDINKIAEAVKSSGCCKITREPGPVKGGSTVIAFAQDPDGYMFELIQRGPTPEPLCQVMLRVGDLERSIKFYEKALGMRLLRKKDVPDYKYTIAMLGYDDEDKTTVIELTYNYGVTEYSKGNAYAQVAIGTNDVYKSAEAVELATKELGGKILKQPGPLPGINTKIASFVDPDGWKVVLVDHADFLKELK

SEQ ID NO: 22902 - protein, 270 aa, Unknown
  Populus tremula x Populus tremuloides
MGRSPCCEKAHTNKGAWTKEEDDRLVAYIRAHGEGCWRSLPKAAGLLRCGKSCRLRWINYLRPDLKRGNFTEAEDELIIKLHSLLGNSRWSLIAGRLPGRTDNEIKNYWNTHIRRKLLNRGIDPATHRPLNEPVQEATTTISFTTTTTSVEEESRGSIIKEEIKEKLISATAFVCTEAKTQVQERCPDLNLELGISLPSQNQPDHHQPFKTGGSRSLCFACSLGLQNSKDCSCNVIVSTVGSSGSTSTKNGYDFLGMKSGVLDYRSLEMK

SEQ ID NO: 22903 - protein, 135 aa, Ralstonia solanacearum
MRMLHTMLRVGDLQRSIDFYTKVLGMHLLRTSDNPEYKYSLAFVGYGPETGNTVIELTYNYGVSAYELGTAFGHLAIEVDNAAQACEQIRAAGGKVTREAGPVKGGSTIIAFVEDPDGYKIELIQARSMPDGNRH

SEQ ID NO: 22904 - protein, 107 aa, Triticum aestivum
  misc_feature (53)..(53): Xaa can be any naturally occurring amino acid
MALSSAPPCPGQEPPSGKQLSYQPAAAVRSINWTYAIFWSLSTGLRPPGVLTXKNGFYNGEVKTRKIISSTMTELTADELFLQRSEQLRELYESLLSGKADHRAKRP

SEQ ID NO: 22905 - protein, 549 aa, Ostreococcus tauri
MDASFFDADRAGTSAAIADADADANVNDPSSELDAKRVRQLVLAFERAYAENVKQRAKHADEPARFAESEIELDCEIKALGQLASAPELYAELVRLNVMESVVGILGHENEDVVADTLEVLRELTDGDAVESDEEGGKALADAIKRAGGYAALYAALVRFEDKRGDTRATTSEASAAVSSALGIVENLGEIVGTTVDEDSGESCNEAFEGLCDETDLLGWLLKRVEKKRVVDENKLAASEILAIVLQSSARCRKKCLDMNGLDALLQAVSAYKKREPEDDGEKELVENLFDAVCAVVMTPETKDEFLDLEGIELMLMILRGSSSGDKKATPFAAIPALKCLDYVTSGNKRACERFVDAGGLKSLFPAFMGRNVKTLRKTFGNEAVLEQQTRSSSLLCSMFKNLADTERRDRLCAKFVEDDHAKCDRLIELWVEFAKRVSAEQSRLENDDEDLGIELTEEEEYLQKLDAGLATLEHLTLILANLWATGHAPILRRLYANASQNSITLGDLRDIIREYAHHVGDSGGEDKRAEQVRAALASLPYAPGERDD

SEQ ID NO: 22906 - protein, 107 aa, Triticum aestivum
MEMSLADCWGSAPASPIGFEGYEKRLEITFSDAPVFADPCGRGLRALSRQQIDSFLDLARCTIVSQLLNKQFDSYVLSESSLFVYSHKVVIKTCGTTKLLLSIPRIL

SEQ ID NO: 22907 - protein, 214 aa, Triticum aestivum
MEVKLWNDKRERELLESLADLYAIIKATEKLERAYVRDLVSAADYEADCLKLISQFNSLSSSLAGVVTIPRFVQAYRLDCPAALNRLVQSGVPATIELRAATSSSSAPPATAASASAIAQCVQSFITAMDAVKLNMLANDQVRPLLHDLSTSMGKLGTVLPPDFEGKVKVNEWLAKLHKMGAGDELTDQQARQLNFDLESAYSAFMASLPTAGL

SEQ ID NO: 22908 - protein, 144 aa, Brassica napus
  misc_feature (12)..(12): Xaa can be any naturally occurring amino acid
  misc_feature (30)..(30): Xaa can be any naturally occurring amino acid
  misc_feature (46)..(47): Xaa can be any naturally occurring amino acid
  misc_feature (57)..(57): Xaa can be any naturally occurring amino acid
  misc_feature (63)..(63): Xaa can be any naturally occurring amino acid
  misc_feature (65)..(65): Xaa can be any naturally occurring amino acid
  misc_feature (75)..(75): Xaa can be any naturally occurring amino acid
  misc_feature (88)..(88): Xaa can be any naturally occurring amino acid
  misc_feature (96)..(96): Xaa can be any naturally occurring amino acid
  misc_feature (109)..(110): Xaa can be any naturally occurring amino acid
  misc_feature (121)..(121): Xaa can be any naturally occurring amino acid
  misc_feature (128)..(128): Xaa can be any naturally occurring amino acid
NGSSMLSSAAVXTSPAQATMVAPFTGLKSXSAFPGARKGNNDITSXXSNGGKVICMXVWPPVXKXKFETLSYLPXLTEGELGKEVDYXLLRNKWIXPCGEFEIEHGFVXXGAWKHPPDTNXGRYWTMXEFLRDGLCSRGSQKQN

SEQ ID NO: 22909 - protein, 117 aa, Oryza sativa
  misc_feature (80)..(80): Xaa can be any naturally occurring amino acid
GKNAYNETIEMTAPVLTQVAPSDGPFCVSSFVVSFYVPAKNQPDPPPAEGLHVQRWAGARYAAVRRFGGFVADSDVGEQXADPTSSYTVAQYNSPFEFSGRVNEIWMLFDAKDASDM

SEQ ID NO: 22910 - protein, 808 aa, Candida albicans
MSHLVSSSLGTTTTATPTSRSPHTNHSTPYNQNSITSNRSSPVPKNSVNSRIIPQTMNPPIDMKSNNILNPEKDTDTSRGDHSESKASSISSASGTTTTNNNNVSNNNSTGKTQIVFIHKLYDMLHDESISHLIWWSPSLDSFYVTPGEEFSRVLSQYFKHTNIASFIRQLNMYGFHKVNEPFLNQDDQQQQQQLQSNRWEFRHSTNQFRKGDTESLKNIKRRSSKTLNAQKEVVNIKSLPPTSHPMEYNTGYSYQNEDSAHYFVHHHSITTMQSPADMRPRSPSTPIPMQPLAQQQQQQQQQQQQQQQQQQQLPSQPVPNGPPVFSGPIPPGAVNQSPQEYLTRPSILNNVQGSFENATNFKFVELTNQINSLRNDFFTMNNRYEILQNELKYQTADSMAVLEILEKLSNDNRIATDIRDLKNVVSQRMQRLNNQFIPQQSNFAPHIPGQQQQQQHGNSVSSNYHLESTNVSRNPSTTNLNVAPQPYPLNPHYTIYANNRASGSSEINNGVFRAREDSNNSKRNLSVYDPLQPVPSRNSSRILIEESTPTHPPTNFNPQQSQSQSQVQLGPAMPPQGFRNRAESTYSPLSHSSNKSQILNKAPTPVNHSPLVQQQQKEAKQELNDSSVAPPSQSSLPVTRPLSRQQQQQQQTLHHPSTTSSRTNSLPNPVAEHPAPQSSYFMQRNSFNTIYEHQKSLRVPSPKRVRYATPPRSIPEQPISSTAPTTMITSTSKTTSTSGAAISRSENHSVVSLTGGALPSVSELDKSIRTGSSVSLPPIKSIKDNDNKNDNGNSDDNGNDHKKRKLE

SEQ ID NO: 22911 - protein, 454 aa, Chenopodium rubrum
MSTPKATNHQSQPQPLKRQLPFTSMKPPFVPSPGDYHRFSDNRAPPAPDPETIVVKTPPMKRKSDTAEYDAESSDWTASPGYTEVVSSPHQTPVSGKAGKGRGSRISKCNRPGPQTPMSNVGSPGNNLTPVGPCRYDSSLGLGTKKFINLIKHAEEGILDLNKAADTLEVQKRRIYDITNVLEGIGLIEKKLKNRIQWKGLDVSRPGEVDDSVTSLQADVENLSIEERRLDEQIREMQERLREMSEDENNQKWLFVTEEDIKGLPCFQNETLIAIKAPHGTTLEVPDPDEAVDYPQRRYRIVLRSTMGPIDVYLVSQFEEKFEEISGAEPPPSIPSTSGYNEDTTTAAKEENRDDETKMQGQETHRICSDANAQQDFVSGIMKIVPEVDSDADYWLLSDADVSITDMWRTDSGVEWNELGTIHEDYTVANVGTPQPQSPPPSATEVLPTNTTGR

SEQ ID NO: 22912 - protein, 296 aa, Saccharomyces cerevisiae
MITTPLVHVASVEKGRSYEDFQKVYNAIALKLREDDEYDNYIGYGPVLVRLAWHISGTWDKHDNTGGSYGGTYRFKKEFNDPSNAGLQNGFKFLEPIHKEFPWISSGDLFSLGGVTAVQEMQGPKIPWRCGRVDTPEDTTPDNGRLPDADKDAGYVRTFFQRLNMNDREVVALMGAHALGKTHLKNSGYEGPWGAANNVFTNEFYLNLLNEDWKLEKNDANNEQWDSKSGYMMLPTNYSLIQDPKYLSIVKEYANDQDKFFKDFSKAFEKLLENGITFPKDAPSPFIFKTLEEQGL

SEQ ID NO: 22913 - protein, 294 aa, Saccharomyces cerevisiae
TTPLVHVASVEKGRSYEDFQKVYNAIALKLREDDEYDNYIGYGPVLVRLAWHTSGTWDKHDNTGGSYGGTYRFKKEFNDPSNAGLQNGFKFLEPIHKEFPWISSGDLFSLGGVTAVQEMQGPKIPWRCGRVDTPEDTTPDNGRLPDADKDADYVRTFFQRLNMNDREVVALMGAHALGKTHLKNSGYEGPWGAANNVFTNEFYLNLLNEDWKLEKNDANNEQWDSKSGYMMLPTDYSLIQDPKYLSIVKEYANDQDKFFKDFSKAFEKLLENGITFPKDAPSPFIFKTLEEQGL

SEQ ID NO: 22914 - protein, 112 aa, Idiomarina baltica
MKMITALIKPFKLDDVRQALADIGCTGMTIAEVRGFGRQKGHTELYRGAEYRVDFLPKIRLELAVSDDQLERAVEVISEAAHTGNIGDGKIFVTHLEHCVRIRTGEVDQEAL

SEQ ID NO: 22915 - protein, 403 aa, Lactobacillus sakei
MNDANLNDTQSSETMAAALDSVHEVKIGDVVKGEVLVIEDRQVIVGIEGTGVEGVVPQKELSSQPIETLTDAVKVGDQFDLVVIATIGNDKENGSYLLSKRRLEARKVWAEIEQKFENKETIKATVLNVVKGGLVVDAGVRGFLPASMLSDRFVRDLNSFKGQELELQIIEIEPSENRLILSRKALVEQERQAQLKAVFEKLLPGDIVEGEVARLTNFGAFVDLGGVDGLVHVSEISYDHINQPSDVLEVGQNVKVKILSLDQEKGRISLSIKDTQPGPWDDIAEKAPVGSTLEGTVKRLTTFGAFVEVFPGVEGLVHISQISHQHIATPNDVLEEGQTVQVKVLSVDPEQQRLGLSIKALQEKPAGAKDSEQEDVAPSDYEMPEEETGFSIGDMLGKALDEK

SEQ ID NO: 22916 - protein, 329 aa, Sorghum bicolor
LLAVPAVRWRAGVRARPNAAGSAGAGRGRLFFRAAAARPVATAVQAEQEDGEEEEEVVVEERYALGGACRVLAGMPAPLGATALHGGVNFAVYSSGASAASLCLFTPDDLKAETVTEEVPLDPLLNLTGNVWHVFIHGDQLHDMLYGYRFDGVFAPERGQYYDVSNIVVDPYAKAVVSRGKYGVPGPGDNCWPQMAGMIPLPHSTFNWQGDLPLKYHQKDLVIYEMHLRGFTKHDSSNAKHPGTYIGAVSKLDHLKELGVNCIELMPCHEFNELEYFSSSSKMNFWGYSTINFFSPMARYSSSGIRDSGRGAINEFKTFVREAHKRGIE

SEQ ID NO: 22917 - protein, 121 aa, Glycine max
ARGTQKEETPEMVAEEAIIPDDKDTENLAKEKTEVSAEPPPALQDRGLNGDSKLLEENEKLREMMKKLLEAGNEQLSVISDLTVRVKDLEKKLARRRSKRVKTKQYRPAASKMSTHEMKSS

SEQ ID NO: 22918 - protein, 329 aa, Sorghum bicolor
LLAVPAVRWRAGVRARPNAAGSAGAGRGRLFFRAAAARPVATAVQAEQEDGEEEEVVVVEERYALGGACRVLAGMPAPLGATALHGGVNFAVYSSGASAASLCLFTPDDLKAETVTEEVPLDPLLNRTGNVWHVFIHGDQLHDMLYGYRFDGVFAPERGQYYDVSNIVVDPYAKAVVSRGKYGVPGPGDNCWPQMAGMIPLPHSTFNWQGDLPLKYHQKDLIIYEMHLRGFTKHDSSNTKHPGTYIGAVSKLDHLKELGVNCIELMPCHEFNELEYFSSSSKMNFWGYSTINFFSPMARYSSSGIRDSGRGAINEFKTFVREAHKRGIE

SEQ ID NO: 22919 - protein, 212 aa, Oryza sativa
MDPSGPGPSSAAAGGAPAVAAAPQPPAQLSRYESQKRRDWNTFLQYLRNHRPPLTLARCSGAHVIEFLRYLDQFGKTKVHASGCAFYGQPSPPGPCPCPLRQAWGSLDALIGRLRAAYEESGGTPESNPFAARAVRIYLREVRDSQAKARGIPYEKKKRKRSQAAQPAGVEPSGSSSAAAAAAGGGDTGSGGGAAATTTAQPGGSGTAPSAS

SEQ ID NO: 22920 - protein, 512 aa, Mycobacterium avium
MTDVVTHTETAPTPAAKAAKPVHTRAVIIGTGFSGLGMAIALQKQGVGFVILEKADDIGGTWRDNSYPGCACDIPSHLYSFSFEPKPDWKNPFSYQPEIWDYLKGVTEKYGLRRYIEFNSLVDRAHWDDDEHRWHVFTTDGREYVAQFLISGAGALHIPSLPDIEGRDEFAGPAFHSAEWDHTVDLTGKRVAVIGTGASAIQIVPEIVGQVAELQLYQRTPPWVVPRSNPEIPPAVRAAMENVPGLRALVRLAIYWGQEALAFGMTKRPNLLKVIEAYAKYNIRRSVKDKELRRKLTPHYRIGCKRILNSSTYYGAVADPKTELVTDHIARITPDGIVTADGTHRPVDVIVYATGFHVTDSYTYVQIKGLHGEDLVDRWNREGIGAHRGITVADVPNLFFLLGPNTGLGHNSVVFMIESQIRYVADAIATCDKLGAQALAPTRAAQDRFNDELQRRLGPSVWNSGGCSSWYLDEHGKNTVLWGGYTWEYWRATRAVKPEEYQFYGIGSRAGV

SEQ ID NO: 22921 - protein, 563 aa, Zygosaccharomyces bisporus
  misc_feature (225)..(225): Xaa can be any naturally occurring amino acid
MSEITLGRYLFERLRQVDTNTIFGVPGDFNLSLLDKIYEVQGLRWAGNANELNAAYAADGYARVKGMAALVTTFGVGELSALNGIAGSYAEHVGVLHIEGVPSISSQAKQLLLHHTLGNGDFTVFHRMSANISETTAWLTDITTAPAEIDRCIRVTYLTQRPVYLGLPANLTDQKVPASLLNTPIDLSLKENDPEAEAEVVETVLELIKEAKNPIILADACCSRXDVKAETKKLIDITQFPSFVTPMGKGSIDEQNPRFGGVYVGTLSSPAVKKAVESADLVLSVGALLSDFNTGSFSYSYKTKNVVEFHSDHIKIRNATFPGVQMKFVLEDLLKKVPAAVKGYNPGPVPPAPSPNAEVAASTPLKQEWLWRQVGKFLQEGDIVITETGTSAFGINQSHFPNRTYGISQVLWGSIGYTTGSTLGAAFAAEEIDPKKRVVLFIGDGSLQLTVQEISTMVRWGLKPYLFVLNNDGYTIERLIHGEKAQYNDIQPWKNLELLHAFGATDYETHRVATVGDWDKLTTDSKFNENSRIRMIEVMLETMDAPSSLVAQAQLTAAINAKQ

SEQ ID NO: 22922 - protein, 99 aa, Sporobolus stapfianus
MATSIAAAASTFLGTRLADPAPQNGRIVARFPFGKKPAAQKKPAKQNTNNSDRPLWFPGAKAPDYLDGTYVGDYGFDPWGLGKPVEYLQFDLDSLDQNL

SEQ ID NO: 22923 - protein, 334 aa, Nannochloris bacillaris
MLIYIKTPPIIIFLPYLIKNSYFLSLQVLEEDFAQDDGDGGPSTQEVALRASKLRKRPPVWQLIAKNIYMHRERKQLDEDEVMICQCKPIWGTDTTTIGCGENCLNRMLNIECVAKYCPCGERCTNRGFSKRAYAKLEIRRAGAKGFGLFAAEDVKAGQFIVEYVGEVLEEEEYARRKEFYIATGQRHYYFMNVGNGEVIDAARRGGLGRFINHSCEPNCETQKWVVRGELAIGLFALEDVPAGSVLTFDYNFERYGDKPMKCLCGSKACRGVIGGSQETAARMTETIVAPEEEEEQDLEPIMVTEKEADAAVSAILDRAVGLGWEDGFDARLQ

SEQ ID NO: 22924 - protein, 816 aa, Unknown
  Burkholderia sp. 383
MLSPDTSRTAESAAPLAAIIIGAGFAGIGMAIALQRAGIHDFAIVERSHDVGGVWRDNSYPGAACDVPSHLYSFSFEPNPAWSRVFAPQPEIHAYLQHCARKYGLARYLRFGAEVAHARYDEAAALWRVTLADGTTLSAAVLVSSTGQLSRPAMPDLPGIDTFRGRAFHSAHWDHDYSLTAKRVAVVGTGASAIQFVPAIAGDVKRLVVFQRSPAYVMPRPDRAYHPWEKALFRRLPWAMKLHRASIYLRYESRAIAFTRLHKLMKVAVGRPFHKLLARDVPDPALRAQLTPDYPIGCKRILLSSEYLAAMSRDNVELVTQRIRRVTEDGIETVDGVHHPVDAIVYGTGFAATEFLSPMRITGRDGLDLNDAWRRGAQAYLGLTVPGFPNFFMLYGPNTNLGHNSIVYMLESQIAHVMRCLRTMRRDGAREIDVDARRYRRFNVHVQQRLEGSVWNSCKSWYVDASGHNSTNWPGFTLTYRWITRFTGMSAYRFTHPLPESVAPARDVVVAPPAGRLEALTAASLRGFLRVAFRPLIGPPFGARMQRRVVALLSPLMPGTSGTLRYRTSAHRVPVEVVAPKRGDAGGAILYLHGGAFCLGGPHTHRGVTTRLANEAGLPVWVPDYRLAPEHPSPAALDDALAVYDAMRAQGHAPHRIVIAGDSAGGALALALAIALRERGEPAAAALLLISPVTDPALGGATLASRRHDDPMIRRGWLEQGLRWYHGAGSVAARGPLDTDLRGLPPMLVQAGDQEVLLSDALRLARHAQACGVPCRLEVHAARWHVFHLQAFYLRSARDALRTLARFAAERVAVTA

SEQ ID NO: 22925 - protein, 322 aa, Vibrio cholerae
MSKIYEDNSLTIGNTPLVRLNKVSNGKVLAKIEARNPSFSVKCRIGANMIWEAEKQGKLKPGVELVEPTSGNTGVALAFVAAARGYKLTLTMPESMSLERRKLLKALGANLELTEAAKGMKGAIAKAEEIVASNPEKYLLLQQFNNPANPQIHEKTTGPEIWDATDGQIDVFVAGVGTGGTLTGTSRYIKGTQGKAILSVAVEPAESPVITQALAGEEIKPAPHKIQGIGAGFIPGNLDLSLIDRVERVTSDEAIEMARRLMEEEGILAGISSGAAVVAANRIAQLPEFEGKTIVTVLPSSGERYLSTALFAGIFTDKENQQ

SEQ ID NO: 22926 - protein, 384 aa, Salinibacter ruber
MLGPSWRTICRTCGAPAWGTPPAAEGRRPGARFFASRRFLMSTSITLFGAGSWGTALAVHLAAAGRDVTLWARRDEAVERMRTTHRNPTYLSDIEIPPSVHVTSDLEAAAGASSLWAVAVPSQNLRSVATRIAPLTRPGTTVVSLAKGIENETLQTMSQVLADELGGMEAQQIGVLYGPSHAEEVAENQPTTLVAAAPTEPRAEWVQDAFMTERLRVYVNTDVVGVEIGGSAKNVLAIAAGIGDGVGYGDNAKAALVTRGLAEIRRLGIAMGAKPRTFAGLAGIGDLLVTCMSPHSRNRYLGEQIGNGMTLEEIESEMDMVAEGVRTTQSVQDLARHHDIEMPVTEAVHRVLFENRRPEDMVDELMTRSAKREHWLPQGLRNVS

SEQ ID NO: 22927 - protein, 375 aa, Salmonella enterica
MAKRDYYEILGVSKTAEEREIKKAYKRLAMKYHPDRNQGDKEAEAKFKEIKEAYEVLTDAQKRAAYDQYGHAAFEQGGMGGGFNGGADFSDIFGDVFGDIFGGGRGRQRAARGADLRYNMDLTLEEAVRGVTKEIRIPTLEECDVCHGSGAKAGTQPQTCPTCHGSGQVQMRQGFFAVQQTCPHCQGRGTLIKDPCHKCHGHGRVEKSKTLSVKIPAGVDTGDRIRLAGEGEAGEHGAPAGDLYVQVQVKQHPIFEREGNNLYCEVPINFAMAALGGEIEVPTLDGRVMLKVPSETQTGKLFRMRGKGVKSVRGGAQGDLLCRVVVETPVGLSEKQKQLLKDLQESFGGPTGEKNSPRSKSFFDGVKKFFDDLTR

SEQ ID NO: 22928 - protein, 557 aa, Oryza sativa
MRNLLLLPLLVAVAATVPLAAALSADGVALLAFKTAVTDDPSGALSSWSDADDDPCRWAGVTCANTSSSGPRVVGVAVAGKNLSGYVPSVLGSLALLRRLNLHGNRLSGTVPPALANATSLHSLFLYGNSLTGGLPPELCDLPRLQNLDLSDNSLTGSLPPELRRCKQLQRLMLSGNGFSGEIPAGVWPEMVSLQLLDLSDNSLTGAIPPELGKLAALAGTLNLSRNHLSGGVPPELGHLPATVTLDLRFNNLSGEIPQSGSLASQGPTAFLNNPGLCGFPLQVPCRAAPPSSSTPPPPSAAGSISGAGGPRQPVKTSLIVLISVADAAGVALIGVIVVYIYWKLRDRRGDGCGGDGDDDEERKRGLFPFPCMRADDSSDDGSDAGDDVKRNNTTTTTTASGGGGGGEEGQLVAIDKGFKMELDELLRSSAYVLGKGGKGIVYKVVVGNGTTPVAVRRLGGGAAAAERYKEFAAEAGAIGRVRHPNVVRLRAYYWSADEKLVVTDFVNNGNLATALRGEHTPSPSPSPSQFVNLFGKRETYFLKKWSKLWLDYNKLW

SEQ ID NO: 22929 - protein, 248 aa, Thermoanaerobacter tengcongensis
MNFDSFLYNTRPFLNYLFDFYSNLEEKSLSSVIYNAGGEDKVSVLVVDMLNGFCKSGPLASPRVAGIIEPIKNLLKACYRMGIKNVFFLNDAHPSDAVEFGEFPPHCVKGTFESEIVDELKEIIEGEPVIVEKNSLNVFFGGELEGGNEFLKKVVEMIKEGKSTFIVVGDCTDLCVYQTAMSIKMIANANNLKVNVIVPENCVETYDTSVKTAQSLKIMPHDGNLIHTMFLYHMKLNGIEVVKELLEE

SEQ ID NO: 22930 - protein, 530 aa, Brassica napus
MGDSTGEPGSSMHGVTGREQTFAFSVASPIVPTDKTAKFDLPVDSEHKATVFKLFSFAKPHMRTFHLSWISFSTCFVSTFAAAPLVPIIRENLNLTKQDIGNAGVASVSGSIFSRLVMGAVCDLLGPRYGCAFLVMLSAPTVFSMSFVSGAAGFITVRFMIGFCLATFVSCQYGMSTMFNSQIIGLVNGTAAGWGNMGGGITQLLMPVVYEIIRRCGATAFTAWRLAFFVPGWLHIIMGVLVLNLGQDLPDGNRSALEKKGEVAKDKFGKIMWYAVTNYRTWIFVLLYGYSMGVELSTDNVIAEYFFDRFHLKLHTAGIIAACFGMANFFARPAGGYASDLAAKYFGMRGRLWALWIIQTAGGVFCVWLGRANTLVTAVVAMVLFSLGAQAACGATFAIVPFVSRRALGIISGLTGAGGNFGSGLTQLIFFSTSRFTTEQGLTWMGVMIVACTLPVTLIHFPQWGSMFLPPSTDPVKGPKEHYYASEWNEQEKEKNMHQGSLRFAKNAKSEGGRRVRSAATPPENTPNNV

SEQ ID NO: 22931 - protein, 247 aa, Bartonella henselae
MKKTTKKTAGGYGGSGSHKLYQRVKKKAGTITASSRRWLERHLNDPYVHQSKVDGYRSRAAYKLIEINQRYKFLKKGQKIIDLGAAPGGWCQVSGCIVGSSDEKPSVVGIDYLHVDPLPGVVMLEMDFLHSDAPQKLIDALGTKPDVVLSDMAAPTTGHRQTDHLRTIYLCEVAADFALSVLKPGGHFLAKAFQGGAENTLLTTLKQNFKTVHHVKPPASRSESVELYLLALEFKAKTERKEQLFLF

SEQ ID NO: 22932 - protein, 523 aa, Vicia faba
MEPLSSTKQINNNNNLAKPSSLHVETQPLEPSPLRKIMVVASIAAGVQFGWALQLSLLTPYVQLLGIHHTWAAYIWLCGPISGMLVQPIVGYHSDRCTSRFGRRRPFIAAGSIAVAIAVFLIGYAADLGHSFGDSLDQKVRPRAIGIFVVGFWILDVANNMLQGPCRALLGDLCAGNQRKTRNANAFFSFFMAVGNVLGYAAGAYSKLYHVFPFTKTKACNVYCANLKSCFFLSIALLTVLATSALIYVKETALTPEKTVVTTEDGGSSGGMPCFGQLSGAFKELKRPMWILLLVTCLNWIAWFPFLLFDTDWMGKEVYGGTVGEGHAYDMGVREGALGLMLNSVVLGATSLGVDILARGVGGVKRLWGIVNFLLAICLGLTVLVTKLAQHSRQYAPGTGALGDPLPPSEGIKAGALTLFSVLGVPLAITYSIPFALASIFSSTSGAGQGLSLGVLNLAIVIPQMFVSVLSGPWDALFGGGNLPAFVVGAVAALASGILSIILLPSPPPDMAKSVSATGGGFH

SEQ ID NO: 22933 - protein, 433 aa, Arabidopsis thaliana
MSLKIKFLLLLVLYHHVDSASIVKFLPGFEGPLPFELETGYIGIGEDENVQFFYYFIKSENNPKEDPLLIWLNGGPGCSCLGGIIFENGPVGLKFEVFNGSAPSLFSTTYSWTKMANIIFLDQPVGSGFSYSKTPIDKTGDISEVKRTHEFLQKWLSRHPQYFSNPLYVVGDSYSGMIVPALVQEISQGNYICCEPPINLQGYMLGNPVTYMDFEQNFRIPYAYGMGLISDEIYEPMKRICNGNYYNVDPSNTQCLKLTEEYHKCTAKINIHHILTPDCDVTNVTSPDCYYYPYHLIECWANDESVREALHIEKGSKGKWARCNRTIPYNHDIVSSIPYHMNNSISGYRSLIYSGDHDIAVPFLATQAWIRSLNYSPIHNWRPWMINNQIAGYTRAYSNKMTFATIKGGGHTAEYRPNETFIMFQRWISGQPL

SEQ ID NO: 22934 - protein, 464 aa, Pseudomonas syringae
MEFLPLFHNLRGSRVLVVGGGEIALRKSRLIADAGAVLRVVAPEIEAQLSELVVQSGGEMILRGYSESDLDGCVLIIAATDDEPLNAQVSHDARLRCVPVNVVDAPALCTVIFPAIVDRSPLVIAVSSGGDAPVLARLIRAKLETWIPSTYGQLAGLAARFRNQVKGLFPNVQQRRAFWEDVFQGAIADRQLAGQGAEAERLLIAKIAGEPPPETGEVYLVGAGPGDPDLLTFRALRLMQQADVVLYDRLVAPTILDLCRRDAERVYVGKRRAEHAVPQEQINQQLVALAKQGKRVVRLKGGDPFIFGRGGEEIEELAVHGIPFQVVPGITAASGCAAYAGIPLTHRDHAQSVRFITGHLKDGTTDLPWSDLVAPAQTLVFYMGLIGLPVICEELIRHGRSADTPAALVQQGTTVNQRVFTGTLANLPQLVAEHEVHAPTLVIIGEVVKLREKLAWFEGAQATV

SEQ ID NO: 22935 - protein, 292 aa, Thermus thermophilus
MSEVRHAVLQFRPEKSRLRESLARLRAHLEALRPHAPQVVVLPEAALTGYFLQGGVRELALTRHELLELLVGVYEKVGWEGVLDVVVGFYERDEGAYYNSAAYLELPHRVVHVHRKVFLPTYGVFDEERYLARGRRVEAFRTRFGRAALLICEDFWHSITATIAALDGAEVIYVPSASPARGFQGGYPENVARWRTLAQAVAAEHGLYVVVASLVGFEGGKGMSGGSLVVGPDGRILAEAPLFEEAALLFPLDRERIPPVRYDSPLLSDLEAGLPLLLSDLQRVLGRRDADT

SEQ ID NO: 22936 - protein, 428 aa, Unknown
  Synechocystis sp. PCC 6803
MAGSLFADASKRLEKALKYVAISDDAGERLKYPKTSLSVSIPVRMDDGSLKIFPGYRVRYDDTRGPGKGGVRYHPNVTMDEVQSLAFWMTFKCALLNLPFGGAKGGITLNPKELSRAELERLSRGYIEAIADFIGPDIDILAPDVYTNEMMMGWMMDQYSIIRRKISPAVVTGKPVTMGGSQGRNTATGTGAFYIMQGMLPKFDQYPENTTVAVQGFGNAGMVVAECLYQDGYKVVAISDSQGGIYNEQGIDIPAVIDYKQRHRTLAGMYCDQAICDLGENQQISNAELLALDVDVLIPAALENQITRDNADQVRARYIFEVANGPTTTAADDILASKGIYVFPDILVNAGGVTVSYFEWVQNRSGLYWSAKEVNDRLKEKMVEEAEHVWNITQELDVNVRTAAYIHALNRLSEAMDAKGTRDYYQDS

SEQ ID NO: 22937 - protein, 587 aa, Nocardia farcinica
MSRWCAFLTEDDPAAHVRAVGAEPITAGPITAGSITAAGPHGFGLLDGPGVAAGPFTAGALTAVGEVTLFNADRLRARLGADAPPPGRPDGEVLLHSYARFGLDGIAAAEGMFALAVADGPDLVLLRDQLGARTLFHARARAGWAASTSLRALRRWPALRTGLHLPAVRSFLTFAYLPGRETLLRDVHEVLPGRCLRLHPDGTSTEHTYWEPREHIDERPASEHALRLRALLEDAVTRRLPAGEPVGVLLSGGIDSSLVTALAAKLHDQAVHTYSISFGADAPDELGYSGLVATHCHTRHRVLTVPGQTVAARLADTVGLLDSPVGDPLTVPNLMLAEAVAADGIRVALNGEGGDPVFGGPKNLPMLIFELTRDDPAEDARAHAYLDSYRKCYADLPALLTRDALAALADAPGPVEHVAPYLRPGAMTSLLNQLLHTNLRTKGAHHILTKVERLTAASGIEGRAPLFDRAVVDHAFAVPPTMKLAGTSEKWILKQAVRDLLPKTIVDRPKSGMRVPVQQWLDGPLRELAHDLLLGRTARERGLFRADTIRAWLRGEGALLPRQGGKLWLVLSLQLWLRSFDLEESVR

SEQ ID NO: 22938 - protein, 319 aa, Listeria innocua
MKRIAILTSGGDAPGMNAATRAVVRKAIYEGLEVYGINYGFLGLVNGDIRKLELGSVGDLLHRGGTFLYSARYPEFATEEGQLKGIEQLKKHQIDGLVVIGGDGSYHGAEALTKRGFPTIGIPGTIDNDISGTDFTIGFDTALNTVLDALDKIRDTATSHERTFIIEVMGRDAGDIALWSGLAGGAEAIIVPEESFNMDDVVDRLNKGRERGKKHSIIVVAEGVMSGNEFAKQLAEYGDYHARVTVLGHVQRGGSPTAFDRVLASRLGARSVELLLENRGGLAVGIRENRIVENNIGEILKEKHTLDQKLFDLASILSI

SEQ ID NO: 22939 - protein, 122 aa, Arabidopsis thaliana
  misc_feature (55)..(55): Xaa can be any naturally occurring amino acid
  misc_feature (106)..(106): Xaa can be any naturally occurring amino acid
  misc_feature (108)..(108): Xaa can be any naturally occurring amino acid
RTHIISSSFLSSATILPSPRHSTMGAPFNKLNSSPAFPTTHKANNDITSITSNYXRVNCMHVWPPILKKKSETLSYLPDLTDSELANEVDYLILNKWIPCVEFYLXTXFVYREHCNSPLFYY

SEQ ID NO: 22940 - protein, 429 aa, Unknown
  Bradyrhizobium sp. BTAi1
MTAPLKAIDGSADLPALMNDLASRARAAARVLALAPAAQKNRALEAMERLIRARVDTIIAANAEDVVEAKAAGITSSFLDRLTLTPARVAAMADGIAAVREVADPIGIVTESWQRPNGMTIERVRVPLGVIGVIFESRPNVAADAGVLCLKSGNAVILRGGSDSFRSCRAIHECLVEGLREAGLPDAAITLVPTRDRAAVGLLLSGLNGGVDVIVPRGGKNLVARVEAEARVPVFAHLEGVNHVYVDGAADLEMAKSIVLNAKMRRTGVCGAAETLLIDRASQDKIKPLVDTLINAGCEVRGDDAVRAADARVKPASNEDWDTEYLDAVIAAKVVDGVEGAIAHIQAHGSHHTDAIVTADVAAADKFLNEVDSAIVLHNASTQFADGGEFGFGAEIGIATGKFHARGPVGVEQLTSFKYRIHGTGQTRP

SEQ ID NO: 22941 - protein, 721 aa, Unknown
  Synechococcus sp. CC9311
MQGQTQSISFDGREIRLTTGRYAPQAGGSVMIECGDTSVLVTATRSKGRDGIDFLPLICDYEERLYAAGRIPGSFMRRESRPPERATLICRLIDRPMRPLFPSWLRDDLQIVATCMSLDERVPADVLAVTGASMATLLAKIPFYGPMAAVRVGLLGDDFVLNPSYREIERGDLDLVVAGTPQGVVMVEAGANQLPEGDVIEAIDFGYEAVSELIKAQQSILKEAGIEQVIPEAPEQDKTLPVYLEKACSKSIGEVLGQFEQTKAERDEKLDAIRSTTAETIQGLKDSDPVRVAVSANGKALPNSFKALTKTLMRQQILKDGKRVDGRNLDQVRPISAAAGVLPKRVHGSGLFQRGLTQVLSTATLGTPSDAQEMDDLNPSNEKTYLHHYNFPAYSVGETRPMRSPGRREIGHGALAERAIVPVLPAKDTFPYVVRVVSEVLSSNGSTSMGSVCGSTLALMDAGVPLKSPVSGAAMGLIKEGDEVKILTDIQGIEDFLVDMDFKVAGTDKGITALQMDMKITGLPVSIVADAVNQARPARLHILEKMMEAIESPREGLSPHAPRLLSFRIDPELIGTVIGPGGRTIKNITERTNTKIDIEDSGIVTIASHDGAAAEEAQKIIEGLTRKVNEGEVFTGSITRIIPIGAFVEILPGKEGMIHISQLSEARVEKVEDVVKVGDEVTVRVREIDNRGRINLTLRGVPQSGESADSQPAPTPVAPLS

SEQ ID NO: 22942 - protein, 92 aa, Kluyveromyces lactis
ARPAFVNKLWSMVNDKSNEKFIHWSTSGESIVVPNRERFVQEVLPKYFKHSNFASFVRQLNMYGWHKVQDVKSGSMLSNNDSRWEFENERHA

SEQ ID NO: 22943 - protein, 416 aa, Arabidopsis thaliana
MASLAQQFSGLRCSPLSSSSRLSRRASKNFPQNKSASVSPTIVAAVAMSSGQTKERLELKKMFEDAYERCRTSPMEGVAFTVDDFAAAIEQYDFNSEIGTRVKGTVFKTDANGALVDISAKSSAYLSVEQACIHRIKHVEEAGIVPGMVEEFVIIGENESDDSLLLSLRNIQYELAWERCRQLQAEDVIVKAKVIGANKGGLVALVEGLRGFVPFSQISSKAAAEELLEKEIPLKFVEVDEEQTKLVLSNRKAVADSQAQLGIGSVVLGVVQSLKPYGAFIDIGGINGLLHVSQISHDRVSDIATVLQPGDTLKVMILSHDRDRGRVSLSTKKLEPTPGDMIRNPKLVFEKAEEMAQTFRQRIAQAEAMARADMLRFQPESGLTLSSDGILGPLGSELPDDGVDLTVDDIPSAVDI

SEQ ID NO: 22944 - protein, 236 aa, Oenothera elata
MTRRYWNINLEEMMEAGVYFGHGIKKWNPRMAPYIYANRKGIHITNLTKTARFLAKACDLVFDAASRGGQFLIVGTKKQAAALVARAAIKARGHYVNKKWLGGMLTNWSTTETRLHQFRDLRTEQKTGRLNRLPKRDAAILKRQLSHLQTYLGGIKYMTGLPDILIILDQHEEYTALRECITLGIPTICLIDTDCDPDLADLPIPANDDAMASIRLILNKLVFAICEGRSSSIRNP

SEQ ID NO: 22945 - protein, 352 aa, Legionella pneumophila
MKKILFIDRDGTLVEEPFDFQVDSLDKIKLTSGVIPALLQLQKAGFTFIMVSNQNGIGTVAFPEEDFAVCHEFILDLFSSQGILFDEIFICPHTPENNCICRKPKTGLLEPYLKETVFAKQYSWVIGDRDTDKEFADNLGVNFLPISKTHTWEMVASAIINDARKASVQRKTKETTIDLSVQLDSDQTSVIDTPIPFFTHMLEQVAKHGGFDLRLQASGDLEVDEHHLIEDTAIALGEAIRTALGDKWGINRYGYTLPMDESLATIAIDISGRSFCDFKGQFTREFIGGMATEMIPHFFQSLSSALGATIHIEVTGTNHHHMIEACFKVLGRALRQACSRTNNYLPSTKGVL

SEQ ID NO: 22946 - protein, 475 aa, Bacillus anthracis
MQQTTNEKLHRTMKSRHLFMIALGGVIGTGFFLGSGYTINQAGPGGAILSYLVGGFIMYLTMLCLGELTVAMPVSGSFQKYATKFIGPGTGFMIGWLYWLGWAVTVGLELTSIGLMMKRWFPNVDVWVWCLVFGVILYASNAISAKSYAELEFWFSSIKVITILAFVVLGGSALLGFISYDGKEAAPLFSNFVSEGGLFPNGLAAVLLTMITVNFSFQGTELIGIAAGESENPEKTIPRAIRNTVWRIMLFFILTMTILVGLISWKEAGVIESPFVVVFDKIGIPYAADIMNFVIITALLSVANSGLYAATRILWSLANEGMAPTSFQKVNKRGIPITALVVTIAVAGLSLFTSFLAEDTVYMYLLSIAGLSAVSSWIIIALSQLRFRSQYIKGGGKLEDLKYRTPLYPIVPILALITNSIVVISLAFIPEQRMALYCGIPFIIFCYIYYYINKKRQKPMKVEMEKANETNNQTR

SEQ ID NO: 22947 - protein, 460 aa, Vitis vinifera
MAVFGVVLIGLCICTALLRWNEVRYRKKGLPPGTMGWPVFGETTEFLKQGPSFMKNQRARYGKFFKSHLLGCPTTVSMDPELNRYILMNEAKGLVPGYPQSMLDILGKCNIAAVHGSTHKYMRGALLALISPTMIRGQLLPKIDEFMRSHLNKWDTKIINIQEKTKEMALLSSLKQIAGIESGTISKEFMPEFFKLVLGTISLPIDLPGTNYRRGFQARKNIVGMLRQLIEERKASQETHNDMLGCLMRTNENRYKLSDEEIIDLIITILYSGYETVSTTSMMAVKYLHDHPRVLDELRKEHLAIRERKRPEDPIDWNDYKLMRFTRAVIFETSRLATIVNGVLRKTTKDMELNGFVIPKGWRIYVYTREINYDPLLYPDPLAFNPWRWLDKSLESQNYFLLFGGGTRQCPGKELGIAEISTFLHYFVTRYRWEEVGGDKLMKFPRVEAPNGLHIRVSAY

SEQ ID NO: 22948 - protein, 253 aa, Vibrio vulnificus
MWRPNPIEDFKMATVSMRDMLKAGVHFGHQTRYWNPKMKPFIFGARNRVHIINLEKTVPMFNEALAELVKVGEKKGKVLFVGTKRAASEAVKEAAIASNQYYVNNRWLGGMLTNYKTVRQSIKRLKELEVQSTDGTFDKLTKKEALMRTREMEKLEKSLGGIKDMGGLPDALFVIDADHEHIAIKEANNLGIPVFAVVDTNSNPDGVDYIIPGNDDAIRAVQLYLNAAASSLTEGRNKDVAAVAEKDGFVEAE

SEQ ID NO: 22949 - protein, 355 aa, Burkholderia pseudomallei
MTSSDQTNSGADPVRAYLDCGIRNYWYPVAPSWQVSSAPVGITRLSEQIVLWRDREGNVHALEDRCPHRGARLSLGWNLGDRVACWYHGVEVNGGGTVTKVPAVSNCPLEGQACVKSYPVEERAGAIFLWFGDDAHREPAPLVLPDELVAPEYAQFVCVSNWTCNYQYAIDNVMDPMHGAYLHATSHSMAEGDKQADMRVRRTETGLMFEKVNQRDVNFDWVELGETGCIWLRLAIPYQRKFGPGGSFGIVGFATPIDDEHCQVYFWRTRKVAGWQRDVWRFLYRNRLEGLHWAVLEQDRYVLESMAPNARDHEYLYQHDIGVTRVRRMLRQRAQEHLAALDAHRAAQADAAERA

SEQ ID NO: 22950 - protein, 425 aa, Glycine max
QPRHTLLPPQYLGSLPLRISKVSHEPHIPGQCTFGQAVLNGINALCGIGILSTPYAAKEGGWIGLSILLLYAVFSFYTGLLLRYCLDSAPGLETYPDIGQAAFGTTGRVIISIILYMELYACCIEYIIVESDNLSTLFPNAHISLGGVELNAHILFAILTAVALLPTVWLRDLRILSYISACGVIATILVVLCLFWVGLLDNADIHTQGTTKTFNLATFPVAIGLYGYCYAGHAVFPNIYTAMANRNQFPGVLLVCFAICTSMYCAVAIMGYTAFGKATLSQYTLNMPQHLVATKIAVWTTVVNPFTKYALSLSPVAMCLEELIPANSPNFFIYSKLIRTALVVSTLLVGLSVPFFGLVMSLTGSLLTMFVSLILPAACFLSIRGGRITRFQVSICVTIIVVGIVSSCLGSYSALSEIIQELFKS

SEQ ID NO: 22951 - protein, 509 aa, Gibberella zeae
MSNPLADGGIPTLNGVYPSESNEKVTTIPNPENDQPAASDQPQLQDMINGNNGQERPQMPDRDFDSSISTSNADFDDLMLSTNGMSNDKPNGVHNGHANNSAKSYAEVAAEGEENDGKSQDTDDLDKSYADVVANRDAKDSRGDDGWTYPKLPITAQPKDLKSASWRAGGIRFAPLRVPMRRRSQTAAVLFHCMSIATLVSAFWLICANPLAWPIIIPYLIHLALSTAGTNGNLTYRSEWVRSLKLWKLFAGYFPMKLHKTHDLPTDRKYIFGYHPHGIISHGAFAAFGTNALGFRELFPGITNTLLTLDSNFRLPFYRDYIMLLGLQSVSKESIWNLLSKGGPNNDGQGRAVTIVVGGARESLEAQPGSLRLILKSRKGFVKMALRTGADLVPVIGFGENDLYDQLSPKTHPIVHRIQMILLKVFKFTVPALHGRGVLNYDVGLMPYRRPVNIVMGRPIRVDKAHGPQPAQKDIDELHERYVQEVEKLWETYKDQFSVERKTEMEIIA

SEQ ID NO: 22952 - protein, 412 aa, Bartonella henselae
MKDMGRKARRAATVLAVMSSEQKNKALEMIALSLEAHSDEILRANHQDLLNATQNNLTVAMVDRLKLNEVRLCTIIDSVRQVACLPDPVGQVMDEWTRPNGLHISRVRTPLGVIGIIYESRPNVTIDASTLCLKAGNAAILRGGSDSFHSAHALHCALVKGLKKAGFPKDAIQMVATKDRGAVGEMLKGLDGAIDVIVPRGGKNLVARIQVDARVPIFAHLEGLCHIYIDQSADLDMARNIVLNAKLRRTGICSAVETVLIDRQALEKFLPILTALQKKGCEIRATEDIVFLMPDAKLAFEEDWSHEYLDAIVSVKTVESVEGAIAHIKRYSSGHTESIIAEDMEIVEKFFNHLDSAILLHNASTQFADGGEFGFGAEIGIATGKMHARGPIGVEQLTSFQYHIKGNGQVRP

SEQ ID NO: 22953 - protein, 510 aa, Ralstonia metallidurans
MPGHEPGHNNKRQRIGDARLSVSIAMTEDILVNITPQETRVAIVQQAAVQELHVERTLTRGLVGNIYLGKVVRVLPGMQSAFIDVGLERAAFLHVADIWHPRDGDKNGHLAIEKTLFEGQALMVQVIKDPIGTKGARLSTQVSIAGRTLVYLPQDPHIGISQRIEGEIDREALRARVQGLVPTDERGGFIVRTIAEEASDEELGNDIAYLRKIWATIRSNATTLPAPSLLYQDLNLAQRVLRDFINDATGVIQIDSRENYQKLVEFAQEYTPAVLPRLSHYTGERPIFDLFNIDAEIEKALSRRVDLKSGGYLMIDQTEAMTTIDVNTGGYVGARNFDDTIFKTNLEAAHTIARQLRLRNLGGIIIIDFIDMENVEHRDAVLSELKRALSRDRTRITVNGFSQLGLVEMTRKRTRESLAHVLCEQCPVCTGKGQVKTPRTVCYDIFREIMRESRQFNPREFRILASQEVIDLFLEEESQHLAMLGDFIGKPISLQVESTFHQEQYDIILM

SEQ ID NO: 22954 - protein, 266 aa, Lemna gibba
MAASMALSSPSLVGKAVKLAPAASEVFGEGRVSMRKTAGKPKPVSSGSPWYGPDRVKYLGPFSGEAPSYLTGEFAGDYGWDTAGLSADPETFAKNRELEVIHARWAMLGALGCVFPELLARNGVKFGEAVWFKAGSQIFSEGGLDYLGNPSLVHAQSILAIWATQVVLMGAVEGYRVAGGPLGEVVDPLYPGGSFDPLGLADDPEAFAELKVKEIKNGRLAMFSMFGFFVQAIVTGKGPLENLADHLADPVNNNAWAFATNFVPGK

SEQ ID NO: 22955 - protein, 493 aa, Taxus wallichiana
MDALSLVNSTVAKFNEVTQLQASPAILSIALTAIAGIIVLLVITSKRRSSLKLPPGKLGLPFIGETLEFVKALRSDTLRQFVEEREGKFGRVFKTSLLGKPTVILCGPAGNRLVLSNEEKLLHVSWSAQIARILGLNSVAVKRGDDHRVLRVALAGFLGSAGLQLYIGKMSALIRNHINEKWKGKDEVNVLSLVRDLVMDNSAILFFNIYDKERKQQLHEILKIILASHFGIPLNIPGFLYRKALKGSLKRKKILSALLEKRKDELRSGLASSNQDLLSVLLSFRGDEAVLDNCFAMLDASYDTTTSQMTLILKMLSSNPECFEKVVQEQLEIASNKKEGEEITMKDIKAMKYTWQVLQESLRMLSPVFGTLRKIMNDINHDGYTIPKGWQVVWTTYSTHQKDIYFKQPDNFMPSRFEEEDGHLDAYTFVPFGGGRRACPGWEYAKVGILLFLHHFVKAFSGYTPTDPHERICGYPVPLVPIKGFPIKLIARS

SEQ ID NO: 22956 - protein, 518 aa, Glycine max
MAMAMALRRLSSSIDKPLRPLFNAGSLYYKSSLPDEAVYDKERPGVTWPKQLNAPLEVVDPEIADIIELEKARQWKGLELIPSENFTSVSVMQAVGSVMTNKYSEGYPGARYYGGNEYIDMAETLCQKRALEAIRLDPAQWGVNVQPMSGSPANFHVYTALLKPHERIMALDLPHGGHLSHGYQTDTKKISAVSIFFETMPYRLNESTGYIDYDQMEKSATLFRPKLIVAGASAYARLYDYERVRKVCDKQKAILLADMAHISGLVAAGVIPSPFDYADVVTTTTHKSLRGPRGAMIFYRKGVKEINKQGKEVLYDYEDKINQAVFPGLQGGPHNHTITGLAVALKQATTPEYRAYQEQVLSNSFKFAQALSERSYELVSGGTENHLVLVNLKNKGIDGSRVEKVLEAVHIAANKNTVPGDVSAMVPGGIRMGTPALTSRGFVEEDFVKVAEFFDAAVKIAVKIKGESKGTKLKDFLATIESSSTFQSEIAKLRLDVEEYAKQFPTIGFDKATMKHKN

SEQ ID NO: 22957 - protein, 339 aa, Schizosaccharomyces pombe
MSYSFQGLLNRVNESAIVNTLKEYTGLNTPKWTFNDIPDLTGKVALVTGSSGGIGYVTALELARKGAKVYLAGRNEEKYQKVMKQIHDEVRHSKIRFLRLDLLDFESVYQAAESFIAKEEKLHILVNNAGIMNPPFELTKDGYELQIQTNYLSHYLFTELLLPTLRRTAEECRPGDVRIVHVASIAYLQAPYSGIYFPDLNLPHVLLGTFARYGQSKYAQILYSIALAKRLEKYGIYSVSLHPGVIRTELTRYSPTFALKLLEKSVFQYLLLDPIRGAMTSLYAATSPEISKEHLNGAYFTAIAQRGILHRAHDDAFVEELYRYTHKIFEDLKYLAPSP

SEQ ID NO: 22958 - protein, 666 aa, Magnetospirillum magnetotacticum
  misc_feature (628)..(628): Xaa can be any naturally occurring amino acid
  misc_feature (631)..(631): Xaa can be any naturally occurring amino acid
MSVVPIRVLLLEDDPADARLVGQMLRRVKTTPFEVTVAGRLAQALERLSDETQHFDVVLADLGVPDSSGIGTLNALTQAAPRLPVVVLTGNDDDTIALEALKRGAQDYLVKGLGDAFILSRVVRYAIERKMGEEVLREARDSAEQAARAKSVFLAMMGHEIRTPLNGVLGMARLLLETDLDPRQKSFTETLVSSGELLLGLVNDILDFSRLDAEGMTLAVEPFDVLDTVEEVRLVLTSRVAEKDLTLTTRFGTGVRRVVAGDRLRLRQILFNLVGNAIKFTDHGGIEISVEPLAVERGQVLRFLIKDTGIGIGPEIGARLFTEFWQGDSGAARRFDGAGLGLAICKRLTDLMGGEIGYDSLPGQGTTFRVDLPLPPSEAPSAEPGKGVERPCRVLLVDDNEVNREVAAGLLERRGHQVVCARDGLEGVAAAARGGFDLILLDMRMPGMDGIETARAIRALPGAAAKVPIYLLTANPVKEDEARWREAGILGCLAKPFRFEHIGRLLAGLGEENRPPASPDPDLVEVAGLLSDLGDLGRDRMVGLVELFRSSSSADLAALRTHAKAGRLAEAGQLAHRMASAASSLHLGPLAAKCRAVEDATRADDPRTDAQAEELADLWTRSLAAVGXGFXGIFRPLTICPRYVTLRGHVTWASALGGPLCSIRPS

SEQ ID NO: 22959 - protein, 466 aa, Unknown
  Shewanella sp. ANA-3
MSLEQSKSVPPNHSSANVGLEKKKMLILVADIFLLFALYYGLPFDQGVNTGLAILVFAAILWLTEAIHISITAILVPILAVFFGVFETKEAMSNFANPIIYLFFGGFVLAAALHHQKIDTLIAQKLLLASKGKLSIACLMLFGVTALLSMWISNTATTAMMLPLALGILQQLDRKLYHSTYVFLLLGIAYSANIGGIGTLVGSPPNAIAAAQVGLSFSDWLKFGIPTVILMLPMMLLALYWYFKPDLSAKCELAVEDQKLTFQGKLTLVIFLATVCCWIFSVPLAKALGGITQFDTVVALGAVVLLAGLGLVGWKKIESTTDWGVLILFGGGLTLSAVLKSTGTSVFLAHWMTDIFGSTHMSLFVFAVIAFVVMLTEFASNTASAALLVPVFAAIAEALGVSPVMLSVLIGIAASCAFMLPVATPPNAIVYGSGHIKQSEMVRVGMIINFLSMIVLGIIAHTFWEV

SEQ ID NO: 22960 - protein, 112 aa, Unknown
  Frankia sp. EAN1pec
MKLVTAIVRPHRVDDVRAALTTYGVHGITVSQVTGFGLEMWRTQTYRGNAFHDESTSNIRLELVVADSDAPDVVNVIRRTAASTSSGAGKIWVLPVEGLARIRTGERGADAL

SEQ ID NO: 22961 - protein, 884 aa, Gibberella zeae
MSTQRTAHSLPPSPPSTAKPSRIGSFHDLQDIPSVDQSCLDSIKPYPLPPRCSSKSVLKEDLKTPDSFVERDPRLIRLTGVHPFNVEAPLSDLYDEGFLTSENLHYVRNHGHVPRCEDDEILDWEFEIDGLVETPIKMTVRDLINEYQQLTYPVTFVCAGNRRKEQNIVRKTKGFSWGAAGLSTALWTGVAIGDLLAAAKPKRGARYVCFEGADKLPNGYYGTSIKLNWCMDPNRGVMVAHRMNGKTLHPDHGKPVRLVIPGQIGGRSVKWLKKITVTQEPSDNWYHIYDNRVLPTMVSPEESADLPEVWKDEKYAIYDLSTNSAICYPAHQESVTLTNTSESYKVRGYAYGGGGRRITRVEITLDKGKSWRLANIRYHEDDYRNAPEGDTLYGGRVDMWWRETSFCWCLWDLEIPLDELRNADDIMMRAMDESMNIQPRDMYWSVLGMMNNPWFRIVIHKDDNALRFEHPTHPTLKNKGWMERVKEDGGNLTNGYWGEKAPGEVKEVVVKELEKQICLTNPHINREITIEELKAHEGEDEPWFVVNGEVYDGTPYLSGHPGGAASIFGAAGQDATEEFMAIHSENAKAMLPTYHIGTLNKESRAILSGDATATSDDSNREIFLQSKTWSKALLCKKMSISPDTKIFSFKLNHEGQKIGLPTGQHLMMRLRDPATREAIIRSYTPYSDGSDCGQLDILIKIYYDTPQRKGGAMTQALDSLPVGHWVDFKGPVGKFVYHGNGRCIISDRERRVRRFIMVCGGSGITPIRQVLRAVMQDPSDTTPCIVFNGNRSFQDILCKEELDNLEAANPSKCRIINALTDPPPDWSGIKGFVNQALVPEQMALPKPSGEGDELVLVCGPPPMVKAAEATFLGLGFKSDDMVFF

SEQ ID NO: 22962 - protein, 219 aa, Vitis vinifera
MADEIILLDFWPSMFGMRVRLALAEKGLKYEYREEDLWNKSPLLLEMNPVHKKIPALIHNGKPICESLIIVQYIDEVWCDKSPLLPSDPYQRAQARFWADYIDKKLYELGRKIWSTKGEEQETAKKEFIECLKLLEGELGEKPYFGGEKIGFVDVALVTFSCWFYAYETFGNFSIEAECPKLIAWTKRCMEKESVSSSLEDPHKVHGFIMGMRKRFGIE

SEQ ID NO: 22963 - protein, 393 aa, Clostridium perfringens
MEGRLVSKKEIVAMILAGGQGSRLGVLTKNLAKPAVPFGGKYRIIDFPLSNCSNSGIYTVGVLTQYKPLKLNEHIGIGDTWDLDRRDGGVSILPPYQKEKGGDWYKGTANAIYQNIEFIERYDPEYVLILSGDHIYKMDYDKMLEMHKQKEADATIAVINVPMHEASRFGIMNTNEDLSIYEFEEKPEHPKSTNASMGIYIFNWKILKKFLEEDELDQSSSNDFGKNIIPKMLNSGKKLIAYPFNGYWKDVGTIESLWEANMDLLKYEDELSLYDSEWKIYSANPVRPAQFIGKDAEIKSSLTVEGCIVHGKVENSVLFQGVYVGKGAIVKDAVIMPNTKIEDNVLIEKAIIGSEAIVCKGCKIGDGNKISVIASKEVVIGSKEVIEECAMVK

SEQ ID NO: 22964 - protein, 132 aa, Unknown
  Synechococcus sp. WH 8102
MRMLHTMLRVGDLDRSIAFYTDVLGMKLLRRKEYPSGRFTLAFLGYGPESEQTVLELTHNWDTSSYELGDAYGHIALGVEDIRSTCAAISGKGGRVVREPGPMKHGSTVIAFVEDPDGYKVELIEMSSRAAA

SEQ ID NO: 22965 - protein, 416 aa, Unknown
  Azoarcus sp. BH72
MFSSQDTLAKVDPELWSAIQAENRRQEDHIELIASENYVSHAVMEAQGSQLTNKYAEGYPGKRYYGGCEHVDVVEQLAIDRLKKLFGADAANVQPNSGSQANQAVLMAFAKPGDTIMGMSLAEGGHLTHGMPLNMSGKWFNVVAYGLDEKEEINYAAMEALAREHKPKIIIAGASAYALRIDFERFARIAREVGAIFWVDMAHYAGLIAAGYYPNPVPHADVVTSTTHKTLRGPRGGIILMKAEHEKAINSAIFPGLQGGPLEHVIAAKAVAFKEAATPAFRDYQEQVIANARVMARVLGEERGLRIVSGRTESHVFLVDLRSKNITGKEAEAVLGSAHITVNKNSIPNDPQKPFVTSGIRIGSPAMTTRGFTEIEAEQIAHLIADVLDAPQDAAVLERVRGKVGELCAKFPVYGS

SEQ ID NO: 22966 - protein, 296 aa, Saccharomyces cerevisiae
MITTPLVHVASVEKGRSYEDFQKVYNAIALKLREDDEYDNYIGYGPVLVRLAWHISGTWDKHDNTGGSYGGTYRFKKEFNDPSNAGLQNGFKFLEPIHKEFPWISSGDLFSLGGVTAVQEMQGPKIPWRCGRVDTPEDTTPDNGRLPDADKDAGYVRTFFQRLNMNDREVVALMGAHALGKTHLKNSGYEGPFGAANNVFTNEFYLNLLNEDWKLEKNDANNEQWDSKSGYMMLPTDYSLIQDPKYLSIVKEYANDQDKFFKDFSKAFEKLLENGITFPKDAPSPFIFKTLEEQGL

SEQ ID NO: 22967 - protein, 289 aa, Medicago truncatula
MYLILQEMMEDPLLLHHQWHLSSINESNSLPIGSAFGDTSQHHSYVYPNFNPRTSMETAQTLETQFVSYPNLLSFVDLNQLNQLGLVKPKDEMIGSQNNNATSSDMISQGTFETKKVATRPKLSLPQDHIIAERKRREKLSQRFIALSALVPGLQKMDKVTVLGDAIKYLKKLQEKVKVLEEEQNMKKNVEFVVVVKKYQLSNDVENSSAESGDPFDEELPEIEARFCDRNVLIRVHCEKIKGVVEKTIHKIEKLNLKVTNSSFMTFGSCALDITIIAQVIFVSTKVLN

SEQ ID NO: 22968 - protein, 141 aa, Arabidopsis thaliana
  misc_feature (126)..(126): Xaa can be any naturally occurring amino acid
GAHARERRRETQEGAGLPLFLSSAAAVTSPAQATMGAPFTGLKASAALPVTRKTNKDITSIERNGGRVSCMKVWPPIGKKKGETLCYLPDLNDVQLAKEADYLVRNKWSACVECELKHRVVYRERXYTPRYYDGRDWTMWK

SEQ ID NO: 22969 - protein, 378 aa, Unknown
  Bradyrhizobium sp. BTAi1
MASPRLENFRRIVVKVGSSLLVDSEAGEVRASWLAALAADIARLHGRGCELLVVSSGSIALGRSRLKLPRGPLKLEESQAAAAVGQIALARIWSEVLGDHGIGAGQILVTLQDTEERRRYLNARSTIAKLLDWRAVPVINENDTVATAEIRYGDNDRLAARVATMASADLLVLLSDIDGLYTAPPAQDPNARLIPVVESITADIEAMAGSAASEFSRGGMRTKIEAAKIATTGGTHMLIASGKIEHPLAAIANGGRCTWFLTPANPVTARKRWIAGSLEPKGTLTIDAGAVTALRAGKSLLPAGVIRVDGQFARGDAVVVRGPDTHEIGRGLVAYDADDAERIKGRSSPDVAVILGISGRAEMIHRDDLVIGPAGAMG

SEQ ID NO: 22970 - protein, 651 aa, Unknown
  Magnetococcus sp. MC-1
MYEQVSHSLLNEIMLELDPEILKQNQMRYFYTRLGANFYAIHSIAKVLYGNRNDFNEQMKRLVETMARQYIARPAQYRESDLEREKDHTWFLHQQWVGMALYSDGFANDLQGLNTKLSYLQELGINMIHIMPLLDCPPNKSDGGYAIRDFRKIDSRAGTLEDITTLADSMHTRGMLLTLDVVLNHTSDEHEWARRAREGDSDYQNYFYVFKDRSMPDLFEESMVEIFPQTAPGNFTWSEEMGRWVMTSFNSYQWDLNYSNPSVLIEILDIILYWANLGADIMRLDAVAFLWKKIGSTCQNQREAHLILQLLKDCCQVTAPGVLFIAEAIVSPLEITKYFGEDAINAKECEIAYNATLMALLWDAIATKKAELLYRGIKSLPDKLERATWLNYIRCHDDIGLGFDDTDIRQAGYEPFAHRRFLVDYFTGGYTDSPARGRPFGQNDKTGDARISGTLASLAGLESALYEGNEEAVHTSIQMILLLHSVILSFGGIPLLYYGDELGTLNDYSYEQQESKREDSRWIHRPTIDWDKAELRNQPGSVEYRLFNALKKMIAVRKEIPAFADFNNREMLDLGNPHLLAYARFDFMHASAKVLVICNFDLKPQYVELEQLRQLGFLKSHNLRDASTGESPQRFNDQLAIPAYGFYWLME

SEQ ID NO: 22971 - protein, 412 aa, Mycoplasma penetrans
MKNLILKEILNNELKRQQGYIELIASENYVSEQILEATGSVFTNKYCEGYPNRRYYGGCEYADQIEQLAIDKAKEIFNAKFANVQPHSGTQANVAAYLSVLKPNDKILAMGLNEGGHLSHGSKVNISGKTYEADHYGVDKETQCLDYDAILKQAQEVKPKLIVCGASNYSRVVDFKKFGEIAKSVGAYLLADVAHISGLIVAGYHPNPLPYADIVTTTTHKTLRGPRSGLILTNNEELIKKINSAVFPGSQGGPLMHVIAAKYLCFDEASKPEFKTYIKNVIDNIAILSQTLKELGYKIIADGSDNHLLSVDLYSSKQITGDLVEQWLEQAKIVVNKNLIPYDINSAKSPSGIRIGSAAMTTRGFTTKEFKQIGLWIHEIIESKGNPNTINKIRNEVDLLVKKFPIYQDIKY

SEQ ID NO: 22972 - protein, 319 aa, Lactobacillus sakei
MKRIGILTSGGDAPGMNAAVRAVARKAMHEGLEVYGINYGYAGLVAGDIFKMDPITVGDKIQRGGTFLYSARYPEFAQVEGQLKGIEQLNKFGIEALVVIGGDGSYHGALRLTEHGYNAIGLPGTIDNDIPFTDQTIGFDTAVNTVLESIDRIRDTAASHERTFVVEVMGRGAGDIALWAGVAGGAQDIIIPERDFDVKAVAEKLRASREHGQKHAIIVLAEGVMHADEFSEKLSEYGDFHLRSTVLGHVVRGGSPTASDRVLASRLGSKAVELLLEGKGGVALGIEKNEIIAHDMLDLFNHKHHAMLDLYDLNEDLAY

SEQ ID NO: 22973 - protein, 325 aa, Thermus thermophilus
MEFNLSALGSTPAAEETYDVVIIGGGPAGLTAGIYAGRAQLKTVIVEKGLPGGQIAQTDEVENYPGFPEGISGPELASRMVRQAEKFGARIVMDEVLGLEKAEGGYLVRGYERNYRARAVIVATGANPRRLGVPGEDKFYGRGVSTCATCDGFFYRDKEVVVVGGGDAAVEEGIFLTKFARKVTLVHRRDELRANKVAQKRAFQNPKMHFLFSHVVTEILGEDQVTGVRLKNLKTGEEYVYPTDGVFVFIGHEPNTAFLKGVVELRPDGYIAVRDEVFTSEPGIFAAGDVADPIYRQLTTSVGAGTRAAMMAERYLAEEAEKVKG

SEQ ID NO: 22974 - protein, 376 aa, Escherichia coli
MAKQDYYEILGVSKTAEEREIRKAYKRLAMKYHPDRNQGDKEAEAKFKEIKEAYEVLTDSQKRAAYDQYGHAAFEQGGMGGGGFGGGADFSDIFGDVFGDIFGGGRGRQRAARGADLRYNMELTLEEAVRGVTKEIRIPTLEECDVCHGSGAKPGTQPQTCPTCHGSGQVQMRQGFFAVQQTCPHCQGRGTLIKDPCNKCHGHGRVERSKTLSVKIPAGVDTGDRIRLAGEGEAGEHGAPAGDLYVQVQVKQHPIFEREGNNLYCEVPINFAMAALGGEIEVPTLDGRVKLKVPGETQTGKLFRMRGKGVKSVRGGAQGDLLCRVVVETPVGLNERQKQLLQELQESFGGPTGEHNSPRSKSFFDGVKKFFDDLTR

SEQ ID NO: 22975 - protein, 742 aa, Unknown
  Synechococcus sp. CC9311
MAEQTTSIRSQCPYCGVGCGLDLQPPAKKGEAVRRDADGTPMWTARGDRQHPSSLGQVCIKGATVGETLSRGRLDQPLGRTSLDDDFQPISWDEALERISSQIKTSLEYKGPDSIAMYGSGQFHTEDYYLAQKLLKGALGTNNFDANSRLCMSSAVAGYTRSLGSDGPPCSYEDLDHCTVAFLIGTNTAECHPVLFQRLLKRKKRHPGSVTIVVIDPRQTDTAKAADIHLAVAPGSDLALLHGIAHLVMRENGQDPTFIDNCTDNYDSFFDVVARWTPRRVALFCGIPEKRLREVAQLFHRREKVLSLWSMGVNQRREGTAVVGGIINLHLLTGQIGKEGAGPFSLTGQPNAMGGREAGGLSHLLPGYRQVTNPEHRAEVEQTWGFPKGKISPNPGLTAWQQVEAMERGELDLWWVAATNPLVSMPDLERVKTAMKRCPLVVVSEAYTDSETSHYAHLLLPAAQWSEKSGTMTNSERRVTYCPAFRNPNRESRADWEVFAEIGKRLGFEKQFTYDSAAEVYAEFTALTKKRLCDVSGLSHDVLAKEGPQQWPFPQDSSPSQETKRLYTNQKFSTANGRARFCTDQPLGLAEPPCDTYPLVLTIGRYLGQWHTMTRTAKVKRLTTMHPEPLLEIHPKDADQFAVQHGELAAISSRRGQLTARVLVTDKIRKGTVFLPMHWGFTQTHACEVNALMHDHACPISKQPELKASAVIVAPAVSVIKPIEQHGNRLDILRRMIIPALR

SEQ ID NO: 22976 - protein, 598 aa, Moorella thermoacetica
MTLGSGAMTNSIAEISTYSDVIFIIGSNTAECHPLVARHVLKAKERGAKLIVADPRLTEMANKADIWLRVPVGYNIPLINGMLHLIIKEGLVKKDFIQKHAEGLDELVRAVEQYTPAYVEELTGIPQRDLIEAARLYGRAQAAMILYCMGVTQFSHGTGNVVSLSNLAVVTGNLGRPGTGVCPLRGQNNVQGACDMGGLPDVLPGYLNVTREEWRRRFEKEWKVKLPSKPGIRIPEVPEAILEGKIRALYIFGENPIMSDPDSDHLRHALEHLDLLVVQDIFLTETARLADVVLPAASWAEKDGTFTNTERRVQRVRKAVDLPGEARPDWQIFGMLAQKMGYMGLNYSNSQEIWDEVRRLVPEKFGGISYARLESVRGITWPCPQEEHPGTPILYEGGKFLTPSGKARLYPVIFYAKASNGASKEKAKAGNQVIVGTIAELPDEEYPFILTNGRRVYHYHTGTMTRKSWLLDQIGPNELVEINPQDARKMGINDGDFVKVSTRRGYVAVRAWVTERVPEGTIFMTFHYWEACCNELTNTANDAICSTPEFKLAAARMDKISPEEARAIYLEKKAKYLVDLEKANVPKTVIGEGGRVDA

SEQ ID NO: 22977 - protein, 180 aa, Rhizobium gallicum
EFDAFPALEQLPLWGFDGSSTMQAEGRSSDCVLKPVAVYPDPARTNGALVMCEVMMPDGVTPHPSNSRATILDDEDAWFGFEQEYFFYEDGRPLGFPEQGYPAPQGPYYTGVGYKNVGSVAREIVEEHLDLCLAAGINHEGINAEVAKGQWEFQIFGKGSKRAADQIWMARYLLLRLCEK

SEQ ID NO: 22978 - protein, 416 aa, Oryza sativa
MAAGVDERWRMRRWWRPNTLVINIGDQLQLGDRLPVSHVAGRSPHTPQSSLHTRAAVVVVLSSSDVVVAVAVVNMAAEAEQQHQLLSTAVHDTMPGKYVRPESQRPRLDLVVSDARIPVVDLASPDRAAVVSAVGDACRTHGFFQVVNHGIDAALIASVMEVGREFFRLPAEEKAKLYSDDPAKKIRLSTSFNVRKETVHNWRDYLRLHCYPLHQFVPDWPSNPPSFKEIIGTYCTEVRELGFRLYEAISESLGLEGGYMRETLGEQEQHMAVNYYPQCPEPELTYGLPAHTDPNALTILLMDDQVAGLQVLNDGKWIAVNPQPGALVINIGDQLQALSNGKYRSVWHRAVVNSDRERMSVASFLCPCNSVELGPAKKLITDDSPAVYRNYTYDEYYKKFWSRNLDQEHCLELFRT

SEQ ID NO: 22979 - protein, 180 aa, Rhizobium gallicum
EFDAFPALEQLPLWGFDGSSTMQAEGRSSDCVLKPVAVYPDPARTNGALVMCEVMMPDGVTPHPSNSRATILDDEDAWFGFEQEYFFYENGRPLGFPEQGYPAPQGPYYTGVGYKNVGSVAREIVEEHLDLCLAAGINHEGINAEVAKGQWEFQIFGKGSKRAADQIWMARYLLLRLCEK

SEQ ID NO: 22980 - protein, 185 aa, Oryza sativa
MARTYESQKRRDWNTFLQYLRNHRPPLTLARCSGAHVIEFLRYLDQFGKTKVHASGCAFYGQPSPPGPCPCPLRQAWGSLDALIGRLRAAYEESGGTPESNPFAARAVRIYLREVRDSQAKARGIPYEKKKRKRSQAAQPAGVEPSGSSSAAAAAAGGGDAGSGGGAAATTTAQPGGSGTAPSAS

SEQ ID NO: 22981 - protein, 212 aa, Triticum aestivum
  misc_feature (51)..(51): Xaa can be any naturally occurring amino acid
  misc_feature (60)..(60): Xaa can be any naturally occurring amino acid
QVAMAARRSGAVVAALMAVLVGLAGADFAADRAECADKLMGLATCLTYVQXRATARSPTXDCCSGFRQVLGASKKCLCVLVKDRDEPTLGIKFNVTRAMNLPSACKIPATFSDCPKILNMSPDSKEAEIFKQYGIEHEGKNATAAGASTTARYLPAAKAPTRRPCRGGTRCAFADLSRARRPHPFVTHLYIDFQPLPSGNADLLSRIFFVLA

SEQ ID NO: 22982 - protein, 217 aa, Sorghum bicolor
ETVTEEVPLDPLLNLTGNVWHVFIHGDQLHDMLYGYRFDGVFAPERGQYYDVSNIVVDPYAKAVVSRGKYGVPGPGDNCWPQMAGMIPLPHSTFNWQGDLPLKYHQKDLVIYEMHLRGFTKHDSSNAKHPGTYIGAVSKLDHLKELGVNCIELMPCHEFNELEYFSSSSKMNFWGYSTINFFSPMARYSSSGIRDSGRGAINEFKTFVREAHKRGIE

SEQ ID NO: 22983 - protein, 404 aa, Burkholderia pseudomallei
MPRTVVVIGGGQAAGWVVKTLRDEGFAGRIVMIADEAHLPYERPALSKAVLAGEADIATVRVMQPDAFGALDVDAWQPERAASIDRARRVVRTASGREIEYDRLVIATGGTPRRLPDAIVGTAHLHYLRTLDEALALGEKLRASRRVLVIGGGWIGLEVAATARKLGVDALVVEGAPRLCARSVPGAVSDFLLDLHRANGVDVRLNASLASLDAHPDDARRVRATLAGGGVVDADFAVAGIGLALNTSLATEAGLHVDDGIVVDEYGATSDPAIFACGDVANHPNAWLKRRVRLESWANAQNQAIAAAKAVLGVRAPYAEIPWFWSDQYDVNLQILGDLPADARCIVRGELAAKRATLFFVADGALRGVIAINAARELKLARKWMNQGRAIDVAALADTAKALA

SEQ ID NO: 22984 - protein, 316 aa, Bacteroides fragilis
MAKIAKKLTELIGHTPLMELSGYSRKYGLQENIVAKLESFNPAGSVKDRVALSMIEDAEERGVLQPGATIIEPTSGNTGVGLAMVATIKGYRLILTMPETMSLERRNLLKALGAQIVLTNGQKGMAGSIAKAEELKKSIPGSVILQQFENPANTEVHARSTGEEIWQDTDGEVAVFVAGVGTGGTVCGVARALKKHNPNVYIVAVEPASSPVLEGGKAVSHRIQGIGANFVPGIYDASVVDEVMPVPDDEAIRGGRELASTEGLLVGISSGAAVYAARQLAGRPEFKGKMIVTLLPDTGERYLTTELFAFDAYPLD

SEQ ID NO: 22985 - protein, 475 aa, Zymomonas mobilis
MRTLFLQAPSFDGFDGGAGSRYQARREIKSFWYPTWLAQPAALIKDSKLIDAPPHGTKLPEVLAIAPDYDLAILHTSVPSFASDVKTVAALKKVNPAMKIGFIGAKVAVEADKSLKDAKGIVDFVARNEFDFTIKDVADGKDWSEILGLSYINDKGEIVHNADRPLLQNMDELPFVTPIYKRDLEIEKYFIGYLKHPYISIYTGRGCKSHCSFCLWPQTVGGHKYRTRSVEHVIEEIKYALKTFPQVKEFFFDDDTFTDDRPRAEAIARELGKLGVTWSCNAKANVPYETLKVLKDNGLRLLLVGYESGNQQILHNIKKGMRVETAEKFTRDCHDLGIAIHGTFILGLPGETRETIEQTIKWACEINPHTIQVSLAAPYPGTLLYKQAIENGWLDQSHAELVDEHGVQIAPLSYPHLSHEEIFRSVETFYKRFYFRPGKVFSIVNEMVRDFDMMKRRLREGVEFFQFLRERKEAC

SEQ ID NO: 22986 - protein, 505 aa, Triticum aestivum
MAAIMASITSELLFFLPFILLALLTFYTSAVAKCHGLHRWSGRTKKRRPNLPPGAVGWPFIGETFGYLRAHPATSMGQFMDQHIARYGKIYRSSLFGDRTVVSADAGLNRYILQNEGRLFECSYPRSIGGILGKWSMLVLVGDPHREMRFISLNFLSSVRLRAGLLPEVERQTLLVLRDWLPSSSSAVFSAQHEAKKFTFNLMAKNIMSMDPGEEETERLRLEYITFMKGVVSAPLNFPGTAYWKALKSRATILGVIERKMEERLEKMNKEASSMEEDDLLGWAMKQSNLSKEQILDLLLSLLFAGHETSSMALALAIFFLEGCPKAVEELREEHLEIARRQKLRGECKLSWEDYKEMVFTQCVINETLRLGNVVRFLHRKVIRDVHYNGYDIPSGWKILPVLAAVHLDSSLYEDPSSFNPWRWKGNASGVAQNSNFMPYGGGTRLCAGSELAKLEMAIFLHHLVLNFRWELAEPDQAFVYPFVDFPKGLPIRVHRIAQEEEGEE

SEQ ID NO: 22987 - protein, 910 aa, Zea mays
  misc_feature (522)..(522): Xaa can be any naturally occurring amino acid
  misc_feature (851)..(851): Xaa can be any naturally occurring amino acid
MAAVEPRQFGRLEPGSSPVRVATNGAKAYPPPASHLPRRADSPVRGCSFPPLVSPPRRLDDASDDEDEEQEDWRELYGSHLQLEVEPAVQDARDEGTADAWIERNPCLVRLTGKHPLNCEPPLARLMHHGFITPAPLHYVRNHGAVPRGDWATWTVEVTGLVRRPARLTMEELARDFPAVEIPVTLACAGNRRKEQNMVQQTVGFNWGAAGVSTSVWRGARLRDVLRRCGIVPRKGGALNVCFEGAEDLPGGGGSKYGTSVTREWALDPSRDIMLAYMQNGEPLLPDHGFPVRVIIPGCIGGRMVKWLKRIIVTPAESDNYYHFKDNRVLPSHVDAELANAEAWWYKPEYIINELNINSVITTPGHDEILPINSITTQRGYTMKGYAYSGGGKKVTRVEVTLDGGETWLVCHLDHPEKPNKYGKYWCWCFWSVEVEVLDLLGAKEIAVRAWDQSLNTQPEKLIWNLMGMMNNCWFKVKVNVCRPHKGEIGLVFEHPTQPGNQPGGWMARQKHLETAEAAAPXCKRSTSTPFMNTTDVGKQFTMSEVRKHASQESAWIAVHGHVYDCTKFLKDHPGGADSILINAGTDCTEEFDAIHSDKAKALLDTYRIGELITTGTGYSSDNSVHGGSVLSHLAPIREAVRAPALSNPRDKIHCRLVGKKELSRDVRLFRFSLPSPDQVLGLPIGKHIFVCASIEGKLCMRAYTPTSMVDEIGHFDLLVKVYFKNEHPKFPNGGLMTQYLDSLPVGSYIDVKGPLGHVEYTGRGSFVINGKQRHASRLAMICGGSGITPMYQIIQAVLRDQPEDHTEMHLVYANRTEDDILLRDELDRWAAEYPDRLKVWYVIDQVKRPXEGWKYSVGFVTEAVLREHVPEGGDDTLALACGPPPMIQFAISPNLEKMKYDMANSFVVF

SEQ ID NO: 22988 - protein, 558 aa, Picrophilus torridus
MLDNNGLWYRDAVFYEVPVKSFYDSNNDGIGDFNGLTMKLDYLKKLGVDALWLLPFYKSPLKDDGYDISDYYSILPEYGTIDDFKNFIDTAHSMNIRVIADLVLNHVSDQHPWFIESRSSIDNPKRDWFIWSDTPEKFKEARIIFIDTEKSNWTYDPETKQYYFHRFYSSQPDLNYDNPDVRNEVKKVIRYWLDLGLDGFRADAVPYLFKRENTNCENLPETHNFFKEIRKMMDEDYPGTILLAEANQWPTETKAYFGNGDEFHMAFNFPLMPRIFIALARSDYYPIMDIIKQTLPIPDNCDWCIFLRNHDELTLEMVTDSERDIMYREYAKIPKMRLNLGIRRRLAPLADNDINTIELLNALIFSLPGTPIIYYGDEIGMGDNIYLGDRNGVRTPMQWSYDRNAGFSMADSEQLYSPVITNPNYHYESVNVEAELRLSSSLLNWMIKIIHVRKDYKELLGRGSIKFIEQGNKRVLSYIREYENQRMLCLFNLSRNPTYVELNLSDYIGLKPIEAITKAAFPRIKDDRYFITMTPRSFFWFNLIVPERDDSYDLIGED

SEQ ID NO: 22989 - protein, 362 aa, Triticum aestivum
MEEIGHHFGLGATAHGQHHSQLPWGSSPLSAVIAPPPQQQQQQQSAGYLAHSPLSLNTAPPSGSHGGGTGCSNPVLQLANGSLLEACAKAAKEPSSSSYAADVEAIKAKIISHPHYSSLLAAYLDCQKVGAPPEVLARLTAVAQDLELRQRTALGSFGTATEPELDQFMEAYHEMLVKYREELTRPLQEAMEFLRRVETQLNSLSISGRSLRNILSSGSSEEDQEGSGGETELPEIDAHGVDQELKHHLLKKYSGYLSSLKQELSKKKKKGKLPKDARQQLLSWWEMHYKWPYPSESQKVALAESTGLDLKQINNWFINQRKRHWKPSDEMQFVMMDAYHPPNAAFYMDGHFVNDSGLYRFG

SEQ ID NO: 22990 - protein, 96 aa, Glycine max
  misc_feature (33)..(33): Xaa can be any naturally occurring amino acid
  misc_feature (39)..(39): Xaa can be any naturally occurring amino acid
  misc_feature (81)..(81): Xaa can be any naturally occurring amino acid
QRARIIEIDAARDIDIALAQNRVWARFSRETNXMIMVLXVSPEEAIWSLLYMHNNDQLITVMVSASDNYSLVQCRISWIEXTRRVKPMAGFAILES

SEQ ID NO: 22991 - protein, 140 aa, Ralstonia metallidurans
MRSKPRIALIAHDRKKDDIVAFAGRHRDFLAQCDLLATGTTGGRIAAETGLPVARMLSGPWGGDLQIGAQLAEGRVTAVVFLRDPMTPQPHEPDINALVRACDVHNVPCATNLATAELVVVELARICFEEDQAAADDAAP

SEQ ID NO: 22992 - protein, 284 aa, Picea glauca
MEHMNTTAQSSSSLYGVHMVEYGGDVGVGSMMALMTEHQPESESIMTSIPIPSSYSSYSHGHGHGHGHGHGHGQSECLLSAAAMFQTSRPCQGANKFEPANAHIGRGGAGHFVMEQFIPEQAVISDSSISSVKTEVCSGSGGTGVPGQFELIRRKEEGRCARAYAEPSFVVTPLVTSLPPQQQEARMVTSLAVDMDSSCSCKPIEADAMKAKIIAHVHYPRLVAAYIDCQKVGAPPDVVSELDELSQKCHAQQCVATISIGADPELDQFMEAYCEMFIKYQEEL

SEQ ID NO: 22993 - protein, 427 aa, Rhizobium leguminosarum
MLDTVAPGPDIDVLMNDIGRKAKAAARPLGFASTEAKNSALNAMADAILANKAHILAENAKDLKDIEGTEMLASFVDRLTLNDKRVAEMAEGIRAIAALADPVGEVIAAWDRPNGLKIERVRTPLGVIGVIFESRPNVTADAGALCLKAGNAVILRCGSDSRRSSQAIHACLVKGLKAAGLPEHAIQLVPVTDRAAVGAMLRGLDGAIDVIVPRGGKSLVARVQSEARVPVFAHLEGLCHIYVDASADIEMAKKIIVNAKMRRTGICGAVETLLVDGAAIGTHLTPLLEALTDAGCEIRASPTVLKVAPGMKPATEEDWSTEYLDAIISVAVVDGISGAIAHIQTYSSNHTEAVIAEDPDVVARFFTEVDSAILLHNASTQFADGGEFGMGAEIGIATGKMHARGPVGVEQLTSFKYRVHGAGQTRP

SEQ ID NO: 22994 - protein, 384 aa, Unknown
  Synechocystis sp. PCC 6803
MGTKRIGILTSGGDCPGLNAVIRAVVKASALKGWEVYGIPYGTDGFVEVAHGKYQAEDLLLTKHGYALPGMLKGLDVLQFLSGSVLGSLSKGHPEQPAIAEAILKGYAILDLEALIVIGGDGSLDIIYDLAQKGNWHIIAIPKTIDNDVPFTDLAVGFSTAVDIVTQALYDLTFTAASHERIIIVQVMGRDAGHLTLHAGIAGGADIILIPEITPCLTSEIIRNCCYQLMNLRKSGRHFALIVISEGVHDQNNKKNKHIADYLAEEISETSQHLCDIKDPAFCDLISLDIRATTLGHLQRSGTPLSFDRLLATVFGIRAVELIEQEIYDQVVIWRSGKVEHADLKPIISIIKECHQENRCPFPVDRDGFMVKTAKSLGIYLGED

SEQ ID NO: 22995 - protein, 1016 aa, Aspergillus nidulans
MPPATKLDIFNEPDWTKTHSHRVGLRSRDDRFPGLTHSGDDWRFVLEEEAEEKIAELKRKVERGELLTVRDFLAKQQDFHLQRPEVHPQNWRYVLHTSENHIKEEQPWFINEKKKERREEEEKDKEREGENAERRDSKLDGQDMGRKSDEDQGSKEEQEEQKGLSPEEKELLELLRNEEAHMRSLKQNTGQGHSPAKSDFLPAEIDEIDQMTPDNWIPRTDHLIRITGKHPLNAEPVVTELFDAGLITPNWLHYVRSHGSVPHLLWENHRLEISVGENMTLLMDDLKDQFESINIPVFVACDGNRRKELNMIKRSKGFNWGPGAVGCAYWRGVRLRDVLKRAGIKALMNEYSESRLWVNFQGAETLSEGKYETCLPLEYVMDKTHDVLLAYEMNDSPLPPDHGYPLRLVVPGYVGGRWVKWLEKIWVTDKENDSHYHIWDNRVVPEFVTDKESELAETVYRNPSTACMEQVLNSILVRPGPKEKIDLVNVKKGKKYRIQGFAYNGGGNEIQRVEISLDEGVSWLYCARRVRYLLAQGRGIADRSSTPNIRCDMGRNSGHGYTGIEIIRVRCWDVNKNAQPEHPTWNLEGMMNNCHYTVKSDIVEDEESGRISIIFRHPCEPATGEGGWMKPSAQIQAEEIQRQASTPGKQFTREEIEKHSTEDDCWIVINGNVYDATGVMSWHPGGKAPIMAHAGRVHQDTTNEFESIHDDFANSKLKECILGTVTKKAKDFMQQEVKVKAKERASSSKQEGQIALKRHKWTQARFVRKTPLSGDTNRYTFELLERTKKLGLQTGQHIQIGFHFKDQLVFRSYTPVKPIMEEEEDGTFDLIVKTYYPDPGQPGGTMSNILDCLAEGEEVEIKGPAGEIVYKGNGTFKIDHKERTFERITLVLGGSGVTPGYQVIAKILLSDGRDKTKIRVIDGNRTENDILLRKELQDFAKEHPEQFQIVHVLSHAGDDWKGERGHVSAEILHKFGFEPDEKSVALLCGPPAMIQKAVLPALVDWGYDQDSNLFGF

SEQ ID NO: 22996 - protein, 599 aa, Ashbya gossypii
MPSAGELEQQPLRGSPSSNVQYISIPIERQSSVTAEAGGHAAAGTPGAHRGSFLDQPLGSFRGVNSLGRFASSFHRSNSFKAIELNAGKERAFLKDGYDELYDPDTLGPSLDGRRLSIAINAPGTVSVRPPASDFYGSVGGGGWRDSTAVVDEDEQSTRLMRVLSNQSLTFVDVNNAAGPDADSIMLKRVETKTGKVVTVLAGQSTAPQTIFNSVNVLIGIGLLALPLGLRYAGWALGIPMLLVFAAGTFCSAELLSRCIDADPSMISYGDLGYAAFGSKGRALISVLFTLDLLGCGVSLIILFGDSLNALFPQYSVTQFKILSFFAVTPQVFLPLSVLSNFSLLGITATLGTVLTILYCGLTKTQSPGSLLDPAPTRVWPASFLEFCLSIGILSACWGGHAVFPNLKSDMRHPSKFKDCLRTTYAITSLTDIGTATVGFLMFGVAVKDEVTRSVMLSDGYPPFVYVLISALMAIIPLAKTPLNARPIISILDVMMGIRNAETELEGHKLFVARALKLTNRLLINVMFVIIAILFPEFDKLIAFLGAGLCFMICLILPCLFYLRICKDRVTPRERMACYATIAVSAVLSVLGVGAAILS

SEQ ID NO: 22997 - protein, 608 aa, Candida glabrata
MAAHDHQQGLQKTRTTTTTATTMIPMITASVAGGEVSLVVGGSRAGLVKSRVKTIVGAGGVAVVLNVGSQWKQLVAEFGDESGVHLLDRDFQLRDLTTLGRAVTAKVVDRVFVNLPLEEDHKVKYIYEQCVRLRIPINTFHRPEYSTFNMIPTYVDPKGSGLQIAVTTNGNGYLLANRIKREIVSHLPANISEVVTNMGALKDRIINEDMKVLLKERYLATDLASPAVGYGLDEDGWESHKFNRLIHEFDMTEREQREKRVRWLSQVMEYYPLTKLADVTMETLEGHSHTARTQQSSKQQSSTDSLQQAQDSNSTTDSNVGNHVDKKPKISPDPKASETKKGSISLVGSGPGSLSMLTLGALNEIKTADVILTDKLVPQTVLDIIPKDTETFTARKFPGNAERAQEELLEKGLEYLSQGKKVVRLKQGDPYIFGRGGEEYNFFNAHGYEPSVLPGLSSALAATVVSKIPATQRAVADQVLICTGTGRKGALPEVPEYVKTRTTVFLMALHRVDVLVKVLLEKEWDPEVLVAVVERASCPDQRITRTKLKYLPAVVEEIGSRPPGLLVIGQAAGVLLPESSVSFNDSNKYHIDEGYRAFELDVNQLIPA

SEQ ID NO: 22998 - protein, 284 aa, Picea glauca
MEHMNTTAQSSSSLYGVHMVEYGGDVGVGSMMALMTEHQPESESIMTSIPIPSSYSSYSHGHGHGHGHGHGHGQSECLLSAAAMFQTSRPCQGANKFEPANSHIGGGGAGHFVMEQFIPEQAVISDSSISSVKTEVCSGSGGTGVPGQFELIRRKEEGRCARAYAEPSFVVTPLVTSLPPQQQEARMVTSLAVDMDSSCSCKPIEADAMKAKIIAHVHYPRLVAAYIDCQKVGAPPDVVSELDELSQKCHAQQCVATISIGADPELDQFMEAYCEMFIKYQEEL

SEQ ID NO: 22999 - protein, 169 aa, Bacillus anthracis
MIVKRGAKTMTVYDFSAKTITGEEKSLKDYEGKVLLIVNVASKCGFTPQYKGLQEVYDKYKEQGLEILGFPCNQFGGQEPGTEADITSFCELNYGVNFPMFAKIDVKGDKAHPLYTYMTEQAPGLLGMKAVKWNFTKFLIGKDGKVVGRFAPQTKPVDLEVEIEKVLGE

SEQ ID NO: 23000 - protein, 367 aa, Serratia marcescens
MNGSQTLVVKLGTSVLTGGSLRLNRAHIVELVRQCAQQHAAGHRIVIVTSGAIAAGREHLGYPELPATIASKQLLAAVGQSRLIQLWEQLFSIYGIHVGQMLLTRADLEDRERFLNVRDTMTALLDNRIVPVINENDAVATAEIKVGDNDNLSALAAILAGADKLLLLTDQQGLYTADPRNNPQAELIREVHGIDDALRAIAGDSVSGLGTGGMGTKLQAADVACRAGIDVVIAAGSKPGVVADVIEGKPVGTRFHALETPLENRKRWIFGAPPAGEITVDDGAVEAMMARGSSLLPKGIREVKGDFSRGEVIRIRNLTGRDLAHGVSRYNSDAMRMIAGHHSQEISEILGYEYGPVAVHRDDMIVS

SEQ ID NO: 23001 - protein, 293 aa, Saccharomyces cerevisiae
TPLVHVASVEKGRSYEDFQKVYNAIALKLREDDEYDNYIGYGPVLVRLAFHISGTWDKHDNTGGSYGGTYRFKKEFNDPSNAGLQNGFKFLEPIHKEFPWISSGDLFSLGGVTAVQEMQGPKIPWRCGRVDTPEDTTPDNGRLPDADKDAGYVRTFFQRLNMNDREVVALMGAHALGKTHLKNSGYEGPWGAANNVFTNEFYLNLLNEDWKLEKNDANNEQWDSKSGYMMLPTDYSLIQDPKYLSIVKEYANDQDKFFKDFSKAFEKLLENGITFPKDAPSPFIFKTLEEQGL

SEQ ID NO: 23002 - protein, 388 aa, Escherichia coli; identical to SEQ ID NO: 374

SEQ ID NO: 23003 - protein, 275 aa, Pyrococcus furiosus
MPRRAREYPEEGELVVATVKRVHNYGAFLDLDEYPGKEGFMHISEVASTWVKNIRDYLREGQKVVAKVIRVDPKKGHIDLSLRRVTQQQRKAKLQEFKRAQKAENLLKLAAEKLGKDFEEAWREVWVPLENEWGEVYAAFEDAARNGIEVLKGYVPDEWLPVLKEIIDSYVEVPTVTIDAEFEITVPKPNGIEIIKEALIKARDRANQEKDIEVKFTYLGAPRYRIDITAPDYYKAEEVLEDIAEEILRVIKEAGGEATLLRKEKRIRKVKKRKK

SEQ ID NO: 23004 - protein, 647 aa, Zea mays
MHWHSPNNLHLSSPEFPFLPRTIIKEKKTFSTLPSGPADMNERSSGTHQSLSHSRRADPLSLVRDYRVKEQLAAEGIDVQSFNADLLYEPWEVLDEDRRPFTMFAPFWNRCLCMPDPAAPLLPPKRINSGDLSRCPWDELVFEDESERGSNALLARAWSPGWQNADKALTAFLNGPLMDYSVNRKKADSASTSLLSPYLHFGELSVRKVFHQVRMKQLMWSNDGNHAGEESCTLFLRSIGLREYSRYLTFNHPCSHEKPLLSHLRFFPWVVNEVYFKVWRQGRTGYPLVDAGMRELWATGWVHDRIRVVVSSFFVKVLQLPWRWGMKYFWDTLLDADLESDALGWQYISGSLPDGRELDRIDNPQFEGYKFDPHGEYVRRWLPELARLPTEWIHHPWDAPESVLQAAGVELGSNYPRPIVELDAANSRLQGALSEMWELEAASCAAIENGMEEGLGDSTDEPPIDFPQELRMEVDRQPAQPAIIHTPVVAGWRREDQRVPSMTSSLIRAETELTADFGNTSEDSRPEVPSNIHLQARAEREETVDGATGNTVRVNGNQQQQNLQNNMHRVLGIAPSISEASSSWTGREGGLVPVWSPPAASVHSDPYTADEADISSRSYLDRHQQSNTMMNWSQLSQSLTTGWEVDN

SEQ ID NO: 23005 - protein, 413 aa, Thermus thermophilus
MTATSLWELAERARKRLSEIAKGNRDRALLAMADLLEARWEEVLRANREDLEEAERTGLPKAKLDRLALKEKDLKTLTEGLRQIARLPDPLGRIEGLAKRPNGLRVGRMRVPLGLIGFIYEARPGATVEAVSVALKAGNAMLLRGGKEAFRSNRALVALWHEALEEAGLPEEAVTLVPTTDREAVLEMCRLELLDLLIPRGGEELIRLVQQEARVPVLAHAKGVNHLYVDEKADLSMALRLALNGKTQRPAVCNALEAVLVHEKVAEAFLPRLEKAMREKGVELRACPRALPLLKEAVPAREDEWDREYLDLVLRVKVVSGLEEALAHIARYGSRHTEAICTEDPKAAWRFLEEVDASLVLWNASTRFNDGFELGLGAEIGISTSKLHAYGPMGPLELTTLKWVALGEGQERT

SEQ ID NO: 23006 - protein, 528 aa, Arabidopsis thaliana
SSSTCNATVFSISSSPSSSSSLKLNPSSFLFQNPKTLRNQSPLRCGRSFKMESQKPIFDLEKLDDEFVQKLVYDALVWSSLHGLVVGDKSYQKSGNVPGVGLMHAPIALLPTAFPEAYWKQACNVTPLFNELIDRVSLDGKFLQDSLSRTKKVDVFTSRLLDIHSKMLERNKKEDIRLGLHRFDYMLDEETNSLLQIEMNTISCSFPGLSRLVSQLHQSLLRSYGDQIGIDSERVPINTSTIQFADALAKAWLEYSNPRAVVMVIVQPEERNMYDQHLLSSILREKHNIVVIRKTLAEVEKEGSVQEDETLIVGGQAVAVVYFRSGYTPNDHPSESEWNARLLIEESSAVKCPSIAYHLTGSKKIQQELAKPGVLERFLDNKEDIAKLRKCFAGLWSLDDSEIVKQAIEKPGLFVMKPQREGGGNNIYGDDVRENLLRLQKEGEEGNAAYILMQRIFPKVSNMFLVREGVYHKHQAISELGVYGAYLRSKDEVIVNEQSGYLMRTKIASSDEGGVAAGFGVLDSIYLI

SEQ ID NO: 23007 - protein, 216 aa, Xylella fastidiosa
MVMTIEALKHLGRVDQSRVGRTEPLPLDNRHYVNGHPLCDAFPGLALIQFGLGCFWGAERLFWQLPGVFSTAAGYAGGGVPYPTYREVCSGETGHAEVVLVVYDHTVISFEQLLQTFWESHDPTQGMRQGNDIGTQYRSVIHCTTSEQYAAASASREVYQQQLNTAGYTAITTEILHPAPPFYYAENEHQQYLAKHPNGYCGLGGTGVTCAIRLQV

SEQ ID NO: 23008 - protein, 153 aa, Oryza sativa
  misc_feature (17)..(17): Xaa can be any naturally occurring amino acid
  misc_feature (29)..(29): Xaa can be any naturally occurring amino acid
  misc_feature (42)..(42): Xaa can be any naturally occurring amino acid
  misc_feature (58)..(58): Xaa can be any naturally occurring amino acid
  misc_feature (69)..(69): Xaa can be any naturally occurring amino acid
  misc_feature (77)..(77): Xaa can be any naturally occurring amino acid
  misc_feature (80)..(80): Xaa can be any naturally occurring amino acid
  misc_feature (89)..(89): Xaa can be any naturally occurring amino acid
  misc_feature (92)..(92): Xaa can be any naturally occurring amino acid
  misc_feature (96)..(96): Xaa can be any naturally occurring amino acid
  misc_feature (98)..(98): Xaa can be any naturally occurring amino acid
  misc_feature (100)..(100): Xaa can be any naturally occurring amino acid
  misc_feature (102)..(102): Xaa can be any naturally occurring amino acid
  misc_feature (106)..(106): Xaa can be any naturally occurring amino acid
  misc_feature (113)..(113): Xaa can be any naturally occurring amino acid
  misc_feature (119)..(119): Xaa can be any naturally occurring amino acid
  misc_feature (124)..(124): Xaa can be any naturally occurring amino acid
  misc_feature (130)..(130): Xaa can be any naturally occurring amino acid
  misc_feature (132)..(133): Xaa can be any naturally occurring amino acid
  misc_feature (143)..(143): Xaa can be any naturally occurring amino acid
  misc_feature (150)..(150): Xaa can be any naturally occurring amino acid
  misc_feature (152)..(152): Xaa can be any naturally occurring amino acid
IRHEEPPSVGHQRVSTXNSFAGVRLPAAXRNPTVSVAPRTGXAICNSISSSSSTPPYXLNAIRFSPIKXSIVSREMXRRXMTDMITYAXTDXLLLXAXSXGXSCAXELSKEPXVSVAVXQQSVXPAGGRXSXXLFSPMVVRKXGHLFLQXLXV

SEQ ID NO: 23009 - protein, 730 aa, Coccidioides immitis
MDDAGTETPTNPPQLPPPQPSPELGALPRTPLNEHGLSLDRDLEAEIKNGGTHNQGQLPGDSEEPRVQEGPGQEHAGLKDGQAWDQIMVDAVPTTDAIATAAIVTEQAQTEPAHAAIVVDPEISTPEAQNHGSSIGQSSIQRQPRQSQTSVAPDSNSVLAVTAPQYTFLESRQAATPQHLGQPPPIPPPSPNYGLPAHPEFIQPRSNHGHPMSLPPCPPSGAPPIQQQQQPTLQNIICHFPSPIQSSPAAPGLSNDGASHFKNMKLIPEPPDLQRWRERLFNVEGTIVLSEEEFQTYFPHVDNVYSHRSTQRYKRKPFISHYWDCRLKGRPPGTPKSADPNKKKRKRIARERNLCDVKIKITEYFPGAMTMAPDLDMGISALAGAVDSLPATSGVNAPTASQPFGVLAPSTMLPEGHPGATGARYYTIQRVNGNGANGRSVTAGGSHRHTLEESDRIKKNSVQRFLIKDEKEKKKAILKTYHKKASGYAWLTVNKHKRESDLKLYASCFCPFVQRVWIALEVKGIPYQYIEVDPYRKPDSLLEVNPRGLVPAIRHGNWACHESTVLLEYLDDLDAGNPLLPPGKPQLRAHCRLWADHVNRHIIPCFYRLLQEQDFQKQIEYTEELKDDISKLVNASHVTGPFFLGPDISFVDIQFAPWMLRLSRVLKPYRGWPDPEKGSRWAAWVDAIEANDQIMATTSSDELYLDSYQRYAGTYFKFPLHQGGGPRSDV

SEQ ID NO: 23010 - protein, 678 aa, Coprinopsis cinerea
MTGFSSLPLASEEGDAGQNARKFTGVAHIVGPRWAHLPTLTVGLLGVQVFWSVEMSYASPYLLSLGLSKSSMAIVFLAGPLSGLIMQPLIGVLADNSTSRFGRRRPYMMLGTVLCMAGMLLLGFTRPVASIFTTLGSSANDTLTIWLAVLAIYFIDFAINAESAVQAMDRALLVDTLPTSKQAPGNAWAAKMLGVGAVVGFFVGKLELTKAFPYLGRTQLEVLSVIVSFFLFTTHSITALFVKERVLLKSTQVEGKTKKQNAFIREVKDIWSNVLTLPWVIRQICFIQFCAWIAWFPVLFYSSIYVGDFHKHASPVPTTAEGRAALDADATRMGSRALFYSSLIALVCNFALPLFILKSNPRNGLPEAQGRYSRFAIPAVLKFHLASLWAFSHLIFALCMFATFFTHSLAGATALIAITGFSWAVTQWAPFALLAEAILTEPGPATADDGGSIQLEDARTRNHDERTAFLVGNDSDGEDDDDVRKAEENRRMLLGNPSAHVSTLDVDRSGSRSTDNEYEIVNGSDAYDSPRTSTRHDREDDGLDTSDANPSGGLSAKAGIILGIHNVFIVIPQFLVTGLSSIIFALFDEKPAVPPHSGAAPAPVLNGTDVLNAVKNVSSALADTVRGRDNLYHLLPRAEDAVPTAKANSVVYVFRLGGVAATFAFVLCWRLAREMRHR

SEQ ID NO: 23011 - protein, 271 aa, Zea luxurians
  misc_feature (187)..(187): Xaa can be any naturally occurring amino acid
HIMRLTGITGIVNDMDVSEWDPSRDKYIAVKYDVSTAVEAKALNKEALQAEVGLPVDRNIPLVAFIGRLEEQKGPDVMAAAIPQLMEMVEDVQIVLLGTGKKKFERMLMSAEEKFPGKVRAVVKFNAALAHHIMAGADVLAVTSRFEPCGLIQLQGMRYGTPCACASTGGLVDTIIEGKTGFHMGRXSVDCNVVEPADVKKVATTLQRAIKVVGTPAYEEMVRNCMIQDLSWKGPAKNWENVLLSLGVAGGEPGVEGEEIAPLAKENVAAP

SEQ ID NO: 23012 - protein, 737 aa, Yersinia pestis
MSLVARMQCEGISNRWIRSSIRSGTAKHKGTILLTPIIRKFQYGQHTVTIETGMMARQATAAVMVSMDDTAVFVTVVGQKKAKPGQSFFPLTVNYQERTYAAGRIPGSFFRREGRPSEGETLTSRLIDRPIRPLFPDSFLNEVQVIATVVSVNPQINPDIVALIGASAALSLSGIPFNGPIGAARVGFINDQYVLNPTTDELKESRLDLVVAGTAGAVLMVESEADILSEEQMLGAVVFGHEQQQVVIENINALVAEAGKPKWDWQAEPVNEALHARVAELAEARLGDAYRITEKQERYTQVDAIKADVTEALLAQDDTLDAAEIQDILASVEKNVVRSRVLRGEPRIDGREKDMIRGLDVRTGILPRTHGSALFTRGETQALVTATLGTARDAQNIDELMGERTDSFLLHYNFPPYCVGETGMVGSPKRREIGHGRLAKRGVLAVMPSASEFPYTIRVVSEITESNGSSSMASVCGASLALMDAGVPIKAAVAGIAMGLVKEGDNFVVLSDILGDEDHLGDMDFKVAGSRDGVTALQMDIKIEGITREIMQVALNQAKGARLHILGVMEQAISTPRGDISEFAPRIYTMKINPEKIKDVIGKGGSVIRALTDETGTTIEIEDDGTIKIAATDGDKAKHAIRRIEEITAEIEVGRIYAGKVTRIVDFGAFVAIGGGKEGLVHISQIADKRVEKVTDYLQMGQDVPVKVMEVDRQGRIRLSIKEATTPDAEAPEAAAE

SEQ ID NO: 23013 - protein, 183 aa, Glycine max
  misc_feature (170)..(170): Xaa can be any naturally occurring amino acid
HRRFAARSPIQPIHNPAAPRPSPPHPQNPSSPPHPTPSPHRLRPPPPPAKMPPNLECRMYEPRFPEVDAAVMIQVKHIADMGAYVSLLEYNNIEGMILFSELSRRRIRSISSLIKVGRQEPSMVLRVDRDKGYIDLSKRRVSEEEAATCEDRYNKSKLVHSIMRHAADTXLGVDLEPLYQRIG

SEQ ID NO: 23014 - protein, 149 aa, Bacillus cereus
MGYIEDMRNLVGNHPLILIGSHAIIVNEKNEILLQLRTDFNRWGIIGGALEYNETLEDALKREVYEETGLIIKNPELFRTYSGPDFFQIYPNGDQVHGVLVVYICREFHGELVCDHTESKELRFFSLNELPSNLPPVIERIIKEFQHSN

SEQ ID NO: 23015 - protein, 487 aa, Prosthecochloris aestuarii
MKETLIFDLSRKGRQGHRIASLDIEPQPAINLIPEKFLRTEPADLPEVPESEVVRHFIRLSNLNHHVDKDMYPLGSCTMKYNPKINDQTADIAGFTSIHPLQPAETAQGTLQLMYELGEMLREIAGMAAITLQPAAGAHGELTGILMIRKYHDSRASKRTKLLVVDSAHGTNPASAALVGYDILSVKSNAEGRTDIEDLKAKLDENVAALMLTNPNTIGLFEKDIKEIEQLVHDNGSLLYMDGANMNALMGITRPGDMGFDIVHYNLHKTFSAPHGGGGPGSGPVGVCDKLKPYLPVPVIEKHDDGNTSRYTLTTDRPLSIGRMMNFYGNFSVMVRAYTYIRMLGAEGIRRVSENAIINANYLLSKLIDRYDLPYPKPVMHEFCLSGDRQKKQHNVRTLDIAKRLLDLGFHAPTIYFPLIVSEALMIEPTETETRETLDRFAEAMLQIADETENSPETVQNAPQFTPVKRLDEAQASRKLNICCPGC

SEQ ID NO: 23016 - protein, 138 aa, Oryza sativa
MAATALSSQVRLPMSLRVATAPAPARVVLPASNKLGDRLRMQATYNVKLITPDGEVELQVPDDVYILDQAEEEGIDLPYSCRAGSCSSCAGKVVSGEIDQSDQSFLDDDQVAAGWVLTCHAYPKSDVVIETHKEDDLI

SEQ ID NO: 23017 - protein, 485 aa, Propionibacterium freudenreichii
MTQTAPSSQTKANIGVVGMAVMGSNLARNLAHHDYTVAVFNRTYARTQKLIAEHGNEGSFIPSEKIEDFVNSIATPRSIILMVKAGAPTDATIDELLPLLSPGDIIMDGGNSYFGDTIRREKAIAAKGFHFVGAGISGGETGALEGPSIMPGGSPESYKILGPMLETISAHYHGDPCCAWMGPNGAGHFVKMIHNGIEYSDMQVIGEAYELLRGVGLTNAECADVFAEWNKGDLDSYLIEITSIVLRQKDPRTGADLIDVIKDRAQMKGTGTWTVQTALELGVPTNGIAEAVFARAESSHDDLRAAARKYLAGPDGTVSVDDRTAFIEDVRKALWCSKVVSYAQGFDEIRTGGQEYDWNINVAEAAKIWRAGCIIRAKLLERIRQAYTDDPDLVSLMAASSVSAEMEANQSAWRRVVSKAAESGVPAPVFSATLAYYDMARAPRVNAALTQAMRDYFGSHTYERVDDHGHFHIEWTGDHSETRID

SEQ ID NO: 23018 - protein, 227 aa, Eucalyptus camaldulensis
WGFISEKNCAPLMLRIAWHSAGTFDVKTKTGGPFGTMKHAAELSHGANSGLDVAVRLLQPIKDQFPIITYADFYQLAGVVAVEVTGGPEVAFHPGREDKPQPPPEGRLPDATKGCDHLRQVFGVQMGLSDKDIVALSGGHTLGRCHKERSGFEGTWTANPLIFDNSYFKELLSGEKKELLQLPSDKALLADPVFRPLVEKYAADEDAFFEDYAEAHLKLSELGFAEA

SEQ ID NO: 23019 - protein, 582 aa, Unknown
  Synechococcus sp. WH 8102
MVVAAAAPKLSLQCEAIAGDTCTIRSLDWDRSRFDIEFGLRNGTTYNAFLVRGERTALIDTSHAKFRDTWIPLLKEQIEPTAIDVLIVSHTEPDHSGLIGDLIDLNPDIEIVGSKVALQFLQDQVHRPFKSRAVKSGEELDLGTNPESGIQHRFEFLSAPNLHWPDTIFSFDHGTGILYTCDAFGLHYCSDDVFDSDPGAIAPDFRFYYDCLMGPNARSVLQALKRMGGLPEINTIAVGHGPLLRHHLSHWVNDYREWSGQRSKGESYAAVCYLSQYGFSDRISQAIAHGIGKAEAQVQLVDLRATDPQELTALIGDAKAVVVPTWPAEPDGELQASIGTLLAALHPKQLVGVFDAFGGNDEPIDAVADQLRSQGQKQAFAPLRIRQLPQGSDYQRCEESGTDLGQLLTKEKAIAAMKSLDGDLDKALGRISGGLYVVTASQGEGESQRRSAMVASWVSQASFSPPGLTVAVAKDRAIEALMQVEDRFVLNVLREDNHQPLLRHFLKRFPPGADRFAGVNVLEGVADGGPVLTDALAYLSCRVEQRMEGPDHWIIYAVVEQGNVADAEASTAVHHRKVGNHY

SEQ ID NO: 23020 - protein, 600 aa, Unknown
  Synechococcus sp. WH 8102
MSVTSTRTERRTLQIPIDTGVVALRGLSPQRHRFELEYALERGSTANSVLFAAGDDQPAVLVHPPGAAYSAVFLPALAKLLPDASHPLLVVVGHVNPNRVALLRSLAETYSGLELITSNAGAKLLEELWTQRKPSPPGEEQEQPPLPDLPSLRVIRHEQTLAMAHGRSLQLIATPTPRWPGGLLAFEQSLGLLMSDKFFSAHLCTEEWAETNRTSTEEERRHFYDCLMAPMARQVEGVVERLEELDIRTIAPGHGPAIEDSWRSLLSDYRRWGEGQQNASLNVALLFASAYGNTAAIADALAQGVSRTGIRVNSLNCEFTSADELIGTIQQADAVLIGSPTLGGHAPTPIVSALGTLLAEGDRNKPVGVFGSFGWSGEAVDLLETKLRDGGFSFGFEPIRVKFSPDAMKVKELEEIGTRFGRQLLQAQKKAQRRSAGGLSESRSDPAVLALGRVIGSLCVLTTRKGELSGAMVASWVSQASFTPPGITVAVAKDRAVEALLHKGDRFALNVLAEGRETAPMKQFLQPFAPGADRFAGLELQESPGDQPLLPESLAWLEGSVKQRMECGDHWLVYAEVLHGGLFDPAGSTAVHQRRSGANY

SEQ ID NO: 23021 - protein, 656 aa, Anabaena variabilis
MVDVCLVSMPYAAIERPSIALGILKSCLTQKGIQAIALYPNISFAEEIGLYKYAEISESSPHLLMGEWTFSGVAFPDFQPDHSEYLSILTAQRNSTKTQALWLVRNQAKAFIERVAQSILDLQPRIVSCSSMFQQHSASLALLRRIKELNQDVITLIGGANCEGSMGVTTHREFPWVDFVASGEGDDLFSKLCRKLLDKGRDVDVAELPYGVIGPAHRSMNILAQEAPRASIHDLDQVPTPDYDDYFQTLNISKLSPYITPGLPIETSRGCWWGQKNHCTFCGLNGAGLTYRSKSSNRVVEEFLQLSQRYDLRKFQVVDNILSMNHINTVLPIFAQLKEPYTIFYETKANLKRQQLQQLRDAGVRLIQPGIESMHDLALKLLNKGNSTVINIQLLKWAYEFGLIVLWNFLVGAPGESAEWYSELLQWLPWIVHLQPPSGVASIRYDRFSLYHNQPTNYGLELLPHKAYSYIYPISPEAMADLAYYFEDHSHQAGKKVLPEHQALAEWVNQWTEMFNSPNPPSLKIAEDNGEQIRIIDTRPCAINNEINLQGLAYQVYTACDRAVTETELLETLHTSYKLDVSWNEIQPVVDELQSYKILLQINGKMLSLAVTASTPYPRQYKDIESPSGYVDIIGFIRNNTKKLESPRPAWATLWM

SEQ ID NO: 23022 - protein, 285 aa, Rheum australe
MAAPVVDADYLKEIDKARRDLRALISSRNCAPIMLRLAWHDAGTYDAKTKTGGPNGSIRNDEEFSHGCNNGLKKAIDWCEEVKTKHQKITYADLYQLAGVVAVEVTGGPTIDFVPGRKDSKVSTKEGRLPDAKQGPPHLRDIFYRMGLTDKDIVALSGAHTLGRAHPERSGFDGPWTKEPLKFDNSYFQLLLEEESEGLLKLPTDKALVEDPAFRPYVELYAKDEDAFLGDYAASHKKLSELGFNPVGPKPVTQSSILAQSAVGVVVAAAVVVFSFLYEARKQLK

SEQ ID NO: 23023 - protein, 311 aa, Prosthecochloris aestuarii
MANQVRDVVIMGTGPAGLTAAIYTGRTNLKPLVIDGVQPGGQLMITSEIENFPGFPSGIRGPELMDKFREQAARFDVEFALGNVREVDLSRKPFCLYLDDEREVLTRSLIIATGANARWLGLPSEEQYRGRGVSACATCDGFFFRDSEVFVIGGGDTAMEEALFLTRFARHVTVVHRRNEFRASKIMSLRAEKNEKISVELNQVVEEILGDGRKVTGIRLKNVVSGESNTHSCDGVFIAIGHSPNSGLFEGQLDIDEYGYIETAGSSSVTSVQGVFACGDVQDYTYRQAITAAGSGCKSALDAERYLESIR

SEQ ID NO: 23024 - protein, 576 aa, Pseudomonas putida
MSGMWLWASVSPESTGIKMSESFAELFEESLKTLNLQPGAIITGIVVDIDGDWVTVHAGLKSEGVIPLEQFYNEAGELTIKVGDEVHVALDAVEDGFGETKLSREKAKRAECWIVLEAAFAAEEVVKGVINGKVKGGFTVDVNGIRAFLPGSLVDVRPVRDTTHLEGKELEFKVIKLDQKRNNVVVSRRSVLEAENSAEREALLETLQEGQQVKGIVKNLTDYGAFVDLGGIDGLLHITDMAWKRIKHPSEIVNVGDEVDVRVLKFDRERNRVSLGLKQMGEDPWVAITARYPEGTRVQARVTNLTDYGCFAELEEGVEGLVHVSEMDWTNKNIHPSKVVQVGDEVEVMVLDIDEERRRISLGIKQCKSNPWEDFSGQFNKGDKITGTIKSITDFGIFIGLDGGIDGLVHLSDISWNETGEEAVRRFKKGDELETVILSVDPERERISLGIKQLEDDPFSNFVAVNDKGAIVKGIVKEVDAKGAIVTLADDIEATLKASEISRDRVEDARNVLKEGEEIEAKIISVDRKSRVISLSIKSKDDAEEREAIQSLKNAPEAAADTTMAALLREAMAKQN

SEQ ID NO: 23025 - protein, 508 aa, Unknown
  Shewanella sp. ANA-3
MQNHSNLNDIGVIGLGVMGKNLALNIADNQYRVSAFDLDPVKVNGVLQQEKQERVGQELRITGCANLSEMLASLAHPRILVLSVPAGAPVDGVCHALISAGIEADDIVIDTGNSLWTDTVEREKRYQGKFIFFSSAVSGGEVGARFGPSLMPSGDLGAWQNVAPIWKAIAAKVDPQTGLPIERFEPGNPVTDGEPCTTYIGPAGAGHYVKMVHNGIEYADMQLICEAYQLMLDGLGMSAAQVGEVFERWNKGSLNSYLMGISAEVLKQADPLTGQPLVEMILDKAGQKGTGLWTAVSSLQIGCPAPTIAEAVYARAVSTQKSLRVELSKKLAGPASVAMDDAQKASLIDALESALYCAKVCCYAQGFQLMAMTAQEQKWQLDFAEIAKIWRAGCIIRATFLQSITQAYQADADLSCLLMADIFATTLSEKQTEWRSAVAAAVMQGIPVPCISSALAYYDSYRSETLPANLLQGQRDFFGAHTFERLDKPAGEKYHLDWSAPNRVLIKL

SEQ ID NO: 23026 - protein, 100 aa, Mycoplasma gallisepticum
MKHITNKAELDQLLSTNKKVVVDFYANWCGPCKILGPIFEEVAQDKKDWTFVKVDVDQANEISSEYEIRSIPTVIFFQDGKMADKRIGFIPKNELKELLK

SEQ ID NO: 23027 - protein, 520 aa, Pseudomonas putida
MLDATLKSQLKTYLERVTQPIEIVASLDDGAKSRELHDLLVEIASLSNLITFSADGTDARRPSFSLNRPGADISLRFAGIPMGHEFTSLVLALLQVGGHPSKASAEVIEQIQALEGEFNFETYFSLSCQNCPDVVQALNLMAVLNPNVRHVAIDGALFQDEVESRKIMAVPSIYLNGEVFGQGRMGLEEILGKIDTNAGARQAEKINAKEAFDVLVVGGGPAGAAAAIYAARKGIRTGVAAERFGGQVLDTLAIENFISVQETEGPKLATALEEHVKQYDVDIMNLQRGEALIPAAEGGLHEVRLAGGASLKAKTVILATGARWREMNVPGEQEYRGRGVAYCPHCDGPLFKGKRVAVIGGGNSGVEAAIDLAGIVAQVTLIEFDSQLRADAVLQRKLRSLPNVNVITSALTTEVLGNGEKVTGLRYKDRSTDEQHEVALEGIFVQIGLLPNTDWLKGTVELSPRGEIIVDAKGQTSIPGVFAAGDVTTVPYKQIVIAVGEGAKASLAAFDHLIRTSAPA

SEQ ID NO: 23028 - protein, 260 aa, Unknown
  Mycobacterium sp. KMS
MTAGDRRVAIVTAAAAGIGKAIALRWCREGGCCVMADTDGEGLDAAVHELAESGAAVCGVAGDVCLSDVANSVVERALTEFGRLDTLFNVVGGSLARNVEEISEEQWRSQIDMNLGSVFQMSKPVIPLLRQGGGGSIVNVASTAGILAENRCSAYSASKGGVVLLTKNMALDFARDNIRVNAIAPGGTRTPRIERFLAEHPEHASMMVDLCAMQRFAGPEEIAAPAVFLASPEASYITGAVLPVDGGMTAGVTFRAFEAV

SEQ ID NO: 23029 - protein, 148 aa, Oryza sativa
  misc_feature (9)..(9): Xaa can be any naturally occurring amino acid
  misc_feature (50)..(50): Xaa can be any naturally occurring amino acid
  misc_feature (57)..(57): Xaa can be any naturally occurring amino acid
  misc_feature (64)..(64): Xaa can be any naturally occurring amino acid
  misc_feature (100)..(100): Xaa can be any naturally occurring amino acid
  misc_feature (111)..(111): Xaa can be any naturally occurring amino acid
MVRRPVRCXYRQIKNKPYPKSRYWRGVLDPKIRIYDVQKNNKGVDEIYHXEHLASWXEDNVTIXAIEDARIECNKHMIKFAQQDALHLMARAHLLHVLLXNMMLSCAVAEXLQTDTSTAYQKSHRTSSRVAIVHILFSVRRLLYNVSP

SEQ ID NO: 23030 - protein, 492 aa, Unknown
  Synechococcus sp. CC9311
MTASRVLFWHRRDLRLADNLGLQAAEAISPAVTGVYVLDPALIQPPESLPPMAPARLWFLVESLRELQQRWRDVGSRLLVVAGDPVQLLPRLASLLEAPAVVWSRDVEPYARERDRQVAKALQADGCKVLVDWDQLLLAPDLIKTGGGDPYRVFGPFLRNWRGQVERSGPSTVDPPRALIDLEAEMLEAVLGGEGALGRLCTEGQRQLEQLQVEHGFRGTDLCPSRPGEAAAAAQLAAFADGALLAYEPDRNFPGMPGTSYLSAGLSVGTVSPRQAWCAAQGVKEIARSDEQQQAITVWEQELCWREFYQQALFHFPELADGPYREQWRRFPWENNSDWFEAWREGQTGMPIIDAAMRQLNQSGWMHNRCRMIVASFLVKDLICDWRWGERAFMELEVDGDLAANNGGWQWSASSGMDPKPLRIFNPATQATKFDAEGEYIREWVPELRHVNTKDLISGEIPALERRSYPEQLINHKVQQAKFKALYATIRS

SEQ ID NO: 23031 - protein, 112 aa, Xylella fastidiosa
MKLITAIIRPFKLDEVREALSKVGVSGITVTEVKGFGQQKGHTELYRGTEYVIDFLPKIKIEMVVTDERLDAVIEVIRIAAVTGKIGDGKIFVTKIEQVVRIRTGEIDIDAL

SEQ ID NO: 23032 - protein, 305 aa, Thermus thermophilus
MEKWVIVNPAGGRGKVGRLSGAILKAARQEGAKAFLTEGPGHATELAQRAPEGARVVAVGGDGTVHEVLKGLAGTGKVLGVVPIGSGNDFARMLGLLGLPWPKALELALHAPEEAVDLGWVNGEPFGASLGIGFDALVAKKALSAPPFLRGMPRYLYALFAVLKELSLPEARVLVDGEEVHRGRMLLLAAMNGPMYGGGIPIAPMADPRDGRLSVVLAGEFSRTGVVLILPRLLLGRHLSHSRVRAYAGQEVAVEFAHPVPAHADGELLPEASLYRAEVRPLGLRVVGGRAGARAGGLVPEPAGT

SEQ ID NO: 23033 - protein, 122 aa, Sorghum bicolor
EGEFASLSVRRLRKRQMRNFFVCLMVSQGVPMFYMGDEYGHTKGGNNNTYCHDHYVNYFRWDKKEEQSSDLYRFCRLMTKFRKECESLGLEDFPTSERLQWHGHQPGKPDWSEASRFVAFTM

SEQ ID NO: 23034 - protein, 442 aa, Arabidopsis thaliana
MAIIQLGSTCVAQWSIRPQFAVRAYYPSRIESTRHQNSSSQVNCLGASKSSMFSHGSLPFLSMTGMSRNMHPPRRGSRFTVRADADYYSVLGVSKNATKAEIKSAYRKLARNYHPDVNKDPGAEEKFKEISNAYEVLSDDEKKSLYDRYGEAGLKGAAGFGNGDFSNPFDLFDSLFEGFGGGMGRGSRSRAVDGQDEYYTLILNFKEAVFGMEKEIEISRLESCGTCEGSGAKPGTKPTKCTTCGGQGQVVSAARTPLGVFQQVMTCSSCNGTGEISTPCGTCSGDGRVRKTKRISLKVPAGVDSGIRLRVRGEGNAGKRGGSPGDLFVVIEVIPDPILKRDDTNVLYTCKISYIDAILGTTLKVPTVDGTVDLKVPAGTQPSTTLVMAKKGVPVLNKSNMRGDQLVRVQVEIPKRLSKEEKKLIEELADMSKNKTANSTSR

SEQ ID NO: 23035 - protein, 418 aa, Solibacter usitatus
MRIRVLGIVLAGGKGTRLSPLTRERAKPAVPFGGKYRIIDFVLSNFINSGIYSIYVLTQFRSQSLLQHLAEGWQFGSLLKNQFVIPVPAQMRSEDETWYQGTADAIYQNINLVEQADPHVVAIFGGDHIYRMNIASMIEYHVAKAAEVTIAAIPMPKKHADEFGVIEAADDDRILGFHEKNPDAPTMPGDPDQVYASMGNYIFSTRTLLSLLEEDSKLPHSHHDFGKDILPRLAGKGRMYAYNFETNRIPGEPADASPYWRDVGTIEAYYEANMDLRYVSPALNLYNREWPLRSTSYSDPPAKFTFDDANRRGQAIDSIVSGGCILSGGVVRNSVLGRGVRVHAGAMVEDSVILDNCDIGRRAKIRRAILDKNVRVAEDAMIGYDLEVDRAKGYHVTETGIVVVGGERSQVDITGLVV

SEQ ID NO: 23036 - protein, 316 aa, Alteromonadales bacterium
MTQKNQFGPNGWTPENLSALHGKTYLITGANTGAGFQATRILLSKGANVVMLNRNPNKSVLAITKLKDEFGSGANVSFITLDLADLTSVRTACTEILIKVPQINALICNGAIAQVEQQQFTADGFESQLGVNHYGHFLLCGLLFERINTSKGRIVVVSSEGHKMGLKTIQFEDMNWDKNYNANKVYSQSKLAQMMFAYELQNKVKAADKNVEVYVCHPGASNTSLIRETASFATRLSWSFMVKLGVAQSAEKGAYPEVMCSAQSNLKQHAYYGPTGFLNFGGPVGECKLESFVLDKKVLTKLWTLSEQQTAFKWQL

SEQ ID NO: 23037 - protein, 308 aa, Thermoanaerobacter tengcongensis
MSTLYDCLIIGGGPAGLSAAIYASRGKLNTVVFERSKIGGQAAITDDIENYPGSVEEATGPKIVKRMREQAESFGTCFVMEEVKKVELSEKIKKVITTKGCYEGKTVIIATGAEHMKLNVPGEEEFIGKGVSYCATCDADFFTDLDVVVVGGGDSAVQEALYLTKFAKNVTIIHRRDKLRANKCLQDKAFKNPKIKFLWDSVVERIEGDGIVEKVIVRNVKTGELKEVKTDGVFIFIGMKPSTEIFKGLIEMDERGYILTDENMRTNIEGVFAAGDCRAKLLRQIVTAAADGAIAAVAAERYIEELEC

SEQ ID NO: 23038 - protein, 136 aa, Brassica napus
MARTKQTARKSTGGKAPRKQLATKAARKSAPATGGVKKPHRFRPGTVALREIRKYQKSTELLIRKLPFQRLVREIAQDFQTDLRFQSSAVAALQEAAEAYLVGLFEDTNLCAIHAKRVTIMPKDIQLARRIRGERA

SEQ ID NO: 23039 - protein, 529 aa, Burkholderia pseudomallei
MNARNMSFGPLDSTNREETLDIAIIGTGFSGLGMAIRLRQTGNQDFAVFEKASSVGGTWRDNHYPGCACDVQSHVYSFSFAPNPRWTRMFAPQPEIRAYMEDCVQRFNVGSHLRFDHELVNATYDETAHRWRLTFANGKRVCARVLVSGMGGLSRAAYPNIPGIETFKGEAFHSQHWKHDYALEGKRVAVIGTGASAIQFVPQIAPRVAKLALFQRTPPWIMPKPDRAVSGVEQWLFRNLPFTQKLMRAGLYWMLESRVLGFAVHPSTMKLVQKLALRHIDKQISEPELRAAVTPDYTIGCKRILMSNDYYPALTRKNVDVITTGIERIEEDAVVTTDGKRHEVDCLIYGTGFQINNPFPRGTIVGRGGVDVVDAWRDGLHAYLGATVPGYPNWFILMGPNTGLGHNSMVYMIESQIEYVLGALKAMRTERAEAIEVRPLVELEYNNRIQNKLKGTVWSTGGCSSWYLDPRTGKNTTLWPTFTWRFRQETAFFSTADYHLYYANPRQSPQPVPALASAAAATATAETTA

SEQ ID NO: 23040 - protein, 215 aa, Zea mays
  misc_feature (46)..(46): Xaa can be any naturally occurring amino acid
  misc_feature (55)..(55): Xaa can be any naturally occurring amino acid
  misc_feature (71)..(71): Xaa can be any naturally occurring amino acid
  misc_feature (80)..(81): Xaa can be any naturally occurring amino acid
  misc_feature (105)..(105): Xaa can be any naturally occurring amino acid
MGRTTARCYRQIKNKPYPKCRYWRGVPDPNIMIYHVGMHTNGADDXPYCVHLVSXQMENVSTDALDAARIXCNKYMTKSXXKDVFHLRIRFHPFHVLCINHMISXPGADRIQTAMRCAFAQPQATCAEVHIGQCLLSARCKDNNAAHATEILRLFKVQFPDPRKIIDSLKCFFTKFSRADYLKYERVGTIVPDGVNANLLGNHGILDKRAPGKAF

SEQ ID NO: 23041 - protein, 446 aa, Thermoanaerobacter tengcongensis
METDVLVIGGSAGGILAALSVKKTYKDKKVTVIRMAERVMVPCGIPYIFGTLKDTSKNVIPDSMLTNAGVELVIDEVVSIDRQNKKVSTRKNGDISYKKLILATGSLPIVPTFIPGYDLDNVFTIKKDEEYLKFVQQKINEAEDVVVVGGGFIGVEMAEQVQLLGKNVTIIEVADKLLWQAFDPEFSDMAEAKLKEHGIKVLTGTKVTKFIGEKEVKEVEIHTGERIKADVVIVAMGVKPNTKLAEEAGIKLNEKGAITVDEYMRTNDPDIFAVGDCAEKKCFFTRKNVPILLASIAANEAKIAGVNAFELRLVRENKGTISAFSTKIYNTAFAAAGLTETQARAEGFDIVIGEFNTIDKHPGTLPNTMNVKIKLIFSRYSGVILGAQLAGGDNVGEMINILSLAIQKGTTASELTTFQVATHPLLTSSPVSYPISSAALDALSKI

SEQ ID NO: 23042 - protein, 244 aa, Magnetospirillum magnetotacticum
MCGMSVVVVGADAQGNIDVEDFSKKAALHADKLAACMITYPSTHGVFEARVRELCAIVHAHGGQVYLDGANLNAMVGLARPGDIGADVSHLNLHKTFCIPHGGGGPGMGPIGVKAHLIPFLPSDPRTGEEGAVSAAPFGSASILPISWSYCLMMGGRGLTQATRVAILNANYIAKRLEGAYPILYAGRNGRVAHECIVDVRPFQKSAGVTVEDIAKRLIDCGFHPPTMSWPVAGTLMIEPTESE

SEQ ID NO: 23043 - protein, 222 aa, Unknown
  Chlamydomonas sp. HS-5
MSAMIAPLVRQGRCLRAQGERSTSVIARAVEFYGPDRAKWLGPFSDDTPSYLTGEFPGDYGWDTAGLSADPETFARYREIEVIHARWAMLGALGCITPELIGGDIAEPVWFKAGAQIFSEGGLDYLGNPSLVHAQSIIATLAVQVILMGQAEAFRAAGYVVPGGFGEDLDNLYPGDAFDPLAWLIPDTFAELKVKEIKNGRLACSHVGSCAGMYAGHSRTTS

SEQ ID NO: 23044 - protein, 271 aa, Zea mays
NIMRLTGITGIVNGMDVSEWDPSRDKYIAVKYDVSTAVEAKALNKEALQAEVGLPVDRNIPLVAFIGRLEEQKGPDVMAAAIPQLMEMVEDVQIVLLGTGKKKFERMLMSAEEKFPGKVRAVVKFNAALAHHIMAGADVLAVTSRFEPCGLIQLQGMRYGTPCACSSTGGLVDTIIEGKTGFHMGRLSVDCNVVEPADVKKVATTLQRAIKVVGTPAYEEMVRNCMIQDLSWKGPAKNWENVLLSLGVAGGEPGVEGEEIAPLAKENVAAP

SEQ ID NO: 23045 - protein, 139 aa, Yarrowia lipolytica
MARTKSTVIARKVTGGKAPRKQIGSKAARKSAAPSNTSGGVKKPHRYKPGTVALREIRRYQKSTELLIRKLPFQRLVREIAQDFKTDLRFQSSAIGALQESVEAYLVSLFEDTNLCAIHAKRVTIQKKDIHLARRLRGE

SEQ ID NO: 23046 - protein, 271 aa, Zea mays
NIMRLTGITGIVNGMDVSEWDPSRDKYIAVKYDVSTAVEAKALNKEALQAEVGLPVDRNIPLVAFIGRLEEQKGPDVMAAAIPQLMEMVEDVQIVLLGTGKKKFERMLMSAEEKFPGKVRAVVKFNAALAHHIMAGADVLAVTSRFEPCGLIQLQGMRYGTPCACASTGGLVDTIIEGKTGFHMGRFSVDCNVVEPADVKKVATTLQRAIKVVGTPAYEEMVRNCMIQDLSWKGPAKNWENVLLSLGVAGGEPGVEGEEIAPLAKENVAAP

SEQ ID NO: 23047 - protein, 368 aa, Bacillus sphaericus
MEKRDYYEVLGLTKDEIKKAYRKLSKQYHPDLNKEPGADEKFKEIAEAYEVLSDDQKKARYDQFGHEDPNAGFGGGFGGGGFGGFEDIFSSFFGGGGRRQDPNAPRKGDDLQYRMNIKFEEAIFGKETEIEIPKDETCETCHGSGAKPGTQPETCSTCNGAGQINQAVDTPFGRMMNRRSCTTCHGTGKIIKEKCSTCRGEGKVQKRKKIKVSIPAGVDDGQQIRVSGQGEPGINGGPAGDLYIMFRVQGHNDFERDGDDIYFELKLTFPQAALGDEIEVPTVHGKVKLRIPAGTQSGAQFRLKDKGVKNVHGYGMGNQYVTVKVMTPEKLTEKQKQLLREFAEISGDIPEEQGSSLFDKIKKKFQGE

SEQ ID NO: 23048 - protein, 248 aa, Picea glauca
MEHLNAAAAQASSSLYGVSMAEYGDVGVSSMMALMTQHEPHERDSILTTSMPSSFSSFHGHAECLLSAAMFQASQGDHKLKRQPEMDQLVSEQAVMSDSSMPSVKTEGCSSLRNQFEIRREQTGNCYTDQSSNAPVSPLVTSLVPQAGGEARMITSLEADSSHFSGGNEAEAIKAKILAHPQYPSLLGAYIDCQKIGAPPEVVARLDALTHEYENQQHRTTVSIGMDPELDQFMEAYSEMLTKYHEEL

SEQ ID NO: 23049 - protein, 86 aa, Arabidopsis thaliana
MASSMLSSAAVVTSPAQATMVAPFTGLKSSAAFPVTRKTNKDITSIASNGGRVSCMTQAGVSRPKAVKALKESNGDIVSAIMELTT

SEQ ID NO: 23050 - protein, 561 aa, Arabidopsis thaliana
MARRGSCSTICLNEKLQRFRIVRISDKADNFNSRSGSFFERSISLVLLLWCFLFLVYSKLGQSHDDYGNADRIGNYTDGSVSKTLNSTSSVFPQATEKENNFCLLRKGQLQDVYEHVLVNNALLICKVVLPERRISKKTLEARDPRYVNLEDKSLKVNGSSQLVNNGTRYRLEPDGNGYNYASAMKGAKVVDHNKEAKGASNVLGKDHDKYLRNPCSVSDKYVVIELAEETLVDTVRIANFEHYSSNPKEFSLSGSLSFPSDMWTPAGSFAAANVKQIQSFRLPEPKWLRYLKLNLVSHYGSEFYCTLSVVEVFGIDALEQMLEDLFVPSETPPSKPAMVELKTADEKQDGEIKSNRTDQIGKETEAQKKKDDVVKTINIIGDKKYEVKEKHNVLKVMMQKVKLIEMNLSLLEDSVKKMNDKQPEVSLEMKKTLVLVEKSKADIREITEWKGKMEKELRDLELWKTLVASRVESLARGNSALRLDVEKIVKEQANLESKELGVLLISLFFVVLATIRLVSTRLWAFLGMSITDKARSLWPDSGWVMILLSSSIMIFIHLLS

SEQ ID NO: 23051 - protein, 313 aa, Avena sativa
VVVITGASSGLGLAAAKALAETGKWHVVMACRDFLKASKAAKAAGMADGSYTVMHLDLASLDSVRQFVDAFRRAEMPLDVLVCNAAIYRPTARKPTFTAEGVEMSVGVNHLGHFLLARLLLEDLQKSDYPSRRLVIVGSITGNDNTLAGNVPPKANLGDLRGLAGGLTGASGSAMIDGDESFDGAKAYKDSKVCNMLTMQEFHRRYHEDTGITFSSLYPGCIATTGLFREHIPLFRTLFPPFQKFVTKGFVSEAESGKRLAQVVGEPSLTKSGVYWSWNKDSASFENQLSQEASDPEKARKVWELSEKLVGLA

SEQ ID NO: 23052 - protein, 723 aa, Desulfitobacterium hafniense
MTQEVLERSIQVGGRTMTFQTGKIGKQAGGAIFCRYGDTVVSAFATGSAQPREGIDFFPLTVEFEERLYAAGKIPGGFIKREGRPSEKAILSARLIDRPIRPLFPEGYRNDVQVVAQVMSVDQDCASDITGINAASAALTISNVPFEGPVAAVTVGLIGDEFIINPTVEQSEKSVMHLTVAGTKDAVMMVEAGAQEVPEAQMLEAIMFGHREIQRIAEFIENYRLEALERNLAKPKQEVVMKQMPEEIVQAVKAFAYDKMDQAVRTEEKKAREEAIRQVKEEALAHFAEQYPEDLKTIDKILEDFVHKIVRRLITVEHIRPDGRALDEIRPISVEVGILPRTHGTGLFTRGQTQVLTVATLGAVGDEQILDGLGLEESKRYMHHYNFPPYSVGETRPMRGPGRREIGHGALAERALLPVIPNENDFPYTIRLVSEVLESNGSSSMASVCGSTLSLMDAGVPVKSPVAGIAMGLISEENHIAILSDIQGMEDHDGDMDFKVAGTSQGVTALQMDIKIKGVSREILERALTQAKEGRLFILDKMLSVIEKPRPELSPFAPRIITASIHPDKIREVIGPGGKTIKKIIDETGVKIDIEDDGRVFISAVDGEAGENALKIIQALTQEVEVGRIYNGRVTRIMDFGAFVEVIPGVLGLSGKEGLVHISQLAHGRVEKVEDVVKLGDEILVKATGIDKQGRLNLSRKEALPNPNPNPNGSTANKNPRNS

SEQ ID NO: 23053 - protein, 388 aa, Hordeum vulgare
MALQLLPSTLSVPKKGSSMGAVAVKDTAAFLGVSSKAKKASLAVRTQVATAPSPVTTSPGSTASSPSGKKTLRQGVVVITGASSGLGLAAAKALAETGKWHVVMACRDFLKASKAAKAAGMADGSYTVMHLDLASLDSVRQFVDAFRRAEMPLDVLVCNAAIYRPTARTPTFTADGHEMSVGVNHLGHFLLARLLMEDLQKSDYPSRRMVIVGSITGNSNTLAGNVPPKASLGDLRGLAGGLSGASGSAMIDGDESFDGAKAYKDSKVCNMLTMQEFHRRYHEETGITFSSLYPGCIATTGLFREHIPLFRTLFPPFQKFVTKGFVSEAESGKRLAQVVAEPVLTKSGVYWSWNKDSASFENQLSQEASDPEKARKVWELSEKLVGLA

SEQ ID NO: 23054 - protein, 372 aa, Bacillus clausii
MSKRDYYEVLGVDRNASVEEVKKAYRKLARKYHPDVNKEEDAEAKFKEVKEAYDTLSDPQKKARYDQFGHADPNQGFGGAGASGDFGGFSDIFDMFFGGGGGRRNPNAPRQGDDLQYTMTLEFKEAVFGKETEIEIPREETCGTCHGSGAKPGTKPDTCSHCGGSGQLNVEQNTPFGRVVNRRVCNYCEGTGKIIKQKCATCSGKGKVRKRKKINIQVPAGIDNGQQLRVAGQGEAGANGGPPGDLYVVFQVKPHEFFERDGEDIYCEVPLTFPQVALGDEIEVPTLTGKVKLKIPAGTQTGTSFRLRGKGVPNVHGRGQGDQHVQVRVVTPKNLTENEKELMREFAGMSGGRPEEQNDGFFDKLRRAFKGD

SEQ ID NO: 23055 - protein, 475 aa, Ashbya gossypii
MFRFALSYTTLLHRQTITRDYAMPPKEDWEKYKAPVETEEEQKQADEKIKPLSEGDIQVLKTYGAAPYAAKLKSTEKDLKDIEQRIKEKAGVKESDTGLAPSHLWDIMGDRQKLSERHPLQVARCTKIIRSNPSADASRSGANTGEDDEDAKYVINLKQIAKFVVGLGERVSPTDIEEGMRVGVDRSKYFIELPLPPRIDPSVTMMTVEEKPDVTYSDVGGCKEQIEKLREVVELPLLSPERFATLGIDPPKGILLYGPPGTGKTLCARAVANRTDATFIRVIGSELVQKYVGEGARMVRELFEMARTKKACIIFFDEVDAIGGARFDDGAGGDNEVQRTMLELITQLDGFDPRGNIKVMFATNRPNTLDPALLRPGRIDRKVEFSLPDLEGRANIFRIHTKSMSVERGIRWELISRLCPNSTGAELRSVCTEAGMFAIRSRRKVATEKDFLKAVDKVINGYKKFSSTSRYMQYN

SEQ ID NO: 23056 - protein, 239 aa, Unknown
  Candidatus Kuenenia stuttgartiensis
MRLRFVFGKSSKRVLTNIFKITACKGGAGMNNYLIPLFILIVLGINGALCGESKNSDSDTTHKKYEMATFAGGCFWCMQQPFDQLEGVISTAVGYTGGNVENPAYEDVYSGRTGHAEAIEIWYDPSLISYASLLQVFWRNIDPTAMNRQFADVGSQYRTAIFYHTEEQKNLAESSKKELEKSGKFNKPIVTEIVPASAFYKAEEYHQKYYEKNQTQYNRYKYGSGRERYLKEKWEKDAK

SEQ ID NO: 23057 - protein, 675 aa, Mesorhizobium loti
MCGIAGIVALNAAAASPSREALMRMVGTLAHRGPDEHGLYRDKRAGLAHARLSVVDLSSGQQPLADTGDTSWIVFNGEIFNYVELREKLIALGHRFRTRSDTEVALHAYRAWGEAAFERMNGQWAIAIWDSIAGRLVLSRDRFGICPLHFCEHAGRLYFASEVKAIFAADPTIPRAFDPAGLDQTFTLWTVVPPQGVFQGIHELVPGHVRIYQDGTVREQVFWQPSYPENIGALQGEFTGSCDDAVDRVRDALEAATALRMVRADVPVGCYLSGGLDSSLVATLGRRFAGRRFQTFSLRFADAEYDETRFQRLVAEATGSEHHEVVVSRGDIAAIFPEVIHHTERPILRTAPAPLFLLSRLVRERGIKVVLTGEGADEMFAGYDLFREAKVRRFWGRQPASTRRSRLLERLYPYLTRSPVQQQAMARQFFGRGIEAYDAPGFAHDTRWRSTGAIKRLFSADLRAESQRRDAVSELLARLPAAFSRWSHLAQDQYLEVQTLMSGYLLSSQGDRMLMAHSVEGRFPFLDDELVRLANSLPPSYKLRVLDEKHVLKRVAQPIVPSEIVTRKKQPFRAPNALCFAADAAPEYIREALSETAIRKANVFDPVSVTRLLDKCQARTGDGDLSNADNMALVGVLSTQLLHQQFVASCPSATHVRGLSVDVDREHREERLHVA

SEQ ID NO: 23058 - protein, 433 aa, Unknown
  Synechocystis sp. PCC 6803
MAAHIALIAHDNKKDALVNFVQQHKSLFSRYDLIATGQTGELVRNKTGLAVDTVFSGPLGGDTQIATQIIDGTIAAVIFLIDPLYAQPHEPDIRTLLRLCEVYNVPLAINLATAKAVIKLLGKTKTGHLIFNPVAGQGNVERELDLIKEHLQSEINLKITFTSAEVNVTDQAKEIVKRIKQANEQSDGEGDSFIIASGGDGTVSGVAAALVNTGIPLGIIPRGTANAFSVALGIPTQIPGACQTINRGITKVVDTALCNDIPMLLLAGVGFEAEMVEKADRELKNNLGVMAYIFAGIQQAREQELFEAHIEIDSETTTMEASAITIANAAPPTSVFAQGAGQVSFTDGLLDITVASSQTALQGLQVVTNLFTSALSKNPSDNENVLHLYGESIKVTTSPPQKIVVDGEIIGTTPVEVKCLPKSLNIFAPVENS

SEQ ID NO: 23059 - protein, 209 aa, Zea mays
MLGPTVRTRPGPGAGRYTFSSLGPDDSCGTPRRGTLTRYGLSAGPGNRPGSSTAAMASSSTLDLAMGPGALLPRSAVPYASFAPGRGRSASGTRSRNLALSASSSNGAAVPSLTTDSEKKGPVIMEIPLDQIRRPLMRTRANDPVKVQELMDSIRVIGLQVPIDVLEVDGVYYGFSGCHRYEAHQRLGLPTIRCKVRRGTKETLRHHMR

SEQ ID NO: 23060 - protein, 373 aa, Desulfitobacterium hafniense
MEPIKGEQRDGQSEIRKLAILTGGGDCPGLNAVIRAAVKTACHRGIAVVGIQDGFRGAVEGDFRPLELKDVSGILPRGGTILGTTNRDNPFAYPTQVGEERQVQDRSAEVLDRFKAEGIDALIAIGGDGSLSIAWEFAKQGLKVVGVPKTIDNDLMCTDLTFGFQTAVATAQDALDRLHTTAESHHRIMILEVMGRYAGWIALYAGVAGGADVILIPEIPYQLESIAEAVQRRARLGKHFSIIVVAEGAKPLGGDMVVERTMSGRTDPIKLGGIGAKLAADLEKVTDMETRVTVLGHLQRGGSPIAVDRVLSTRYGVAAVEAALAGDFGMMVALQGQDIVRVPMAEAVHKLKQVEPDDPVLNAARSMGIEFGD

SEQ ID NO: 23061 - protein, 447 aa, Wolinella succinogenes
MKSLIWFRRDLRLEDNRTFEQASGEVLPLFIFDSHLLSPLPKEDRRVGYIYGEVMRLKSELRARGLDLAIFYGEPLKILSRLKEQGFSRLFASQDYDSYALSRDEAARELLDCRFVLDNYLFDPNEVLKKEGSPYTIFSAYYNQSLKILSEGHYAKGLDLPKKLAPYPIPAPPSLESMGFSPLPLLESLKILPQKRLEEFSSKITRYALDRDSLEAEATSGLSLFLRFGTLGVREVIRRLKVWQEEGIKVAPFYRQILWREFYAMLLYHFPHSEREDFKPMQMRWSESQERLERWQKGECGVPLVDAGMRELNHTGFMHNRARMVCASFLTKNLHLHWSWGERYFASKLLDYDVAQNAGNWQWCAGSGADAQPFFRIFNPYTQSLKFDPKGEYVKRWIPELRGISTQNWSSEERWEGLKERYLAPIVSAKRSAQEAKAMQNTLRVSS

SEQ ID NO: 23062 - protein, 245 aa, Nicotiana tabacum
MATASSASAALRTISSSAKLTSSFPTTSASQKIRSFKLPNPLISQSLKLGTSTNSKSFYCKSQSGSTDSSTTKVQELSVYELNERDRGSPAYLRLSQKNVNSLGDLVPFSNKLYTGDLKKRIGITAGLCILIKHEEEKKGDRYEAIYSFYFGDYGHIAVQGSYLTYEDTYLAVTGGSGIFAGVSGQVKLQQIIFPFKLFYTFYLKGIPDLPSELLVTAVPPSPTVEPAPEAKACEAGATLKNFTN

SEQ ID NO: 23063 - protein, 394 aa, Photorhabdus luminescens
MRNQTFIIVGAGQAGAMAAATLRQQQFDGDIILIGKEYHAPYERPILSKDYLINPEEAPKYLFSEDFYLEKQIDLRIGQLVSQIMPSKHCVVLENGGKLRYDKLLLTMGARARRFPLLDQLGENIYTLRTLDDAQRLRQAVKKDKRILIVGGGVIGLELAATSCELGANVTVIEQADNIMGRCAPPLLQDYLLNRHQEKGVQFFLDTNIVSAQKQGSELVLILNTGEKVIGDIIIYGIGAEFRDQLAADAGLVTDGGIVIDSRCQTSEPDIFAAGDVCLQREPLTGDLQRRETWENANRQATIAAHAMMGLAPPQPGAPWFWTDQWGINIQMVGNMQAEEWHIQGDLQSDKAILFGTENEVLVGAVAINQGREMRNLRKLLANPAQVVSGVEWA

SEQ ID NO: 23064 - protein, 252 aa, Medicago truncatula
MASMSSLKMISSLNLSTSPLQTQNQIVSSGLSLSFPSRRNFNTSTTKQVSTTKRSSQNTRTNALFFNNQKQHQESSKPAKVQELFVYEINERDRGSPAYLRLSQKSVNSLGDLVPFSNKLYSGNLEKRLGITSGLCILIQNEPEKKGDRYEAIYSFYFGDYGHISVQGPYLTYQDTYLAITGGSGIFEGVYGQVKLQQLVFPFKLFYTFYLKGVADLPADLLGKPVDPSPHVEPSTAAKATEPHASLPNFTN

SEQ ID NO: 23065 - protein, 203 aa, Triticum aestivum
MDPTKSSTPPPPPVLGAPVGYPPGAYPPPPGAPAAAYPPQLYAPPGAAAAQQAAAQQQQQLQVFWAEQYREIEATTDFKNHNLPLARIKKIMKADEDVRMIAAEAPVVFARACEMFILELTHRGWAHAEENKRRTLQKSDIAAAIARTEVFDFLVDIVPRDDAKDAEAAAAAAMATAAAGIPRPAAGVPATDPSMAYYYVPQQ

SEQ ID NO: 23066 - protein, 604 aa, Unknown
  Synechococcus sp. CC9311
MCGIFGGFSFEASAFSGELPVMMAKSILHRGPDNTGYWSNEEALLGNCRLSIIDLSKNGNQPFYSKNKDIVVVQNGEIYNYIELRDLLIGEGACFQSDSDTEVVLHAYAIWGPDFVSRLNGMFSIAIYDSRVSTAVLRLYRDRLGVKPLYYCIDGGCLWFGSEIKAILAAGVKANPNYNALRSYFALNYIPPPQTAFANIYHLQPGHSAAITKSGVKLNRYWDCNDIGLNEDITTAEAKSGIITLLDDAVRIRLRSDAPFGAFLSGGLDSSSVVGLMSLYKESPTKTFSIGFEDARYDETSYAEMASKRFGTYHSTKIMSENALDIWSKFIWHCDQPHGDISFIPTYQVSENASQEVKMVLTGDGGDELFAGYDKYASFFSGECDRSHPRWFSDYAQFTGLIEADMAKRLFKGEIKASFEENDPYAPITESMLRFGQDDHINKVLYADTVNLLPGNNLVKPDRMAMAHSLEVRSPFLDYRLVEYAFSLPGKMKLKGTETKYIYKMAVEELLGETLTWRKKQMFTVPVGDWFRGHLADFCSRILLDNRSLSRGLYAESVLREVIEDHTSARKNYTRLLRALISLEIWFRLFIDQDMSNLELITSK

SEQ ID NO: 23067 - protein, 114 aa, Neisseria meningitidis
GPMKKIEAIVKPFKLDDVREALTEIGITGMTVSEVKGFGRQKGHTEIYRGAEYAVDFLPKIKIELVLADDAVERAIDVIVEVARSGKIGDGKIFVLPVEEAIRIRTGERSDAAV

SEQ ID NO: 23068 - protein, 865 aa, Methanothermobacter thermautotrophicus
MTVLEAALANDIYIPHLCFREGIEPFGGCRLCLVENTDGRLVTACETPVEDGAEFISESERINNIRRTVVSLLISEHSRDCLSCPSSGDCSLQEVSSYLNLTEDDLSRLRQDLPESEPDESNPFFIRNHDKCILCGLCVRVCRATGAEAIDFAYRGHDTRISTFMDRAITESSCVSCGECVEVCPVGALVSREEKPFTEVKTVCPYCGAGCGIYLGVRGDRVVSSRGDPDNPVNRGKLCVKGRFALKFVNSPERLKKPLIKVDGRFVEVEWDEALSTVAERLSEYSGEEFAAVASAKCTNEENYILQKFTRAVMLSGNIDHCARLCHAPSVRSLSMTLGSGAMTNSIAELEDSACILAVGTNPTETHPLTAYSVIRAIRSGAKLVVIDPRRTRISELADIHLQNRPGSDIPLIMAMCRFIIEEGLHDTEFIESRTENFDEFRDAVMALDLEEVESLTGVGVEDMRRAAITYASKKPASIIYSMGITQHAHGTDNVIALSNLALLTGNLGKPSAGINPLRGQNNVQGACDMGALPDLLPGYQTLDDSFRFSDKWGSTIPGPGMTLPEMFDAALEGRLRAMYIMGENPLLSEPETEKTRKALESLDFLVVQDIFMTETAELADVVLPACAWAEKDGTFTNTERRVQLIRKALDAPGEARTDWEIICMLAEKMGAEGFDYASSSEIFKEIAALVPSYAGISHERLQDGGIQWPCTSYEHGGTQYLHSERFSTPTGRASFLLPGYHVGEVSEEYPMVLVTGRNLYQYHTRSMTGRVPELDSFSDREELLINPLDAAKLGVEDGGTVLVKSEGGSLEVRARVSGDVMEGVVFMTFHFAETPANVLTGGDRDPVSGMPELKFTPVSIRPVE

SEQ ID NO: 23069 - protein, 112 aa, Coxiella burnetii
MSEHVHTASDENFETEVLQADMPVLVDFWAEWCQPCKMISPVVEEIAKEYAGRVKVFKLNVDENAQTPTKYGVRGIPSLLIFREGEVVDRKVGALNKSQLAAFLDESLHFSS

SEQ ID NO: 23070 - protein, 322 aa, Streptomyces clavuligerus
MSDVRNVIIIGSGPAGYTAALYTARASLQPLVFEGAVTAGGALMNTTDVENFPGFRDGIMGPDLMDNMRAQAERFGAELIPDDVVSVDLTGDIKTVTDSAGTVHRAKAVIVTTGSQHRKLGLPREDALSGRGVSWCATCDGFFFKDQDIVVVGGGDTAMEEATFLSRFAKSVTIVHRRDSLRASKAMQDRAFADPKISFAWNSEVATIHGEQKLTGLTLRDTKTGETRELAATGLFIAVGHDPRTELFKGQLDLDDEGYLKVASPSTRTNLTGVFAAGDVVDHTYRQAITAAGTGCSAALDAERYLAALADSEQIAEPAPAV

SEQ ID NO: 23071 - protein, 180 aa, Zymomonas mobilis
MEKQAILAGGCFWCIEAIFKDIIGIISVESGYIGGDVPNPSYEQVCEGKTGHAEAVRLTFDPEKISYSDILDLFFDIHDPTQLNRQGDDIGVQYRSAIFPLDKAQEQVAQDAIVKAQAHSKKPIVTKIEPASIFYPAEAYHQDYFYQKGQENRYCSIVVAPKIAKFRKSHQDRIKKQASA

SEQ ID NO: 23072 - protein, 271 aa, Zea mays
NIMRLTGITGIVNGMDVSEWDPSRDKYIAVKYDVSTAVEAKALNKEALQAEVGLPVDRNIPLVAFIGRLEEQKGPDVMAAAIPQLMEMVEDVQIVLLGTGKKKFERMLMSAEEKFPGKVRAVVKFNAALAHHIMAGADVLAVTSRFEPCGLIQLQGMRYGTPCACASTGGLVDTIIEGKTGFHMGRLSVDCNVVEPADVKKVATTLQRAIKVVGTPVYEEMVRNCMIQDLSWKGPAKNWENVLLSLGVAGGEPGVEGEEIAPLAKENVAAP

SEQ ID NO: 23073 - protein, 954 aa, Sinorhizobium meliloti
MSMPKDFTFTDYKPYDFANRRHIGPSPAEMDEMLKVVGYPSLDALIDDTVPPSIRQRTPLAWGAPMTEREALDKLRETANRNRKLVSLIGQGYYGTITPPVIQRNILENPAWYTAYTPYQPEISQGRLEALLNYQTMVCDLTGLDVANASLLDEATAAAEAMAIAERVAKSKAKAFFIDENCHPQTIALLKTRAEPLGWQIVLGDPFEDLDAAGVFGAIFQYPGTYGHVRDFSGLIAKLHGQGAIAAVAADPLALALLKSPGEMGADIAIGSTQRFGVPVGYGGPHAAYMAVKDAYKRSMPGRLVGVSVDARGNRAYRLSLQTREQHIRREKATSNICTAQVLLAVMASMYAVFHGPDGIKAIAQSVHQKTVRLAMGLEKLGYTVEPDVFFDTITVEVGKLQGIILKAAVAEEVNLRKIGTTRIGISLDERSRPVTLEAVWRAFGGDFKVEEFEPDYRLPQELLRTSAYLTHPIFHMNRAESEMTRYMRRLADRDLALDRAMIPLGSCTMKLNATAEMLPITWPEFSEIHPFVPADQALGYQHLIEDLSQKLCAITGYDAISMQPNSGAQGEYAGLLAIRAYHIANGNEHRDVCLIPTSAHGTNPASAQMAGMKVVVVKVSDAGEIDMDDFRAKAEQYADTLSCCMITYPSTHGVFEENVREVCEVVHKHGGQVYLDGANMNAMVGLSRPGDIGSDVSHLNLHKTFCIPHGGGGPGMGPIGVKSHLAPFLPGHPQTDGHEGAVSAAPFGSASILPISWSYCLMMGGEGLTQATKVAILNANYVAARLKGAYDVLYKSAKGRVAHECIIDTRPLAESAGVTVDDVAKRLIDCGFHAPTMSWPVAGTLMIEPTESETKAELDRFCDAMLAIREEARAIEDGRMDKVNNPLKNAPHTVEDLVGDWDRPYSREQACFPPGAFRVDKYWSPVNRVDNVYGDRNLVCTCPPIESYAEAAE

SEQ ID NO: 23074 - protein, 428 aa, Pisum sativum
MRDQKGEVQYFIGVQLDGSQHVEPLHNRIAEDTAKEGENLVKKTAENVDDALRELPDANMKPEDLWMNHSKMVHPKPHRREDAAWRAIQKIMESGEQIGLKHFKPIKPLGSGDTGSVHLVELCGTDHQFAMKAMDKGVILNRNKEHRACTEREILDMLDHPFLPALYASFQTKTHICLITDYCPGGELFMLLDRQPAKVLKEDAVRFYATEVVVALEYLHCQGIIYRDLKPENVLLQSTGHVSLTDFDLSCLTSCKPQLLVPSTNDKKKGQHGPIFMAEPMRASNSFVGTEEYIAPEIITGSGHTSAVDWWALGILLYEMFYGYTPFRGKNRQRTFANILHKDLKFPKSKQVSLGAKQLIYYLLQRDPTSRLGSKGGANDIKNHSFFKGINWALVRCTKPPELDAPLFDTNKEEKEKEDKYVDNGQRI

SEQ ID NO: 23075 - protein, 569 aa, Unknown
  Azoarcus sp. BH72
MAYNLGVPPGWRKATRNLPALSPPVIVTDTFTPPQRLPVWSSLEQHAARLRATRVRTLFDTDAGRFQRLSRSVCGLTVDFSKQRLDAAALADLLELASAAGLQDGIAGLFGAAQMNFTEGRAALHMALRGSCPAPGGEDVTRYFREARSFARALREGGIKGATGKSINHVINLGIGGSDLGPRMVFEALAHTHRPVKVDFVANIDPRDLDEALAGVDPERTLFIVSSKSFGTAETLSNATAARAWLASTLPARVADNALAVHFAAVSNATASAAAFGIPPERVFPLPEWVGGRYSVWSAIGLPLLIAFGEAGFDAFLAGGRDLDQHFLKAPLADNLPVLMGLVGLWNTDFLGLETLAVLPYAHGLRNFAMWLQQLEMESNGKRTLRNGEASAVQTSPVVWGGVGTVGQHAFHQLFYQGTRTIPMDFIVPVGDDDPRQRGLVDNAFAQAAALMNGRDLATATAALAAKGMTPDEVERLAPHLVCPGNQPSTTILLPQLDAYHLGALLALYEHKVFVQGWIWGINSFDQYGVELGKEMARALAQGGSAECDASTAGLMAAAAAIRASNRAR

SEQ ID NO: 23076 - protein, 123 aa, Prosthecochloris aestuarii
MSVRDYECDIQGIVNNSVYQNYLEHTRHEYLKSVGIDFKAYALEGINLVVVRAELDYRFPLESGDAFLVGLNLTRTSRLKFTFHQDIYRERDRRLILNAKITGTALNERGRPEIPPALDRLMA

SEQ ID NO: 23077 - protein, 271 aa, Zea mays
  misc_feature (183)..(183): Xaa can be any naturally occurring amino acid
NIMRLTGITGIVNGMDVSEWDPSRDKYIAVKYDVSTAVEAKALNKEALQAEVGLPVDRNIPLVAFIGRLEEQKGPDVMAAAIPQLMEMVEDVQIVLLGTGKKKFERMLMSAEEKFPGKVRAVVKFNAALAHHIMAGADVLAVTSRFEPCGLIQLQGMRYGTPCACASTGGLVDTIIEGKTGFXMGRLSVDCNVVEPADVKKVATTLQRAIKVVGTPAYEEMVRNCMIQDLSWKGPAKNWENVLLSLGVAGGEPGVEGEEIAPLAKENVAAP

SEQ ID NO: 23078 - protein, 235 aa, Oryza sativa
MAGDGELKLLGMWTSAFVLRVRFVLNLKSLPYEFVEENLGDKSDLLLASNPVNKTVPVLLHAGRPVNESQVILQYIDEAWPDRPPAVLPSDPYERAVARFWAAYVDDKVRLAWLGILFRSETEEERAAAVAQADAALETLEGALRECSGGKPFFGGDGVGLVDVVLGGYLGWFTAIKKLIGRRMIDPARTPALAAWEDLFRATDAARGVLPDDADKMLEFRQTALALGASKKITL

SEQ ID NO: 23079 - protein, 801 aa, Bacillus anthracis
  misc_feature (387)..(387): Xaa can be any naturally occurring amino acid
MKKRLVMIGNGMAGIRCMEEILKHDCDSYEITIFGDEPHPNYNRIMLSHVLQGKTNIQDIIMNEYSWYEENEITLYTNERVQSIDREEKVIMTEKNRTLTYDKLIIATGSSAFILPVEGSTLPGVTGFRTIEDTQFMMDTAKEKKKAVVIGGGLLGLEAARGLIDLGMDVHVVHLMPSLMEQQLDTKAASLLREDLEAQGMKFLMEKKTVKILGTNHVEGIQFEDGEVVDCDLIVMAVGIRPNTQIARDAGLIVNRGIVVNDYMLTNDESIYAVGECAEHDGIAYGLVAPLYEQGAILAKHISNLQTDGYSGSIVGTQLKVAGCDLFSAGQIYEDDQTKAISIFNECKRSYKKVLIRDNKVVGIVLYGDTADGTRLFSMLKKEEDIXEYTPASILHKAGEESELDVATMSADDTICGCNGVTKGTIVHAILEQELTTFEEVKGCTKAAGSCGKCRPLVEQVLSHTLGDAFDASAQSAGMCGCTPLSRDEVVAAIHEKGLKSPKEVRNVLGFVHEDGCSKCRPALNYYLRMAIPEEYEDDKASRFVNERMNGNIQHDGTFSVIPRMYGGVTTADDLMKIAEVAKKYDVPLVKITGASRIGLYGVKKQDLPNVWADLNMTSGYAYSKSLRNVKSCVGSRFCRFGTKDSLGLGMLLEQSLEMVDTPHKMKMGVTGCPRNCAEVLTKDFGVVCVENGYQLYIGGNGGTEVREADFVMIVPTEDDVLHIATAYMQYYRETGIYGERTAYWTERLDFDHIKEILQDANMVTKLNERFQTARGTYKEAWGQALETKSLKAMYEVETVK

SEQ ID NO: 23080 - protein, 505 aa, Arabidopsis thaliana
GLELQLSYTLRHQHPVEYTVPIQLPVINQVFGTSRAVKISPNSPVARLRPVSGKYMLGEVVAVRVPLLHLSNFQINDWPELSTKRYALMVLMLPSDSARQWHVHELELVEVVADQVAVALSHAAILEESMRARDLLMEQNVALDLARREAETAIRARNDFLAVMNHEMRTPMHAIIALSSLLQETELTPEQRLMVETILKSSNLLATLMNDVLDLSRLEDGSLQLELGTFNLHTLFREVLNLIKPIAVVKKLPITLNLAPDLPEFVVGDEKRLMQIILNIVGNAVKFSKQGSISVTALVTKSDTRAADFFVVPTGSHFYLRVKVKDSGAGINPQDIPKIFTKFAQTQSLATRSSGGSGLGLAISKRFVNLMEGNIWIESDGLGKGCTAIFDVKLGISERSNESKQSGIPKVPAIPRHSNFTGLKVLVMDENGVSRMVTKGLLVHLGCEVTTVSSNEECLRVVSHEHKVVFMDVCMPGVENYQIALRIHEKFTKQRHQRPLLVALS

SEQ ID NO: 23081 - protein, 260 aa, Methanosarcina acetivorans
MELDEVIITRAIFDEYSKTFLDYTDIDVALVGGGPANLVAAKYLAEAGVKVALYEQKLSLGGGMWAGGMMFPRIVVQEEATRILDDFGIRYKEYESGYYVANSVESVGKLIAGATSAGAEVFNLVSFEDIMIRENDRVTGIVINWGPVTTQRLHVDPLMIRTKLVIDGTGHEAVVCNTILRKIPNAKIGELGLLGEKPMWSEVGERLAVNATQEIYPGLIVAGMAANAATRAPRMGPVFGGMLLSGEKAAKLALDRLKTI

SEQ ID NO: 23082 - protein, 505 aa, Arabidopsis thaliana
GLELQLSYTLRHQHPVEYTVPIQLPVINQVFGTSRAVKISPNSPVARLRPVSGKYMLGEVVAVRVPLLHLSNFQINDWPELSTKRYALMVLMLPSDSARQWHVHELELVEVVADQVAVALSHAAILEESMRARDLLMEQNVALDLARREAETAIRARNDFLAVMNHEMRTPMHAIIALSSLLQETELTPEQRLMVETILKSSNLLATLMNDVLDLSRLEDGSLQLELGTFNLHTLFREVLNLIKPIAVVKKLPITLNLAPDLPEFVVGDEKRLMQIILNIVGNAVKFSKQGSISVTALVTKSDTRAADFFVVPTGSHFYLRVKVKDSGAGINPQDIPKIFTKFAQTQSLATRSSGGSGLGLAISKRFVNLMEGNIWIESDGLGKGCTAIFDVKLGISERSNESKQSGIPKVPSIPRHSNFTGLKVLVMDENGVSRMVTKGLLVHLGCEVTTVSSNEECLRVVSHEHKVVFMDVCMPGVENYQIALRIHEKFTKQRHQRPLLVALS

SEQ ID NO: 23083 - protein, 577 aa, Synechococcus elongatus
MSGSASRSTAANPLELAWITPSAAQLASTADLYYVQDLLGRYLSFAWRSGQWLGLNSEQVVGSYLGEQFTPVDLNLYLARMRRAMHRGRAEQFRTGFRFQGQVYVFDLTLSPILQPQQASTLLLVIGRQQEPLPEALPEPPIAIAPPHHAKLFAQIAWDIRRTLDPETIWRHTVQGLGQALGLQRCLLCPYELGSTAIAIVAEYRQAHLPVVLGEQLAIARNPSLADALLSLRPTQAVVDFERSPAEPIWMVPTGYQDHPNGVLLLRSAEELTAGDRDLVWELADQVGTALAHARLYAQSQALALELQRANQTLLEQQQALIEAHRQSEALSQLKTDFLANTSHELRTPLTGMIGYLQLLQDDLAETPEERQEFIAGAYHSALHLLGIINDILDIARIEAGRLQLQAETVPLRNLLAEVETCLRSQAQAKGLVYRCRIAAETESVALWGDRQRSLQVLFNLVGNAIKFTLTGYVEVRATAVWQPLCANGQNLPGYLRLEIEDSGIGVAPERQGSLFQSFSQADSSLTRQFGGSGLGLVICRRLLESMGGIVELFSPGEGLGTTVTCLIPLAPAIIPS

SEQ ID NO: 23084 - protein, 665 aa, Mesorhizobium loti
MCGIAGILLAPDAANTNALRAIGPMMMALRHRGPDGEAFWMSREAGIAFGHRRLAIVDLSEAGRQPMHSASGRYVITFNGEIYNFRDLRRELEGAGHHFRGTSDTEVMLCAIESWGLEAALARFAGMFAFGLWDLKNRTLHLARDRMGKKPLYVASTPEALVFASELKAITCFPGFTPELDVDAAATMLSKGWVPDDRCIWQGVFKLPPGSVLSVTAADFANARGAGSLAHRIRRWWSLADVACKAQRDPIAGSDEDLTTELDSLLRLAVKERMVADVPLGAFLSGGIDSSTVVALMQAQSPTPVRTFTIAFGESGFDEAPHAAAVARHLGTDHTELHLSPAAALEVIPELPRIWDEPFADESQIPTLLVSRLARRHVTVALSGDGGDECFAGYSRHFLATRLRRQHELPSSFRRMLAAGAGLLAQASQKDIFGSLPLSANMRHGLRGDRLNRLARLFAAANEDQLLQRLTESSTNKLIHHKPAASNASATQLDGLLSRLLFDDMTGYLPGDILVKLDRATMANSLEGRCPILDHRVVEFAWRLPTDAKVRSGKGKWILRQLLDRYVPRRLVDRPKQGFDVPVGAWLRGPLRDWATDIIATTRLSGDGVIDCAKVDACWRDHLHGNQDHFRDLWPLLMFQAWRNDAMRPSAPATHASYDIELTGD

SEQ ID NO: 23085 - protein, 505 aa, Arabidopsis thaliana
GLELQLSYTLRHQHPVEYTVPIQLPVINQVFGTSRAVKISPNSPVARLRPVSGKYMLGEVVAVRVPLLHLSNFQINDWPELSTKRYALMVLMLPSDSARQWHVHELELVEVVADQVAVALSHAAILEESMRARDLLMEQNVALDLARREAETAIRARNDFLAVMNHEMRTPMHAIIALSSLLQETELTPEQRLMVETILKSSNLLATLMNDVLDLSRLEDGSLQLELGTFNLHTLFREVLNLIKPIAVVKKLPITLNLAPDLPEFVVGDEKRLMQIILNIVGNAVKFSKQGSISVTALVTKSDTRAADFFVVPTGSHFYLRVKVKDSGAGINPQDIPKIFTKFAQTQSLATRSSGGSGLGLAISKRFVNLMEGNIWIESDGLGKGCTAIFDVKLGISERSNESKQSGIPKVPAIPRHSNFTGLKVLVMDENGVSRMVTKGLLVHLGCEVTTVSSNEECLRVVSHEHKVVFMDVCIPGVENYQISLRIHEKFTKQRHQRPLLVALS

SEQ ID NO: 23086 - protein, 827 aa, Magnetospirillum magnetotacticum
MSLTRRDFIKANAVPATAAAAGLATPAIAQPAKANIRWDKGVCRFCGTGCSVLVGVQDGRVVATQGDPDSPVNRGLNCIKGYFLSKIMYGEDRLTRPLLRMKDGKFDKNGEFQPISWDQAFDIMAEKWKEQLKKPDGVTRVGMFGSGQWTIWEGYAASKLYKAGFRSNNLDPNARHCMASAVAGFMRTFGIDEPMGCYDDIEQTDAFVLWGSNMAEMHPILWSRVTDRRLTHEGCKVAVLSTFEHRSFELADIPMVFTPQTDLAILNYICHYIISKNAYNKEFIDKHVNFKKGATDIGYGLRPTHALEKDQANAATPDKADPMTFDEFKAFVAEYTVEKVSKLSGVPADKLEALAKLYADPKVKVVSFWTMGFNQHTRGTWVNNMIYNVHLLMGKISEPGNSPFSLTGQPSACGTAREVGTFAHRLPADMVVMNDKHREIAERCWKLPAGTINPKIGYHAVLQHRMLKDGKLNAYWVMCTNNMQTAPNMNEEGYPGYRNPANFIVVSDPYPTVTALAADLILPTAMWMEKEGAYGNAERRTQFWAPEGQGSGRGRSDLWQIMEFSKRFKIEEVWPEELIAKKPELRGKTLFEVLYKNGQVDKFPLTELQAGFENDEAKAFGFYPQKGLFEEYASFGRGHAHDLAPFESYHKARGLRWPVVDGKETLWRFREGYDPYVKAGEGVKFYGKPDGKAWIFALPYAPAAESPDKDFDLWLSTGRVLEHWHSGSMTRRVPELHKSVPNAVLYMHPNDAAKRNLRNGDVVKVASRRGEVTTRIDTRGRNKPPEGLVFMPFFDESQLVNKLTLDATCPISKETDYKKCAVKVSKA

SEQ ID NO: 23087 - protein, 363 aa, Wolbachia endosymbiont
LEVGRNASIDEIKKAYKKLALKYHPDRNPGNQEAEEKFKEVTAAYEVLSDSEKRAGYDRYGHEGASGGFQGFSSAGDFSDIFNDFFGGGFGGGASRSRAKRSTTGVSGADLRYDLEITLEDAFKGIQAPIHYVTNVKCDTCQGTGGEGAIKPVQCHTCQGSGRIRTQQGFFTIERTCTTCYGEGEIIQNKCKKCGGSGRRRDEVNISVSIPKGIEEGAKVRISGKGEAGTKGGKSGDLYVYVKIIFHKIFARNKADLHCKVPIRMTLAVLGGEIDIQSIDGAKIKVKVPEGTQTGTKLRCREKGMPYMNSHARGDLYVQVIVETLNPKNLTKKQIELLKALEEEENASVQQQSEGFFSKVKKK

SEQ ID NO: 23088 - protein, 161 aa, Brassica napus
MENVAAQLKRGISRQFSTGSMRRTLSRQFTRQSSLDPRRNNMRFSFGRQSSLDPIRRSPESLGCEPKMSVPENLDSTMQLLFMASKGDVDGVEELLDEGIDVNSIDLDGRTALHIASCEGHYDVVKVLLSRRANIDARDRWGSTAAVDAKYYGNMEVYNLL

SEQ ID NO: 23089 - protein, 375 aa, Sorghum bicolor
AEAPATRKDCFGVFCTTYDLKAEDKTKSWKKLVNIAVSGAAGMISNHLLFKLASGEVFGQDQPIALKLLGSERSFQALEGVAMELEDSLYPLLREVSIGIDPYEVFEDVDWALLIGAKPRGPGMERAALLDINGQIFADQGKALNAVASKNVKVLVVGNPCNTNALICLKNAPDIPAKNFHALTRLDENRAKCQLALKAGVFYDKVSNVTIWGNHSTTQVPDFLNAKIDGRPVKEVIKRTKWLEEEFTITVQKRGGALIQKWGRSSAASTAVSIADAIKSLVTPTPEGDWFSTGVYTTGNPYGIAEDIVFSMPCRSKGDGDYELATDVSNDDFLWERIKKSEAELLAEKKCVAHLTGEGNAYCDVPEDTMLPGEV

SEQ ID NO: 23090 - protein, 419 aa, Coxiella burnetii
MYEPTLTVESFDSELAGAIRDERRRQEHHVELIASENYVSPRVLELQGSVLTNKYAEGYPGRRYYGGCEFVDIAEQLAIDRAKELFGADYANVQPHSGSQANAEAYMALMNPGDTLLAMDLSHGGHLTHGSPVSFSGKFYKAVHYGLNAHGDIDYEQAAQLAQEHKPKVILAGFSAFSGIVDWQRFREIADSVNAYFMTDIAHVAGLVAAGVYPSPVQIADVTTTTTHKTLRGPRAGLILAKANPELEKRLNSAVFPGSQGGPLMHIIAAKAVAFKEAMQPEFKTYAQQILKNAKAMAEVMKERGYTIVSGGTQNHLFLVSLLDKNISGKEAEAALGRANITVNKNTVPGETRSPFVTSGLRIGTPAITTRGFKEKEASQLAHWVCDILDDIHNEKVIADVKQKAHELCGKFPVYQELD

SEQ ID NO: 23091 - protein, 322 aa, Thermus thermophilus
MKRIGVFTSGGDAPGMNAAIRAVVRQAHALGVEVIGIRRGYAGMIQGEMVPLGVRDVANIIQRGGTILLTARSQEFLTEEGRAKAYAKLQAAGIEGLVAIGGDGTFRGALCLVEEHGMPVVGVPGTIDNDLYGTDYTIGFDTAVNTALEAIDRIRDTAASHERVFFIEVMGRHAGFIALDVGLAGGAEVIAVPEEPVDPKAVAEVLEASQRRGKKSSIVVVAEGAYPGGAAGLLAAIREHLQVEARVTVLGHIQRGGSPTAKDRILASRLGAAAVEALVGGASGVMVGEVEGEVDLTPLKEAVERRKDINRALLRLSQVLAL

SEQ ID NO: 23092 - protein, 249 aa, Arabidopsis thaliana
MSHYIRPTFVRIVKKKSVEEYSPIPYLATLINCLVWVLYGLPTVHPDSTLVITINGTGILIEIVFLTIFFVYCGRQKQRLIISAVIAAETAFIAILAVLVLTLQHTTEKRTMSVGIVCCVFNVMMYASPLSVMVQVIVSSLTLFPIFKMVIKTKSVEFMPFWLSVAGFLNAGVWTIYALMPFDPFMAIPNGIGCLFGLAQLILYGAYYKSTKRIMAERENQPGYVGLSSAIARTGSEKTANTNQEPNNV

SEQ ID NO: 23093 - protein, 105 aa, Coprinopsis cinerea
MGVTPINSLEEFKTIINGDKPVIIDFWATWCGPCRIISPIFEKFSDTTDKVGFYKVDVDAQQEISQEVGVRAMPTFTVFQNGNKVDELVGAVPGKLEELVKKFSA

SEQ ID NO: 23094 - protein, 271 aa, Zea mays
NIMRLTGITGIVNGMDVSEWDPSRDKYIAVKYDVSTAVEAKALNKEALQAEVGLPVDRNIPLVAFIGRLEEQKGPDVMAAAIPQLMDMVEDVQIVLLGTGKKKFERMLMSAEEKFPGKVRAVVKFNAALAHHIMAGADVLAVTSRFEPCGLIQLQGMRYGTPCACASTGGLVDTIIEGKTGFHMGRLSVDCNVVEPADVKKVATTLQRAIKVVGTPAYEEMVRNCMIQDLSWKGPAKNWENVLLSLGVAGGEPGVEGEEIAPLAKENVAAP

SEQ ID NO: 23095 - protein, 120 aa, Lemna minor
KKACIVFFDEVDAIGGARFDDGVGGDNEVQRTMLEIVNQLDGFDARGNIKVLMATNRPDTLDPALLRPGRLDRKVEFGLPDLESRTQIFKIHTRTMNCERDIRFELLARLCPNSTGADIR

SEQ ID NO: 23096 - protein, 124 aa, Legionella pneumophila
MGGSAFNVMEKNMKMITAIIKPFKLDDVHEALMEIGVPGITISETRGFGRQKGHTELYRGAEYVVDFLPKIKIELALPDNMVEAAIEAICKSAYTGKIGDGKIFVYALEQVVRVRTGEVGTDAL

SEQ ID NO: 23097 - protein, 192 aa, Unknown
  Rhizobium sp. CCBAU 41044
APLWGFDGSSTMQAEGRSSDCVLKPVAIYPDPARTNGVLVMCEVMMPDGVTPHASNARATILDDEDAWFGFEQEYFFYENGRPLGFPESGYPAPQGPYYTGVGYSNVGSVAREIVEEHLDLCLAAGINHEGINAEVAKGQWEFQIFGKGSKKAADQIWMARYLLQRLTEKYGIDIEYHCKPLGDTDWNGSGI

SEQ ID NO: 23098 - protein, 216 aa, Pseudomonas syringae
MARSKTSHNWLKEHFDDKYVKMAQKDGYRSRASYKLLEIQEKDKLIRPGMTVIDLGAAPGGWSQVTSRLIGGQGRLIASDILEMDSIPDVTFIQGDFTEDKILEQILEAVGNTQVDLVISDMAPNMSGLSAVDMPRAMFLCELALDLAGRVLRPGGDFLIKVFQGEGFDVYHKDIRKLFDKVQMRKPSSSRDRSREQYLLARGFRGIDGAASIERF

SEQ ID NO: 23099 - protein, 72 aa, Glycine max
  misc_feature (27)..(27): Xaa can be any naturally occurring amino acid
MNICYICLYNCITLLHDFEGKTKMKEXLTRVSKMGAADELTPQQARQLHFHLASSYSSFMAMLLHDWVGVCL

SEQ ID NO: 23100 - protein, 469 aa, Streptomyces coelicolor
MNLRLAAALCAALSLCAVLAVPANFPALGGDARLTLAVFALATCAWIGTPIDDTYIALGAGLALTATGVISSDTLFGTLGEDTVWLLICAFVLAAAVARTGLAGRAAAFLVGGARTVRQLVHLTTAALVVTAFAMPATSGRAALALPVFLALAKVLADRKRLVVMLALLFPTVILLSAVATLIGAGAHLITVSVLWEATGDRIGFTQWLLLGLPLAVASSHLAAETVLLTTTRRADRAGPVRITAEEIQRHSESPVTGPWTQAEKRCALLLATVVALWCSEPLHRVSPAVVALIGAVVASSPALGTVRLKDALKTVPWSLLLFMAATMAMGVALADSGAAGWLVSGLPADVAPAVFLGVVVAVSTAAHLVLQSRSARSSVLVPLVIAAAVGAGVNPVAAALASTAAAGFCHTLPASAKPVTLFSDVPGVPTYTPRDLLRLSAVLAPLTALLVLFFAAAVWPLLGVPVTR

SEQ ID NO: 23101 - protein, 480 aa, Prosthecochloris aestuarii
MRLRTDNDTDDHHAPKTITPGSGHCNDWQTDIPFMTTDHQANAEITRLPKEFLDRLAKPFTHFLHIEAAGGAILLLFTVAALVLSNSPWAHMFEQAWKTKIGLQLDSLEYARSLREWINDGLMTLFFFLVALELKRELVLGELNKPRMAMLSISAALGGMIFPAAIYLTLQSGQPGEHGWGTVMATDTAFVIGCMALLGSRIPQSLRVFMLSLAIVDDIGSILVVAIGYSSNISWGALAVAALGVVIVRAIAMLGFRSFPPYILIGGMIWLAIDTSGIHATITGVILGLMTPARRWVSADRLYAILDQVVAHPHGGARGSADTKDRQTLQVAEIAARETLSPVERLEIALHPWIGFCIMPLFAFANAGLPLSLSDLGNSVSIAVFAGFVLGKPLGILSFSWLAVRTHIAMRPPELSWRLIAGGSLLGGIGFTMALFIANIAFDNSVITSAKLGIFLASIFSATAGLSMLRWFPASGKPAQ

SEQ ID NO: 23102 - protein, 143 aa, Cicer arietinum
MPRGTLEVVLISAKGLEDNDFLSSIDPYVILSYRAQEHKSTVQEGAGSNPQWNETFLFTVSDSASELNLRIMEKDNFNNDDNLGEAIIPLEAVFEEGSLAENAYKLVKEQEYCGEIKVALTFTPERNDEEETCGGWKESTRDF

SEQ ID NO: 23103 - protein, 505 aa, Arabidopsis thaliana
GLRLQLSYTLRHQHPVEYTVPIQLPVINQVFGTSRAVKISPNSPVARLRPVSGKYMLGEVVAVRVPLLHLSNFQINDWPELSTKRYALMVLMLPSDSARQWHVHELELVEVVADQVAVALSHAAILEESMRARDLLMEQNVALDLARREAETAIRARNDFLAVMNHEMRTPMHAIIALSSLLQETELTPEQRLMVETILKSSNLLATLMNDVLDLSRLEDGSLQLELGTFNLHTLFREVLNLIKPIAVVKKLPITLNLAPDLPEFVVGDEKRLMQIILNIVGNAVKFSKQGSISVTALVTKSDTRAADFFVVPTGSHFYLRVKVKDSGAGINPQDIPKIFTKFAQTQSLATRSSGGSGLGLAISKRFVNLMEGNIWIESDGLGKGCTAIFDVKLGISERSNESKQSGIPKVPAIPRHSNFTGLKVLVMDENGVSRMVTKGLLVHLGCEVTTVSSNEECLRVVSHEHKVVFMDVCIPGVENYQISLRIHEKFTKQRHQRPLLVALS

SEQ ID NO: 23104 - protein, 485 aa, Kluyveromyces lactis
MVRLGPKKPPARKGSMADVPANLMEQIHGLETLFTVSSEKMRSIVKHFISELDKGLSKKGGNIPMIPGWVVEYPTGKETGDFLALDLGGTNLRVVLVKLGGNHDFDTTQNKYRLPDHLRTGTSEQLWSFIAKCLKEFVDEWYPDGVSEPLPLGFTFSYPASQKKINSGVLQRWTKGFDIEGVEGHDVVPMLQEQIEKLNIPINVVRLINDTTGTLVASLYTDPQTKMGIIIGTGVNGAYYDVVSGIEKLEGLLPEDIGPDSPMAINCEYGSFDNEHLVLPRTKYDVIIDEESPRPGQQAFEKMTSGYYLGEIMRLVLLDLYDSGFIFKDQDISKLKEAYVMDTSYPSKIEDDPFENLEDTDDLFKTNLNIETTVVERKLIRKLAELVGTRAARLTVCGVSAICDKRGYKTAHIAADGSVFNRYPGYKEKAAQALKDIYNWDVEKMEDHPIQLVAAEDGSGVGAAIIACLTQKRLAAGKSVGIKGE

SEQ ID NO: 23105 - protein, 116 aa, Triticum aestivum
  misc_feature (41)..(41): Xaa can be any naturally occurring amino acid
  misc_feature (66)..(66): Xaa can be any naturally occurring amino acid
MATGGDRAAEELVSVEMPAPEGWTKKFTPKSRGKSEMVLAXPPGEEFKTRRQLTSYLKANPEGPTXSKLDWTTGDTPRRPARISEKEKVLDSPEGKRYQRVWDLMGKRDQEKGDLN

SEQ ID NO: 23106 - protein, 322 aa, Candida albicans
MPATTPIIYEDSLFESQDLFASPFKQQHQKVDTVATKNEIGLELNLGLPEMQKASETVSTPFQIHSSVLESVFSTNLDGVNDIDHTPMFDELDLIMDGAKVNSSEDWVALFGDDNDDGVAIAGATSKEPMLSLNEDNENNDDDADDDDDDDALVPREDTIEALLLEPSPNRTISAATSASTSSLNSPESTIATTVTAGGEVVVASKKQFQLVTPNPSSTLPTPLLDSKNSKKRVKVDHLGCVTYSKKHRSQPLQPIVVDDIKDAAALKRAKNTEAARRSRARKMERMSQLEDKVENLINEKQALQDQVERLQELLRVNGIQF

SEQ ID NO: 23107 - protein, 72 aa, Unknown
  Mesorhizobium sp. BNC1
MPKEEVLEFPGVVTELLPNAMFRVKLENDHEIIAHTAGRMRKNRIRVLTGDKVLVEMTPYDLTKGRITYRFK

SEQ ID NO: 23108 - protein, 505 aa, Arabidopsis thaliana
GLELQLSYTLRHQHPVEYTVPIQLPVINQVFGTSRAVKISPNSPVARLRPVSGKYMLGEVVAVRVPLLHLSNFQINDWPELSTKRYALMVLMLPSDSARQWHVHELELVEVVADQVAVALSHAAILEESMRARDLLMEQNVALDLARREAETAIRARNDFLAVMNHEMRTPMHAIIALSSLLQETELTPEQRLMVETILKSSNLLATLMNDVLDLSRLEDGSLQLELGTFNLHTLFREVLNLIKPIAVVKKLPITLNLAPDLPEFVVGDEKRLMQIILNIVGNAVKFSKQGSISVTALVTKSDTRAADFFVVPTGSHFYLRVKVKDSGAGINPQDIPKIFTKFAQTQSLATRSSGGSGLGLAISKRFVNLMEGNIWIESDGLGKGCTAIFDVKLGISERSNESKQSGIPKVPAIPRHSNFTGLKVLVMDENGVSRLVTKGLLVHLGCEVTMVSSNEECLRVVSHEHKVVFMDVCMPGVENYQIALRIHEKFTKQRHQRPLLVALS

SEQ ID NO: 23109 - protein, 170 aa, Arabidopsis thaliana
  misc_feature (100)..(100): Xaa can be any naturally occurring amino acid
  misc_feature (125)..(125): Xaa can be any naturally occurring amino acid
  misc_feature (146)..(146): Xaa can be any naturally occurring amino acid
MASSMLSSATMVASPAQATMVAPFNGLKSSAAFPATRKANNDITSITSNGGRVNCMQVWPPIGKKKFETLSYLPDLTDSELAKEVDYLIRKKWIPCVEFXELEHGFVYREQGNSPGYYDGRDWTXWEASLFGWTDSAPGLKESERXRRGTPRAFIRIFGFEKTPATPGHQ

SEQ ID NO: 23110 - protein, 173 aa, Triticum aestivum
MSRSVEPLIVGRVIGEVLDTFNPCVKMVTTYNSNKLVFNGHELYPSAVVSKPRVEVQGGDLRSMFTLVMTDPDVPGPSDPYLREHLHWIVTDIPGTTDASFGREVISYESPKPNIGIHRFIFVLFKQKRRQTVTVPSFRDHFNTRQFAAENDLGLPVAAVYFNCQRETAARRR

SEQ ID NO: 23111 - protein, 1110 aa, Aspergillus fumigatus
MPLIDNSRSNDAVQSSICNGISHTTIIESVRDPDYRHNDPNRRQKIVIVGLGMVAISFIEKIVKQDAERRKYDIVVIGEEPHIGYNRVGLSSFFEHRKIEDLYLNPKEWYGSFKDRSFDYHLNTKVTDIFPERKTVRTSTGDVIPYDILVLATGSDAVLPTHTPGYNAKGIFVYRTIQDLERLIEFASKHKGETAVTCRREAWFGLEAAKAMKDLRGFRKSQTHCPHQSGFWHRQAPTGDAGTTRNFGKIKRARPGPYYTEKRVPKRSKRDDRQQTSPGITFEDGEEIDCCCICFAIGVRPRDELGPPAGIQCAGRGGFVINESLQTSIPDIYAIGECASWENQTFGIIAPGIEMADVLSFNLTNPDKEPKSFKRPDLSTKLKLLGVDVASFGDFFADRDGPKFLPGQRPSIVDGSVGNADGDKEPSVKALTYKDPFAGIYKKYLFTMDGKYLLGGMMIGDTKDYVKLNQMVKSQKPLEVPPSQFILGAQKEGEENADDLDDDAQICSCHNVTKGDIVENVKSGTCKTIGEIKSCTKAGSGCGGCMPLVQSIFNKAMRDMGQEVIVCMHIPYSRADLYTVIAVKRLRTFVDVMQAVGRKPDSLGCEICKPAIAPILSSLFNQHIMDKELHDLQETNDRFLANIQRNGTFSVVPRVPGGEITADKLITIGQVAKKYNLYCKITGGQRIDLFGAKKQDLLDIWTELVDAGMESGHAYAKSLRTIKSCVGTTWCRFGIGDSVGMAIRLEERYKSIRSPHKLKGAVSGCVRECAEAQNKDFGLIATEKGYNIFVGGNGGAKPRHSELLAKDVPPEKVIPIIDRYLIFYIRTADKLQRTARWIENLPGGINYLREVIIDDKLGIGAEMEQQMEELVNSYFCEWTETVRNPKRRKYFQQFANSDETVDTVEVIKEREQQRPTYWPKDSAGEDFKGHQWSSLSWQPVIEANYFSDEHPQISSANIKRGDTQLAIFKVKGKYYATQQMCPHKRAFVLSDGLIGDDDAGKYWVSCPYHKRNFDNFELNGEQAGRCTNDESMNIATFPVEERDDGWVYMKLPPVEELDSVLGTEKWKVRKGEAPDPFQKVDKRYKGMRGKKACDISTKAPTTQAANIIDW

SEQ ID NO: 23112 - protein, 333 aa, Aspergillus oryzae
MQSVLKPIIGPKKEIHDLSGRVALITGGALGIGYEVARAFVLNGARVIMVNRKEEQGQAAIDKIKEEAGADAKIEWVPCDMGNLAQIKEVFTGIREREERLDLLILSAGINANQYGETHDKIDRHFQVNWLGQFYVCNLLFPLIRKTSKLPDTPAPRIVWETSEQHRAAPKVVHFGSLDEINNPAIDNTELYGRSKLAIILGVKYGFLDRVIKPNEDNIYVLSVHPGAVNTTMQQQWKDAYPGLLGKVLTTAMLAIGRDVEQGAFSALWAATSPEIEEKSWNGYYFSDSAQPGKETSQASDPTLGASLWDLSHRIIQDKVGKDAIVDWNSSKS

SEQ ID NO: 23113 - protein, 307 aa, Anabaena variabilis
MQETTILILGAGAWGASLANLALANGHRVRVWSRRGTETLAALLEDVDIILSAISMKGVREVASQIQSLTPSPETIFVTATKGLEPETIYTPSQIWQSCFPNHPVVVLSGPNLSKEIDQSLPAATVVASRIATAAATVQLAFSSSRFRVYTNPDPIGVELGGTLKNVIAIASGVCDGLHLGTNAKAALVTRGLTEMVRIGNCWGAKTETFYGLSGLGDLLATCNSPLSRNYQVGYQLAGGQTLAQILAKLPGTAEGVNTCQVLVQLARQQNIVIPITEQVYRLLQGEVTPQQALDELMLRDIKPEYN

SEQ ID NO: 23114 - protein, 516 aa, Oryza sativa
MASPPTASASASEAAESGRRSAPGPIDVPSPRDHLHHLLDRRDTPRVVHVEGTTMQRQRGEAAGDAGAAAAAKPEVKLVTGDGGYVLEDVPHVCDYLPDLPTYSNPLQDNPAYSVVKQYFVNPDDTVCQKAIVHKDGPRGNHFRRAGPRQRVFFESDEVHACIVTCGGLCPGLNTVIREIGGYRGFYACNTIDLSPKSVNDIHKRGGTVLGTSRGGHDTMKIVDSIQDRGINQVYVIGGDGTQRGAGVIFEEIRRRGLKVAVAGIPKTIDNDIPVIDRSFGFDTAVEEAQRAINAAHVEAGSAENGIGLVKLMGRHSGFIAHYATLASRDVDCCLIPESPFYLEGEGGLFRYLEKRLKENGHMVIVVAEGAGQKLINETKESMGKDASGNSILLDVGLWLSQKIKEHFKKIKTTINLKYIDPTYMIRAIPSNASDNVYCTLLAHSVVHGAMAGYTGFTVGQVNGRHCYIPFYPSFLSKKDVEDAKMEEERASKFFDGPPPNPKVEDKVASNGKAVK

SEQ ID NO: 23115 - protein, 377 aa, Idiomarina baltica
MSKYIFIMLAVLFTHLSMAQNEINEKQSHEQIATFAGGCFWCVEEAFEQMNGVREVISGFSGGTELNPTYQEVSAGKTGHTESVQVYYDPNIVSYAALLQKFWRIIDPTDNKGQFVDRGQQYRPEIFYHTDQQRKIAQQTKQYLAEHGPFKKPIVVPITRFKSFYPAEDYHQNYYDKNPIRYKVYTFNSGRYDFIEKFWGDTSDIDYQQYTNQNPNGVNQSNAAQARWKSYSKPSDEVLQQKLTDIQFEVTQEDGTEEPFNNAYWDNKRPGIYVDILSGEPLFSSTDKYKSGTGWPSFTQPITSDAVVEKEDNSWFYTRTEIRSRYGNNHIGHVFSDGPKPTGLRYCMNSAALEFIPLDEMKEHGYGDYIKYVTADN

SEQ ID NO: 23116 - protein, 671 aa, Idiomarina baltica
MCGIAGVFNHRVNDPIDAQTLVNMAAIMHHRGPDGYGYHIQSEQGIGFSHARLSIIDLDEERAKQPFLSADERLMLTHNGEFYDFKRIRADLTARGARFRTKSDSEIVLHLFERYGLEATLKELRGEFAFGLYDKDEDALYLVRDRFGIKPLYWTETDEGVVFGSELKVLFAHPQVKRAFSAEGLYHQLIQVMVPGSTAFEGVHQVQPGQVVKIKRNNGTLNIDTLKYWDVDFPNEHDYPGDEVDETEYVEGVREKLLEAVQHRMTADVPVGCYLSGGIDSCSILGLASASTQTSVKAFTIGFDSDDYDETPIAREMAEATDADHHIMALKANDLYDHFVKTLWHTERTIYNTLGVAKYLMSQEVHEAGYKVVMTGEGSDELFAGYPAFRKDMFLHGLDHLPEIERLEWQKLLEKNNQLFKGAMLAREEFSSDALNKKVGFTPSCVQPWLSCSSVAKPLINRDLQKQLGNYDPGQAIADTLDETYLAGRHPLDRAQYVWIKTMLEGQILTWGGDRVDMANSMEARPAFLDHHLAEYAFTVPPHLRIKGNKEKYVLREAMKGLLPETLYKREKFAFMAPPAHTDPEKWKAVERLAEEFLSEQAVKDAGLLDFDAVQAVFARHSSSDVTAEEQVQLDAVINHMLGVQVLHHHFVATDVPKQAQQRAQELGWHA

SEQ ID NO: 23117 - protein, 417 aa, Desulfitobacterium hafniense
MDFAPELITIGQKAKDAARKLAYAGTAAKNKALLAMAEALLNHEQKILEANRKDVEAAIQKGTKKSLVNRLALTSEGIRQMSDALKEVVNLGDPVGEGEFWTRPNGLRIQRTRVPLGVVAMIYEARPNVTVDAAALCLKSGNAVILRGGSEAIESNKILSKVIAGAAESQGMPTACIQLLENTNRQWVQQLMKMNGYVDVIIPRGGAGLIETVVKEATVPVIETGTGVCHAYVDGEADLAKGVSIVFNAKTQKPGVCNALEAVLVNEAVAQEFLPLLGEKFRDYGVEIRGCEKTCAILPYAAKAKEEDWGIEHLDLIISAKVVQGVDEAMDHIYQYGTKHSETIITENYTTAQRFLNEVDAAAVYVNASTRFTDGGRFGFGAEIGISTQKLHARGPMGLQALTTMKYMVYGEDHIVT

SEQ ID NO: 23118 - protein, 118 aa, Streptococcus pyogenes
MYNRLIIKMKWRKKMALEVTDATFVEETKEGLVLIDFWATWCGPCRMQAPILEQLSQEIDEDELKILKMDVDENPETARQFGIMSIPTLMFKKDGEVVKQVAGVHTKDQLKAIIAELS

SEQ ID NO: 23119 - protein, 411 aa, Nicotiana plumbaginifolia
MNALAATNRNFKLASRLLGLDSKLEQCLLIPFREIKVECTIPKDDGSLATFIGFRVQHDNARGPMKGGIRYHPEVDPDEVNALAQLMTWKTAVANIPYGGAKGGIGCSPSDLSISELERLTRVFTQKIHDLIGVHTDVPAPDMGTNPQTMAWILDEYSKFHGYSPAVVTGKPIDLGGSLGRDAATGRGVLFAAEALLRDHGKSIAGQRFVVQGFGNVGSWAAQLITEQGGKIVAVSDITGAIKNKNGIDIASLLKHVKENRGVKGFHGADSIDPNSILVEDCDVLIPAALGGVINRDNAKDIKAKFIVEAANHPTDPEADEILAKKGVVILPDIYANSGGVTVSYFEWVQNIQGFMWDEERVNTELKAYMNRGFKDVKDMCKTHNCDLRMGAFTLGVNRVARATTLRGWEA

SEQ ID NO: 23120 - protein, 364 aa, Salinibacter ruber
MGAAQRILCRSTSTPQPPPEPWFRCAGDGRSSANPISHAFVDSTMADETTTDTPDVQDEDAPDEDAPQTPDDTASDSTGEAAAADTDADAPDENAPDEDAPDAAPQDKDDGDDAPEESSSEEETSHRVTIEELLKAGAHFGHLTSRWNPRMEKYIFMERNNIHIIDLMQSQVLLDEAAEAAKRFARRGKKILFAGTKKQAEDIVREHAEECGMPHMVDRWLGGTMTNFQTIRKSIRRMEEIERMDRDGTLDKLKKKEKLMRLREHEKLEETLGGIRDMANLPSAIYIVDVQREDIAVSEANNLGIPIIAMVDTNGNPKNIDYPIPVNDDALSSIELVTSTLTDAVQEGLQERRMKKEEKKKAAA

SEQ ID NO: 23121 - protein, 413 aa, Thermoanaerobacter tengcongensis
MAVNPLKAVQEQIKNACELLNLEESVYEILKEPLRVMEVSIPVQMDDGTVKVFKGYRSQHNDALGPAKGGIRFHPDVTLDEVKALSMWMTFKCGVVGLPYGGGKGGVAVNPQELSPTELERLSRGYIRAISSIIGPEKDIPAPDVGTNAQVMAWMVDEYNKIVGYNSPAVITGKPLIYGGSKGRVDATGYGVALIAREAAKKLEMDIKNCTVAIQGYGNVGSYTGIHLQRLGAKIVGVVDIYGGVYNERGIDAEKLAEHVRKTGSVKDFEGTTSLTNEELFALDVDVLIPAALENQITEENAPNVKARMVCEAANGPTTPEADRILREKGIFVVPDILANSGGVIVSYFEWVQNLMNYYWTEEEIKERQEIVMINAFNNIYQLAQEYKVDMRTAAYMIAIKRIYEAMKVRGWI

SEQ ID NO: 23122 - protein, 170 aa, Haemophilus somnus
MSNKAIYLAGGCFWGVEGYFHRIDGVLDAISGYANGKTENPSYQDVLYNNTGHAETVKVIYEQNKLSLEDILQYYFRVIDPTSLNQQGNDKGTQYRTGIYYTDPQDREIILTALTQEQKKYSKPIVVEVLPLQRFDPAEEYHQDYLLKNPNGYCHIDIKKADEPLVKTYK

SEQ ID NO: 23123 - protein, 408 aa, Streptococcus thermophilus
MLATDFGLENLTGYFYQYRIKRGDQSIIVLDPYAKSLAAWNSDDASKGPEHKIAKAAFVDLANYGPKDLDYAKIPNFKSREDAIIYEAHVRDLTSDKAISAELKHQFGTFAAFAERLDYLKDLGVIHIQLFPVLSYYFVNEMQNGKRLDAHASSNSNYNWGYDPQNYFSLTGMYFEKPSDPDKRIEEFKNLVSAIHAHGMDVILDIFYNHTAKTAIFEDLEPNYYHFMDADGTPRSSFGGGRLGTTHYMSRRVLVDSIAYLTKEYKVDGFRFDTMGYHDAESIEKDYHAARALNPNLIMLGEGWVTYAGDENSPIQPADQSWMKNTDTVAVFSDDIRNILKSGYPNDGTPAFITGGKRDINKVFDNIKAQPTNFEADSPGDVVQYIAAHDNLTLFDIIAQSINQSRRI

SEQ ID NO: 23124 - protein, 676 aa, Arabidopsis thaliana
MSFFWLFPFLLHLSFADSLSPLSAPVQNFIHLNHSCPSSILTYSRNSTYFTNLKTLLSSLSSRNASYSTGFQTATAGQAPDRVTGLFLCRGDVSQEVCRNCVAFSVKETLYWCPYNKEVVLYYDECMLRYSHRNILSTVTYDGSAILLNGANISSSNQNQVDEFRDLVSSTLNLAAVEAANSSKKFYTRKVITPQPLYLLVQCTPDLTRQDCLRCLQKSIKGMSLYRIGGRFFYPSCNSRYENYSFYNETATRSSSPPSLPPRSTPQQQLKLAPPPLISERGKGRNSSVIIVVVVPIIALLLLFVAFFSLRAKKTRTNYEREPLTEESDDITTAGSLQFDFKAIEAATNKFCETNKLGQGGFGEVYKGIFPSGVQVAVKRLSKTSGQGEREFANEVIVVAKLQHRNLVRLLGFCLERDERILVYEFVPNKSLDYFIFDSTMQSLLDWTRRYKIIGGIARGILYLHQDSRLTIIHRDLKAGNILLGDDMNAKIADFGMARIFGMDQTEANTRRIVGTYGYMSPEYAMYGQFSMKSDVYSFGVLVLEIISGKKNSNVYQMDGTSAGNLVTYTWRLWSNGSPLELVDPSFRDNYRINEVSRCIHIALLCVQEEAEDRPTMSAIVQMLTTSSIALAVPQRPGFFFRSSKHEQVGLVDRLSINTSALCSVDDASITNVTPR

SEQ ID NO: 23125 - protein, 256 aa, Geobacillus stearothermophilus
MTIGKVYLVGAGPGDEKLITVYGRECLEPADVIIYDRLINRKLLRYAKPGAEVLYCGKEPGKHDTVQEQIHELLVWHAQQGKTVVRLKGGDPCVFGRVGEEAEVLAKAGIPFEIVPGVTSGIAVPAYAGIPVTHRDYAASVAMVSGHRSERIDWEALTRGCDTILVYMGAANLPDICGRLMAAGKPSDTPAAIIEWGTTERQRTVAATLSTLSDEAEQAGISHPAIIIIGDVVRLRETLQWFPERQGGVVDADASS

SEQ ID NO: 23126 - protein, 65 aa, Zea mays
  misc_feature (43)..(43): Xaa can be any naturally occurring amino acid
  misc_feature (52)..(52): Xaa can be any naturally occurring amino acid
MLRRSARCYRQIQNNPYPMFRYCRGVSDPKIRIYDVSMRRMAXSDEFPYCVXFVSWEKGNSLQRG

SEQ ID NO: 23127 - protein, 267 aa, Prunus persica
MASSTMALSSPSLAGQAVKLGSSVSNIVGEGRITMRKTASKSKNVSSGSPWYGPDRVKYLGPFSGEAPSYLTGEFPGDYGWDTAGLSADPETFAKNRELEVIHSRWAMLGALGCVFPELLSRNGVKFGEAVWFKAGAQIFSEGGLDYLGNPSLVHAQSILAIWATQVILMGAVEGYRVAGGPLGEITDPLYPGGSFDPLGLAEDPEAFAELKVKELKNGRLAMFSMFGFFVQAIVTGKGPIENLADHLADPVNNNAWSYATNFVPGK

SEQ ID NO: 23128 - protein, 324 aa, Sinorhizobium meliloti
MTARHTKVLIIGSGPAGYTAAIYTARAMLSPVLIAGMEQGGQLMITTDVENYPGYADPVQGPWMMEQMLNQAIHVGTEIVNDLVTDVDLSVRPFRIKTDSGTDWTADALIIATGAKAKWLGIETEPTFMGFGVSACATCDGFFYRNKEVIVVGGGNSAVEEALYLSNLAKTVTVVHRRDAFRAEKILQERLFAKPNVKVIWDHEVLEYLGTPAKPPMPASVNGVKLRNTKTGETSDMAIDGVFVAIGHAPAVELFKGKLRQKPNGYLWTAPDSTATDVAGVFAAGDVTDDIYRQAVTAAGMGCMAALEAEKYLAGHMPAAIAAE

SEQ ID NO: 23129 - protein, 462 aa, Desulfitobacterium hafniense
MSSEKDHHVELHRGLKNRHIQMIALGGAIGTGLFYGSATTIQLVGPAIIVSYLLGGTAIFFIVRALGEMCVDQPVAGAFSYFAYKYLGDFPGFFSGWNYWFNYIAVSMAELTVVGVYINFWYPNVPQWVTALAFLVIITLINLINVEAFGEFEFWFALIKVVAILAMIAFGLVMIFFGLGEQGAVGFSNLWTHGGFLPNGVWGLLLSLVIVMFSFGGVELIGITAAEADDPKRSIPKAINQVVWRILIFYIGALTILMILYPWDQIGTSGSPFVEIFSAIGIPAAAHILNFVVLTAALSVYNSGIYSNGRMLHGLALQGNAPKFLTKVSRNGIPINGVFASSAVTLIAVILNFLVPGKVFLYLISIATIAGIFNWAMILVTQLRFRKVEAEKGREDQLQFKMPLYPISNYIALAFLAMVVVLMAYIPDMVYSLYIGPIWIIILYIGYKFLRRNPETKPPHRE

SEQ ID NO: 23130 - protein, 297 aa, Bacillus cereus
MQVGLIGLGKMGLNLGKNLMDHKHEVVAFDLNASAVEEMKEYGATGTSSLNELVQSLQSPRVLWVMVPHAVVDSVIDEVTPLLSKGDILIEAGNSHYKESIRRYEQLKKDGIHFMDAGTSGGMEGARNGACYMIGGDQEAWDIVEPIFRDTAVENGYLYAGKAGSGHFLKMVHNGIEYGMMAAIGEGFEILEKSEFDYDYEKVSRVWNNGSVIRSWLMELTENAFSKDAKLDEIKGVMHSSGEGKWTVETALDLQTATPVIAMSLLMRYRSLDNDTFTGKVVAALRNEFGGHAVEKK

SEQ ID NO: 23131 - protein, 241 aa, Salmonella enterica
MATVSMRDMLKAGVHFGHQTRYWNPKMKPFIFGARNKVHIINLEKTVPMFNEALAELNKISARKGKILFVGTKRAASEAVKEAANSCDQFFVNHRWLGGMLTNWKTVRQSIKRLKDLETQSQDGTFEKLTKKEALMRTRELEKLENSLGGIKDMGGLPDALFVIDADHEHIAIKEANNLGIPVFAIVDTNSDPDGVDFVIPGNDDAIRAVSLYLGAVAATVREGRSQDLASQAEESFVEAE

SEQ ID NO: 23132 - protein, 532 aa, Arabidopsis lyrata
KTTLVELGRTLALEECALWMPTRTGLELQLSYTLRHQHPVEYTVPIQLPVINQVFGTSRAVKISPNSPVARLRPVSGKYMLGEVVAVRVPLLHLSNFQINDWPELSTKRYALMVLMLPSDSARQWHVHELELVEVVADQVAVALSHAAILEESMRARNLLMEQNVALDLARREAETAIRARNDFLAVMNHEMRTPMHAIIALSSLLQETELTPEQRLMVETILKSSNLLATLMNDVLDLSRLEDGSLQLELGTFNLHTLFREVLNLIKPIAVVKKLPITLNLAPDLPEFVVGDEKRLMQIILNIVGNAVKFSKQGSISVTALVTKSDTRDADFFVVPTGSHFYLRVKVKDSGAGINPQDIPKLFTKFAQTQSLATRSSGGSGLGLAISKRFVNLMEGNIWIESDGLGKGCTAIFDVKLGISERSNESKQSGIPKVPAIPRHSSFTGLKVLVMDENGVSRMVTKGLLVHLGCEVTTVSSNEECLRVVSHEHKVVFMDVCLPGVENYQIALRIHEKFTKQRHQRPLLVALTGNT

SEQ ID NO: 23133 - protein, 113 aa, Prosthecochloris aestuarii
MKLITAIIQEDKLDQVREALIQANISRISVSRISGHGRQEDIDIYRGRKIAPNLRPKIKLEIAVNEEFVDVAIDTIVDSARHGSGEIGDGKIFVTPLEQCVRIRTNERGGSAI

SEQ ID NO: 23134 - protein, 476 aa, Triticum aestivum
  misc_feature (139)..(139): Xaa can be any naturally occurring amino acid
  misc_feature (341)..(341): Xaa can be any naturally occurring amino acid
  misc_feature (374)..(374): Xaa can be any naturally occurring amino acid
  misc_feature (379)..(379): Xaa can be any naturally occurring amino acid
  misc_feature (423)..(423): Xaa can be any naturally occurring amino acid
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQXKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGXIPPDQQRLIFAGKQLEDGRTLADYNIQKESTLXHLVLXLRGGMQIFVKTLTGKNITLEVESSDTIDNVKAKIQDRRASHQTXSASSLLVSSLRTGAPSLTTTSEGVNLHLVLRSGVYEILSDLTGRHHLRLVLDT

SEQ ID NO: 23135 - protein, 532 aa, Arabidopsis lyrata
KTTLVELGRTLALEECALWMPTRTGLELQLSYTLRHQHPVEYTVPIQLPVINQVFGTSRAVKISPNSPVARLRPVSGKYMLGEVVAVRVPLLHLSNFQINDWPELSTKRYALMVLMLPSDSARQWHVHELELVEVVADQVAVALSHAVILEESMRARNLLMEQNVALDLARREAETAIRARNDFLAVMNHEMRTPMHAIIALSSLLQETELTPEQRLMVETILKSSNLLATLMNDVLDLSRLEDGSLQLELGTFNLHTLFREVLNLIKPIAVVKKLPITLNLAPDLPEFVVGDEKRLMQIILNIVGNAVKFSKQGSISVTALVTKSDTRDADFFVVPTGSHFYLRVKVKDSGAGINPQDIPKLFTKFAQTQSLATRSSGGSGLGLAISKRFVNLMEGNIWIESDGLGKGCTAIFDVKLGISERSNESKQSGIPKVPAIPRHSSFTGLKVLVMDENGVSRMVTKGLLVHLGCEVTTVSSNEECLRVVSHEHKVVFMDVCLPGVENYQIALRIHEKFTKQRHQRPLLVALTGNT

SEQ ID NO: 23136 - protein, 185 aa, Triticum aestivum
SWPVMAARVVADMDADRSECAEQLVGLAPCLQYVQGQARSPAPDCCGGLSQVLDKSPKCLCVLVKDKDDPNLGIKINASLGLALPSDCGNTKANVSHCPQLLHLPPNSKDAAIFSPGGDKGTAAAPANDNTVSMVNSRAQQATSAGAASSTATAGVALAALLAGYLARILRGDFLATAASFKSIW

SEQ ID NO: 23137 - protein, 524 aa, Bordetella parapertussis
MAPPGHVVPSPANGHRHDARPATRLPEPTSLRRTLSARHLTMIAVGGSIGTGLFVASGATIAQAGPGGALLAYLLVGIMVYFLMTSLDELAASMPVAGSFSTYGAKYVDEGFGFALGWNYWYNWAVTVAVDLVAAQLVMAYWFPEMPGVLWSAAFLALIVGLNALSARGFGEAEFWFALIKVIAVLAFIAMGVLMLLGIIRGGEHGGLAYWTLDDAPFAGGFAALIGVAMVVGFSFQGTELIGIAAGESKDPARNLPRAVRQVFWRILLFYVLAIAVIGLLIPYTDPQLLRNEVSDVSVSPFALIFERAGLLAAASIMNAVVLTSVLSAGNSGMYAATRMLYSLARDGKAPARFGRLSRSGVPLWALLATTAVAALCFLSFLFSPKAVYIWLLNTSGMTGFIAWLGIAISHYRFRRGYVAQGNNLADLPYVSPFFPFGPLFAFVLCLVITLGQNYHAFLQDRIDWTGAAATYVGIPLFLAIWAGYRLVRGSRFVRYRDMQFPDLRMRNRELNAMLSGDCAEPRR

SEQ ID NO: 23138 - protein, 441 aa, Yarrowia lipolytica
MGEKPNRIGRANISYINHDHIFLPSFQPSYPSRQLHPLISSQNKVHSSIVHLPKVASPSSPETQQHSQAPLFITHIMSGLPQALASGFAARVREGGTTLYINTTPMLRSARHNTAVNYAEFEEDFDANDFEDDDDDDQSQRESRDGSEEAEGDEDGTKKEEQDKFAGLKAPLVSNEPKRAAPPVRPVMYPQEVLEELSQVKEPTLIPIRVAVENIDVFRVQDFFLWDADEKILTPEQFATLTCADLDVPIGYSAQMSAQIKKQLAEYTAAPALPKDVEVHVIVELAVTVDKIVYEDKFEWDLSGEYATPQEFARTVVQDLGLGQEFYPAITYQLYETLGKLQKAWLERSIPLDVDNRAAFGLEAGLRVDQDNLGESWVPRVEEMTPEEMQKREMERDRSSRRLKRESARMAEVPYVDLDSLYSRKRRRRFDEDSRSGSPMW

SEQ ID NO: 23139 - protein, 428 aa, Starkeya novella
MNHSKPRAPVDRRRFLNLVGLAGAGAGAVAAGVRPAAAGATPDPDIVNIPGWTQSLGAGVNNHPYGIPSPFEKDVVRREVTWLTASSESSVSFTPLYALDGIITPNGLCFVRHHGGEAEIDPARHRFMIHGMVDKPLVFTMEDIKRMPGRTNRAYFLECAANSGMEWRGAQLNGCQYTHGMIHNVVYTGVPLRAFLEAAGVKPKGKWVLAEGADASAMTRSIPIEKAMDDCLVAWAMNGEALRPEQGYPLRLVVPGWEGNMWIKWLRRVEIGDQPWGQREETSKYTDLLADGRSRRFTFFMDAKSVVTNPSPQAPLRAKGPNVVSGIAWSGRGTITRVDVSLDGGKNWTTARIEGPALPRSMTRFYLDFDWNGQELLLQSRAMDDSGYLQPTKAELRAVRGENSIYHNNGIQTWLVRSNGEAENVEVS

SEQ ID NO: 23140 - protein, 204 aa, Kluyveromyces lactis
MNTEYDYLFKLLLIGDSGVGKSCLLLRFADDTYTNDYISTIGVDFKIKTVELDGKTVKLQIWDTAGQERFRTITSSYYRGAHGIIIVYDVTDQESFNNVKTWLQEIDRFGTAGVLKLLVGNKNDLTDKKVVDTEVAKEFADSIGIPFIETSALDSSNVEEAFLIMTKQIKESVAKQQKDNGRAEDKSNVNLKGQSLTGSNGGCC

SEQ ID NO: 23141 - protein, 587 aa, Corynebacterium efficiens
MAILQVVSHAERIKQFDHIFLPLFHFTFQHVNGVRIPGSQKDPYAKRRIAAMSATEVKEGGTGDTGGAREAGDVGEVMKVGDRREWHRRARGLITGVVLALLVYLFFPSNAVEVVAESAGFDPEAEYSREAMRITAATTVLMAAWWMTEAIPLPATALIPLIAFPLFQVSSFADAASPYANPTIFLFLGGFLLALGLQKWDLHRRMALAVVLAVGTRPKQLVLGFMVATGFLSMWVSNTATAVVMLPIGMSVLVLTAETVGGMKNQKKFATGLMLAIAYSASIGSLGTLIGTPPNALLAAYMSESHDITIGFGQWMLVGVPIAVIFTVIAWLVLTTVFKPEIDEIPGGKELIREEIKKLGPWTKPQISVGIVFLAAALSWVFIPLILDWTGSELAIHDAMIGIIAGVLLFTIPANFKNGERLLDWKTANETPWDVLILFGGGLSLSAMFTQTGLSLWIGEMAKGLGTLPVILLIFSVAALVLFLTEFTSNTATAATFLPIMGGVAVGIGLTAGGEQNVLLLTIPVALSATCAFMLPVATPPNAIAFGSGYVKIGEMVKGGVWLNIIALILITIATYLIAIPVFGIVL

SEQ ID NO: 23142 - protein, 212 aa, Zea mays
MGRRPARCYRYCKNKPYIKSRYCRGVPEAKLRIFDLGKKKAHVDEFPVCVHMVSLEFEQLSSEALEAARICANKYISKFAGKDGFHMRVRVHPWHVLRINKMLSCAGADRLQTGMRGAFGKPCGVVARVDIEQVLISIRTKESFKAAACEALRRAKYKFPGRQKILVSKNWGFTKFHKEEYNELRASGKIVPDGAHCKLISQHGPITKPHAH

SEQ ID NO: 23143 - protein, 917 aa, Arabidopsis thaliana
MAASVDNRQYARLEPGLNGVVRSYKPPVPGRSDSPKAHQNQTTNQTVFLKPAKVHDDDEDVSSEDENETHNSNAVYYKEMIRKSNAELEPSVLDPRGEYTADSWIERNPSMVRLTGKHPFNSEAPLNRLMHHGFITPVPLHYVRNHGHVPKAQWAEWTVEVTGFVKRPMKFTMDQLVSEFAYREFAATLVCAGNRRKEQNMVKKSKGFNWGSAGVSTSVWRGVPLCDVLRRCGIFSRKGGALNVCFEGSEDLPGGAGTAGSKYGTSIKKEYAMDPSRDIILAYMQNGEYLTPDHGFPVRIIIPGFIGGRMVKWLKRIIVTTKESDNFYHFKDNRVLPSLVDAELADEEGWWYKPEYIINELNINSVITTPCHEEILPINAFTTQRPYTLKGYAYSGGGKKVTRVEVTVDGGETWNVCALDHQEKPNKYGKFWCWCFWSLEVEVLDLLSAKEIAVRAWDETLNTQPEKMIWNLMGMMNNCWFRVKTNVCKPHKGEIGIVFEHPTLPGNESGGWMAKERHLEKSADAPPSLKKSVSTPFMNTTAKMYSMSEVKKHNSADSCWIIVHGHIYDCTRFLMDHPGGSDSILINAGTDCTEEFEAIHSDKAKKMLEDYRIGELITTGYSSDSSSPNNSVHGSSAVFSLLAPIGEATPVRNLALVNPRAKVPVQLVEKTSISHDVRKFRFALPVEDMVLGLPVGKHIFLCATINDKLCLRAYTPSSTVDVVGYFELVVKIYFGGVHPRFPNGGLMSQYLDSLPIGSTLEIKGPLGHVEYLGKGSFTVHGKPKFADKLAMLAGGTGITPVYQIIQAILKDPEDETEMYVIYANRTEEDILLREELDGWAEQYPDRLKVWYVVESAKEGWAYSTGFISEAIMREHIPDGLDGSALAMACGPPPMIQFAVQPNLEKMQYNIKEDFLIF

SEQ ID NO: 23144 - protein, 359 aa, Pyrococcus furiosus
MKVVIVGNGPGGFELAKQLSQTYEVTVIDKEPVPYYSKPMLSHYIAGFIPRNRLFPYSLDWYRKRGIEIRLAEEAKLIDRGRKVVITEKGEVPYDTLVLATGARAREPQIKGKEYLLTLRTIFDADRIKESIENSGEAIIIGGGFIGLELAGNLAEAGYHVKLIHRGAMFLGLDEELSNMIKDMLEETGVKFFLNSELLEANEEGVLTNSGFIEGKVKICAIGIVPNVDLARRSGIHTGRGILIDDNFRTSAKDVYAIGDCAEYSGIIAGTAKAAMEQARVLADILKGEPRRYNFKFRSTVFKFGKLQIAIIGNTKGEGKWIEDNTKVFYENGKIIGAVVFNDIRKATKLEKEILDFYS

SEQ ID NO: 23145 - protein, 411 aa, Desulfitobacterium hafniense
MFKNGSDHEQNTEQTIDKKALLFGLMSVFLCGIGFSIITPVVPFLVQPYISNPEEQAIAVTLLTSVYAACVFLAAPVLGALSDRYGRRPLLLICLLGSAIGYLVFGIGGALWVLFAGRIIEGITGGSIGTIFAYFADIIPPQQRTKYFGWVSAVVGVGTVIGPTLGGLLAKFGYSVPMYFGTVITLLNVVYGLFYMPESLDKNKRLQEISLIRLNPFIQLANILSMKSLTRLLVSAFLLWLPNGSLQAVFSQFTLDTFHWQPALIGLMFSIMGLQDIIAQGFIMPKLLLKFSDQQIAMLGMAAEIIGYSFIAASALFVFYPLLIAGMFIFGFGDSIFGPSFNGMLSKSVPSGEQGRIQGGSQSIQSLARMMGPLIGGQIYVSLGHAAPAFMGMLLIAAAIPVLHKRPQANM

SEQ ID NO: 23146 - protein, 128 aa, Volvox carteri
MSMAVRSSFAARVAGARPAVRAARPSARTVSVNAYKVTFKTPSGDKVVEVADDVYLLDAAEEAGMDLPYSCRAGACSSCAGKIVSGTVDQSDQSFLDDKQMEAGFVLTCVAYATSDLVILTNQEEGLY

SEQ ID NO: 23147 - protein, 385 aa, Vibrio harveyi
MSKRDFYEVLGVSRDASERDIKKAYKRLAMKYHPDRNQGDESAADKFKEVKESYEILTDPQKKAAYDQYGHAAFEQGGGGFGGGGFGGGGADFGDIFGDVFGDIFGGGRRGGGQQRAQRGADLRYNMELSLEEAVRGVSKEIEVPTLVHCDTCDGSGAKKGSSAETCGTCHGHGQVQMRQGFFAVQQTCPTCHGKGKIIRPCNECHGQGRKQKTKTLNVKIPAGVDTGDRIRLSGEGERGEMGAPAGDLYVQVHVKEHHIFEREGNNLYCEVPVSFLMACSMAALGGEVEVPTLDGRVNLKVPTETRAGRMFRMRGKGVKGVRGGGVGDLIVKLVVETPVNLSARQKELLKEFDESCGGDAQLSTNQNLKGFFNGVKKFFDDLTS

SEQ ID NO: 23148 - protein, 482 aa, Staphylococcus epidermidis
MEDNNMKRGLNSRHISMIAIGGAIGTGLFVATGSVISQAGPGGAILAYILIGIMLYFLMSSIGELATFYPVSGSFSSYSTRFVDSSLGFTMGWLYWGMWSLVTSVDIIVASNVLQYWDVFKVLNPLTWSLIFLTLLFLINIFSVKAFGETEFWLSLIKVITIIVFIIFGIMMIFGILGGHTYGFENYTKGQAPFVGGISGILSVLLVAGFSVGGTEVVAVTAGESNNPEKSMPKAIKQVFWRILLFYVLSIAVIAAIIPYTDPLLLNENESVSQSPFTIVFDRIGIAFAASVINAVILTSLLSAANSGIYTTSRMLFSLSADKQAPKFFGKLNDKTKLPMRALITTYIIIVLVIVYANFNANAVFNLLNIIGSMVIVVWGSSIWSQIRLRQAIKKQGKNPDKLLPYKAPFYPVGPIIVLFTLLFLLLGSSFGSIASGDILGVIRNFTPLFILAIIYIAHKLIKRTHFVKLEEIDLTPHNYKN

SEQ ID NO: 23149 - protein, 383 aa, Lactobacillus sakei
MAEKRDYYDVLGVGRDASDDEIKKAYRKLSKKYHPDINKAPDAEAKFKEVTEAYEALSDPQKRAAYDQYGHAGMNGGFGGGAGAGQGFGGFGGGAEGFGGFDDIFSSFFGGGARQQPNGPRQGSDLQYRMDLKFEEAVFGKETKISYSREAECHTCHGSGAKPGTSAETCHKCHGAGQIQVERQTPLGRMMSRETCDVCGGTGKEIKSKCDTCHGTGREEERHTVKVKVPAGVEDGQQMRLQGQGEAGSNGGPYGDLFIVFRVAPSDEFERDGAQIFVEVPISFVQAALGDEIEVNTVHGPVKLKIPAGTQTNTVFRLRGKGAPKLHGTGNGDQKVTVNVVTPKSLNSKQRDALKAFAVASGDSVNPQDNNLFDKILNKKHKK

SEQ ID NO: 23150 - protein, 408 aa, Nicotiana tabacum
MDEATCSTNALPPFLTKTYEMVDDPSSDAIVSWSSSNKSFVVWNPPDFARDLLPRYFKHNNFSSFIRQLNTYGFRKVDPEKWEFANEDNFFRGQPHLLKNIHRRKPVHSHSAQNLHGLSSPLTESERQGYKEDIQKLKHENESLHLDLQRHQQDRQGLELQMQVFTERVQHVEHRQKTMLSALARMLDKPVTDLSRMPQLQVNDRKRRLPGNSCLYNETDLEDTRAISSRALTWENMNPSSLLTINAELLNQLDSSLTFWENVLQDVDQAWIQQNCSLELDESTSCADSPAISYTQLNVDVGPKASDIDMNSEPNANTNPEVAAPEDQAAVAGTTTNVPTGVNDIFWEQFLTENPGSVDASEVQSERKDIGNKKNESKPVDSGKFWWNMKSVNSLAEQLGHLTPAEKT

SEQ ID NO: 23151 - protein, 415 aa, Sinorhizobium meliloti
MLDKKFVRRGLFLVFLILFLDIMGIAIIVPVLPTYLEELTGADIGEAAVDGGWLLLVYSAMQFLFAPLIGNLSDRFGRRPVLLASVLTFALDNLICALATSYWMLFIGRSLAGISGASFGTASAYIADVSDDENRAKNFGLIGIAFGTGFALGPVIGGFLGELGPRVPFYGAAALSFLNFIMGVFLLPETLAPANRRRFEWHRANPLGALKQMRHYPGIGWVGLVFFLYWLAHAVYPAVWSFVGSYRYGWSEGQIGLSLGIFGVGGAIVMALVLPRVVPALGERRTAALGLTFTALGMAGYAAAWEGWMVYAVIVATALESLADPPLRSIASVHVPPSAQGELQGALTSISSITTILGPLMFTQIFAFFTDPAAAHSFAGAPYALAGCLIVAALVIFLAKVGAGRGGAVRGAVRA

SEQ ID NO: 23152 - protein, 580 aa, Lotus japonicus
METATQLTSPPPPSAFDGTLGHHLARRLVEIGVRDVFSVPGDFNLTLLDHLIGEPQLNVIGCCNELNAGYAADGYARAKGVGACVVTFTVGGLSVLNAIAGAYSENLPVICIVGGPNSNDYGTNRILHHTIGLPDFSQELRCFQTVTCFQAVVNNLEDAHELLDTAISTALKESKPVYISISCNLPAIHHPTFARDPVPFFLSPKVSNQEGLEAAVEVAAAFLNKAVKPVIVGGPKLRAPKAQKAFLEFAEASGYAIAVMPSGKGFVPEDHPHFIGTYWGAVSTGYCGEIVESADAYIFVGPIFNDYSSVGYSLLVKKEKAIMVQPNRVTIGNGPSLGWVFMADFLTALSKKVKTNKAAMENYQRIFVPPGIALTREKGEPLRVNVLFKHIQAMLSGDSAVIAETGDSWFNCQKLRLPANCGYEFQMQYGSIGWSVGATLGYAQAATNKRVIACIGDGSFQVTAQDISTMIRCEQKTIIFLINNGGYTIEVEIHDGPYNVIKNWDYTRFVEAINNGQGKCWTAKVRTEDDLTEAIAAATGPQKDSLCFIEVFVHKDDTSKELLEWGSRVAAANGRPPNPQ

SEQ ID NO: 23153 - protein, 848 aa, Bacillus cereus
MQMIKRLINKSVLLLTIIVMLSSVFSFQSVKAVSNSKTTEVIIHYKEQSGNTKDWNLWIWGENANGNSYEFTGEDEFGKYAKINIDGDYNRVGFIIRTNEWEKDGSDRWIENIKDGRAEVWILSGDEKVYNSKPSSDLSIQKASIDSFNEITVTTNVPFHIKERNIEIEGIKIKNISPYDRNSGNITNKFKIITEQKIDLKQTYKVKIENVADTNTEIGKVIRSEEFDHSFYYGGNDLGNIYTPQHTKFRVWAPTASEAKLVTYKKWNDKIGTEINMQQSEKGTWKAELKGNQKGLYYTYKVKIGDKWIEAVDPYARAASVNGDKGAVVDLEETNPKKWKANKKLKFINPEDAIIYELHVRDLSIQPESGIKQKGKYLGVTEKGTKGPEGVKTGLDHIKDLGVTHVQFLPIFDYASVNEENVNEPQYNWGYDPKNFNVPEGSYSTNPYEPTVRITELKQMIQTLHDNNLRVVMDVVYNHMYSATESNFHKLVPGYYYRYNEDGTFANGTGVGNDTASERKMMRKFMIDSVTYWAKEYNLDGFRFDLMGIHDYETMNEIRKAVNQIDPSIILHGEGWDLNTPLAAELKANQKNAEKMKGIAHFNDNIRDGLKGSVFEEKENGFINGKENMEDRIKKGITAGIDYDTNSSTYQDPEQVLTYVEAHDNHTLWDKLELTNPSDSEEVRKQMHKLSSSILLTSQGIPFLHAGQEFMRTKYGDHNSYKSPDSINQMDWLRRATFNNEVDYMKGLIELRKKYSAFRMTSAEQIKTHVSFIDAPKNTVAYTIEGNKNEYFTVAHNANREAVEITLPSKGPWKALVDGKQAGSKPLYVVHDNKIKVPALSSFVLKLK

SEQ ID NO: 23154 - protein, 236 aa, Drimys granadensis
MTKRYWNINLEEMMEAGVHFGHGTRKWNPRMAPYISAKRKGIHITNLTRTARFFSEACDLVFDAASRGKHFLIVGTKNKAADSVASAAIKARCHYVNKKWLGGMSTNWSTTETRLHKFRDLKAEQKAGKLNRLPKRDAAMLKRQLSHLQTYLGGIKYMTGLPDIVIIVDQQEEYTALRECLTLGIPTICLIDTNCNPDLADISIPANDDAIASIRLILNKLVSAICEGRSSYIRNR

SEQ ID NO: 23155 - protein, 238 aa, Moorella thermoacetica
MAIISMKQLLEAGVHFGHQTRRWNPKMAPYIFTERNGIYIIDLQRTVKKIEEAYNFIRDLSRDGGKVLFVGTKKQAQESVKEEAERCGMFYVNVRWLGGTLTNFQTIRRRIERLKELERMEEEGTFDLLPKKEVAHLRGEREKLERFLGGIKEMKSLPDALFIIDPRKERIAVAEGRRLGIPIVAIVDTNCDPDEIDYVIPGNDDAIRAVRLLTSKMADAVIEGQQGQDQPEEEAVVE

SEQ ID NO: 23156 - protein, 337 aa, Prochlorococcus marinus
MALVQAAPGTVLITGTTSGVGLYATKSLVERGWRVITANRCSLRAEASASAVGLPTNSPRQLKHIQIDLGDLDSVRNGAKSLLEDLEKPLDALVCNAAVYLPRLKKPLRSPQGYEISMATNHFGHFLLIQMLLENLSKSSRPVWKGRSWGVESSRVVILGTVTANNKELGGKIPIPAPADLGNLSGFEEGFCDPISMASGKRFKPGKAYKDSKLCNMITTQELHRRFNSSPILFSSLYPGCVANTRLFRNTPKLFQWLFPWFQKLITGGFVSEALAGDRVAQVVSDPQFAISGVHWSWGNRQRKDRQQFSQELSDRVTDPVTSRKVWELSMRLVGLK

SEQ ID NO: 23157 - protein, 91 aa, Triticum aestivum
  misc_feature (35)..(36): Xaa can be any naturally occurring amino acid
  misc_feature (64)..(64): Xaa can be any naturally occurring amino acid
  misc_feature (69)..(70): Xaa can be any naturally occurring amino acid
  misc_feature (72)..(73): Xaa can be any naturally occurring amino acid
  misc_feature (75)..(75): Xaa can be any naturally occurring amino acid
  misc_feature (77)..(78): Xaa can be any naturally occurring amino acid
  misc_feature (82)..(82): Xaa can be any naturally occurring amino acid
  misc_feature (89)..(89): Xaa can be any naturally occurring amino acid
RAEFGTSGDAVDNAEDQDPNQRPRKKRYHRHTQHXXQEMEAFFKECPHPDDKQRKELSRELGLXPLHVXXWXXNXRXXMKNXHERHENXQL

SEQ ID NO: 23158 - protein, 230 aa, Dunaliella salina
DRNCKVIVVGNPCCTNALIAMENAPNLPRKNFNALTRLDENRAKSQLALKAGKFYTSVNRVAVWGNHSTTQVPDFLNAKIGGLPAMNVIRDNQWFKEEFTPKVALRGGALIKKWGRSSAASTAVSVADSIRSLITPTPPGDCFSSGVCSDGNLYGIQEGLNFSFPCRSKGDGDYEICNDFIIDDWLRMKIKAAEEELIQERDCVSHLIGREGGACQIGPGAPDTSVPGEN

SEQ ID NO: 23159 - protein, 592 aa, Prosthecochloris aestuarii
MCGIAGELRFDSAAASSTTVDAMLGILEPRGPDAQGVFAHNRICFGHRRLKIIDLSDCASQPMVDSALGLVLVFNGAVYNYRELCTELVGKGYSFFSQSDTEIIIKAYHAWGEDCVGHLQGMFAFAIWERDTGRTFFARDRLGIKPLYFTEDNASMRFASSLPALLKSGAVDTAIDPAALDCYMSFHSVVPAPWTIFRGIRKLPPATTMMVEPDGRKQQRTYWQPDYSRSDEERRRSAGEWIDAVHDALKLAVQRRLVADVPVGVLLSGGLDSSLVVGLLSELVQRHLSTFSVGFEDVAEEEGNEFRYSDIIAERYSTDHHKIFVDHRELQTHLSDCVRAMSEPMVSHDVIGFYLLSREVSQHVRVVQSGQGADEVFAGYHWYPPMMNTPPTEAYSTYSGVFFDRDFNEYRQAVNSSFITEDHAAAFVRNHFAMPGAEEPIDKALRLDSTIMLVDDPVKRVDNMTMAWGLEARVPFLDHELVELAAKIPAEYKVKDGGKYVLKEVGRRIIPHEVIDRPKGYFPVPALKYLEGEYLDMAKNILNQDAAKQRKIFNREYVDMLLNAPQDHITPLRGSKLWQITLLEYWLQEQGL

SEQ ID NO: 23160 - protein, 504 aa, Bordetella parapertussis
MKEHDAAQGGTRTETEVLLIGTGFSGLGMAVALKREGRRDFIVLERAGDVGGTWRDNHYPGAACDIQSHLYSYSFRPNPRWSRVYAPQPEILQYLRDTARDEGILDHVRFGANVVRAAWDAAQAAWLVDTTAGRFKAQVLISAAGHLSDPSFPDIEGLASFRGAVFHSANWDHSYDLAGKRIGVIGTGASAIQIVPELARDAGQLTVFQRSAPYVIPRRDHVYSEAEKGLFARFPEAAQELRDELFWGNESRFPQRRQVPAFIEQVTAMALSHLRKQVPDEALRAQLTPHYAIGCKRVLISNDYYPALQQPNVALETAGIARIDEQGVVLKSGGRVDLDLLVVATGFEAAELPIAERIHGRQGRRLSDQWRAGGQAFACTAVSGFPNFFLMLGPNTGLGAGSMIFMVETQINYIKGAVAFIFEHGAIVDPDPDAQRDYVESIYRRSAGTVWLDGGCSSWYLHPQSGKLTTLWPDFMTQFRKENGTFSRQGYQVALRAPHAAEQA

SEQ ID NO: 23161 - protein, 788 aa, Mycobacterium avium
MATDRIANPWGTRTPYAPGTRWPERIDTYLADGVTAESVDRWVQSAAVLHSNGDGLDIAVKDGRIVGVRGRAVDRVNHGRLDPKDLFGWQANASADRLTTPLLRVRGALRPCDWDTAMERIVARSRELLDRHGPSSIGFYTSGQLFAEEYYTQAAIAHGAIGTNHVDGNTRLCTATAAEALKESFGCDGQPGSYTDVDHADVIALFGHNVAETQTVLWARMLDRLAGSDPPAIVCVDPRLTPVARHATVHLAPLPGTNVALMNGLLHEIIGNGWIDRDYIDAHSVGFDELQCRVSEFTPEWVAEICGVAATDLRRAARLIGTAQRLLSTVLQGFYQSHQATAAAVQVNNIHLVRGMLGRPGCGVLQMNGQPTAENTRECGADGDLAGFRNWSNDSHVAELADLWNLEPLQIPHYGPPTHAMQMFRFAEEGTLRMLWVTATNPAVSLPELPRIRDILSQQRLFLVVQDIFLTETAALADVVLPAAAWAEKTGTFTNADRTVHLSEKAVEPPGSARSDLEIFLDYARRMDFRDKDGRPFPPWTDPESAFEAWKKCSAGRPCDYTGLSYAKLRGGSGIQWPCNTDHPDGIERLYEDGRFPAAPDYCEAYGKDLITGAPLQPDEYRSLNPSGKAIIKAAQYLPPHERPGPDYPFALITGRTIYHFHTRTKTARAQQLQDAAPEVWVEVSERDARRLGIEAGDLVHVSTPRGRITCAARVGGIRDGVLFVPFHYGYWDRDGGDHQRAGNELTATDWDPASKQPSFKTAAARLDMAPTHTAAPVSEAVAAGSPS

SEQ ID NO: 23162 - protein, 638 aa, Micromonospora echinospora
MNALVAAPSVTEGNQVKVFLVKPPIRGCMVEIGRHVPIGLAYVSSALRAAGHETEIFDSLAYTEDNHVVPDAELTTIERAKLERHPRWRHIMHWGARTERIEAALAASEADVVGISCMFTPYYESAYELARMAKRVLPNAKVIVGGQHGTVAFPHVLEVPEVDAVMLGEAEVTTVALLDAFATGRPLTELLGVAFRCGEGLCECATPGTPHIRPRAPFVADLDSLAPPAADQLDFDRYGNAVTLITSRGCPFSCSFCTVHATVGKQFRARDPQRVVDEIEHYVNVHGVRRFLVEDDNFTFDIERVHAICQEIVRRKLDVRLSLPNGMTVVKLTEDLVESMVSAGFDDLFLGLETTDAARLRKMRKGFTSLDKVSAGVALFEKFGLTASAAIIVGLPDQSLDAIVQDAVNLVLAGVEFWTNPFYPIYGSPDYQTCLTRGIVDPLTDPALFDQFNFAFANGVLAADELYTAWVGTLAMALWPKYVLEGAERREQGPVSAAEAGARLVEHSMAQLDPESPEELPATVRAIRESADGLLALGHPLGCVCVMQHVADADKGAGADQFCRFAGDMIAAAIALYSGQPQVSAQVGAQTAGDAEGCSFMVRPTGDERIGRIQRRFVELLDENRREAELVTAEAVSH

SEQ ID NO: 23163 - protein, 721 aa, Prochlorococcus marinus
MQGQTQSISFDGREIRLTTGRYAPQAGGSVMMECGDTSVLVTATRSTGREGIDFLPLICDYEERLYAAGRIPGSFMRREGRPPERATLIARLIDRPMRPLFPSWMRDDLQIVATCLSLDERVPADVLAVTGASMATLLAGIPFQGPMAAVRVGLLGDDFVLNPSYREIERGDLDLVVAGTPDGVVMVEAGANQLPEGDVIEAIDFGYEAVCELIKAQQSILKDAGIKQVQPEPPTQDTKLSTYLEKNCSKSIGEVLKQFEQTKAERDSKLDAIKAKTAEAIDSLKEDDAVRKSVNANSKVLSNNFKALTKKLMREQIIKQGKRVDGRKLDEVRTITSAAGVLPKRVHGSGLFQRGLTQVLSTATLGTPSDAQEMDDLNPGPEKTYLHHYNFPPYSVGETRPMRSPGRREVGHGSLAERAIIPVLPPKDTFPYVLRVVSEVLSSNGSTSMGSVCGSTLALMDAGVPLKAPVSGAAMGLIKEDAEIRILTDIQGIEDFLGDMDFKVAGTKDGITALQMDMKITGLPVKTIAEAVNQARPARIHILEKMLEAIDAPRTSLSPHAPRLLSFRIDPELIGTVIGPGGRTIKGITERTNTKIDIEDGGIVTIASHDGAAAEAAQRIIEGLTRKVNEGEVFSGTITRIIPIGAFVEILPGKEGMIHISQLSEARVEKVDDVVKVGDEVTVRIREIDNRGRINLTLRGVPQNGEETQSEPAPTPVAPLN

SEQ ID NO: 23164 - protein, 450 aa, Unknown
  Erythrobacter sp. NAP1
MAVTDHVNLEQFMEGVKKRNPGQPEFVQAVHEVAQDIFEFMEDKVEYHEAQILRRIAEPDRIVSFRVCWEDDNHNIRVQRGWRVQNNNAIGPYKGGIRFHPSVTESVLKFLAFEQTFKNSLTGLPMGGGKGGANFNPKGKSDAEVMRFCQSFMTELYRHIGPDTDVPAGDIGVGGREIGYMFGQYKRITNRWEGVLTGKGQEYGGSQMRPEATGYGAVYFLQNMLKHQGKDVEGHTAVISGSGNVATHAAEKITQLGGKVLTLSDSGGFIHDPDGIDQEKIDWVKHLKTVKRGRISEYVDEFKSATFHEGRPWNIAADLALPCATQNELNEDEAKALVSNGCKGVSEGANMPTTLEGVKVFHDAKILYGPGKAANAGGVAVSGLEMSQNSERISWNHERLGEMLTDLMSGIHEKCTEYGEQDGGYVDYVKGANIAGFKKVADAMLAFGVV

SEQ ID NO: 23165 - protein, 481 aa, Unknown
  marine gamma proteobacterium HTCC2207
MIIIGAGLSGIGAACHLQLKHPNKSYKIIESRERMGGTWDLFRYPGVRSDSDMHTLGYSFKPWLDAKAIADGPAIRDYIKESAAEFGVDQHIHYQRKVVAAAWDSTTAKWTLTLENTSSDERRETEILTCNFIYSCTGYYRYDQGFTPDFPDADQFKGQVVHPQLWPEDLDYSGKRIVVIGSGATAITLVPSLAKTAAHVTMLQRSPTYVLSRPDVDSVSQKLRRWFPEQFAYDLTRWKNVTAQAILFQLSRRFPNYVKKLVRKVVHAWMGDDFDIDTHFNPSYNPWDQRLCLVPNGDLFRSLRKGTSSIVTDHIERFTENGIQLKSGEILEADIIITATGLELLLLGGLKLEVDGVEKKVSDSLTYKGMMFSGIPNLALAAGYTNASWTLKCDLTSNYVCRLISYMDRHNYQYCVANNDPSVKRLQFLDLASGYVDRAIDQFPKQGDKSPWKLHQNYLLDIMNLRLGSVRDSAMEFYKAK

SEQ ID NO: 23166 - protein, 177 aa, Unknown
  Halobacterium sp. NRC-1
MGTETATLGGGCFWCTEAAMEELAGVTDVTSGYAGGDTADPSYRDVCSGTTGHAEVVQVEYDTAELAYEDVLEVFFTVHDPTTVDREGPDVGSQYRSIVLPHDDQQHERATAFVDELAAADAFDGSIVTEIEPLETFYPAAEKHQNYFEKNPDAAYCTVNVAPKVSKVREQFGARTE

SEQ ID NO: 23167 - protein, 409 aa, Unknown
  marine gamma proteobacterium HTCC2207
MAAKSRCIILGASHAAAQLAPTLRQQGWTGSISMISNEYALPYHRPPLSKDYLAGTKTAEQILIRPAAVYSKCNVGITMGVTAAAIDRSNKQLLLDDGMALDYDKLVLTTGARVRKIDIPGVDLNGVFYLRDLNDAQQIKMFTGANKRAVIIGGGYIGLETASALRKLGMQVTVLEAMPRILQRVTAPEVAAFYSRIHAEEGVEIVADVQAVSISGAKQVESVQCHDGTEYEADIVIIGVGVIPNTELAEQAGLKIDNGIVVDEYARTSDEDILAAGDCTSHYNPIYQRHLRLESVQNALDQASVAANTICGNLKPYSALPWFWSDQYDLKLQIAGLSQGYTDVVVRGDIDGSRSFAAFYMREGKLLAVDAVNRPQEFMFGKKLIMQGNQLDTAQLADDSLSLKTLLTS

SEQ ID NO: 23168 - protein, 590 aa, Zea mays
MGRGGARAAPAAAVPPWHALPDEVWEHAFSFLPADSDRGAAACACHAWLRFERRSRRRLAVANCYAASPRDAVERFPAVRAVEVKGKPHFADFGLVPPAWGADAAPWVAAAAAGWPLLEEISFKRMVVTDDCLEMIAASFRNFQVLRLVSCEGFSTAGLAAIAAACRNLRELDLQENEIEDCSIHWLSLFPVSFTSLVTLNFSCLEGDVNITVLEQLVTRCSNLKTLKLNNAIPLDKLANLLRKAPQIVELGTGRFSADYHPDLFSKLEAAFAGCKSLRRLSGAWDAVPEYLPAFYCVCEGLTSLNLSYATVRGPELIKFISRCKNLQLLWVMDLIEDHGLAVVASSCNKLQELRVFPSAPFEAAEQVSLTERGLVDVSASCPMLESVLYFCRRMTNEALITIAKNRPNFTCFRLCIIEPHTPDYITHQPLDAGFSAIVESCKGLRRLSVSGLLTDSVFKSIGAHADRLEMLSIAFAGNSDLGLHYILSGCKSLKKLEIRDCPFGDKPLLANAAKLETMRSLWMSTCSMTLGACRQLARKMPRLSVEVMNDPRRGFPLDSLTDESPVETLYVYRTISGPRSDTPACVQIL

SEQ ID NO: 23169 - protein, 492 aa, Xanthomonas campestris
MTAKPRLNFWQIWNMCFGFLGIQFGFALQNANASRIFQTLGAQVDDVPGLWIAAPLTGLIVQPVIGYLSDRTWTPWGRRRPYFMVGAVFTTLALLVMPNAPMLWVAAGTLWVLDASINISMEPFRALVGDQLPPSQRPTGYAMQSFFIGIGAIVASFLPWLLTHWGIANTAPPGQLPDSVRYTFYLGAAVLFLSITWTVLRTREYSPEQLAGFDDAHPPLAQVASTGMAPTPMASVLWCGLGVLLATAIAWQHGDRMLYVLAGLCLAYGVLLALARMLPATSMLVAIVQDVRSMPMTMRRLAWVQFFSWFALFAMWIYTTAAVTQVHFGANDTASAAYNDGANWVGVLFGAYNGFAALAAVVIPLLVRAIGLRWGHLCNLWLGAAGLLSMLVIRDPQWLLLSMVGVGFAWASILSLPYALLSDSVPAPKMGVYMGIFNFFIVIPQLVAASALGFVLRVWLGGQPIYALAIGGLSLLIAGVCVVRVPVASGGQ

SEQ ID NO: 23170 - protein, 213 aa, Oryza sativa
  misc_feature (61)..(61): Xaa can be any naturally occurring amino acid
MHHQIWRLLPSALSPIHAGAPRPSRPPARLGRPSPQRRRALALALAHLATRRTCRLLAVSXAQSASPHAGLRLDQFFEVEMKVRDYELDQYGVVNNAIYASYCQHGRHELLECVGISADAVARSGESLALSELHLKYYAPLRSGDKFVVKVRLASTKGIRMIFEHFIEKLPNRELILEAKATAVCLNKDYRPTRISPEFLSKLQFFTSEGSSS

SEQ ID NO: 23171 - protein, 468 aa, Photorhabdus luminescens
MSKQQIGVVGMAVMGRNLALNIESRGYSVSIFNRSSDKTDEVIAENPGKKLVPSYTVEEFVDSLEKPRRILLMVKAGEATDKTIASLTPHLDKGDILIDGGNTYFQDTIRRNRELSAQGFNFIGTGVSGGEEGALKGPSIMPGGQKEAYKLVAPILQEIAAKAEGEPCVAYIGPDGAGHYVKMVHNGIEYGDMQLIAEAYSLLKNALNLSNEELSEIFTDWNNGELSSYLIEITADIFHKKDEAGQYLVDVILDEAANKGTGKWTSQSSLDLGIPVTLITESVFARYISSLKDQRVAAAQVLSGPDVQPFKGDKAEFIEKVRRALYLGKIVSYAQGFQQLKAASDEYQWDLNYGEIAGIFRAGCIIRAQFLQKITDAYNENVDIANLLLAPYFKKIADEYQQALRDVVSYGVQNGIPTPTFSAAISYYDSYRSAVLPANLIQAQRDYFGAHTYKRTDKEGVFHTEWME

SEQ ID NO: 23172 - protein, 516 aa, Moorella thermoacetica
MVSCNLLPAPYILIIKSPFGNDNSTNCKGGDNMATATQTGTQAVATGKKAGTRWAYFIIGLAVLGLFYILPVPAGMKPAAMRTLGVMATTVFWWLTETLPIPVTALMVPLMLHFTGILSLDKSVAQSFGDSFVPFLIGVLALSVAFTMSGLGKRITYLLLALSGTKVSRVIGIYFLVSFVISMFVTDVAVVAMMLPIVVGLLQSVDAKPGESNLGRGLMMAIMFGSTLGGICTPSGVASNVITMSFLTKNAKIGVSFLDWVAIATPIFVAVGIIAWWLILKIFPPEIKELPYGKDMIHKELKGMGSWSIEEITTMVVFLLAVVLWLTSSWNGLPIAFVSLLILGLLSMPGVGVFKKWSDVEKRLEWGALMLVVGGFALGLAASQSGLAQWVAQHALKPMTILPRPLQPLAVTLLVAVDSLGFSSFTAAASVNVPFIIAYAQQNALPVLSMALAAGFAASTHFILVTESPSFVLPYAYGYFSFKDLFKIGVILTIVSAGAIAIGLVLAGMPAGVPLH

SEQ ID NO: 23173 - protein, 578 aa, Photobacterium profundum
MYPNDVKIEEDHNAALKVKSDGNDEFTVFTSKLNQLLEDRHFSQANIIKAKEEAEKANAAKSSFLANMSHEIRTPLNGIIGMSGILSDTELNPSQAEYLQTIETSSQTLLLLINDILDLSKIESGNLVLSPHESNLAEVVYDTITIVQAKASEQGLNLQIQLDPELPTSVMLDEHRLRQVLMNLMSNAVKFTLQGSVTLSITYTDIGDKKASLLFSIKDTGIGIEKDKQQQVFAPFTQEDGSITRQFGGTGLGLAICRQLVELLGGSIELKSEKGVGSDFYFSLDVDVVKYQPKIISNFENKKCLLLSNQSSNAELIEIECKKWGLNVTISDIETAAVSGISQQYDLILYCQKTLNRTIKDIELFNRIQERPALVICSQLQDEQFDFGHTIDGLTILPLLGQRFVKAINSAFTNVLKNSEIQTKSALNPDSRLIDIKPVSINTTPVITESQDVILIVEDNIVNQKVASLLLKKAGYQIVVANNGQEAVDLITQKEPTLFKAILMDCMMPIMDGFAATEAIRLWEKEQHTDRLPIIALTASVLDEDISKCYEAGMDDYVAKPFRKEHLLDKLERLNEVA

SEQ ID NO: 23174 - protein, 305 aa, Brassica napus
MADRIKGPWSPEEDEQLRRLVVKYGPRNWTVISKSIPGRSGKSCRLRWCNQLSPQVEHRPFSAEEDATIARAHEQFGNKWATIARLLNGRTDNAVKNHWNSTLKRKCGGFDHRYDASAEDQRPVKRSVSDGYPPVANGLYMSPGSPTGSDVSDSSTLPVLPSVEVFKPVPRAGGVMLPLPIETSSFCDDPATSLSLSLPGADVSEESNRSHESTNNNTSRSHNTNTMSLMQFSGGFRGAIEEMGRSFAGDGGSEFMAVVQEMIKAEVRSYMAEMQRNHNGGGFVVGGFRDNGMIPMSQVGVGRIE

SEQ ID NO: 23175 - protein, 310 aa, Salinibacter ruber
MSTRPESLATVTDIDCTGQTALVTGSTSGIGRVAAYALGRLGAEVIVHGRDREAGEAVVEGIREEGGEAAFVAADFTEAAAIRTLAETVRTETDGLDLLLNNAGGLFREGRLVEGIERTFYVNHLAPYLLTAELLDHLREDARVVTMASDAHRGAELDLDRVRTVDGYSGMGAYAHSKLANVLFASELARRLDAAGRPAVSNSLHPGFVPGSQFGRFLPGPLSGLFQMLGVVPGTSSVADGAAELLHVAVSPDTADVSGRYFSGQSPTTPAAAARDRAAAERLWHRSAELLGMDVPLSDAVSGSAATDAS

SEQ ID NO: 23176 - protein, 244 aa, Azospirillum lipoferum
MEHATMRLDRFERYPLTFGPTPIEHLPRLTAALGGKVEIYAKRDDCNSGLAMGGNKLRKLEYIVPDAIASGTDTLVSIGGVQSNHTRMVAATAAKIGMKCVVVQESWVPHEDAVYDRVGNILLTRLMGADSRIVPDGFDIGIRKSWEEAIQSVKDAGGKPYGIPAGASVHKYGGLGYVGFAEEVRKQEADLGFKFDYIVVCVVTGSTQAGMIVGFAADGRGDRVIGIDASGTPEQTRTQVRQIV

SEQ ID NO: 23177 - protein, 355 aa, Shigella flexneri
MSQKYLFIDRDGTLISEPPSDFQVDRFDKLAFEPGVIPELLKLQKAGYKLVMITNQDGLGTQSFPQADFDGPHNLMMQIFTSQGVQFDEVLICPHLPADECDCRKPKVKLVEGYLAEQAMDRANSYVIGDRATDIQLAENMGINGLRYDRETLNWPMIGEQLTKRDRYAHVVRNTKETQIDVQVWLDREGGSKINTGVGFFDHMLDQIATHGGFRMEINVKGDLYIDDHHTVEDTGLALGEALKIALGDKRGICRFGFVLPMDECLARCALDISGRPHLEYKAEFTYQRVGDLSTEMIEHFFRSLSYTMGVTLHLKTKGKNDHHRVESLFKAFGRTLRQAIRVEGDTLPSSKGVL

SEQ ID NO: 23178 - protein, 396 aa, Streptomyces avermitilis
MSTKDFIEKDYYKVLGVPKDATEAEIKKAYRKLAREFHPDANKGNAKAEERFKEISEANDILGDTKKRKEYDEARTLFGNGGFRPGPGAQGGSFNFDLGDLFGGGAQQGGGAGGGFGGGIGDVFGGLFNRGGAGPGTGTRTQPRRGQDIESEVTLSFTEAVDGATVPLRMSSQAPCKACSGTGDANGTPRVCPTCVGTGQVARGSGGGFSLTDPCPDCKGRGLIAENPCEICKGSGRAKSSRTMQVRIPAGVSDSQRIRLRGKGAPGERGGPAGDLYVVVHVDAHPVFGRKGDNLTVTVPVTFAEAALGGEVKVPTLGGPAVTLKLPPGTPNGRTMRARGKGAVRKDGTRGDLLVTVEVTVPKDVSGKARDALEAYREATAGEDPRAELFQAAKGA

SEQ ID NO: 23179 - protein, 264 aa, Burkholderia cepacia
EDCNTGLAFGGNKTRKLEYLVPDALAQGADTLVSIGGVQSNQTRQVAAVAAHLGMKCVLVQEHWVNYEDPVYDRVGNIQLSRMMGADVRLVADGFDIGIRRSWEEAMESVRQAGGKPYPIPAGCSEHPLGGLGFVGFAEEVRAQEAELGFRFDYVVVCSVTGSTQAGMVVGFAADGRADRVIGIDASAKPEQTREQITRIARHTAELVGLGRDIVERDVALDTRYGGPEYGLPSDGTLEAIRLCARLEGMLTDPVYEGKSMHGR

SEQ ID NO: 23180 - protein, 496 aa, Solanum chacoense
MKKATVAAVVVGTAAAVAVAALIMRHRMGKSSKWARARAILKEFEEKCATPDGKLKQVADAMTVEMHAGLASEGGSKLKMLISYVDNLPTGDEGGVFYALDLGGTNFRVLRVQLGGKDGGIIHQEFAEASIPPNLMVGTSEALFDYIAAELAKFVAEEGEEFHPPPGRQRELGFTFSFPIMQTSINSGTLIRWTKGFSIDDTVGKDVVAELTKAMQKREIDMRVSALVNDTVGTLAGGRFTNKDVSIAVILGTGTNAAYVERAQAIPKWHGPLPKSGEMVINMEWGNFRSSHLPLTEYDHAMDTDSLNPGEQIFEKICSGMYLGEILRRVLLRMAEEAGIFGEEVPPKLKNSFILRTPEMSAMHHDTSSDLRVVGDKLKDILEISNTSLKTRRLVVELCNIVATRGARLAAAGILGIIKKMGKDTPRESGPEKIVVAMDGGLYEHYTEYSKCLENTLVELLGKEMATSIVFKHANDGSGIGAALLAASNSVYVEDK

SEQ ID NO: 23181 - protein, 375 aa, Unknown
  Synechococcus sp. RS9917
MADYYEMLGVGRDADADTLKRAYRRLARQYHPDVNKDPGAEDRFKEIGRAYEVLSDPQSRARYDQFGEAGLGGAAGMPDMGDMGGFADLFETFFSGFGGAGSGGRQRRRGPQQGDDLRYDLTIDFEQAVFGQEREIRIPHLETCTTCNGSGAKTGSGPTTCTTCGGVGQVRRATRTPFGSFTQVAECPSCNGSGQVIADPCTACGGQGVQQVRKKLRINIPAGVDTGTRLRVAGEGNAGLRGGPAGDLYVFLTVKPHPSLRRDGLTVLSEVKVSYLQAILGDTIEVETVDGPADLEIPAGTQPNAVLTLENKGIPKLGNPVARGNQRISVTVQLPTRLNDDERRLLEDLAGHHSARGEQHHHHKSGLFARLFGQR

SEQ ID NO: 23182 - protein, 264 aa, Pseudomonas fluorescens
EDCNSGLAFGGNKTRKLEYLIPEALEQGCDTLVSIGGIQSNQTRQVAAVAAHLGMKCVLVQENWVNYSDAVYDRVGNIEMSRIMGADVRLDAAGFDIGIRPSWEKAMSDVVEQGGKPFPIPAGCSEHPYGGLGFVGFAEEVREQEKELGFKFDYIVVCSVTGSTQAGMVVGFAADGRSKNVIGIDASAKPEQTKAQILRIARHTAELVDLGREITEEDVVLDTRFAYPEYGLPNEGTLEAIRLCGSLEGVLTDPVYEGKSMHGM

SEQ ID NO: 23183 - protein, 265 aa, Pseudomonas fluorescens
EDCNTGLAFGGNKTRKLEYLIPEAIEQGCDTLVSIGGIQSNQTRQVAAVAAHLGMKCVLVQENWVNYSDAVYDRVGNIEMSRIMGADVRLDAAGFDIGIRPSWEKAMSDVVEQGGKPFPIPAGCSEHPYGGLGFVGFAEEVRQQEKELGFKFDYIVVCSVTGSTQAGMVVGFAADGRSKNVIGIDASAKPEQTKAQILRIARHTAELVELGREITEEDVVLDTRFAYPEYGLPNEGTLEAIRLCGSLEGVLTDPVYEGKSMHGMI

SEQ ID NO: 23184 - protein, 520 aa, Pseudomonas putida
MLDATLKSQLKTYLERVTQPIEIVASLDDGAKSRELHDLLVEIAGLSNLITFSADGTDARRPSFSLNRPGDSISLRFAGIPMGHEFTSLVLALLQVGGHPSKASAEVIEQIQALEGEFTFETYFSLSCQNCPDVVQALNLMAVLNPNVRHVAIDGALFQEEVEARKIMAVPSIYLNGEVFGQGRMGLEEILGKIDTSAGARQAEKINAKDAFDVLVVGGGPAGAAAAIYAARKGIRTGVAAERFGGQVLDTLAIENFISVQETEGPKLATALEEHVKQYDVDIMNLQRGEALIPASEGGLHEVRLAGGASLKAKTVILATGARWREMNVPGEQEYRGRGVAYCPHCDGPLFKGKRVAVIGGGNSGVEAAIDLAGIVAQVTLIEFDSQLRADAVLQRKLHSLPNVKVITSALTTEVLGNGEKVTGLRYKDRTTDEQHDVALEGIFVQIGLLPNTDWLKGTVELSPRGEIIVDAKGQTSIPGVFAAGDVTTVPYKQIVIAVGEGAKASLAAFDHLIRTSAPA

SEQ ID NO: 23185 - protein, 268 aa, Pseudomonas fluorescens
EDCNSGLAFGGNKTRKLEYLIPEAIEQGCDTLVSIGGIQSNQTRQVAAVAAHLGMKCVLVQENWVNYSDAVYDRVGNIEMSRIMGADVRLDAAGFDIGIRPSWEKAMSDVVEQGGKPFPIPAGCSEHPYGGLGFVGFAEEVRQQEKELGFKFDYIVVCSVTGSTQAGMVVGFAADGRSKNVIGIDASAKPEQTKAQILRIARHTAELVELGREITEEDVVLDTRFAYPEYGLPNEGTLEAIRLCGSLEGVLTDPVYEGKSMHGMIITS

SEQ ID NO: 23186 - protein, 457 aa, Alteromonadales bacterium
MQVALVGLGVMGKNLALNLIDKGITLVAYDKNPHAGEELISCAKSQGMADKLHIVSDLGDMVRRLEAPRSILLLVPAGELVDTVCNELVNAGVECDDIIVDCGNSNYKDGITRKLKYQNKFEFATMGISGGAEGARHGPAMMASGSEGGWERIEPWFEKVAASYNGSSCFARVGQSASGHFVKMVHNGIEYALMQLIAEMYQLLRSGTNRSPKEVAAIFDEWSQGQLNSYLLSISSHILTLENDKNVPLVDLIDNKVGAKGTGLWTAQNALELGIAVPSLVAAVQARHLTNACDTTAAQEMTYASKSTNIVDIDLDELKDAFTLASLLAYRQGLALIKGASRTHQWKVDLSKTLQTWRAGCIIRADYLDSVAQGVEFIDSLDKEANALRKITGQAVMSGLAFPVLSSTQTYLATLTTPSNGHLVQAQRDYFGEHGIKTHSGETCHLTDLVEIDAKVR

SEQ ID NO: 23187 - protein, 180 aa, Streptococcus agalactiae
MLENDIKKVLYSEEDIILKTKELGAKLTADYAGKNPLLVGVLKGSVPFMAELLKHIDTHVEIDFMVVSSYHGGTTSSGEVKILKDVDTNIEGRDVIFIEDIIDTGRTLKYLRDMFKYRQANSVKVATLFDKPEGRLVDIDADYVCYDIPNEFIVGFGLDYAENYRNLPYVGVLKEEIYSK

SEQ ID NO: 23188 - protein, 250 aa, Bacillus clausii
MFDLTGKKAVVTGGARGLGKGIATALGNAGAEVVLIDISHQLDHIVQELKPRFKVHSVYGDLSTFAGREEAFQKAISLLNGKVDILVNSAGIHDRRACFDLPVTDFNKVMEINHTAVYHACQFFGKTMVEQGSGKMINLASMLTFFGGFNATAYAASKGAVGQLTKSLSNEWAGYGVQVNAIAPGYMATEMNKDLLEETNERLPQINARIPARRWGTPEDVGGAAVFLASDAANYVSGVILPVDGGYAAR

SEQ ID NO: 23189 - protein, 356 aa, Hevea brasiliensis
MSLLSDLINLNLSDTTDKIIAEYIWIGGSGMDMRSKARTLSGPVSDPSKLPKWNYDGSSTGQAPGEDSEVILYPQAIFKDPFRRGNNILVMCDAYTPAGEPIPTNKRHAAAKIFSHPDVVAEEPWYGIEQEYTLLQRDVKWPIGWPLGGYPGPQGPYYCSIGADKSFGRDVVDSHYKSCLYAGINISGINGEVMPGQWEFQVGPAVGISAGDELWVARYILERITEIAGVVLSFDPKPIQGDWNGAGAHTNYSTKSMRHDGGYEVIKKAIEKLGLRHKEHIAAYGEGNERRLTGRHETADINTFLWGVANRGASIRVGRDTEKQGKGYFEDRRPASNMDPYVVTSMIAETTILWKP

SEQ ID NO: 23190 - protein, 199 aa, Solanum lycopersicum
MASPSLSKSNFSLHSFSSSPSLSQFPHFTSITVVQPKFFPSQLTFKRCQNAPSFPIIRAQNSPDFVPDAKFYKVEAILRPWRIQQVSSALLKMGIRGVTVSDVRGFGAQGGLTERQAGSEFSEDTFVAKVKMEIVVSKDQVEGVIAKIIEEARTGEIGDGKIFLTPISDVIRVRTGERGEKAERMMGGHADMSSALSTS

SEQ ID NO: 23191 - protein, 248 aa, Picea glauca
MEHLNAAAAQASSSLYGVSMAEYGDVGVSSMMALMTQHDPHERDSILTTSMPSSFSSFHGHAECLLSAAMFQASQGDHKLKRQPEMDQLVSEQAVMSDSSMPSVKTEGCSSLRNQFEIRREQTGNCYTDQSSNAPVSPLVTSLVPQAGGEARMITSLEADSSHFSGGNEAEAIKAKILAHPQYPSLLGAYIDCQKIGAPPEVVARLDALTHEYENQQHRTTVSIGMDPELDQFMEAYCEMLTKYHEEL

SEQ ID NO: 23192 - protein, 413 aa, Burkholderia xenovorans
MNGPVSIEVLRQHLIDPEICIRCNTCEETCPVDAITHDDNNYVVKADICNGCMACVPPCPTGAIDNWRTVLKADAYPIDEQFTWDVLPEQNTMAVAAADELSGAGASGDTPADASGIEVDTVRGSVVPPWSAAKPYVNLYTHKAPTTATVVGNYRLTDGSTDSDIHHIVLDFGAMPFPVLEGQSIGILPPGSTADGRAHHARQYSIASPRDGERPGYNNISLTVKRVSQQHGDSTDGVCSNYLCDLKKGDVVNVIGPFGGTFLMPNHPNSHLLMICTGTGSAPMRAMTEYRRRRRLKGATGKLMLFFGARTKEELPYFGPLTNLPKDFIDTNLAFSRTPGQPKRYVQDAMRERAVDVAHMLRDENTHIYVCGLKGMEDGVLQALKEIGEQHQLDWDGLWARLKREGRLHLETY

SEQ ID NO: 23193 - protein, 730 aa, Moorella thermoacetica
MPGDLGVKLRVCEGMVEDARKGIVRVLTPVMDELGLKPNDVVAITGKRTTVARIMPAFQDGCPPGNIQMDGLQRQNAQVGIGEGVTLSPVEWETARTVVLAPVLPGWTLGGEHEIVHLKKHLIGRAVVPGDQVTIPQFSGGDEAFTVEGAAPRGAVVITRDTAVRFKGGEATEGRGQRVTYEDIGGLAREVQRVREIIELPLKYPQLFQRLGVEAPKGILMHGAPGTGKTLIARAVASETEAHFIHVNGPEIMHKYYGESEARLRQVFDEARRKAPSIIFLDEIDALAPRRADVHGDVEKRVVAQLLALMDGLESRGNVIVIAATNIPDLVDPALRRPGRFDREIAINVPDQRGRREILQIHTRGMSLAEDVSLDRLAAITHGFVGADLAALCREAGMYALRRALKSFQLGNERTEDLQLQVTMRDFLDALTEVEPSATREFAMEIPTATWEDIGGLEKIKERLQAMVEWPLRYPELFQQFGLQTPKGILLSGPPGTGKTLVAKALARESGINFIPVNSSLLFSHWWGEAEKTLHEVFRKARQASPCLLFFDELDALVPARKAGEGSSIGSRLVSQFLMELDGLEELREVIVLGATNRIDMIDPAVLRPGRFDQILEFPYPDQAARKEIFQIYLRNRPVDPGINLDSLAGAAEGLVGSEIEALCKRAALLAVSEVINHKGAGAYIKTCHLEQALAEIQAEKQQARTGAENHTLRPVWNNVVPGAISQVGR

SEQ ID NO: 23194 - protein, 429 aa, Ustilago maydis
MATQVHQLSLGPLTAHSFNADRTKVAVSPNSNVVHIYAQSSTGWTLEHTLAEHDKLVTGIDWAPSSNRIVTCSQDRNAYVWQLQPDSQTGAQVWKPTLVLLRLNRAATYVRWSPKEDKFAVASGARIISVCSFEEDNDWWVAKHIKRPLRSTVLSLDWHENNVLLAAGCADMKARVFSAYIKGVDAKPPASVWGERLPFGTVCGEFSTPSGGWVHGVSFSPSGDVLGFVGHDSSLTVVYPSGPEQPPAAVHVIRSPTLPYVTLTFINENQLIAAGHDCQPVLFQGDAETGWSIVKSLDAAGAAASKGAPPPPPPKAAGLAGPGRLNNEAFNRFKSADSRGGASSPAVAAGAGASIAGALGAVAGASVGADGELHTTHQNTITSVRPFSGAKNAIDHISSSGVDGRLCIFAVAHGTPVAGIQKGLSSLQL

SEQ ID NO: 23195 - protein, 724 aa, Bacillus anthracis
MYNSKPSSDLSIQKATIDSFHEITVTTNVPFNIKEKKIEMEGIKIKSISPYDINSGDITNKVKIITEQKIDLKQTYKVKIENLADTNTEIGKVIRSEEFDYLFYYGGNDLGNIYTPQHTKFRVWAPTASEAKLVTYKKWNDKIGTEINMQQGEKGTWKAELKGNQKGLYYTYKVKIGDKWTEAVDPYARAASVNGDKGAVVDLEETNPKKWNTNKKPKLKNPEDAIIYELHVRDLSIQPESGIKQKGKYLGVTEKGTKGPEGVKTGLDHMKDLGVTHVQLLPIFDYASVNEEKVNEPQYNWGYDPKNFNVPEGSYSTNPYEPTVRITELKQMIQTLHDNNLRVVMDVVYNHMYNAAESNFHKLVPGYYYRYNEDGTFANGTGVGNDTASERTMMRKFMIDSVTYWAKEYNLDGFRFDLMGIHDYETMNEIRKAVNQIDPSIILHGEGWDLNTPLAAELKANQKNAEKMKGIAHFNDNIRDGLKGSVFEEKENGFVNGKENMEDRIKKGITAGIDYDTNSSTYQDPEQVLTYVEAHDNHTLWDKLELTNPGDSEEVRKQIHKLSSSILLTSQGIPFLHAGQEFMRTKYGDHNSYKSPDSINQMDWLRRATFNNEVDYMKGLIELRKKYPAFRMTSAEQIKTHVSFIDAPKNTVTYTIEGNKHEYFTVAHNANREAVEITLPSKGPWKVLVDGKQAGSKPLYVVHDNKIKVPALSSIVLKSEKPIK

SEQ ID NO: 23196 - protein, 370 aa, Mycobacterium avium
MHDTDEVRLIEAQAVPTRFARGWHCLGLIRDFGDGKPHPINAFGQKLVVFRGGDGAINVLDGYCRHMGGDLSRGEVKGNEIACPFHDWRWGGDGRCKQVPYSRRTPRLARTRAWTTLQQDGMLFVWNDPEGNPPPPEVTIPRIEGAGSDEWTDWHWYSTVVQSNCREIIDNVVDMAHFFYIHGSLPKQFKNIFEGHVATQYMNSAGRPDIGGQGARMLGTTSVASYWGPSFMIDDLTYHYEDADHQTVLINCHYPIDANSFVLQYGIIVKKSDALPDDLAMQTAIALGDFVKLGFEQDVEIWRHKARIDNPLLVEEDGPVYQLRRWYQQFYVDVADVQPDMVDRFEFELDTTRPYAAWMKEVEANLAARA

SEQ ID NO: 23197 - protein, 334 aa, Chlamydophila pneumoniae
MKQHIGYLGMGIWGFCLASLLANKGYPVVAWSRNPDLIKQLQEERRHPLAPNVVISPNLSFTTDMKEAIHNAFMIVEGVTSAGIRPVAEQLKQITDLSVPFVITSKGIEQNTGLLLSEIMLEVLGDSVTPYLGYLSGPSIAKEVLNGSPCSVVVSAYDSQTLKQIHEAFSLPTFRVYPNTDIKGAALGGALKNVIAIACGIAEGLSFGNNAKAGLVTRGLHEMRKLAAIMDCKPETLNGLAGLGDLCVTCFSESSRNLRFGHLLAQGLTFEQAKAKIGMVVEGAYTALSAYQVAKHHKIDMPITTGIYRVLYENLDLKEGIALLLQRNTKEEFL

SEQ ID NO: 23198 - protein, 355 aa, Photorhabdus luminescens
MNQKLLFIDRDGTLITEPPTDFQVDRLDKLALETEVIPALLALQKSGFRLIMITNQDGLGTDSFPLEQFEPPHNLMMQIFSSQGIHFDEVLICPHKPEENCHCRKPKIKLVEKYLTEGLMDTANSYVIGDRETDLQLAKNMGIQGLHYHPKNLGWFAICEQLTRQDRHAHVQRITKETSINIDVWLDHEGSSDINTGVGFFDHMLDQIATHGGFRMHVQVKGDLCIDDHHTVEDTGLALGEALKLALGDKRGICRFGFVLPMDECLARCALDISGRPHLEYKAEFKHQRVGDLSTEMIEHFFRSLSYAMACTLHLKTKGSNDHHRAESLFKAFGRTLRQAIRVEGDTLPSSKGVL

SEQ ID NO: 23199 - protein, 374 aa, Hevea brasiliensis
MAISSSTSGTSSSLPSRTTVMLLLIFFTASLGITDAQVGVCYGMQGNNLPPVSEVIALYKQSNIKRMRIYDPNRAVLEALRGSNIELILGVPNSDLQSLTNPSNANSWVQKNVRGFWSSVLFRYIAVGNEISPVNGGTAWLAQFVLPAMRNIHDAIRSAGLQDQIKVSTAIDLTLVGNSYPPSAGAFRDDVRSYLDPIIGFLSSIRSPLLANIYPYFTYAGNPRDISLPYALFTSPSVVVWDGQRGYKNLFDATLDALYSALERASGGSLEVVVSESGWPSAGAFAATFDNGRTYLSNLIQHVKGGTPKRPNRAIETYLFAMFDENKKQPEVEKHFGLFFPDKRPKYNLNFGAEKNWDISTEHNATILFLKSDM

SEQ ID NO: 23200 - protein, 263 aa, Oryza sativa
MPPLLASTSSTSPLLLASRLRGGGGCGCGGAPLLHRTRRGFLAPSTTTTQTTRTSFAAMSWLGKLGLGGLGGSPRASAASAALAQGPDEDRPAAGNEFAQFGAGCFWGVELAFQRVPGVTRTEVGYSQGNLHDPTYEDVCTGATYHNEVVRVHYDVSACKFDDLLDVFWARHDPTTPNRQGNDVGTQYRSGIYYYTPEQEKAARESLEKQQKLLNRTIVTEILPAKRFYRAEEYHQQYLAKGGRFGFRQSAEKGCNDPIRCYG

SEQ ID NO: 23201 - protein, 117 aa, Impatiens walleriana
CYVQCGYCTTILLVSVPCSSLSMVVTVRCGHCTSLLSVNMTKSTFLPLHLLASMSPDEPKFDASPIVLKEGGNDQNPTDKRSLPHVMSSDDEDDDLIPLNHVVNKPPEKRQRAPSAY

SEQ ID NO: 23202 - protein, 815 aa, Solibacter usitatus
MAQSTESMVSTDASRHLPLLLLLFAGSGCAALIYETVWYQLLQLAIGSTSVSLGFLLATFMGGLCIGSVGLPRMKLAGQHPLRVYAWLELGIGVCAILVHFLLPLINMVYVAGAEAGMPGMLLRGFISAFCLLPPTILMGASLPAIVRWLKSTPNGVSWYGLLYGGNTAGAVFGCLLAGFYLLRIYNMAIATYVAAGINFTIALVSFGLAARTPQQASAPETDSAPLAAATSSAADGIPRWTIYAAIALSGATALGAEVVWTRLLGMLLGLTVYIFSIILAVFLIGLAIGSALGSMLLRSVRPRLALGWSQVLLTAGIAWTAWIISKSLPYWPINPLLTMSPWHTFQLDMVRCLWAILPPTLLWGASFPFAVAALTETGDDPGKTVGSVYAANTLGAIFGALIVSLALVPWIGTQDSQRALVWISLAGGVLILVPYIRARKSPGVAAALAAGVMAAAWLSSSLAPVPGELIAYGRRMAMNFGRSEVLYTVEGRNSSVAITRWNDGAIEIDVNGHVEATTEPYDMKLQRMVGHLPGMLHPNAKRVLGIGFGAGVSAGTFTRYPGIEHITVCEIEPVIPPTSTKFFGKQNYEVYLNPKTRVVFDDARHYLMTTKDMYDIIASDPLDVFAKGTAAIYSKEYFEAVKRHLNPGGLFTLYVPLYESDVRTVKSELATFFEAFPHSTIWANTVGGQGYDMVFMGHLEAPTINLDEMQARLDRPDYAPVAQSLHEIGVNTMVDLLSNYAGQNADLGKWSEGAEINRDVDLRLQYLGGWGINSTLEDAIYRQMLKFRRMPTTLFTGSPERVGALVEAIALTGR

SEQ ID NO: 23203 - protein, 611 aa, Cryptococcus neoformans
MPPRRQSQASQRKGKQPAQETQDDSDEETQGGRSGPLTDADIESRAGMLVRLALFQEYKRIPIRRTEVAKQILPDNTRAFPLVFARAQTILRDTFGCELYEIRARGKGDSTEDPSQTQAMTQTQKKGKGKGRQPNRGLDAIDEEEEEEDEEEEDATITQKVKRETGTKVYILQNILPGKIIEAMAEPAPLPHGIEVEGDDDDSGALLQWDKGDGGIIGHVGLLGIRTLILSLVLCHNRIINDDHLHALLRRLNLHRETVLPYASKDTTDPHLTLDKYLELLAKYQYLEKIKNPGPMGQAEGGTVEWKWGSREAEFSSKAAAKFMEEIMLGKEGESDSEEEDEDQPRRRGRGAPRERASRPQKRQKLRDDIIKAAGGVPLKPRHSAHYGQRQHPHQHLHPQQNYNHQHASMSEHGQEEYPPVPLQTGPMIAPHQDLHSFLESFWTRQMDTVEGETPDWKSYNLPLARIKKVMKSDEEVKMISAEAPIMFSKACEIFISELTCRAWLVAESHKRRTLQKSDVAAAIAYSDMFDFLIDIVPRDDGGVGGGGSGGGVGGSGTVTGAGSVVADEGMERDEDDPEGDEGEGEGEGEGEGFDGQEEEGDLYSEYVQGD

SEQ ID NO: 23204 - protein, 215 aa, Fagus sylvatica
MARRADEEYDYLFKVVLIGDSGVGKSNLLSRFTRNEFCLESKSTIGVEFATRTLQVEGRTVKAQIWDTAGQERYRAITSAYYRGAVGALLVYDVTKPTTFEQVWLKELRDHADSNIVIMLIGNKTDLKHSRAVRTEDAQGFMLRKKALSFIETSALKATNVEKAFQTILCLRFTGIISKKSLSSDEPAPSVIKEAVKHIVVGGSEANTKKPCCSN

SEQ ID NO: 23205 - protein, 461 aa, Haemophilus influenzae
MGEMASLKSHKNGIIFILDIVLFFVLLNVLPFEPKANSGLALLVFIAVLWLSEALHVTITALLVPLLAVALGLVSTKQALVGFADPTIFLFFGGFSLATALHIQKLDKMIANKIMALARGNLFIAVIYLFLITAFLSMWMSNTATAAMMLPLSMGILSQLDREKDHNTYVFVLLGIAYSASIGGMGTLVGSPPNAIVASNLHLTFSDWLWYGLPIMIILLPLMIGILYIIFKPKLHLNFEQTFENIEMNPMRILTFIIFSVIALTWIFSGKINPFISGLLGLQKNIASFDSIVALLAAIVICSTGVASWKQIQSNTDWGVLMLFGGGLTLSAVLKDSGASKILADSIVFMIDGQHFYLIGLLVAAFIIFLTEFTSNTASAALLVPIFISIAQSLGMPEIGLALIIGIGASCAFMLPVATPPNAIVFGSGQVKQSEMVKVGFLLNLVCVVVIATMGYMFWIK

SEQ ID NO: 23206 - protein, 450 aa, Helicobacter hepaticus
MSYASNVLNKLKEQYPSQTLFHQAVAEVFESLEPALQKDKKYETYAILERLTIPDREIHFRVSWTDDNGKIQTNRAYRIEFNAAIGPYKGGLRFHPSVNEGVIKFLGFEQILKNSLTTLAMGGGKGGSDFDPKGKSEGEIMRFCQAFMNELYRHIGATTDVPAGDIGVGGREIGYLFGQYRKLTNCFEGVFTGKAIPWGGSLVRTEATGYGCVYFAQEMLKDRGESLEGKVCSVSGAGNVAIYTIEKLLQLGAIPVTASDSQGMIYDKEGIDLALLKEVKEIKRLTLAEYAKARPQAVYTKVADYPKDSNPVWAIPCFAAFPSATQNELNGNDAKTLLANGCKCVSEGANMPSTIEAVHQFLDAKICYGPGKAANAGGVAVSGLEMAQNASMNPWTFEVVDKRLHTIMESIYANASETAKEFGEPTNLVLGANIAGFRKVAGAMIDQGVI

SEQ ID NO: 23207 - protein, 466 aa, Yersinia pestis
MMSDQQEGAELKRGLKNRHIQLIALGGAIGTGLFLGIAQTIKMAGPSVLLGYAIGGFIAFLIMRQLGEMVVEEPVAGSFSHFAYKYWGHFAGFASGWNYWVLYVLVAMAELTAVGIYVQYWWPEIPTWVSAAVFFLAINAINLANVKVYGEMEFWFAIIKVIAIIAMILFGGYLLISGRGGPEATVTNLWAQGGFFPNGIMGLVMAMAVIMFSFGGLELVGITAAEAEDPAKSIPKATNQVIYRILLFYIGSLAILLSLYPWGKVVEGGSPFVLIFDALDSNSVATVLNIVVLTAALSVYNSCVYCNSRMLFGLAKQGNGPKILLKVDGRGVPVIAIAVSAFATAFCVLINYLLPGRAFELLMALVVSALVINWAMISLAHLKFRAAKNRQGVIPKFKAFWYPFGNCLCLLFLTGILVIMFLTPSIRISVILIPVWVVVLAIGYILKNQSQRQNQQLSASSRKVTK

SEQ ID NO: 23208 - protein, 210 aa, Zea mays
  misc_feature (187)..(187): Xaa can be any naturally occurring amino acid
DARRFRSGIPGSTHASGRLLILQGSHGRAQPASSGLTDETAFSCCSDPDPSTKDFLLQQTMLRIKDPKKSLDFYTRVLGLTLLQKLDFPAMKFSLYFLAYEDKNDIPKDKSEKTAWTFSRKATLELTHNWGTEDDETQSYHNGNSDPRGFGHIGIAVPDVYSACKRFEELGVKFVKKPDDGKMKGLXAFIQDPDGYWIEILNPNKIATII

SEQ ID NO: 23209 - protein, 340 aa, Zea mays
PRVRNTEDQQEARDISLQAQDVDSMKDSGEVPDRTIEASTDDELELGTSADVEKNDQPTLLEPRPESVSVPELSVLDESDDKMQCGVSGKDEEAHVDEKTVTIVVDKVTGGSANCEDPLCEASRKESDIEKSHPSLGEEADDTIGGTVFPGSGSCELSCPQDGGIAVYEGPEMVSPESQTDARKENIHSDVAETDECTKTQKAALAGTEGENSAEDSGVPVSEMDKCNEMPKDAPTLTAAGANPAEDEASLKDLSVQTENKASSASPAPDDPKASDEKTLAEENQKLKELLQKLLASGNDQMGVITDLSEKVKVLERRLARKKRPKVRVPNPSRHASCVH

SEQ ID NO: 23210 - protein, 175 aa, Aspergillus oryzae
MSNNTQIATLAAGCFWGVEHLFRKNFGNGKGLLDAKVGYCGGETASPSYRAVCTGDTGHAEAVQVTFDPSIVTYRSLLEFFYRMHDPTTLNRQGPDVGTQYRSAIFTHGDEQEQIAKDVSEKVSKEWYKQPLSTDIVRAGQWWDAEEYHQLYLNKNPTGYECPAHYVRTFPPLSA

SEQ ID NO: 23211 - protein, 532 aa, Arabidopsis lyrata
KTTLVELGRTLALEECALWMPTRTGLELQLSYTLRHQHPVEYTVPIQLPVINQVFGTSRAVKISPNSPVARLRPVSGKYMLGEVVAVRVPLLHLSNFQINDWPELSTKRYALMVLMLPSDSARQWHVHELELVEVVADQVAVALSHAAILEESMRARNLLMEQNVALDLARREAETAIRARNDFLAVMNHEMRTPMHAIIALSSLLQETELTPEQRLMVETILKSSNLLATLMNDVLDLSRLEDGSLQLELGTFNLHTLFREVLNLIKPIAVVKKLPITLNLAPDLPEFVVGDEKRLMQIILNIVGNAVKFSKQGSISVTALVTKSDTRDADFFVVPTGSHFYLRVKVKDSGAGINPQDIPKLFTKFAQTQSLATRSSGGSGLGLAISKRFVNLMEGNIWIESDGLGKGCTAIFDVKLGISERSNESKQSGIPKVPAIPRHSSFTGLKVLVMDENGVSRMVTKGLLVHLGCEVTTVSSNEECLRVVSHEHKVVFMDVCLPGVENYQIALCIHEKFTKQRHQRPLLVALTGNT

SEQ ID NO: 23212 - protein, 117 aa, Tortula ruralis
ARATKAARKSAPTTGGVKKPHRYRPGTVALREIRKYQKSTELLIRKLPFQRLVREIAQDFKTDLRFQSHAVLALQEAAEAYLVGLFEDTNLCAIHAKRVTIMPKDIQLARRIRGERA

SEQ ID NO: 23213 - protein, 443 aa, Coprinopsis cinerea
MRQTLLAWLLCLGSLIGTSFAAPGRPSKAPRGFVQTRGRSFELDGKPFYFVGANSYWLPHLTNQRDVEATFREMRDAGIKVLRTWGFNAINATELPEALASNLTYYQVWDGPKWKLNDGPQGLHRLDNIVETAGKYGIKVIIAFTNNWGAYGGSSLYVNWIAGSQGTHDTFYTDRRIVAEYQRYVRVLVSRYKHSPNIFAWELMNEARCRGDMQGGPECVAGSDIITHWYREQSDFIRSLDRHHLITTGGEGHFYKRDEDIGYWLNGQWVSDYNYNGDAGEDFDVDLTLPNIDFGTYHIYPQYWYANLDNPERTNFTIGAWGLDWIRQHAESAKKANKPVVLEEFGTWGLQNKTEIYPRWVKTALDTDHAHVYDLIFLQRIMPWQFGMLGLKEHGGNRHIKYGDYIIDGASPNDSFTYYKNQTAVWKVFTDAAKVQALKSRRW

SEQ ID NO: 23214 - protein, 421 aa, Pseudomonas fluorescens
MRAQVQQGLVLGMSTLAFTVCFMVWMMFAVLGVPIKELLALNETQFGLLAATPVLTGSLVRLPLGLLTDRFGGRIVFFLLMLACVLPLYLITLATAYWQFLVLGLFVGLAGGSFSVGIAYVAKWFDKQNQGFAMGVFGAGNAGAAVTKFLAPALIAFGTWHLVPKVFSAILFITALLFWFLTAEKKEHRNAGGATLREQLKSLKDPAVWRYCQYYSIVFGGYVALALWMTKYYVQEYGFSLQSAALLAACFSLPGGVLRAVGGWMSDRWGAQSVTWWVLWVSWICLFLLSYPQTQLQVQTVNGIVDFHIGLNATLFPVILFVMGIAFAFGKASVFKYIANNYPQNMGAVSGIVGLAGGLGGFVLPIMFGALVDLTGVRSSCFMLLYGVVWVSLIWMYLSKVHKRPLLGKQPPASQSPFSSI

SEQ ID NO: 23215 - protein, 71 aa, Rickettsia conorii
MSKDDLIQFTGTVLELLPNATFRVKLENDHVIIAHTSGRMRKNRIRILLGDKVMVEMTPYDLTKGRVIHRH

SEQ ID NO: 23216 - protein, 409 aa, Bordetella parapertussis
MAMDSIAIIGAGQAGAALAARLRQAGFQGGIDVFGAESAPPYQRPPLSKKYLAGDWEQERLWLRPAQFWREQGIALHLGGTVEALDLASRTLRCGGRRHGWRKLALTTGAAPRPLPAAFAGRSNVFELRNLADVQRLQPAFLAGRRLLVLGGGYIGLETAAVAAQAGLSVQVVERASRVLERVACPATAAAIRALHQRHGVLIHEGRTVAGTEGDEALTGVELDNGLRIACDLVVAGVGVAPQTALAEAAGIDCDDGILVDAYGRTSAPDVWAAGDCARFVLGGEPARLESVQNAIDQAEAVADDMLGQGRPYQPVPWFWSDQYDMKLQIVGLNRGYDAVVSHASAKGESHWYFRADRLISVDALNDGRAYMVGKKLLEAGRAVGRGEVERPGFEPMQLLRDQAESRLR

SEQ ID NO: 23217 - protein, 532 aa, Oryza sativa
MEVEGVEAAGGKPRFRMPVDSDLKATEFWLFSFARPHMASFHMAWFSFFCCFVSTFAAPPLLPLIRDTLGLTATDIGNAGIASVSGAVFARLAMGTACDLVGPRLASASLILLTTPAVYCSSIIQSPSGYLLVRFFTGISLASFVSAQFWMSSMFSAPKVGLANGVAGGWGNLGGGAVQLLMPLVYEAIHKIGSTPFTAWRIAFFIPGLMQTFSAIAVLAFGQDMPGGNYGKLHKTGDMHKDSFGNVLRHALTNYRGWILALTYGYSFGVELTIDNVVHQYFYDRFDVNLQTAGLIAASFGMANIISRPGGGLLSDWLSSRYGMRGRLWGLWTVQTIGGVLCVVLGIVDFSFAASVAVMVLFSFFVQAACGLTFGIVPFVSRRSLGLISGMTGGGGNVGAVLTQYIFFHGTKYKTETGIKYMGLMIIACTLPVMLIYFPQWGGMLVGPRKGATAEEYYSREWSDHEREKGFNAASVRFAENSVREGGSVSIAKVVDSLGTVARNVKVLRLYELQILSKSEEQCQASAFVRSK

SEQ ID NO: 23218 - protein, 495 aa, Taxus canadensis
MDAMDLTVAKFKEFTQLQSSAILLTVVSGIIVIVILLLRSKRRSSLKLPPGKLGLPLIGESLSFLWALRSNTLEQFVDKRVKKYGNVFKTSLLGQPTVVLCGAAGNRLILSNQEKLLSRTVSDRVAKLTGDTSISVIAGDSHRIIRAAVAGFLGPAGLKIHIGEMSAHIRNHINQVWKGKDEVNVLSLARELVFAISASLFLNINDREEQHQLHKTLETILPGYFSVPINFPGFAFRKALEGNSKRRKHFSVLQEKRRRDLSVGLASRTQDLLSVLLAYEDDKGNPLTDEEVLDNISALIDGSYESTSSQMAMLLKLLSDHPECYEKVVQEQLEIASHKKEGEEITWKDVKAMRYTWQVMQETLRMFAPVFGPRGKAITDIHYDGYTIPKGWQLSWATYSTHQNDTYFNEPDKFMPSRFDEEGGRLAPYTFVPFGGGRRKCPGWEFAKTEILLFVHHFVKTFSAYTPIDPHESIWGRPLPPVPANGFPIKLISRS

SEQ ID NO: 23219 - protein, 632 aa, Escherichia coli
MVSYFYPSLKSPHSIKPVKNYRSINKYTQKPSPFSSISNRHYVFYFSTAKSLAHRAALRHFFNKQTQHAVNTRLTEKVMCSIFGVFDIKTDAVELRKKALELSRLMRHRGPDWSGIYASDNAILAHERLSIVDVNAGAQPLYNQQKTHVLAVNGEIYNHQALRAEYGDRYQFQTGSDCEVILALYQEKGPEFLDDLQGMFAFALYDSEKDAYLIGRDHLGIIPLYMGYDEHGQLYVASEMKALVPVCRTIKEFPAGSYLWSQDGEIRSYYHRDWFDYDAVKDNVTDKNELRQALEDSVKSHLMSDVPYGVLLSGGLDSSIISAITKKYAARRVEDQERSEAWWPQLHSFAVGLPGSPDLKAAQEVANHLGTVHHEIHFTVQEGLDAIRDVIYHIETYDVTTIRASTPMYLMSRKIKAMGIKMVLSGEGSDEVFGGYLYFHKAPNAKELHEETVRKLLALHMYDCARANKAMSAWGVEARVPFLDKKFLDVAMRINPQDKMCGNGKMEKHILRECFEAYLPASVAWRQKEQFSDGVGYSWIDTLKEVAAQQVSDQQLETARFRFPFNTPTSKEAYLYREIFEELFPLPSAAECVPGGPSVACSSAKAIEWDEAFKKMDDPSGRAVGVHQSAYK

SEQ ID NO: 23220 - protein, 508 aa, Unknown
  Erythrobacter sp. NAP1
MSLPDATNRARPASLLWTYRALGIALAALVYALLGSAEMSGDARFVAAIATLMAVWWISEAAPLAVTSLLPIVLVPALTERTVRETTSAYANPIVFLFLGGFLIAIAMQKWGLHRRIALLTVKRVGVSPTRIVLGMMIATAFLSMWVSNTATTLMMVPIAISVLSLVSANAAVAGGGDAEADANIATFGVCLVLSIAWSSSMGGLATLTGSTPNAFIAGYAREQLDITIGFAEWMMLGLPLSVSFIAIGWFVMTRFLYRFDLAEIPGGKELIDREVEELGSMNAGERRVAWVFASAAFLWIVPALLEQLPLSEGMLAVLGVLDDAVIAIGAGVALFLLPASRPGEMVLNWKDAEEGLPWGVLLLFGGGLSLAGAVAGTGLDSWFGTQVAGLTTLPAILLIASVTAIVLFLTELTSNTATSATLIPVLGGVALGVGMEPMGLLVPAALAATCAFMLPVGTPPNAIVFGTGAVTIGEMARGGVVLNLIGIALITGFVYWLGGTAMGLVFS

SEQ ID NO: 23221 - protein, 54 aa, Nicotiana clevelandii
VICDAYTPAGEPIPTNKRHKAAQIFSDPKVVSQVPWFGIEQEYTLLQQNVKWPL

SEQ ID NO: 23222 - protein, 532 aa, Arabidopsis lyrata
KTTLVELGRTLALEECALWMPTRTGLELQLSYTLRHQHPVEYTVPIQLPVINQVFGTSRAVKISPNSPVARLRPVSGKYMLGEVVAVRVPLLHLSNFQINDWPELSTKRYALMVLMLPSDSARQWHVHELELVEVVADQVAVALSHAAILEESMRARNLLMEQNVALDLARREAETAIRARNDFLAVMNHEMRTPMHAIIALSSLLQETELTPEQRLMVETILKSSNLLATLMNDVLDLSRLEDGSLQLELGTFNLHTLFREVLNLIKPIAVVKKLPITLNLAPDLPEFVVGDEKRLMQIILNIVGNAVKFSKQGSISVTALVTKSDTRAADFFVVPTGSHFYLRVKVKDSGAGINPQDIPKLFTKFAQTQSLATRSSGGSGLGLAISKRFVNLMEGNIWIESDGLGKGCTAIFDVKLGISECSNESKQSGIPKVPAIPRHSNFTGLKVLVMDENGVSRMVTKGLLVHLGCEVTTVSSNEECLRVVSHEHKVVFMDVYLPGVENYQIALCIHEKFTKQRHQRPLLVALTGNT

SEQ ID NO: 23223 - protein, 702 aa, Thermoplasma acidophilum
MKIGYQLIINTYYAASSVCFRRNIFKSRQNSKIMTLTVCPYCGTGCQIEVDYSGDHYTVHGYTRSAVNEGKLCIKGYQGLSYASSHDRITSPMLRSGDTWVKVSWDEAIDYVVKRLKEIRDRYGPDAIAFQASAKCTNEENYLLQKIARMIGTNNVDHCARSCHSSTVAGLIRTLGTAAATGSIKSLKSTQTFFVIGSNTTEQHPIIGTTIIKQKKAGKKLIVADPRRTKLASIADVFLQFKPGSDVALLNSMMFVILKRGLIDSEFIKSRTEGFEAFAEEIEKYPPELTEQITGVPPDLVEKAAEIYASNRPSAILYGMGITQHIHGTENVMSVSNLALMTGNLGRYGSGIFPLRGQNNVQGSSDMGALSEFYPGYVPPDSPGVEKFERIWEAKLPRKVGLMLSEMFDAAIDGRVKAIYLMGENPVITEANLSDVERGLKNLELFVVQDIFMTDTARYAHVILPATSALEKEGTFTNTERRIQRVVPVKDPPGDARPDWWILSQIYSKIFDREAYRSPEDIFNEIRLAIPNYSGVRYSDLYPDGKQWPINDQHPEGAEILHVDKFARGLGRFMAIPYKSPSESPDEEYPFILTTGRNYYHWHSGTMTRRSEILERESPNPYVEISVNDAKKLSIRNGQTITIESRHGSIKLPAMVTSKIPDGIVFVPFHFKEARVNLLVGENLDPYSKIPEFKVVAVKVKA

SEQ ID NO: 23224 - protein, 113 aa, Impatiens grandis
VVTVRCGHCTTLLSVNMTKATFLPLHLLAPLSPEEEPKFDGSTPVLKEGANDPNPTDKKPSSHVMSSDDEDDDLIPLNHVVNKPPEKRQRAPSAYNNFVKEEIRRLKARYPSM

SEQ ID NO: 23225 - protein, 170 aa, Streptomyces avermitilis
MAAQTQRAVLAGGCFWGMEDLIRRLPGVTATRVGYTGGDVPNATYRNHGTHAEAIEILFDPARTDFRAILEFFFQIHDPSTKNRQGNDIGLSYRSAIYYVDDEQKRIAEDTIADVDASGLWPGKVVTEVEPVGPFWEAEPEHQDYLERYPDGYTCHFPRPGWRLPARAEG

SEQ ID NO: 23226 - protein, 416 aa, Unknown
  Halobacterium sp. NRC-1
MTESGPLENMLAQMEQAREYVDIDDGIYERLKSPERTLSVSLPVRMDDGSVEVFDAYRCQFDSARGPYKGGIRYHPTVSEEEVSALAGWMTWKTALVDLPFGGAKGGIVCNPKELSDNEIEQLTRRYTEGIRRMIGPETDIPAPDMNTDPRTMAWVMDTYSVYQGYAVPEVVTGKPPEIGGTDGRVEATGRGVSIITEETFEYFDTDIQDADVAIQGFGNVGSVTADLLSERGANIVAVSDVTGAIHDPTGLDIADVQAYADANGGRLEGYDAEPISNDDLLTLDVDALIPAAIEDVITVDVAERLAADVIVEAANGPTTFDAAQVLSDRGVPVVPDILANAGGVIVSYLEWVQNSQQYSWDVEEVNRDLRQRLTGAFDEMLVAYEDRNIPTLRTAAYTIALERSADAHEFRGLFP

SEQ ID NO: 23227 - protein, 54 aa, Nicotiana clevelandii
VICDAYTPAGEPIPTNKRHKAAQIFSDSKVVSEVPWFGIEQEYTLLQQNVKWPL

SEQ ID NO: 23228 - protein, 76 aa, Nicotiana corymbosa
GNNILVICDAYTPAGEPIPTNKRHKAAQIFSDSKVVSEVPWFGIEQEYTLLQQNVKWPLGWPVGGYPGPQGPYYCG

SEQ ID NO: 23229 - protein, 220 aa, Kluyveromyces lactis
MARRPARCYRYQKNKPYPKSRYNRAVPDSKIRIYDLGKKKATVDEFPLCVHLVSNELEQLSSEALEAARITANKYITKMTGRDSFHLRVRVHPFHVLRINKMLSCAGADRLQQGMRGAWGKPHGLAARVAIGQVIFSVRTKDNNKDTVIEGLRRARYKFPGQQKIIISKKWGFTSLNREEYVKKRDAGEIKDDGAFVKFLSKKGSLEENIREFPEYFAKA

SEQ ID NO: 23230 - protein, 571 aa, Yarrowia lipolytica
MSDSEPQMVDLGDYLFARFKQLGVDSVFGVPGDFNLTLLDHVYNVDMRWVGNTNELNAGYSADGYSRVKRLACLVTTFGVGELSAVAAVAGSYAEHVGVVHVVGVPSTSAENKHLLLHHTLGNGDFRVFAQMSKLISEYTHHIEDPSEAADVIDTAIRIAYTHQRPVYIAVPSNFSEVDIADQARLDTPLDLSLQPNDPESQYEVIEEICSRIKAAKKPVILVDACASRYRCVDETKELAKITNFAYFVTPMGKGSVDEDTDRYGGTYVGSLTAPATAEVVETADLIISVGALLSDFNTGSFSYSYSTKNVVELHSDHVKIKSATYNNVGMKMLFPPLLEAVKKLVAETPDFASKALAVPDTTPKIPEVPDDHITTQAWLWQRLSYFLRPTDIVVTETGTSSFGIIQTKFPHNVRGISQVLWGSIGYSVGAACGASIAAQEIDPQQRVILFVGDGSLQLTVTEISCMIRNNVKPYIFVLNNDGYTIERLIHGENASYNDVHMWKYSKILDTFNAKAHESIVVNTKGEMDALFDNEEFAKPDKIRLIEVMCDKMDAPASLIKQAELSAKTNV

SEQ ID NO: 23231 - protein, 501 aa, Mycobacterium avium
MTTTRTVANPYLDGFLAPVRAEVTAFDLPVTGRIPDHLDGRYLRNGPNPVAEVDPATYHWFSGDGMVHGVALRDGRARWYRNRWVRTAHVCAALGEPAPGGLDPRAGMLSVGPNTNVLSHAGQTLALVEGGGANYRLTEDLDTVGTCDFDGTLFGGYTAHPHRDPRTGELHAVSYSFGRGRRVQYSVIDTAGRARRTVDIEVSGSPMMHDFSLTDEYVVIYDLPVTFDPVQVMPADVPRWLSAPARLVVQSLLGRVQLPGPMATAMNRNRQPLHRMPYRWNDAYPARLGVMPRDGGNDEVRWFDIEPCYVYHPLNAYSEIRDGAKVLVLDVVRYSRMFDRDLRGPGDTRPTLDRWTVNLATGAVGSELRDDRPQEFPRINEALLGRRHRFGYTVGTDGGYLSDGASEMSTGLYKHDYATGSRRVAPLDPDLLIGEMCFVPNPAGGQDGTEDDGILMGFGYHRGRDENQLVLLDAQSLEQVAAVHLPQRVPMGFHGNWVPAG

SEQ ID NO: 23232 - protein, 509 aa, Camptotheca acuminata
MAVLLLFLPLIFIFLAYKLYQRLRFKLPPGPRPLPFVGNLYSVKPVKFRCFAEWAQVYGPIMSVWFGSTLNVVISNSELAKEVLKENDQHLADRERNRSSNSFSRGGKDLIWADYGPHYVKVRKLCTVELFTPKRLEALRPIREDEVTAMVDSIFKDSANPDNYGKSLLVKQYIGAVAFNNITRLVFGKRFMNSEGVMDEQGKEFRGIVANGVKIGGLRFIGEHIPWLRCMFPQEEEILVKHEARRDRLTRAIMEEHTLARKHSGGAKQHFVDALLTLQKEYELSDDTVIGLLWDMITAGMDTTSISVEWAMAELIKNPRVQQKAQEELDRVIGYERIMSETDFPNLPYLQCVAKEALRLHPPTPLMLPHKANSNVKIGGYDIPKGSIVHVNVWAIARDPATWKDPHEFRPERFLEEDVDMKGHDFRLLPFGAGRRICPGAQIAINLITSMLGHLLHHFSWAPPEGVKPEEIDMTENPGLVTFMKTPVQAVAKPRLPSHLYKRVAVGAV

SEQ ID NO: 23233 - protein, 682 aa, Amycolatopsis mediterranei
MTQVETHCPYCALQCGMSLEGTRVTPRDFPVNAGGLCQKGWTSGSLLTSPRRLTTPMLRVNGALEPVSWDFALDHVARKLAEIQGEHGPDGVAIFGGGGLTNEKAYLLGKFARVALGTSQIDYNGRFCMSSAAAAGIKAFGADRGMPFPVTDLKNADVVLLAGANPAETMPPFTQHLRGTDLIVVDPRRTPTAELASLHLAPAPGTDLALALGILHAVVESGHLDRSYVDDRTSGFAEMWRIAASWWPERAERVTGVSAADMRLAAEKLAAARNAYVLTARGTEQHATGTATVGAWINLALSLGLPGRPGSGYGCLTGQGNGQGGREHGQKADQLPGYRKLDDPAAREYVASVWGVDADSLPGPGRSATELLEALGQENGPKALMVFGSNVVVSAPRSQRVQDRLSGLDFLVVADFVLSETAALADVVLPVTQWAEEDGTLTNLEGRVLLRRKALTPPPGVRSDLDVLNGLALRLGQPENRFPADAETVFEELRIASKGGIADYSGVSYDRLRAGEALHWPVPADDHPGTPRMFLESFAHPDGRARFVPVEHTGPAELPDDEFPLQATTGRVLQHYQSGAQTRLIGELNDVVPEVFVEVHPDTAKRAGLEEGDRAVVRSRRGETVARVRFTQSLKPDLIFLPFHFPGEQRANLFTNPALDPVSRMPEFKVCAVSLSTVDGAA

SEQ ID NO: 23234 - protein, 475 aa, Amycolatopsis mediterranei
MSPREVVIVGYGMAGARLADEIRRRDPIAERVRLTVLGAEKHAAYNRVLLSAVVAGGMSAESVRLHDDEWAQRHNIDLRLGVDVARIDREKRCVELADGSSIDYDALVLATGANPWIPPVEGLEAGPGVVAFRSLDDCAKILDAARFGAPVAVLGGGLLGLEAARGLAGRGNQVTVVHPLGHVMERQLDPAAGHVLARQLTDMGVTFKFGATAARYLPGDGLKLDDGSLVPADLVVVAAGVRAETSLAVEAGLDVDLGILVDDTLRTSDGRIHALGDCARHPGAPAGLIQPAWEQASVLADVLTGTNAAARYRGTTAVTRLKARGIDLAALGETQLDAGNPNVEVLTFNDPTGGRYGKLVVRENRVTGAILLGLPDAAATITQFHDRGTLLPEDRLGVLLGRALPTGATPAASPADLPAAAVICRCNNVTKGRLIEAWKAGATDTPALARATRATTGCGGCSDTVGGIANWLAAQ

SEQ ID NO: 23235 - protein, 281 aa, Saccharomyces cerevisiae
MSEYQPSLFALNPMGFSPLDGSKSTNENVSASTSTAKPMVGQLIFDKFIKTEEDPIIKQDTSSNLDFDFALPQTATAPDAKTVLPIPELDAAVVESFFSSSTDSTPMFEYENLEDNSKEWTSLFDNDIPVTTDDVSLADKAIESTEEVSLVPSNLEVSTTSFLPTPVLEDAKLTQTRKVKKPNSVVKKSHHVGKDDESRLDHLGVVAYNRKQRSIPLSPIVPESSDPAALKRARNTEAARRSRARKLQRMKQLEDKVEELLSKNYHLENEVARLKKLVGER

SEQ ID NO: 23236 - protein, 145 aa, Lactobacillus plantarum
MGYVLDLRRQVGHQPLVVAGAALMAQNSIGKIVLIYRTDNHCWGLPAGSTEPGETVQQTARRELKEETGLTVGELTLIDVYSGPKMHYQYPNGDIIDSVTTLYRANTTGGELIQATDETSTAAFFALDALPTPLTPLTKWMLCGE

SEQ ID NO: 23237 - protein, 103 aa, Coccidioides immitis
MTGRGKGGKGLGKGGAKRHRKILRDNIQGITKPAIRRLARRGGVKRISAMIYEETRSVLKTFLEGVIRDAVTYTEHAKRKTVTSLDVVYALKRQGRTLYGFGG

SEQ ID NO: 23238 - protein, 840 aa, Amycolatopsis mediterranei
MPTLVVAGHGMVAHRLVEAVRAEDPSGNWHIVVLSEEPRPAYDRVALTSYVDTWDPATLALPGSDYAGDEHVDLRLGEPAVSVDRDARTVTTASRRGRRVRRSGAGHRLAAVRAAGARARLDGCFVYRTIEDLDAIRAAAVDKPGRGRRSAVVIGGGLLGLEAAKALRDMGLSPHVVEMAPRLMPLQVDEGGGSMLPRMITALDVTVHTGTSTDAIEADGSRLLAKLGNGTELDVDLVVFSAGVRPRDDLARQSGLELGPRGGVLTDASCRTGDPAIYAIGECAAVEGKVYGIVAPGYAMAEIVAAQLTGGAGTFPEPDTSTKLKLMGVDVASFGDAHAKTEGALEVAVNDAVAGTYKKLVVTDDGKTLLGGVLVGDATEYNTLRALVGRPLPAEPGAILAPAGGGAAVGVDALPDAAQICSCNAVSKGAITQAIHEDGCDTVPKLKACTRAGTACGSCVPLLGRLLSAAGVEQSKAVCEHFPQSRAELFEIVQATRITTFSELIGRYGSGSGCAICKPAVASILATLGNGHVLGGEQMTLQDTNDRYLANLQRNGTYSVVPRIPGGEITPDKLIVIGEVARDFGLYTKITGGQRIDLFGATVDQLPLIWRRLVDAGFESGHAYGKALRTVKSCVGSTWCRYGVQDSVGLAIELELRYRGLRSPHKLKSAVSGCARECAEARSKDFGIIATENGWNLYVGGNGGTTPRHAELLVSDVDTETLIRTIDRFLMFYVRTADRLQRTAPWIEELDGGLDHLRAVIVDDSLGICEDLDAAMAKHVDNYADEWKGVLEDPEKLARFTSFVNAPGAPDPAISFREERQQKVPVMLGVPGFSNSEVRR

SEQ ID NO: 23239 - protein, 1005 aa, Streptococcus salivarius
MNTTEKIQTYLNDPKIVSVNTVDAHSDHKYFESLAEFSEGEMKLRQSLNGKWKIHYAQNTNQVLKDFYKTEFDETDLNFINVPGHLELQGFGSPQYVNTQYPWDGKEFLRPPQVPQESNAVASYVKHFTLNDALKDKKVFISFQGVATSIFVWVNGNFVGYSEDSFTPSEFEISDYLVGGDNKLAVAVYRYSTASWLEDQDFWRLYGIFRDVYLYAIPKVHVQDLFVKGDYDYQTKAGQLDIDLKTVGDYEDKKIKYVLSDHEGIVKEGDASVNADGELSVSLEDLQIKPWSAESPKLYNLTLHVLDDGQVVEVVPVKVGFRHFEIKDKLMLLNGKRIVFKGVNRHEFNARTGRCITEEDMLWDIKVMKQHNINAVRTSHYPNQTRWYELCDEYGLYVIDEANLETHGTWQKLGLSEPSWNIPASEPEWLPACLDRANNMFQRDKNHASVIIWSCGNESYAGKDIADMADYFRSVDNTRPVHYEGVTWCREFDYITDIESRMYAKPADIEEYLTNNPQKPYISCEYMHTMGNSGGGLKLYTDLEKYPEYQGGFIWDFIDQAIYKPLPNGSEFLSYGGDWHDRPSDYEFCGNGIVFADRTLTPKLQTVKHLYSNIKIAVDEKSVTIKNDNVFEDLSAYTFLARVYEDGRKVSESEYHFDVKPGEEATFPVEFAVGASNAERIYEVACVQNEATEWAPKGHEIVRGQYVAEKISTETPVKAPLNVVEGDFNIGIQGQNFSILLSRAQNTLVSAKYNGVEFIEKGPKLNFTRAYTDNDRGAGYPFEMAGWKVAGNYSKVTDTQIQIEDDSVKVTYVHELPGFSDVEVKVTYQVDYKGRIFVTTSYDGKAGLPNFPEFGLEFAIGSQFTNLSYYGYGAEESYLDKLPGAYLGRYKTSVEKTFAPYLMPQESGNHYGTREFTVSDDNHNGLKFTALNKAFEFSALLNSTEQIENARHQYELQQSDATWIKVLAVQMGVGGDDSWGAPVHDEFLVSSADSYQLSFVIEPLN

SEQ ID NO: 23240 - protein, 514 aa, Hordeum vulgare
MEGESKPAAMGVQAAPKGKFRIPVDSDNKATEFWLFSFVRPHMSAFHLSWFSFFCCFVSTFAAPPLLPLIRDNLGLTGKDIGNAGIASVSGAVFARLAMGTACDLVGPRLASAAIILLTTPAVYCSAIIESASSFLLVRFFTGFSLASFVSTQFWMSSMFSSPKVGLANGVAGGWGNLGGGAVQLLMPLVFEAVRKIGSTDFIAWRVAFFIPGVMQTFSAIAVLAFGQDMPDGNYRKLHKSGEMHKDSFGNVLRHAVTNYRAWILALTYGYSFGVELAVDNIVAQYFYDRFDVNLHTAGLIAASFGMANIISRPGGGLMSDWLSDRFGMRGRLWGLWVVQTIGGILCIVLGIVDYSFGASVAVMILFSFFVQAACGLTFGIVPFVSRRSLGLISGMTGGGGNVGAVLTQVIFFRGTKYKTETGIMYMGLMILACTLPITLIYFPQWGGMFVGPRKGATAEEYYSKEWTEEERAKGYSAATERFAENSVREGGRRAASGSQSRHTVPVDGSPADV

SEQ ID NO: 23241 - protein, 525 aa, Arabidopsis thaliana
MEPVEAFNVYYLWMGLTNFAPLLGALISDAYIGRFKTIAYASLFSILGLMTVTLTACLPQLHPPPCNNPHPDECDDPNKLQLGILFLGLGFLSIGSGGIRPCSIPFGVDQFDQRTEQGLKGVASFFNWYYLTLTMVLIFSHTVVVYLQTVSWVIGFSIPTSLMACAVVLFFVGMRFYVYVKPEGSVFSGIARVIVAARKKRDLKISLVDDGTEEYYEPPVKPGVLSKLPLTDQFKFLDKAAVILDGDLTSEGVPANKWRLCSIQEVEEVKCLIRVVPVWSAGIISIVAMTTQATFMVFQATKMDRHMGPHFEIPAASITVISYITIGIWVPIYEHLLVPFLWRMRKFRVTLLQRMGIGIVFAILSMFTAGFVEGVRRTRATEMTQMSVFWLALPLILMGLCESFNFIGLIEFFNSQFPEHMRSIANSLFPLSFAAANYLSSLLVTTVHKVSGTKDHPDWLNKDLDRGKLDYFYYLIAVLGVVNLVYFWYCAHRYQYKAGSQIEDFNEEKSLLDIEPNQRHDQSPS

SEQ ID NO: 23242 - protein, 563 aa, Cryptococcus neoformans
MVCVVSDPDWWRQAVVYQIYPRSFADANGDGIGDLKGITARVPYLKALGVDAIWLSPFYPSALRDGGYDVADYRDVDPKIGTLEEFDEMTAAFQKVGIRVIVDIVPNHSSDDHEWFQAALKAGKGSPERERYIFRDGLGPNKDQPPTDWICSFGGSAWSPSGMNDGQWYFHWFDSSQPDWNWENPDVKADFLKTLKFWGDRGVSGFRIDVAHGLAKDMSEPLPNWEQLTKLTHQKLTNGNSELDHPLLDRKEVHDIYRSWREVFNQFNPPLMAVAEAWVAPDQKPLYASSEGLGQTFSFDILLCNFDAEEYRQCIKSSLAGSKKSDSTTTWVLSNHDVMRHPTRFGLPNVPNANHAMTTDTYNKFLKTKLTDPKVDIEQGLRRAKAATLMILALPGSTYLYQGEELGLQEVVEIPDEERQDPIFIRTKGEEVGRDGCRVPIPWVADEKNFGYGPGKRAHLPQPAWFKDYAVDVEEKDANSVLSLYRRALGLRKELQSAEELEWVENPNKEVLHFRRPGGWEVVVNIGKDSVDLPKGSVLISSSNNALKGGSIPGETTVWLKSA

SEQ ID NO: 23243 - protein, 388 aa, Cycas revoluta
MAEPGLFRSALEQINSDENYGFKDFQALSLSMSSGSQSNSATTFPQPASPDRSTVGTRKRCAENREVVPRKSIDSFGQRTSQYRGVTRHLWTGRYEAHLWDNSCRKEGQTRKGRQVYLGGYDKEEKAARSYDLAALKYWGPSTHTNFPLSTYEKEIEEMKTMTRLEYVAHLRRKSSGFSRGASAYRGVTRHHQHGRWQSRIGRVAGNKDLYLGTFSTQEEAAEAYDIAAIKFRGINAVTNFDINRYDVKRICASSTLLIADLFMNKKDSSECPHVNAHPDVMTSSSIISTIKDSNGAPKENDWEVVLHARHPGVNRQPQHQGQHSPDHQNPNCYPDQMFNNNDCLHSAVLHDLIGLDASTADQMSSTSLLMTPPWEARAIRSARTRTA

SEQ ID NO: 23244 - protein, 419 aa, Methylobacillus flagellatus
MEDIKHYMQQLGSEARTASRAMARADTETKNKALRAIATAIRRERDTLLAANAADLEAARRHGLEPAMLDRLVLSEKGIDTMAEGLEQIAGLPDPIGEMSDFKYRPSGIQIGKMRVPLGVIGIIYEARPNVTVDAAGLCIKSGNAAILRGGSEAIQCNRALAAIVHEGLAAAALPASAVQVVATTDRAAVGELITMKDYVDVIVPRGGKGLIERISNEARIPVIKHLDGNCHVYIDESADLAKALRILENSKTQRLGTCNTAESLLVARSIAQEALPPLTAMLISKGVEIRGCSETRALVPQAKPATEEDYYTEYLAAIISVKVVADVDEAIAHINQYSSQHTEAIVTENYTNARRFLREVDSSSVIVNASTRFADGFEYGLGAEIGISTDKLHARGPVGLEGLTSLKYIVLGDGEVRA

SEQ ID NO: 23245 - protein, 511 aa, Ginkgo biloba
MYYDHNGAAGFDRDNPRLNINQLPLTHCRRMDVPPSYHAFGDNNNISSQQTYETHIHQESGLNQPNLYHVAFQQNSKESMFADCSLQLPPGTGMIENATNMVGISAIKTWLRQYPTAAASDKPPTTEPSGSPADKEGIESYGDLQSQALTLSMSPGSQSSSVTMPQSTSTECVAVETRKRGPGSKSGSRHPVPRKSIDTFGQRTSQYRGVTRHRWTGRYEAHLWDNSCKKEGQTRKGRQVYLGGYDMEEKAARSYDLAALKYWGPSTHINFPISTYQNELEEMKNMTRQEYVANLRRKSSGFSRGASMYRGVPRHHQHGRWQARIGRVAGNKDLYLGTFSTQEEAAEAYDIAAIKFRGINAVTNFDISKYDVKRITSSNTLLVGELAKRNKELEPSEPSEDHHSNSNNLLIGQDNDNRIITAQICSGSGKENDHDAQKIDQDWQIVVGQHEHHSNSDQKSSQAFNDQMQSGHLAALHNLIGIGCINNTGGMLESNRLLTDIPDRHHFSTIE

SEQ ID NO: 23246 - protein, 161 aa, Pseudomonas fluorescens
MSDNLLNIPCTTIKGEQKTLADFAGKAVLVVNTASKCGFTPQYKGLEELWQTYKDQGLVVLGFPCNQFGKQEPGNEGAISEFCELNYGVSFPLFKKIEVNGTGAHPLFVQLKKRAPGVLGSQGIKWNFTKFLIGKDGQLVKRFAPATKPQDLSREIEALLK

SEQ ID NO: 23247 - protein, 150 aa, Vibrio angustum
MDSSEYPEQDEFSGVKKAKAPVYGVGDSTLQAAGGEQGVKQLVDAFYHYMDTLPVAAKVRAMHSPDLTESKAKLTTFLVGWMGGPSRYAEMYGSINIPGAHRHLDIGLAEKDAWLLCMQKALDDQPYEETFKRYVMVQLSFPAEMCRNRK

SEQ ID NO: 23248 - protein, 324 aa, Yersinia pestis
MTVQPQAELAMILPPIFHGCYCEGEAPNMSQKELWYETLHANFGQYFSVENVLFREKTEHQDLVIFENPELGRVMALDGVVQTTERDEFIYHEMMTHVPLLAHGQAKKVLIIGGGDGAMLREVSRHKNIEQITMVEIDAGVVEFCRQYLPNHSAGAYDDPRFKLVIDDGVNFVNQTTEKFDVIISDCTDPIGPGESLFTSVFYEGCARSLNEGGIFVAQNGVCFLQQDEAVNSHNKLSHYFSDVSFYQAAIPTYYGGIMTFAWATQNPALRQLDLATLQNRFAQAGLACRYYNPAIHVGSFALPQYLLDALTTIPKVIGVDSSE

SEQ ID NO: 23249 - protein, 304 aa, Triticum aestivum
VALALLLGAFASIPQSVESIGVCYGMSANNLPAASTVVSMFKSNGINSMRLYAPDQAALQAVGGTGVNVVVGAPNDVLSNLAASPAAAASWVRSNIQAYPKVSFRYVCVGNEVAGGATQNLVPAMKNVQGALASAGLGHIKVTTSVSQAILGVYSPPSAGSFTGEADAFMGPVVQFLARTGAPLMANIYPYLAWAYNPSAMDMSYALFTASGTVVQDGSYGYQNLFDTTVDAFYTAMAKHGGSNVKLVVSESGWPSGGGTAATPANARIYNQYLINHVGRGTPRHPGAIETYVFSMFNENQNDR

SEQ ID NO: 23250 - protein, 145 aa, Bacillus cereus
MSMSLYYKKIREKLGHELIFMPSVAAVIKNEQEDILFQYPGGEYWSLPAGAIEPGETPEEAVVREVWEETGLKVQVKKQKGVFGGEEYRHTYPNGDQVEYIVVVFECEITSGKLKSIDGESLKLQYFSLSEKPPLALPYPDKIFL

SEQ ID NO: 23251 - protein, 325 aa, Rickettsia conorii
MNKFKNIAVYGGGSFGTSLASLAAQNCNNVTLFLRDEAIAKEILHNKTNVKYLGDIKLPAHLQATTNLDIIKDFELIIIALPSYAFDDSIKLLKTHSISKDNTLLIATKGFARNPTALLSDRLKTLLPYNPTAFFVGPNLAKELAKNLPASASIASLDIDIANKIAYNLSSKIFTTNVSSDIVTLQVAGALKNIFAIKSGIDLARKQGENARATLIVAALKEIAILSKALGGMQKNSDILLEGVVGDLVLTCYSLGSRNTKFGYELGISSDKKKFLQEYKELAEGREALKLVLDLIKKYNLHMPIISEVASCVIPYVIPAKAGMT

SEQ ID NO: 23252 - protein, 680 aa, Aspergillus oryzae
MATVVVQQQQQTLRHSTPPPTGISPALSLNRNPSPIPNKHLPFCPEGPTPIITHNASPLHKEEVTDQTSSLLYPPDSYKQLSSSPAVYSIDAVTLEAALDHWASQPLPDPSKVFPWLHGLHPENHLQLGFFTNRKRSLRRIPRVWRGITIIKVGGDLISGRLKGAVSLDEVLAPSTTEFLAVDPREGFSVRNFQIQTAKLAPLSDIVIYGEDGVTRKQLLDVAGRVAAAQHRWRSKNDPEQVLPVYNTFVLSSTFSEVQQRAPGIVAIHARGQLTGQIMDFFQWERWEMCDMSRASEISTNIWQGPTPDYLLRPGTLEPTTGEYFDLLIEASDFASLPGPRFLAKLNKQLDDGPQRLEFPSSGSILPPSGDDREVDDLVNTVRWLYYLANPDEPENRRDSDGDIAMDPMPKKPRKILIHCPDGYTESSLLVIAYVMFAEGVTAPDAWLKLHCDKKRNFFAYPSDVTFLSAVQARLLHESPATPIGSLTGLEDPHWFKFFDGSLPSRILPYMYLGNLSHANNPEMLWALGIRRILSVGESVTWTNSEVAKFGAENIMHVTQVQDNGIDPLTQELERCLDFVRKGKKDGTATLVHCRVGVSRSATICIAEVMASLGLSFPRAYCFVRARRLNVIIQPHLRFVYELLKWEELQLQKQNKPPKRELEWPTVAREIALMNKPYSR

SEQ ID NO: 23253 - protein, 99 aa, Glycine max
DSFFEALMPISQEIAEIEKGKVDIINNVLKGAPHPPSVVMADAWTKPYSREYAALPAPGLGTAKFGRTTERVDNVYGDHNLMCTIIPASQGVEDQANTT

SEQ ID NO: 23254 - protein, 532 aa, Arabidopsis lyrata
KTTLVELGRTLALEECALWMPTRTGLELQLSYTLRHQHPVEYTVPIQLPVINQVFGTSRAVKISPNSPVARLRPVSGKYMLGEVVAVRVPLLHLSNFQINDWPGLSTKRYALMVLMLPSDSARQWHVHELELVEVVADQVAVALSHAAILEESMRARNLLMEQNVALDLARREAETAIRARNDFLAVMNHEMRTPMHAIIALSSLLQETELTPEQRLMVETILKSSNLLATLMNDVLDLSRLEDGSLQLELGTFNLHTLFREVLNLIKPIAVVKKLPITLNLAPDLPEFVVGDEKRLMQIILNIVGNAVKFSKQGSISVTALVTKSDTRDADFFVVPTGSHFYLRVKVKDSGAGINPQDIPKLFTKFAQTQSLATRSSGGSGLGLAISKRFVNLMEGNIWIESDGLGKGCTAIFDVKLGISERSNESKQSGIPKVPAIPRHSSFTGLKVLVMDENGVSRMVTKGLLVHLGCEVTTVSSNEECLRVVSHEHKVVFMDVCLPGVENYQIALCIHEKFTKQRHQRPLLVALTGNT

SEQ ID NO: 23255 - protein, 204 aa, Zea mays
MASSMLSSAAVATSPAQATMVAPFTGLKSSAAFPVTRKSNTDITSIANNGGRVSCMKVWPPVGKKKFETLSYLPDLTDVELAKEVDYLLRNKWIPCVEFELEHGFVYREHGSTPGYYDGRYWTMWKLPLFGCTDSAQVLKEVQECKTEYPNAFIRIIGFDNNRQVQCISFIAYKPPSFTGGLFSFQKQPKKNPNPFPFPMAGFT

SEQ ID NO: 23256 - protein, 76 aa, Nicotiana acuminata
GNNILVICDAYTPAGEPIPTNKRHKAAQIFNDSKVVSEVPWFGIEQEYTLLQQNVKWPLGWPVGGYPGPQGPYYCG

SEQ ID NO: 23257 - protein, 459 aa, Unknown
  Erythrobacter sp. NAP1
MLRIGLTLTAALVLTACDAAIGSETATSYEPQPYVQVEAPEWAADAVIYQMNTRQFTEEGTFTAAQEHLPRLAEMGVDIVWLMPIHPIGEEKRKGGMGSPYSVLDYRAVNPDLGTEQEFRAFVDAAHEQGLKVILDWVANHSAWDNPLTQSNPEWYTRTPEGEMMPPEGTDWSDVVDFDFSNPGLREYMTGSLAYWVREFGVDGYRADVAGYVPTDFWETARAELDAIKPVFMLAEWETRDLHRSAFDATYAWGWKEVMQDIAKGEADANAMRGYFAGQKVTWPHAAMRMTYTDNHDQNSWDGVASEIYGPAYETAIALSFTSHGIPLIYNGQEADLDRQLAFFEKDEIEWKVGEYDPLFRQLIALKTEERALWNGASGAPMIDIPTSVDEDVFAFVRGEGDARVFGVFNLSPREHTVTFDFARHHGSFANALSGEGSEFGADTALTLGAWDYRIYTAN

SEQ ID NO: 23258 - protein, 535 aa, Unknown
  Erythrobacter sp. NAP1
MNQAAATGSARKPAMNAGQIWNMSFGFLGIQIGFDLQNGNVSRIFQTLGAEVNELAILWIAAPMTGLIVQPVIGHLSDNTWGRFGRRRPYFLVGALLATLALFIMPNSPTLWIAAGMLWIMDASLNITMEPFRAFVGDNLPDRQRTRGYAMQSFFIGVGAVIAGALPWVMTNWMGLSNVAPEGQIPETVQWAFYIGGAALFAAVCWTVFKTNEYSPEQLAGFEAARHMALGVTPRDASTTRRSAAKFQRGGLLWIIIGIAFAALVMAARTDPRPAWLGDLEIAQELYVLAGLIAAFGVIQFIASFLRKSGRDDNGFMEVVNDLFAMPKTMRQLAVVQFFSWFAMFSMWIYGTPAVAEYHFASPDPVTQGYQDAADWWSLLGSVRNGIAAAAALGFIIIAAKMDRCRLHALNLTIGAVGFASMLLIRDPGLLWLPMVAVGIAWASIVSLPYAILAGSVPAKKMGIYMGIFNIFIVVPQLIAATLLGFLLTTFFDGAPIYAMMISAVSFALAAVATFFVTDGTSAILERQAQLKEAS

SEQ ID NO: 23259 - protein, 295 aa, Unknown
  marine gamma proteobacterium HTCC2207
MQYPTIDQGIGNTRLVQLQRMPGNTSNTILAKLEGDNPAGSVKDRPALSMIKKAQARGEIKPGDRLIEATSGNTGIALAMVAAMMGYRMTLIMPANATDERKWAMTAYGAELIEVSKEQGMEGARDLARQMQEQGLGKVLDQFNNPDNPLAHYEGTGPEIWRDTQGSITHFVSSMGTTGTIMGTSAYLKQQNPDIQIVGLQPQEGASIPGIRRWPAAYMPSIFDAAKVDQTLDISQQAAEQTMRRLATEEGIFCGVSAGGSVSAALEISKQVENAVIVAIICDRGDRYLSSGIYG

SEQ ID NO: 23260 - protein, 74 aa, Nicotiana miersii
GNNILVICDAYTPAGEPIPTNKRHKAAQIFSDSKVVSEVPWFGIEQEYTLLQQNVKWPLGWPVGGYPGPQGPYY

SEQ ID NO: 23261 - protein, 136 aa, Coccidioides immitis
MARTKQTARKSTGGKAPRKQIAAKAARKAAPSTGGVKKPHRYKPGTVALREIRRYQKSTELLIRKLPFQRLVREIAQDFKSDLRFQSSAIGALQESVEAYLVSLFEDTNLCAIHAKRVTIQSKDIQLARRLRGERS

SEQ ID NO: 23262 - protein, 741 aa, Archaeoglobus fulgidus
MMRQGGVMVGARKRWITDWWPNRLNLKILRQNLQNPYGEDYDYVEEVENLDIDAVIRDLKELMRSSQDWWPADFGHYGPLFIRLAWHSAGSYRIFDGRGGARDGSIRFPPRINWPDNINLDKAIRLLWPIKKKYGRKLSWADLIILAGTVAMEDMGVKLFGFALGREDIFEPDESPDWGPEEEMLTAKRGEKEELERPFAATEMGLIYVNPEGPGGNPDPLGSAQEIRVAFRRMGMNDEETVALIAGGHAFGKCHGAGPADYLGPDPSSSPIEMQGLGWKYNYGKGKGSDTFTSGLEVTWSPTPTKFGINYLRILFTYEWELEKSPAGKNQWVAKDAPEIIPDAHDPNKKHRPRMLTADLALRFDPEFSKIARRFLENPEEFEKAFAIAWYKLTHRDMGPKDCYIGKYVPEETFVWQDPLPRRDYELVDEKDVEELKRRILASGLSLSQLVYFAWASASTYRNSDRRGGANGARIRLKPMSVWEVNHPEELKKVIAAYEKIQQEFNEGAKGSEKRISIADLIVLGGIAAVEEAARRAGFSVKVPFIPGRVDAQQEHVDEEFYRVIEPFADGFRNYFRYPERINERDVYTTPEYFLVDKANLLTLTVPEMVVLIGGMRALGANYSHSDYGVLTERPGVLSNDFFVNLLDMSVEWRAADDYRYTFEGYDRKSGELRWRATRVDLILGHHDELRAVAEVYGCDDAKEKFVKDFAAVCAKVMHLDRFDLWRSNRKLYKEITAGLR

SEQ ID NO: 23263 - protein, 375 aa, Mycobacterium avium
MARTVSDSAPDSAEDPSEREFGQAGIALSTYRFPTGWFIVAFGSDLAPGQVKRAHYFGEELVLFRTASGRVHVMDAYCQHLGANLGVGGTVEGENIVCPWHGWQWRGDGSNALIPYSKIGCKNNVRIRTYPSMEWYGFVLAWHERHGRAPYWQPPVLPELETGEYYPLHPHTQMVNRVKVHPQMIIENAADPYHVQYVHKAANPATTASFEVSGYHLHATVNAHFGGGRAQTWLTPNGPVDAKIIYDNYSLGLGVVRFPSELVATVQVTGQTPVDEDYTDYFYTQASVREPGDTGDVPTGRAARFLALQKEVIKQDFFTWENMKYLEKPNLAPEEAHDYAALRRWAHRFYPGPQPAPTDFGYTADGEPDPAAAKA

SEQ ID NO: 23264 - protein, 1030 aa, Unknown
  Photobacterium sp. SKA34
MTTFFDTLQKRDWENPQSVNIHCLKAHSPLASFRSVEHARDDVFQQRLSLNGQWKFKLFDAPEQVDDEFIQTTFNDTDWNEINVPSNWQLQGYDKPIYTNVKYPFEAKPPFVPKENPTGCYRTALWLSDTELENTQRIIFDGVNSAFHFWCNGKWVGYSQDSRLPAEFDLTPYLVEGENTLAVMVMRWSDGSYLEDQDMWWLSGIFRDVTLLSKPKNCIEDVFITPDLDACYRDGSLSITTRISAPETYKVQVQLFDNGEAVTEPQVDGPNNRRIDERGCWDDVVFQTIHVRDPKKWTAETPNLYRLVVSLFDENGAHLESEAYQVGFRKVEISNGQLKLNGKPLLIRGVNRHEHHPELGHVMTEEDMIRDICLMKQYNFNAVRTAHYPNHPRWYELCDQYGLYVCDEANIETHGLHPMSRISDDPQWSNAYMSRYSQMVMRDKNHPSIIIWSLGNESGYGCNHNAMYAWSKKYDPSRPVQYEGGGSNTPATDIIAPMYARVDSDIEDEVVPKWAIKKWISLPNESRPLILCEYAHAMGNSLGSFADYWEAFRTFPRLQGGFIWDWVDQGLSQQDENGQHFWAYGGDFGDEINDRQFCINGLIFPDRTVHPTLEEAKFCQRMITVSLQDQTEGNCTLLITNENLFRATDNEQLNWSLLENGKVIQTGSQTLNIEANSQASLDITLNYTPKAEAQYHLNTDISLITATPWAHADYVVSSEQMALSNTTGLIIPTLKSQPAPMLTQQDNSILVSSLDEKHHWCWDKQSGLMTAWLINNNPQLLSAPQDNFFRAPLDNDIGISEVDNVDFNAWSSRWDAAGIGQWERQCIACNSETLAHAVKVTSTFTYHFNSTVQAITTWTYTLSNNGEMELVVDVKLADSLPSMPRIGLEFALPLNGQNTPITWQGLGPFENYPDRFAAARFGLYTQTLEQMHTPYIFPTDSGLRCGTQWLKVNELDISGDFQFSVSQFALQQLAKAKHTNDLIAEEKVYVRVDHQHMGIGGDDSWSQSVHKEFQLREKHYTYTITFNQKA

SEQ ID NO: 23265 - protein, 895 aa, Streptococcus thermophilus
MNMTEKIQTYLNDPKIVSVNTVDAHSDHKYFESLEEFSEGEMKLRQSLNGKWKIHYAQNTNQVLKDFYKTEFDETDLNFINVPGHLELQGFGSPQYVNTQYPWDGKEFLRPPQVPQESNAVASYVKHFTLNDALKDKKVFISFQGVATSIFVWVNGNFVGYSEDSFTPSEFEISDYLVEGDNKLAVAVYRYSTASWLEDQDFWRLYGIFRDVYLYAIPKVHVQDLFVKGDYDYQTKAGQLDIDLKTVGDYEDKKIKYVLSDYEGIVTEGDASVNGDGELSVSLENLKIKPWSAESPKLYDLILHVLDDDQVVEVVPVKVGFRRFEIKDKLMLLNGKRIVFKGVNRHEFNARTGRCITEEDMLWDIKVMKQHNINAVRTSHYPNQTRWYELCDEYGLYVIDEANLETHGTWQKLGLCEPSWNIPASEPEWLPACLDRANNMFQRDKNHASVIIWSCGNESYAGKDIADMADYFRSVDNTRPVHYEGVAWCREFDYITDIESRMYAKPADIEEYLTTGKLVDLSSVSDKHFASGNLTNKPQKPYISCEYMHTMGNSGGGLQLYTDLEKYPEYQGGFIWDFIDQAIYKTLPNGSEFLSYGGDWHDRPSDYEFCGNGIVFADRTLTPKLQTVKHLYSNIKIAVDEKSVTIKNDNLFEDLSAYTFLARVYEDGRKVSESEYHFDVKPGEEATFPVNFVVEASNSEQIYEVACVLREATEWAPKGHEIVRGQYVVEKISTETPVKAPLNVVEGDFNIGIQGQNFSILLSRAQNTLVSAKYNGVEFIEKGPKLSFTRAYTDNDRGAGYPFEMAGWKVAGNYSKVTDTQIQIEDDSVKVTYVHELPGLSDVEVKVTYQVDYKGRIFVTANYDGKAGLPNFPEFGLEFAIGSQFTNLNYYGYGA

SEQ ID NO: 23266 - protein, 167 aa, Bacillus anthracis
  misc_feature (140)..(140): Xaa can be any naturally occurring amino acid
MVLLYNGCQKIQLFINRVGENYMSMSLYYKKIREQLGHELIFIPSVAAVIKNEQGEILFQYPGGEYWSLPAGAIEPGETPEEAVVREVWEETGLKVQVKKQKGVFGGEEYRHTYPNGDQVEYIVVVFECEITSGKLKSIXGESLKLQYFSLSEKPPLALPYPDKIFL

SEQ ID NO: 23267 - protein, 220 aa, Saccharomyces cerevisiae
MTEQKALIKRITNETKIQIAISLKGGPLALEHSIFPEKEAEAVAEQATQSQVINVHTGIGFLDHMIHALAKHSGWSLIVECIGDLHIDDHHTTEDCGIALGQAFKEALGAVRGVKRFGSGFAPLDEALSRAVVDLSNRPYAVVELGLQREKVGDLSCEMIPHFLESFAEASRITLHVDCLRGKNDHHRSESAFKALAVAIREATSPNGTNDVPSTKGVLM

SEQ ID NO: 23268 - protein, 446 aa, Cryptococcus neoformans
MPLKRPSPGPHPLDLNPYERLQFEEKENRRSHNDTDHHATLTSRQEGLRRRAALGENVDISADGESKEDEGYSAQKRNDRLSSPEDTKTGEGKGKKSPLMSNLKLDDFRDTLEAGIERKFAPLHIPPHRRLQTAAVALWALLLPICMIVLLLLLSLPPMWLILIPYFIWISFDRAPIHGGRPKEWARKGFIWKYFADYYPCSIVKEAELPPNRPYLFGYHPHGIIGMGAFATFATEGTNFSEYFPGIKPHLLTLGSNFKIPFYRELLMIHGCGSVSKRSCANVLSQGPGSAIAIVIGGASESLSAHPGTADLTLKKRFGFVKMAIREGADLVPVFSFGENDIYAQLANAKGSMVYKLQKKFEKVFGFTLPLFYGRGLFNYNYGLMPFRHPIVSVVGKPIHVERDPHPSDEKVQELQGKYIAELTRIWDKYKDLYARGRTKELTLVE

SEQ ID NO: 23269 - protein, 180 aa, Unknown
  Silicibacter sp. TM1040
MSERPYVIDVMISAKAIAARIEELCGDITAEFGDTDKLVVVGLLRGSFVFIADLVRELDLPIEVDFLEASSYGDGMESSREVRILKDLRGAIEGRDVLVVEDIVDTGHTLNHVISLLKSRKPARLKSIALLDKPSRREVDFRADWIGFEIPDEFVVGYGIDFAQRNRNLPHIGKVRFTEV

SEQ ID NO: 23270 - protein, 395 aa, Zea mays
  misc_feature (383)..(383): Xaa can be any naturally occurring amino acid
MAVLSAAGAPPASAIGFEGYEKRLEITFSEAPVFVDPHGSGLRALSRSQIDSVLDLARCTIVSELSNKDFDSYVLSESSLFIYPLKIVIKTCGTTKLLLTIPRILELAEELSMPLAAVKYSRGTFIFPGAQPAPHRSFSEEVAVLNRYFGGLKSGGNAYVIGDAARPGQKWHIYYATEYPEQPMVNLEMCMTGLDTKKASVFFKTNADGNTTCAKEMTKLSGISEIIPEMEICDFDFEPCGYSMNAIHGSAFSTIHVTPEDGFSYASYEVMGLDATALSYGDLVKRVLGCFGPSEFSVAVTIFGGRGQAGTWGKELGAEAYDCNNMVEQELPGGGILIYQSFCAAEDAVASSPKSVLRCFDGENAAPFAKDCKLANLVCLEEXDAIEEKDGVLDE

SEQ ID NO: 23271 - protein, 188 aa, Gnetum parvifolium
TRHRWTGRYEAHLWDNSCKKEGQSRKGRQVYLGGYDQEEKAARSYDLAALKYWGPTTHINFPLSMYTKQIDEMKHMTRQEFVAHLRRKSSGFSRGASMYRGVTRHHQHGRWQARIGRVAGNKDLYLGTFSTQEEAAEAYDIAAIKFRGLNAVTNFDITRYDVNLICASASLPSGHVAKRHLQSQPFNE

SEQ ID NO: 23272 - protein, 322 aa, Brassica juncea
MASRIAKDVTELIGNTPLVYLNNVAEGCVGRVAAKLEMMEPCSSVKDRIGFSMISDAEQKGLIKPGESVLIEPTSGNTGVGLAFTAAAKGYKLIITMPASMSVERRIILLAFGVELVLTDPAKGMKGAIAKAEEILAKTPNGYMLQQFENPANPKIHYETTGPEIWKGTDGKIDGFVSGIGTGGTITGAGKYLKEQNPNVKLYGVEPIESAILSGGKPGPHKIQGIGAGFIPSVLEVDLIDEVVQVSSDESIDMARLLALKEGLLVGISSGAAAAAAIKLAKRPENAGKLFVAVFPSFGERYLSTVLFDATRKEAESMTFQA

SEQ ID NO: 23273 - protein, 184 aa, Photobacterium profundum
MALKSLAIVEAEWFFYPHIRVRMMMTTFYDISADNIRGESVSMNEFAGKLVLVVNTASECGFTPQYRGLQDLYAKYKDQGLVIIGFPCNQFGGQEPGENTDIAESCLINYGVDFPMFAKVDVNGADSHALFQYLVKALPGTFGSKVKWNFTKFMISRDGKPLKRFAPTKKPESMEADIVRALKA

SEQ ID NO: 23274 - protein, 181 aa, Yersinia pestis
MLAVKHTVEVMISEQEVKTRIAELGRQISEHYRDSGSDMVLVGLLRGSFMFMADLCRAIDVSHEVDFMTASSYGNGMSTTRDVKILKDLDEDIRGKDVLIVEDIIDSGNTLSKVREILQLRGPKSLAICTLLDKPERREVHVPVEWVGFTIPDEFVVGYGIDYAQRYRHLPYVGKVVTLDE

SEQ ID NO: 23275 - protein, 704 aa, Xanthomonas campestris
MAKITKTFQYGKHTVTLETGEIARQAGGAVIVKFDDTVLLVTAVAAKSAREGQDFFPLTVDYQEKFYAGGRIPGGFFKREGRATEKETLISRLIDRPIRPLFPEDYKNEVQIIATVMSMNPDIDGDIAALIGASAALSLAGTPFKGPIGAAKVGYKNGEYILNPTVTELKDSQLELVVAGTANAVLMVESEAELLSEEVMLGAVTFGHREMQKVINVINELTVEAGTKPSDWVAPAKNEGMIAALKEAVGDQLASAFQVRDKLQRRDAISAIKKDVLGALAPRATIEGWAAGDLAKEFGELEYQTMRGSVLSSKVRIDGRALDTVRPISAKAGVLPRTHGSALFTRGETQAIVITTLGTARDGQVIDAVSGEYKENFLFHYNFPPYSVGECGRFGAPKRREIGHGRLAKRGVLAVMPTLEEFPYTIRVVSEITESNGSSSMASVCGSSLALMDAGVPIKAPVAGIAMGLVKEGNDFVVLSDILGDEDHLGDMDFKVAGTAEGVSALQMDIKIEGITEEIMKQALQQAKAGRLHILGEMAHALTTPRQELSDYAPRLLTIKIHPDKIREVIGKGGSTIQAITKETGTQIDIQDDGTIIIASVNAIAAQAAKSRIEQITSDVEPGRIYEGKVAKIMDFGAFVTILPGKDGLVHVSQISSERVEKVGDKLKEGDLVRVKVLEVDKQGRIRLSIKAVEEGEGVQASAE

SEQ ID NO: 23276 - protein, 455 aa, Unknown
  Nocardioides sp. JS614
MRRRLVVVGGGAAGMSAASAARRVDRELEVVVLESGAHAAYGLCGLPYFLSDVVTEVDSLRAYPPTFFQEQRDINLRFGAEVVRIDPERQLVNFRSEGQSEHLHYDKLILTAGATPSLPPIPGLDDDHVFTIRNVAESVRLRCLLDAGHIGHATVVGGGYIGLEVVESFAERGVSVTLIEALPGLMANLDPEFSRRVEEEVRLHAEVRLSSGLVSLVRTDEGLTLSLADGDTIETDVVVVATGVRPASGLGSSIGANTGPHGALLVDEQMRTSVPNVFAAGDCIAPNHIVTGRPTFIPLGPAANKTGRVAGTVAAGGTACFSGVAGTAIVKVFGLGIGRTGLTLAEALSAGYDAQATDAVGRSRAKYFPGSAPIDVRLVHNSDGRLLGAQFVGVGDEVAKRVDVAAVALHAGLSVEDLADLDLSYAPPFAPVYEPILLAANSAVASLKPMEDLAH

SEQ ID NO: 23277 - protein, 324 aa, Brassica juncea
MASRIGIANDVTELIGNTPLVYLNSVAEGCVGRVAAKLEMMEPCSSVKDRIGFSMISDAEKKGLIKPGESVLIEPTSGNTGVGLAFTAAAKGYKLIITMPASMSIERRIILLAFGVELVLTDPAKGMKGAIAKAEEILAKTPNGYMLQQFENPANPKIHYETTGPEIWKGTEGKIDGFISGIGTGGTITGAGKYLKEQNPNVKLYGVEPVESAILSGGKPGPHKIQGIGAGFIPNVLETNLIDEVVQVSSDESIDMARLLAREEGLLVGISSGAAAAAAIKLAKRPENAGKLFVAVFPSFGERYLSTVLFDATRKEAESMTFEA

SEQ ID NO: 23278 - protein, 416 aa, Magnetospirillum magnetotacticum
MLRKHPRYVEAAVLERVCEPERQIIFRVPWVDDIGRVQINRGFRVEFNSALGPYKGGLRFHPSVYLGIVKFLGFEQIFKNSLTGMPIGGGKGGSDFDPRGRSDGEVMRFCQSFMTELYRHIGENTDVPAGDIGVGGREIGYLFGQYKRITNRYESGVLTGKGISWGGSLVRTEATGYGTVLFAQNMLETRGQELDGRRVVVSGSGNVAIYATAKAQQLGANVVAFSDSSGYVVDEAGVDLELLRQIKEVERGRVADYAARRPGARVVTDGSIWDVPCDVALPCATQNELDEAAAKQLVANGVVAVAEGANMPTTPSAVALLQEAGVLFAPGKAANAGGVATSALEMQQNASRDAWSFEYTEDRLAQIMAGIHDRCVETADEYGTPGNYVLGANIAGFTKFADAILAGDPLDRLTAC

SEQ ID NO: 23279 - protein, 310 aa, Rickettsia conorii
MKITTKVLIIGSGPAGLSAAIYTARAALKPILINGMQPGGQLTITTDVENYPGFAETVQGPWLMEQMYMQAKNVGTEIVSDYVEKVDLSKRPFKVFTGAGNEYDAESIIICTGAEAKWLGIASEQKFRGFGVSACATCDGFFFKNQEIVVVGGGNSAVEEALYLTNHANKVTIVHRRDSFRAEKILQDRLFKNSKISVIWDHVVDEIVGSNKPKSVTGVKIQNVHTKEISLLNCSGVFIAIGHAPNTGLFTGQIVMDDDNYIITKSGTTRTSVEGVFAAGDVQDKIYRQAVTAAGTGCMAALEAEKFLNK

SEQ ID NO: 23280 - protein, 146 aa, Glycine max
MPQGSLEVFLVNAKGLENTDYLCNMDPYVILICRTQEQKSSVASGQGSEPEWNEAFVFNVSEGVSDLRLKIMDSDSTTAHDLVGEATIPLDGLFIEGNIPPTSYNVVKDGHYCGEIRIGLTFTPQDRSERCPEENFGGWKESGYRD

SEQ ID NO: 23281 - protein, 467 aa, Lactobacillus acidophilus
MQQFGVIGLSVMGKNLALNVRNHGFSVSGYSIDKPEVDALAKYEDDKLKPCYTLEEFVNSLEKPRKILIQIMAGDPVDQTLHKLLPLLDKGDIVIDGGNSNYHDTNRRYHEMEKHGIHFIGMGVSGGEEGALNGPALMPGGDEEAYKEVAPILEAIAAKNKDGKPCVSYMGPEGAGHYVKMVHNGIEYAIMQEFSEVYSLLRDVAHKSNGEMSEIFDKWNHSVVEAYLSEITSKVLKQEDDLTPDHIIDHILNVASYKGTGNWTLEDGVALGAPVTVIAEAVMARFMSKQTHLALKSGIKPTEFKYDGEIPDDLVDEFGKTLQLAQAVAYAQGFQELTMAAKAYDWDLRYKSIAQGWEAGCIIRSAMLKDIEDAYADGKELTNLFEDGYFRKLMEDNLPALRKSVEFATKAGVPTPTLSAALNYLESIFNPKLPANMIQGQRDYFGAHTYQRNDREGVYHTEWYEEK

SEQ ID NO: 23282 - protein, 151 aa, Casuarina glauca
ALTEKQEALLKQSWEVLKQNIPAHSLRLFALIIEAAPESKYVFSFLKDSNEIPENNPKLKAHAAVIFKTICESATELRQKGHAVWDNNTLKRLGSIHLKNKITDPHFEVMKGALLGTIKEAIKENWSDEMGQAWTEAYNQLVATIKAEMKE

SEQ ID NO: 23283 - protein, 379 aa, Unknown
  uncultured marine group II euryarchaeote 37F11
MSDKRDYYEVLDVERTATEKDLKNAFRRLARKYHPDRSEEEDAENKFKEIQEAYAVLSDSDKRAHYDRFGHDSPGGNPFGGFSGGGFNINLEDLLGGDFFSGFFGGGGGGGGGRRRDRRGSDILVRHSIDLTTVISGSDESIELDLPSECIVCSGTGAKGGSTTTCNACQGQGRVRVRQQIGPFVNEVVQDCRECAGVGSTIDSKCQDCSGLGHKVESKTIRFSVPPGAEDGTRLRLRGQGQPAERGQGKTGDLLVEIEVLTHPWFERNGSDLIMSLPLGYPDLVLGTTITLDHIDGKTMDIVIPAKSSAGHTLEIKKRGLPRLRRNGRGDVIVLLKLHMPKSISKAEKKQLKAMKEGLNPNDQLQTILDDAADRRVNG

SEQ ID NO: 23284 - protein, 527 aa, Hordeum vulgare
MSSMQFSSVLPLEGKACVSPVRREGSACERLKIGDSSSIRHERASRRMCNGGAGAPPPPVRSACSPPTPARPTPLFSGRPSGGITPIRTRSRPSVAAVILGGGTGTQLFPLTSTRATPAVPIGGCYRLIDIPMSNCFNSGINKIFVMTQFNSASLNRHIHRTYLGGGINFTDGSVEVLAATQMPGEAAGWFRGTADAVRKFIWVLEDYYKHKSIEHILILSGDQLYRMDYMELVQKHVDDNADITLSCAPVGESRASEYGLVKFDSSGRVIQFSEKPKGDDLEAMKVDTSFLNFAIDDPAKYPYIASMGVYVFKRDVLLNLLKSRYAELHDFGSEILPRALHDHNVQAYVFTDYWEDIGTIRSFFDANMALCEQPPKFEFYDPKTPFFTSPRYLPPTKSDKCRIKEAIISHGCFLRECKIEHSIIGVRSRLNSGSELKNAMMMGADSYETEDEISRLMSEGKVPIGVGENTKISNCIIDMNARIGRDVVISNKEGVQEADRPEEGYYIRSGIVVIQKNATIKDGTVV

SEQ ID NO: 23285 - protein, 1289 aa, Yersinia pestis
MHTPIIWCNSLRTTFLLRGRFSLRSWFSLRTVLYCLLLISGQLHASLMTGRQGCDTGQPLTIHSIANSYNDDLLLTPATDTRQSSRRTVKVGVVMDANTPFVVNRDDNAIEGIVADYLKIISDASQLSFQMIGYCDYGLVLNALENGQIDLMAGTPMLAQPGLIASHAFFTNRHVEVRSKNWDPTKRTHPETVAIVNNEPLSPEFLFNYHADRIVAYPNQLQGLLAVAYGNADVFVANATSANYLIDQLQLLTLQIRNFAPYHPAPYSFLARESNQKLIDYLNQILELLPTRATGDIQQRWFGSKHHYNIDAKLLLTEQELSWIQHHPVVTYIAPLDLAPLIFRDRRTGEMAGFSVDLIDIIARRTGIKFDPVYTKDTGEGVRSFKAGKVDLLPIVAVRNGQYGNNLYSSSIAQSLWGIMTREDRMDINNVGDLAGKRVGIQAGSASSSIISNPLLAQRITFVEAPDTMTLVRWLQQGKVDAVVKNMMTANYLSAQNFSPNIKTVAVAGEEPLMMAFAIRPDLPELKTIIDKVIESIPPEEFDNLTSEWSTFKPKPISFDESSLDNELLMIALKISSGLLLVFGLYLCYLVFNKRRQAKLLHARLLQQESIINALPFAVFIRTASGELAVYNSHFADVHSDKLYDMLNQTHEPAHWPMTSPLDREIDKYCRSVLLNRKPQLVDLSVEIKGDIRDIFLWIIPLNNAEQGVLGGWLDISQRKTVERQLEAARVEAESANRTKSTFLATISHELRTPMYAIMGLLELEIRSNRPVEKDTLVTVSKSAQSLMLLLDDIIDSAKIEAGQLSIHPTAVDFHQEMERMFTLYQPIANERGLRFSGWLDDHIPPLLMADMLRVRQVMGNLLGNALKFTEQGSVSVDITWEPSDEQHGVMNIDITDTGIGISPAAQATLFQPFSQANEGKSPRFGGSGLGLWICHQLIHKMGGKIALESQLGKGTSLLITLPLNIATADDLAQDAAITHVDDERLNQLRNLRILVVDDLPANRQLLQQQLAFIGIEQVVTAENGAKACQILQHNNFDVVITDCSMPVMDGYELAAHIRQDPALKDLIVIGCTADAREESAARCIDAGMNACMIKPVAIDTLQATLLRKDIVSQISNTNHSQSTEDNDRGGNQSNLSEKNTAQQENAPAIHSTTITSSVNRLAAAQNKLRTLSGGNPAVELQLLQSLLESNLQDAVTLTQLYRQLCVEDEDVVETVDTAETVDTADTVEDGETRGPGSTVGRHSTAGSDHIPHADIYKQMASLVHRIKGSVQLIDAQELVASCVKFESQ

SEQ ID NO: 23286 - protein, 343 aa, Streptomyces coelicolor
MTFKAEYIWIDGTEPTAKLRSKTKIITAAPAGLDALPVWGFDGSSTNQAEGSSSDCVLKPVFSCPDPIRGGEDILVLCEVLDTDMTPHPSNTRAALAELSERFAAQEPVFGIEQEYTFFKGTRPLGFPEGGFPAAQGGYYCGVGSDEIFGRDVVEAHLENCLKAGLGISGINAEVMPGQWEFQVGPLAPLEVSDQLWVARWLLYRTAEDFEVSATLDPKPVKGDWNGAGAHTNFSTKAMREGYDAIITAAESLGEGSKPMDHVKNYGAGIDDRLTGLHETAPWNEYSYGVSDRGASVRIPWQVEKDGKGYIEDRRPNANVDPYVVTRLLVDTCCTALEKAGQV

SEQ ID NO: 23287 - protein, 412 aa, Unknown
  Polaromonas sp. JS666
MTNAKPLVIVGASYAGVQIAASARELGFAERIVIVGEEVHAPYQRPPLSKGMLTGKTTIDQLPLRGPDFFEQNEIELLLGRRAEVMDVGGRTVRLDDGATLEYSWLALATGARCRSFTLPGSKLEGVFNLRTLDDALRVADAADRAQRACVIGGGFIGLEVASALHSRGVDVTVIEAQPRLLMRSLPTRMAAYVEHAHRLRGTDLLTGRGVRALHGEQGRVASVELDDGMRIDCDLVVLGIGVQPNAEMAQQAGIAIDNGIVVDMLGRTSAPHVLAAGDVANMALPAAPGAPARMRFESIQAANDGAKAAASLMVGCAQPCVAVPWFWSDQFNLKFQMAGLPLPGDDVVLRGDMATDRFSVFYLRDGTLVAAHSVNKPSEHMQSRKLIGARAQFTAYQLADESFDLKKSGAH

SEQ ID NO: 23288 - protein, 182 aa, Oryza sativa
MLHVVYRVGDLDKTIKFYTECLGMKLLRKRDIPEERYTNAFLGYGPEDSHFVVELTYNYGVESYDIGTAFGHFGIAVEDVAKTVDLIKAKGGTVTREPGPVKGGKSVIAFIEDPDGYKFELIERGPTPEPLCQVMLRVGDLDHAINFYEKAFGMELLRKRDNPQYKYTIGWYFSKPLHGFTS

SEQ ID NO: 23289 - protein, 75 aa, Nicotiana trigonophylla
GNNILVICDAYTPAGEPIPTNKRHKAAQIFSDPKVVSQVPWFGIEQEYTLLQQNVKWPLGWPVGGYPGPQGPYYC

SEQ ID NO: 23290 - protein, 77 aa, Drimys granadensis
MKEQKLIHEGLITESLPNGMFRVRLDNEDLILGYVSGRIRRSFIRILPGDRVKIEVSSYDSTKGRIIYRLRNKDSND

SEQ ID NO: 23291 - protein, 242 aa, Candida glabrata
MATTVSSEYSTDTSNVPIEHRFNPYSDNGGTILGIAGEDFAVLAGDTRHTTDYSINSRYEPKVFDCGDNIIMSANGFAADGEALVKRFKNSIKWYHFDHNDKKLSISSAARNIQHLLYGKRFFPYYVHTIIAGLDDEGKGAVYSFDPVGSYEREQCRAGGAAASLIMPFLDNQVNFKNQYVPGTDGKVKRELKYLSLEEVIKLVRDAFTSATERHIHVGDGLEILIVTKEGVRTEFFELKRD

SEQ ID NO: 23292 - protein, 76 aa, Nicotiana quadrivalvis
GNNILVICDAYTPAGEPIPTNKRHKAAQIFSDPKVVSQVPWFGIEQEYTLLQQNVKWPFRLACWRLPRTSGPYYCG

SEQ ID NO: 23293 - protein, 481 aa, Ustilago maydis
MSATTASISAEQVARQARAAFESSSQLLSTSSSADATRSSALQSIRAALEAHKKRIQEANQLDMQAANALVEEGKLSSSLAARLDLFSKPGKWESLLDGVSEVAALASPLDQVQWAKRLAHETSTQAAIDLYRITCPIGVLLCIFEARPEVVVNIASLAIKSGNAAILKGGKESKHTAAILSSIISSALAQAGLPKHLIQTVETRSDIQSLLHLDEYIDLVIPRGSNELVRAIQRDARMPVMGHADGLCIGYVHEDAELDMVVGTVVDSKTDYPAACNALETLLVHESLLHRKDFWPPLAQALVSAGIQLRLDQVSLQCLDQLDASLRTSYASQIIAAQPADFTTEFLDLILAVKATDSLDSAISHITTHSSGHTDLILTSSSSPNRAAHKFVKSINSANVFVNISSRFADGFRFGLGTEVGISTGKTHARGPVGLDGLVIYKYVARSNPSTTKNAAQTAAQFNAGRKWAHSPIEPNYPTL

SEQ ID NO: 23294 - protein, 373 aa, Coccidioides immitis
MASAARTLTRAFARATPATSSARSSVTRSSLRFSAPAYTFRASSRRGYSSGAEGGKSSSGLIWGLAAVAAGGAGAFYYLNGDHLSSNSAKPTIISDPTKEDFQKVYDEIARLLVEKDDYDDGSYGPVLVRLAWHASGTYDKETGTGGSNGATMRFAPESDHGANAGLKAARDFLEPVKKKFPWISYSDLWTLAGSCAIQELGGPDIPWRPGRKDADMTACTPDGRLPDASKDQKHIRAIFGRMGFDDREMVALCGAHALGRAHSDRSGYDGPWDFSPTVFTNEFFKLLLDEKWVQKKWNGPKQFTDNTTKTLMMLPTDMALIKDKEFKKHVDRYAKDSDVFFKEFSDVFVKLLELGVPFTSKAEDRYVFKRSE

SEQ ID NO: 23295 - protein, 247 aa, Ralstonia metallidurans
MSVTMREMLEAGCHFGHQTRFWNPKMAPFIFGHRNKIHIINLEKTLPMFQDALKYVRQLAANRGTVLFVGTKRQSREILAEEAGRAGMPYVDARWLGGMLTNFKTVKISIKRLKDMEAAKEAGALETMSKKEALMFEREMEKLEKSIGGIKDMGGIPDAIFVVDVGYHKIAVTEANKLGIPVIGVVDTNHSPEGIDYVIPGNDDSSKAVALYVRGVADAILEGRANAVQEVVEAARGDDEFVEVQEG

SEQ ID NO: 23296 - protein, 341 aa, Solanum chacoense
MAELLSNWSSTLEAVPPSHCIPVHERPSDPVEIVDSIPVIDLGKANGEERSAVVKDLLKAFEEYGFFQIINHGVPVDLMDEAMKVYKEFFSLPAEEKAEYAKDAANDTNRGAATLYSSSAKHYDSEEHRYWRDVLEHSCNLDGKDKKTWPSNPPRYREVIGAYGDELRRVSKVILGLLAEGLGLEAGFFDKELGQRMLVNHYPACPDPSLTLGVGGHCDPNLITIIQQEVYGLQILKDDKWIGVQPIRNAFVVNSGLPITVVSNGKLTSVAHRVVTNTTHSRTSIGTFICPHDIVEPAKALVGPENPPQFKSFNWGIDFMPHYLSKKSVYHASLEPFKIDA

SEQ ID NO: 23297 - protein, 345 aa, Streptomyces avermitilis
MTNTATTPSYQRYQQLPIIDLSAADRGPQARALLHAQLHSAAHDVGFFQLVGHGVTQAETDELLRAMHAFFALPEADRLAIDNVNSPHFRGYTRTGDERTGGSRDWRDQLDIGAERPVRTPGPGEPAYWWLEGPNQWPAALPELRTAALAWIDKLSAVAQRLLHELLTAIGAPAGFYDPVFGEHAHPHLKLVRYPGSAGDGADQGVGAHKDYGFLTLLLQDQVGGLQVQREDGLFHEVPPLPGAFVVNLGELLEVATNGYLLATNHRVVSPPGATERFSVPFFYNPRLDARVEPLPFPHASTAPGVTDDPANPLFAEYGLNELKGKLRAHPLVAARHHAELLTPA

SEQ ID NO: 23298 - protein, 372 aa, Coccidioides immitis
MQERHVMHILTKASIARFKPVELNITTNSRISGGSLVKFSFAVTSCVVGHYIVCLCTLFDLLILISVHSGQFCPGHAKDLLEEVIQAAIQKDMRIFCLTEHMPRHTEDLYPEEVGTNTLETMLEVEAAYFKEATRLREKYQSQINLPIGFECDWIRPSSLDLIKQSLDKYPFDFFIGSVHHVHTIPIDYDRDFYIRAREISGGTDEKIFGDYFDSQYKMLMELKPPVVGHFDLIRLMSESPDRSFKHWPNVWEKILRNLDFVAGYGGILELNSASLRKGMVEPYPKAEICKEFIARNGRFCLSDDSHGVHHVALNYSRVRDFLDTAGITTIHYLKYEPDSTAPADDFRFPNMRIGSISVEDLKKESFWEITA

SEQ ID NO: 23299 - protein, 220 aa, Saccharomyces cerevisiae
MTEQKALVKRITNETKIQIAISLKGGPLALEHSIFPEKEAEAVAEQATQSQVINVHTGIGFLDHMIHALAKHSGWSLIVECIGDLHIDDHHTTEDCGIALGQAFKEALGAVRGVKRFGSGFAPLDEALSRAVVDLSNRPYAVVELGLQREKVGDLSCEMIPHFLESFAEASRITLHVDCLRGKNDHHRSESAFKALAVAIREATSPNGTNDVPSTKGVLM

SEQ ID NO: 23300 - protein, 181 aa, Unknown
  Dehalococcoides sp. CBDB1
MNRMKLSLFIPKTEIEVYLERLAYEINRDFKDRPLVVIGVLKGSFVFMADLIRRLNMPVELDFVGLASYGKNTQSCGKVHLTRPLNRDIAEKDILVIEDIVDSGLTVSYLLKYLKKRRTNSVKLCALLSKPSRRVCPVEIDYLGCEVEDKFLVGYGLDWAECYRQLPEIFALEEKPDADKP

SEQ ID NO: 23301 - protein, 548 aa, Streptomyces avermitilis
MIEPHAPAPPGAAPPWGGQSRPWLPVRPGVGRFFVLAGVFVCAACGLVYELELVALASYLIGDSVTQASVVLSVMVFAMGIGSLAAKRLRPHAAAGFGAIEAALALVGGSSAMALYAVFAWTGDWGGVWAGGPRCLLVAFSLAIGLLIGAEVPLLMELIQRIRRQDAGGAVADLFAADYVGALVGGLAFPFLLLPLLGQLEGVLLTGTVNALAGGALVLGLFRRDLTRRGRWLLIVVNLVVLGLLATAAVLVDDFERAARQAVYGRDVRVALQTGVQEVVLTGGTRGRPLDLFLDGRLRVSGHDERRYHEALVHPAMSDGRHARVLVLGGGDGLAAREVLRYADVARVDVVELDAGVVRLARRDPALSSLNAHAYDDPRVHVVTADAFCRLRHTRSAYDVVISDLPDPGITASTKLYSQEFYGLVSRVLAPGGRLVVHAGPVASRPRAYWTVEATVRAAGLRTVPYRVGGRDTGFAAGPDRSTDASRAPRDWGFVLASRTGPALSLGPGGPRLRTLTRASLAADALDPGRARPPDVAPSTLVHPRYAD

SEQ ID NO: 23302 - protein, 319 aa, Photorhabdus luminescens
MSAAKHHKLIILGSGPAGYTAAVYAARANLNPVLITGVERGGQLTTTTEVENWPGDPEGLTGPGLMERMHQHAEKFQTEIISDHIQKVDLQSRPLRLYGDEQEYTCDALIIATGASARYLGLPSEEAFKGRGISACATCDGFFYRNQKVAVVGGGNTAVEEALYLANIAAEVHLIHRRDTFRSEKILISRLMDKVKNGNIILHTDRILDEVLGDDMGVTGVRLRDTKSGATEELAVTGTFIAIGHTPNTAIFESQLELDNGYIKVQSGLQGNATQTSIPGVFAAGDVMDHTYRQAITSAGTGCMAALDAERFLDGLAAK

SEQ ID NO: 23303 - protein, 472 aa, Staphylococcus epidermidis
MGSTVKYRKFILPIVVGLIIWALTPIKPDALNDQAWFMFAIFVSTIIACITQPMTIGAVSIIGFTIMILVGIVDTKTAVQGFGNSSIWLIAMAFFISRGFVKTGLGRRIALQFVKLFGKKTLGLAYSLVGVDLILSPATPSNTARAGGIMFPIIKSLSESFGSSPRDGSERKMGAFLIFTEFQGNLITSAMFLTAMAGNPIAQSLAEKTAHVQITWMNWFVAAIIPGLISLIVVPFIIYKLYPPTVKETPNAKKWATEQLEEMGHMSIAEKLMVGIFIIALALWVLGSFINVDATLTAFIALALLLLTGVLAWSDILNETGAWNTLVWFSVLVLMAEQLNKLGFIPWLSKLIAQGLNGFSWPIVLVLLILFYFYSHYLFASATAHVSAMYAALLGVAVASGAPPLFSALMLGFFGNLLASTTHYSSGPAPILYAAGYVTQKRWWTMNIVLGIVYFIIWIGVGSLWMKLIGMM

SEQ ID NO: 23304 - protein, 715 aa, Glycine max
MENTDPCRHFLKDVKRIIIKVGTAVVTRQDGRLAVGKLGALCEQIKELNSLGYEIILVSSGAVGLGRQRLRYRKLINSSFADLQKPQVELDGKACAAVGQNSLMALYDVLFSQLDVTSAQLLVTDNDFRDKDFRMQLSETMKSLLALKVIPIFNENDAVSTRKAPYEDSSGIFWDNDSLSALLALELKADLLILLSDVEGLYSGPPSDPRSKLIHTYIKEKHQSEITFGDKSRVGRGGMTAKVKASIHAAEAGIPVIITSGYAAENIIKVLQGQRIGTLFHKDAHKWAPVKEVDAREMAVAARDCSRRLQALSSEERKQILLKIADALEAHQNEIRIENEADVADAKEAGYEKSLVARLVLKNEKLASLANNIRIIANMEDPIGRVLKRTELAEGLILEKTSSSLGVLLIVFESRPDALVQIASLAIRSGNGLLLKGGKEAKRSNAILHKVITEAIPDIVGSKLIGLVTSRAEIPELLKLDDVIDLVIPRGSNKLVSQIKSSTKIPVLGHADGICHVYVDKSADLEMARRIVLDAKIDYPAGCNAMETLLVHKDLVEKGWLNSIIIDLRTEGVTLYGGPKASPLLNIPMARMLHHEYNSLACTVEIVDDVYAAIDHINLYGSAHTDSVVAEDHEVANVFLRQVDSAAVFHNASTRFSDGARFGLGAEVGISTSRIHARGPVGVDGLLTTRWILKGSGQIVDGDKAVNYTHRDLSI

SEQ ID NO: 23305 - protein, 292 aa, Brassica napus
  misc_feature (43)..(43): Xaa can be any naturally occurring amino acid
RHEASLSYSSSSTFIATTTLSSSLKLNPQSFIFHLNLRKPAPXEACASSLAMESQKPMFQVENFDDEFVQKLVYDALVWCSLHGLVVGDKTYQKSGTVPGVGMTHAPISLLPTQFPESYWKQACEVAPIFNELVDRVSLDAKFIQDSLSRTKKADIFTSRLLDIHSKMLESNKKEDIRLGLHRSDYMLDEETKSLLQIEMNTISCSFPGFGRLVTELHQSLLRSHGDHLGLDSERVPRNASTCQFADAMAKAWLEYNNPRAVVMVVVQPDERNMYDQHWLSSVLREKHSIVT

SEQ ID NO: 23306 - protein, 204 aa, Glycine max
IRLEVSSSLLAKLCITFFRCYRKRVSAVTEQFDNCMKKQVEAIARVLHLFQSYKEDNIPCKIDEGLYLGSIATAANKPALKDCNITHVLTVAGRIPPAHPHDFVYKIIDVVDKDDEDLKQYFNECFDFIDEAKRHDGGVLVHCFAGRSRSVTIVVAYLMKTRGMSFFEALQHVRSIRPAAGPNQGFICQLQDFEKSLQGANKLH

SEQ ID NO: 23307 - protein, 641 aa, Oryza sativa
MMGGGLVMDQGMMFPGVHNFVDLLQQNGGDKNLGFGALVPQTSSGEQCVMGEGDLVDPPPESFPDAGEDDSDDDVEDIEELERRMWRDRMKLKRLKELQLSRGKDPAGGVVGDPSKPRQSQEQARRKKMSRAQDGILKYMLKMMEVCRAQGFVYGIIPEKGKPVSGASDNLRGWWKEKVRFDRNGPAAIAKYQADNAVPGFESELASGTGSPHSLQELQDTTLGSLLSALMQHCDPPQRRYPLEKGVPPPWWPTGDEEWWPELGIPKDQGPPPYKKPHDLKKAWKVSVLTAVIKHMSPDIEKIRRLVRQSKCLQDKMTAKEISTWLAVVKQEEELYLKLNPGARPPAPTGGITSAISFNASSSEYDVDDCKGDEAGNQKAVVVADPTAFNLGAAMLNDKFLMPASMKEEATDVEFIQKRSASGAEPELMLNNRVYTCHNVQCPHSDYGYGFLDRNARNSHQYTCKYNDPLQQSTENKPSPPAIFPATYNTPNQALNNLDFGLPMDGQRSITELMNMYDNNFVANKNLSNDNATIMERPNAVNPRIQIEEGFFGQGSGIGGSNGGVFEDVNGMMQQPQQTTPAQQQFFIRDDTPFGNQMGDINGASEFRFGSGFNMSGAVEYPGAMQGQQKNDGASEFEELE

SEQ ID NO: 23308 - protein, 769 aa, Oryza sativa
MASHIILPKEEEAALGVAVEEDHDSPAAPGYQHQQGPPVAKALPFSATCVRISRDSYPNLRALRNASAMSLPDDDAAYAKLEEGDYGYLLDDVPHFTDYLSDLPTFPNPLQDHPAYSTVKQYFVNADDTVPEKVVVQKDSPRGVHFRRAGPRQRVYFESEDVKACIVTCGGLCPGLNTVIRELVCGLSHMYNVNDIFGIQNGYKGFYSSNYLPMTPKSVNDIHKRGGTVLGTSRGGHDTKKIVDNIQDRGINQVYIIGGDGTQKGAYEIYKEIRRRGLKVAVAGVPKTIDNDIAVIDKSFGFDSAVEEAQRAIDAAHVEASSAENGIGLVKLMGRYSGFIAMYATLASRDVDCCLIPESPFYLEGEGGLFEYIEKRLKENNHMVIVVAEGAGQDLIAKSIAAADQIDASGNKLLLDVGLWLTHKIKDYCKNKKMEMTIKYIDPTYMIRAIPSNASDNVYCTLLAHSAIHGAMAGYSFTVGMVNGRHAYIPFHRVTSTRNKVKITDRMWARLLSSTNQPSFLSQKDIDAAREADKLASKSPVPVNTKEHGENVKKPANGEGSSDAVVQEPFATTPTSPAALAAGAVSNPALTPAAVSMSFYDVNAGEQPSREDEAPEEVVEAAVANGAPTAVEKHNKLYSPAETPAGSGTRPHPTADAVAETAGAAPDDVDGCTTPPPPPVHDSEGSDTQSADDHGSPQREKPRTTSTAGGVKRDVAPSWSSRLLAFRSFSRDKKAKATVDARPPAHGKARDEGDEHKEKGKERRKRFWK

SEQ ID NO: 23309 - protein, 473 aa, Burkholderia xenovorans
MKTLFLQAPSYDGFDGGAGSRYQAKREVRSFWYPTWLAQPAALVPDSRVLDAPADGLSVEQTLDIAEQYDLVVIHTSTPSFPTDALFAEDLKKRKPSVLIGMVGAKVAVDPHNSLTATEAIDFVCREEFDFTCQEVAEGKPFAQIKGLSYRAADGSIEHNEARPILENMDELPFVAPVYKRDLKIDNYFIGYLKHPYVSIYTGRGCRSKCTFCLWPQTVGGHRYRTRSVENVLAEVKWIRDNMPEVREIMFDDDTFTDFKPRVEEIARGLGQLGVTWSCNAKANVPYPTLKIMKENGLRLLLVGYESGDDQILLNIKKGLRTDIARRFSDDCRKLGIKIHGTFILGLPGETQDTIQKTIEYAKEINPHTIQVSLAAPYPGTTLYNQAVDNGWLEENKVINLVSKSGVQLAAIGYPHLSRDEIYHQLENFYKRFYFRPSKIWEILREMLTSWDMMKRRLREGVEFFRFLRAHEA

SEQ ID NO: 23310 - protein, 420 aa, Rhizobium leguminosarum
MVEKRVQPLARDAMAYVLAGGRGSRLKELTDRRAKPAVYFGGKARIIDFALSNALNSGIRRIGVATQYKAHSLIRHMQRGWNFFRPERNESFDILPASQRVSETQWYEGTADAVYQNIDIIQDYGVEYMVILAGDHVYKMDYEWMLQQHVDSGADVTIGCLEVPRMEAVGFGVMHVNDKDEIIAFVEKPADPPPIPDKPDFALASMGIYVFHTKFLLDALRRDAADPNSSRDFGKDIIPYIVKNGKAVAHRFAKSCVRSDFEHEPYWRDVGTIDAYWQANIDLTAIVPELDIYDKSWPIWTYAEITPPAKFVHDDEDRRGSATSSVVSGDCIISGAMLNNSLLFTGVRANSFSKMEGAVILPNVKIGRRAQLKNVVIDHGVVIPEGLVVGEDAELDAKRFRRTESGICLITQPMIDKLDI

SEQ ID NO: 23311 - protein, 161 aa, Bacillus cereus
MSIEVGSKLQGKVTGITNFGAFVELPEGLTGLVHISEVADNYVKDINDHLKVGDQVEVKVINVEKDGKIGLSIKKAKEREKTEGDRPRGEYQRGGDQQRSGRPQRNNRSFNRDNRGGGNDRAPKETFEQKMARFLKDSEDRLTSLKRNTESKRGGRGARRG

SEQ ID NO: 23312 - protein, 329 aa, Methylobacillus flagellatus
MKISILGAGAWGTALALQISRRHQVSLWTRNQAHIVDMQVTRANLQYLGDFAFGDQLAVEGDLGRALDGADLIVSVVPTNGFRNALKEIKRLGCDAPVVWASKGLEAATAKLPHEVAQDELGDSRHWGVLSGPSFAAELVRGLPTAVTLAANDAEFAARAGAMLHGGNFRVYTSTDVIGVSVGGALKNVLAIAAGISDGMQCGNNARAALITRGIAEMTRFGVALGGAKETFMGLTGAGDLILTCTGQYSRNREVGLRLANGQTLQEILKTLGHVAEGVHTAREVVKRAGQLGVEMPITQEVDQVLSHGRSPRQAMENLLSREQKSEAL

SEQ ID NO: 23313 - protein, 528 aa, Oryza sativa
MMGGGLVMDQGMMFPGVHNFVDLLQQNGGDKNLGFGALVPQTSSGEQCVMGEGDLVDPPPESFPDAGEDDSDDDVEDIEELERRMWRDRMKLKRLKELQLSRGKDPAGGVVGDPSKPRQSQEQARRKKMSRAQDGILKYMLKMMEVCRAQGFVYGIIPEKGKPVSGASDNLRGWWKEKVRFDRNGPAAIAKYQADNAVPGFESELASGTGSPHSLQELQDTTLGSLLSALMQHCDPPQRRYPLEKGVPPPWWPTGDEEWWPELGIPKDQGPPPYKKPHDLKKAWKVSVLTAVIKHMSPDIEKIRRLVRQSKCLQDKMTAKEISTWLAVVKQEEELYLKLNPGARPPAPTGGITSAISFNASSSEYDVDVVDDCKGDEAGNQKAVVVADPTAFNLGAAMLNDKFLMPASMKEEATDVEFIQKRSASGAEPELMLNNRVYTCHNVQCPHSDYGYGFLDRNARNSHQYTCKYNDPLQQFFIRDDTPFGNQMGDINGASEFRFGSGFNMSGAVEYPGAMQGQQKNDGSNWYY

SEQ ID NO: 23314 - protein, 161 aa, Solanum tuberosum
MGCFNSKVKKQFRGHEDPIALASQTAFSVSEVEALFELFKSISSSVIDDGLISKEEFQLALFKNRKKENLFANRIFDLFDVKQKGVIDFGDFVKGLHVFHPNAPQEEKVNFSFKLYDLDGTGFIERQEVKQMLIALLCESEMKLADETIESILDKIVTLYM

SEQ ID NO: 23315 - protein, 136 aa, Mycobacterium avium
MKILARFRKAEPASIYDRIGGHEALEVVVENFYVRVLADEQLSGFFTGTNMNRLKGKQVEFFAAALGGPHPYTGAPMKQVHQGRGITMHHFGLVAGHLADALTAAGVPSETVSEILGAIAPLAPEIATGEAGKVTV

SEQ ID NO: 23316 - protein, 340 aa, Bacillus anthracis
  misc_feature (273)..(273): Xaa can be any naturally occurring amino acid
MTKITVVGAGSWGTALAMVLADNGHDVRIWGNRSELMDEINTKHENSRYLPGITLPSTIVAYSSLEEALVDVNVVLIVVPTKAYREVLQDMKKYVAGPTTWIHASKGIEPGTSKRISEVIEEEIPEDLIKDVVVLSGPSHAEEVGLRQATTVTSAAKRMEAAEEVQDLFMNSYFRVYTNPDIVGVELGGALKNIIALAAGITDGLGLGDNAKAALMTRGLTEIARLGRKMGGNPLTFAGLTGMGDLIVTCTSVHSRNWRAGNMLGKGHSLEEXLESMGMVVEGVRTTKAAHELAEKMEVEMPITAALYDVLFNGNNVKDAVGSLMGRVRKHEVEAIPDLL

SEQ ID NO: 23317 - protein, 180 aa, Bacillus cereus
MMNQDIEKVLISEEQIQEKVRELGAIIAEDYKNTVPLAIGVLKGAMPFMADLLKRTDTYLEMDFMAVSSYGHSTVSTAEVKILKDLDTSVEGRDILIVEDIIDSGLTLSYLVDLFKYRKAKSVKIVTFLDKPTGRKVDLKADYVGFTVPHEFVVGYGLDYKEQYRNLPYVGVLKPSVYSN

SEQ ID NO: 23318 - protein, 409 aa, Myxococcus xanthus
MSAVEGTNYYFRKAARIMDVGTPIETLLATPLREVKVQVSIEMDSGEIRTFLGYRIQHDNSRGPMKGGLRYHPMLDQDECASLASLMTWKTAVVNVPYGGAKGGIACDPSQLSIKELERLTRKYVDQVQDVIGPTRDIPAPDVNTNPQVMAWIMDQYSRYHGHSPAVVTGKPLELYGSKGREAATGRGLLYVAREILRDLGLPVKGTRFALQGFGNVGGHTAQLLWEDGGVVVAVADALGGVRNPQGLDIPSLFEHVKRTGTVTGFSGGASCSNDDVLGADCEVLIPAALGHVLTRENAHAVRAKLIIEGANGPTQPEADEIFEKRGIFVVPDVLASAGGVTVSYFEWVQNLQHLSWEEDRVNAELEKSMKEAYERVAQVARSRKVSMRTAAYILAIGRVGKATVLRGI

SEQ ID NO: 23319 - protein, 658 aa, Rhizobium leguminosarum
MRGNSSAQAGAIVFETGVEFAVWSHHAAQIELCLFEDDGNREFARLPMARDSNYFHRLFVDGLKAGARYGYRADGIYAPDNGLWYDPSKLLIDPYAKEIDRPFRYDPRLGIYGEDSQDLMPKAIVTTDTRAAIRKPLFKPGGFIYEVAVRPFTILHPDVPEAERGTVAALAHPSVVAHLKRIGVDAVELMPITAWIDERHLPPLGLTNGWGYNPVAFMALDPRLVPGGMTELRETVAALHAEGIAVILDLVFNHTGESDRYGATLSLRGLDNLHYYRHAQNCPGELVNDTGTGNTLACDHPEVRRLVIDSLRHFVLNAGVDGFRFDLAPVLGRTATGFERDGTLAAILSDDVLADRIMIAEPWDIGPGGYQLGNFPPHFLEWNDRVRDDLRCYWRGDGWKTGALATALAGSSDIFSRNEGKETRSVNFLAAHDGFTLIDLVSYAGKHNDANGEHNRDGHNENHSWNNGVEGETVYPTIRKRRRDDVMALISTLFVTRGSIMLTAGDEGGRSQHGNNNAYCQDNEITWLDWKALDGDLIAHTTFVAGLRRRFTVFSERDFLSGNGDVEWISLSGEPMTVAEWETPSLSTLGMLLSTGDRSSSGRQTRLGVLFNRSGSRQFFTLPSEGEPGWRQLTPDGAKKTGGRATVEPRSIAFFVEN

SEQ ID NO: 23320 - protein, 266 aa, Bordetella parapertussis
MTPTGKIAAIQFDVRQGENDANRARSCELARQAAAAGANLIVLPECCVGGLVFDSRDEIRAVSETVPGPSTRAWSQVSRETGAWIVAGLSETDGAKIYNTAVLVGPNGELHRHRKLHVRGIEQRLFDVGDALTCVDTPLGRIGLAICYDMWFPEVCRNYALDGVDVVAAPANWSKSVRTADAFDAYGLPQGYHLMAATAVSNELVVVAADRVGTERGVAFLGTSCIFGPSGEEQILLADWPDIAAVRAQGGPHLGQRQPAVYPVTR

SEQ ID NO: 23321 - protein, 307 aa, Bacillus cereus
MRVAQSVSELIGKTPIVKLNRIVESDSADIYLKLEFMNPGSSVKDRIALAMIEDAEKKGLLKEGDTIIEPTSGNTGIGLAMVAAAKGYNAILVMPETMSIERRNLLRAYGAELVLTPGPEGMGGAIRKATELAKEHGYFIPQQFKNQSNPEIHRLTTGPEIIEQMGDQLDAFIAGIGTGGTITGAGEVLKEAYKDIKIYAVEPADSPVLSGGKPGPHKIQGIGAGFVPETLDVEVYDEIIQVKTEQAFEYARRVAKEEGILVGISSGAVIYAATEVAKKLGKGKKVLVIIPSNGERYLSTPLYQFES

SEQ ID NO: 23322 - protein, 263 aa, Unknown
  Nicotiana langsdorffii x Nicotiana sanderae
PCYLKSMYQSRGIYLNAKVALCIHNIAYQGRFTFSDSSLLNLPNEYKSSFDFIDGYEKPVKGRKINWMKAGILESHRVVTVSPHYAQELVSGVDKGVELDNILRKTCITGIVNGMDIQEWNPATDKYTDVKYDITTVMDAKPLLKEALQAAVGLPVDRKIPLIGFIGRLEEQKGSDILVAAIHKFIGLDVQIIVLGTGKKEFEQEIEQLEELYPNKAKGVAKFNVPLAHMITAGADFMLIPSRFEPCGLIQLHAMRYGTVPIC

SEQ ID NO: 23323 - protein, 105 aa, Streptococcus thermophilus
PLTYSGLSGVGDLIVTGTSIHSRNWRAGDALGRGEKLEDIERNMGMVIEGISTTKVAYEIAQELGVYMPITTAIYKSIYEGADIKESILNMMSNELRSENEWDKK

SEQ ID NO: 23324 - protein, 554 aa, Bacillus cereus
MSRKIVVVGGVAGGASVAARLRRLSEEDEIIMVERGEYISFANCGLPYYIGGVITERQKLLVQTVERMSKRFNLDIRVLSEVVKINKEEKTITIKNVTTNETYSEEYDILILSPGAKPIVPSIPGIEEAKALFTLRNVPDTDRIKAYVDEQKPRHATVIGGGFIGVEMVENLRERGIDVTLVEMANQVMPPIDYEMAAYVHEHMKKHNVELVLEDGVDTLEEHGTVVRLKSGSIIETDMIILAIGVQPESSLAKDAGLALGVRGTIKVDERFQTSDPHIYAIGDAIEVKDFVTETETMIPLAWPANRQGRMLADIIHGHTDSVYKGTLGTSVAKVFDLTVASTGVNEKILKRLNIPYEVVHVQANSHAGYYPNATPVLIKLIFNKDSGKIYGAQALGRDGVDKRMDVIATAMKANLTVIDLPDLELSYAPPYSSAKDPVNMVGYAASNIVDGFVETVQWHEIDHIVENGGYLIDVREPNELKQGMIKGSIHIPLDELRDRLDEVPVDKEIYITCQLGMRGYVAARMLMEKGYKVKNVDGGFKLYGTVVPERVVY

SEQ ID NO: 23325 - protein, 368 aa, Archaeoglobus fulgidus
MKEVNKVEFEDLGISENGLNAVRRKGFEKPTEIQREIIPRFFEGEKDMVGQAQTGSGKTAAFALPILDLVDERSKDVQAIVITPTRELALQVKDEIESLRGGKKVHVLAVYGGQPIFPQIERLRKGVQIVVGTPGRVIDHLERRTLSLEKVRFFVLDEADRMLDMGFIDDIERILRHAGAERRVLMFSATMPPEVLRLARRYMRDYEVVRVHSKITPENVEHRCLKVNPEKRFEHLCRILDENNFYGIVFCQTKKETRELGRRLRARGYKADALNGDIPQHKRESILRNFRKGYTRVLVATDVAARGIDVKDLTHVVNYSIPQDPEAYIHRTGRTGREGKRGKAITFVAPWESRKLKIIERTAKVRFR

SEQ ID NO: 23326 - protein, 469 aa, Bacillus cereus
MEKLQIGVVGVGVMGKSLALNFESKGYSVALYDISKEKVDEIIEENRGKKLVGTHIVEEFVKSLESPRKILLMVNAGEITDKAIDSLVPHLDKGDILIDGGNTYFVDTIRRNKRLAEEGINFIGAGVSGGEEGALKGPSIMPGGQKDAYEKVKDMLENISAKVNNEPCCSYIGPNGAGHYVKMVHNGIEYGDMQLICEAYFFLKQTLDLTAEEFHEIFAEWNKGELNSYLIEITADIFKKKDEETGKPLVDVILDTAGQKGTGKWTSQSALDLGISLPIITESVFARCISALKEERVNASKVLSGPKDKTAIGVEKAELIEAVRQALYMSKICSYAQGFTQLKAASEEYDWNLDFGSISMLWRGGCIIRAAFLQNIKEAYETNTDLPNLLLDPYFKEIVESYQGGLRQIISMAVQQGIPIPAFSAAISYYDSYRTAKLPANLLQAQRDYFGAHTYKRVDKEGTFHTKWI

SEQ ID NO: 23327 - protein, 385 aa, Oryza sativa
SLFKMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGQ

SEQ ID NO: 23328 - protein, 147 aa, Desulfovibrio desulfuricans
MKGQRNIGMVAHDERKEDLLDWVQHNLQALIPHRIFATGTTGGLLRQRFGDLTITPMKSGPLGGDQQLGSMIAEGRLDMLFFLIDPMAPHPHDVDIKALLRLAVLYNIPAAYNRSTADFLITSPFMTGEYIPEIKDYTPYVKRLGAK

SEQ ID NO: 23329 - protein, 53 aa, Oryza sativa
QVNTVRQFYENLVPSYTICDIDCPDYSFRKFTDDGNYLVAFSRNHQDLIVYRP

SEQ ID NO: 23330 - protein, 341 aa, Triticum aestivum
  misc_feature (80)..(80): Xaa can be any naturally occurring amino acid
MFSSWSIRPHIYMYVVVHIFVEVQLQIRPRHGRARVHLLFPFMRSAFKLMQIDQEFNIFHGVKRAVDLCAAPGSWSQVLXRNLYLPAKLTSDGKDGGLPLIVAIDLQPMAPIEGVIQVQGDITNARTAEVVIRHFDGCKADLVVCDGAPDVTGLHDMDEFVQSQLILAALTIVTHVLKVGGKFVAKIFRGKDTSLLYCQLKLFFSQVTFAKPKSSRNSSIEAFAVCENYSPPEGFKEKDLYHLLEKVGTPSGADDLDCRSGWLEGPNKVYIPFLACGDLSGYDSDRSYPLPSTEGGTYQSLDPVQPPIAPPYKTALEMKKASSHGAGTDTSKLSLDPQTTL

SEQ ID NO: 23331 - protein, 149 aa, Bacillus subtilis
MYTQGAFVIVLNESQQILLVKRKDVPLWDLPGGRVDPGESAEEAAVREILEETGYNAALSAKIGVYQRPKFQDEQHLFFGSITGGQAMADGTETAGLKWVSPGRLPLFMVPNRKRQINDFKNGAQDVNVTVKDSGLLAAIDLLKRRLGK

SEQ ID NO: 23332 - protein, 516 aa, Oryza sativa
  misc_feature (59)..(59): Xaa can be any naturally occurring amino acid
MAVTRLAVAAALSAAPPSSRRRRAFFHHSCRPLPSSAAAAAKALRASAAPAVDEEAPRXSRPPSDLGKGVENLVIIGSGPAGYTAAIYAARANLKPVVFEGYQVGGVPGGQLMTTTEVENFPGFPDGVTGPDLMDKMRKQAERWGAELHQEDVEFVNVKSRPFVIRSSDREVKCHSVIIATGAAAKRLRLPREDEFWSRGISACAICDGASPLFKGQVLAVVGGGDTATEEAIYLTKYARHVHLLVRKDQLRASKAMQDRVLNNPNITVHFNTEAVDVVSNPKGQMSGIQLKRTDTGEESVLEVKGLFYGIGHTPNSQLLQGQIDLDDAGYILVEEGTAKTSVDGVFAAGDVQDHEWRQAVTAAGSGCVAALSVERYLVANDLLVEFHQPVREEKEKEITDRDVEMGFDISHTKHRGQYALRKVYHESPRLVCVLYTSPTCGPCRTLKPILSKVIDEYNEHVHFVEIDIEEDPEIAEAAGIMGTPCVQFFKNKEMLRTVSGVKMKKEYREFIESNK

SEQ ID NO: 23333 - protein, 107 aa, Glycine max
QDNHEEQKAHLVIIRETEPLEFSHVTYDADAQIMKDVSQAAWLRKAVIPALSQTVKMNTVGTYMDAPESYDNMDGPYVEEGWGDQTCRVCMTDTIGEAEQLDMAGTH

SEQ ID NO: 23334 - protein, 101 aa, Brassica napus
  misc_feature (10)..(10): Xaa can be any naturally occurring amino acid
  misc_feature (16)..(16): Xaa can be any naturally occurring amino acid
  misc_feature (22)..(22): Xaa can be any naturally occurring amino acid
  misc_feature (31)..(31): Xaa can be any naturally occurring amino acid
  misc_feature (34)..(35): Xaa can be any naturally occurring amino acid
  misc_feature (37)..(37): Xaa can be any naturally occurring amino acid
NTFVDWVKEXQIKAIXVVGICXDICVFDFVXTVXXAXNHSVLPPLEDVIVYSRGCATYDLPLHVAKDIKGAQAHPQEMMHHVGLYMAKGRGARVVSRVSFD

SEQ ID NO: 23335 - protein, 722 aa, Salinibacter ruber
MTYESSRLRRMKPEAHIEDIEFVPDRSLSLETGRIAKQADGSVVARLGDTMVLSTATLSDSVNESNFFPLTVDYREKFAAGGKVPGGFIKREGRPTDKETLTSRLIDRAIRPLFPDGFYHDVHVVNFVISAGQDFDADVIAGVGSSAALMLSGAPFAGPFAEVRVGRVDGDYIVNPTMQQTEESDIDLVVAGKEDALVMVEGEAEEISEESMIEALDVAHRSIRRLCEGQHRLVEQAGEPDPFEWEADRVPEQLVQRMREEYGPKVADHIHGPYSKETFHGGIGDLKDQAVDDVLGDASETPEGYTASDIRDAIGEVEKGEMRNMIVEEGKRIDGRDQTDVRDLWMEVGYLPRVHGSAIFTRGETQVLGSITLGTSDDVQPVDEVFADTDKSFYLHYRFPPFSVGEASYLRGPKRREIGHSMLAERALRPVIPEQDEFPYTIRINADVMESNGSSSMASVCAGSLALMDAGVPIEKPVAGIAMGLVQEDDETTVLTDILGQEDHLGDMDFKLTGTRDGITACQMDMKIEGLSRDVMLKALKQSRDARHHILDRMEETIAEPRAELSSHAPRLTKLTIDPDRIGAVIGPGGKVVKSVQEETNTEITVEEEEGVGIVTIAATNQRDAEAAIERIKQIVAVPEEGEDYVGTVKGIRDFGAFVEIMPEKTGLLHVSEIDYDYVENVEDYLEVGDKVKVHLLEVHDDGKMRLTRKPFVSEENGEQNE

SEQ ID NO: 23336 - protein, 220 aa, Saccharomyces cerevisiae
MTEQKALVKRITNETKIQIAISLKGGPLAIEHSIFPEKEAEAVAEQATQSQVINVHTGIGFLDHMIHALAKHSGWSLIVECIGDLHIDDHHATEDCGIALGQAFKEALGAVRGVKRFGSGFAPLDEALSRAVVDLSNRPYAVVELGLQREKVGDLSCEMIPHFLESFAEASRITLHVDCLRGKNDHHRSESAFKALAVAIREATSPNGTNDVPSTKGVLM

SEQ ID NO: 23337 - protein, 268 aa, Triticum aestivum
MPPPLSVSLPSPQPLSLLPRHARAAHSHPLALAQPLSTRAPPSSACSVVPARHSDYFDPRAPPSQRDAYGQPPLEREPPVPGGQAGRVFASYSIYKGKAALAFDPRPPQFVPLESGAYKVAKEGFVLLQFAPAVGPRQYDWTRKQVFSLSVWEMGTLLTLGLTDSCEFFHDPFKGRSDEGKVRKVLKVEPTPDGNGRFFNLSVQNRLLNVDENIYIPITKGEYAVIVSTFNYIIPHIMGWSTFTNSIKPEESQPYNRPQSSPELEWRR

SEQ ID NO: 23338 - protein, 445 aa, Desulfitobacterium hafniense
MKIVLIQPKMNKRPMDTDLKTRMAPPLSLLTLMGLTPEGHEVIMVNENVEKIDYACGAELVGITITLDVMPRAVEIAEEFHRLGIPVVAGGIHVTSSPDECRGYFDAICIGAAERIWARMIEDAEEGRLQQVYHDMTDFRGEEIASPAYHRIDKNRYLYTNIITTSRGCPNRCGFCYNSCRNRMYIRRPVANVLRDIEGLGTRHILFIDDNFIGVPAYTRELLNHLRGRELKWSAAVTTKIADYPDVLDLMAETGCQSLFIGFESINNSSLHGVNKDNQFEKYERIVTAIHSRGIMINASMVFGLDGDEPDVFQRTLDWLVKNKIETLTSHILTPYPGTELHGRMKEEGRILDHELSRYNTAHVVFQPKGMTAEELYKGYLWIYREFYSFPNIWRRRPEHKAQRKSYFLFNIFYRKFGGFTSALARVIPMRAVGRLAARISYRVK

SEQ ID NO: 23339 - protein, 588 aa, Unknown
  Burkholderia sp. ICD
MTPSEAFVETLAANGVTEMFGIMGSAFMDAMDIFAPAGIRLIPVVHEQGAGHMADGYARVSGRHGVVIGQNGPGISNCVTAIAAAYWAHSPVVMITPEAGTMGIGLGGFQEAKQLPMFQEFTKYQGHVTHPARMAEFTGRCFDRALAEMGPTQLNIPRDYFYGQIKAEIPQPQRLDRGPGGDQRLDEAAELLAQAKFPVIISGGGVVMGDAIEECKALAERLGAPVVNSYLHNDSFPANHPLWCGPLGYQGSKAAMKLIQRADVVVALGSRLGPFGTLPQHGMDYWPQNAKIIQIDADHKMLGLVKKISVGICGDAKAAAKALTQRLEGRTLVCDASREERAGEIAAEKAAWEKELDGWTHERDPYSLDMIEEQKGERTPGGGNYLHPRQVLRELEKAMPEDVMVSTDIGNINSVANSYLRFNKPRSFFAAMSWGNCGYAFPTIIGAKVAAPHRPAVSYAGDGAWGMSLMETMTCVRHNIPVTAVVFHNRQWGAEKKNQVDFYNRRFVAGELDNQSFAGIARAMGAEGVTVDRLEDVGPALKRAIDAQMNHGKTTIIEIMCTRELGDPFRRDALAKPVRLLDKYKDYV

SEQ ID NO: 23340 - protein, 145 aa, Coxiella burnetii
MKSVFTWESKVRDYELDSQGIVNHATFLNYFEQCRNDYARSMGIDFREYHLAGYDLMIADIQIQYRSPLRAKDEFYVTAQVDAYNEKRILFGQEIKYKADNHSVAKALVSVACVDQKTGRACMPNRLKNRLPAEKYVKHRLMLKL

SEQ ID NO: 23341 - protein, 171 aa, Staphylococcus epidermidis
MNINTAYFAGGCFWCMTKPFDTFDGIEKVTSGYMGGHLVNPSYEEVKTGSTGHYEVVKIEYDVALFSYHKLLEIFFSVIDPLDDGGQFQDRGSQYKTAIFYSNEHQRQLAEQYICELQDSFNADKAIATKILPASTFYEAEVYHQDFYKKNPERYEQEQQDRANYVKDNHM

SEQ ID NO: 23342 - protein, 804 aa, Hyaloperonospora parasitica
MSDKKDDFKAGIMDRKRSPNRLVVDEALNDDNSVVALSMAKMEELQLFRGDTVLLKGKKGHETVCVVLQDETVDDHNVRMNKVVRKNLRVRLGDVVGLHTCGDVPYGKRIHVLPIDDTIEGVTGNLFDVYLKPYFVEAYRPVKKGDLFLVRQAMHPVEFKVVETEPGPYCIVAPDTIIHCEGEPVRREDEEKMDEVGYDDIGGCRRQMAQIREMIELPLRHPQLFKTLGVKPPRGVLLYGPPGSGKTLIARAVANETGAFFFLINGPEIMSKMAGESESNLRKAFEEAEKNAPAIIFIDEIDSIAPKREKTNGEVERRIVSQLLTLMDGLKQRASVVVIGATNRPNSMDPALRRFGRFDREIDIGVPDENGRLEIFRIHTRNMKLDDDVDPELIARDTQGFVGADMAALCTEAALQCIREKMDVIDIEDETIDAEILDAMSVTQAHFKYALGVSNPSSLRETTVEVPTVTWRDIGGLEGVKRELLELVQYPVEHPEKFEKYGLSPSKGVLFYGPPGCGKTLLAKAVANECQANFISIKGPELLTMWFGESEANVREVFDKARGAAPCVLFFDELDSIAQQRGSSSGDAGGAGDRVMNQLLTEMDGMGAKKNVFIIGATNRPDIIDPALMRPGRLDQLIFIPMPDFDSRLSILRSVLRKSPVSKDVDLNFLAQQTDKFSGADLTEICQRAAKLAIRESIARDMERDRLRAEAGDEMEDIEDDDPVPEITPRHFEEAVRNARRSVSDRDLAQYSTFAQTLQQARSHVTAGGTSLANFSFPGRNVSANTGGGAAVAADEEDEEDLYS

SEQ ID NO: 23343 - protein, 273 aa, Oryza sativa
MANASLQSFLLHHHHSFLSNGIHEGSSPSIILKLTTNSNSSISFKLFSNTTSSSSSSVTTTASTPNSPVTPAPVTASSPPPPSLELLGAQLAERDYRQADETTRALLIELAGEPARRRGYVFFSEVQFISADDLRAIDALWQEHSGGRFGYSVQRRLWEKSRRDFTRFFIRVGWMKKLDTEVEQFNYRAFPDEFIWELNDDTPEGHLPLTNALRGTQLLGNIFTHPAFEEEQEDELAAEENDTPDNTGQSKDGSKGKERPKFMRDFFKPDYSF

SEQ ID NO: 23344 - protein, 241 aa, Glycine max
MVSSNTAELLREEIPVKQQPLTLSADIITGLVLVDVVNGFCTVGAGNLAPKEPDERISQMVKESLRLSKAFSERKWPIFAFLDCHHPDKPEPPYPPHCIIGSGEEKLVPDLLWLENDPNATLRQKECIDGFLGSTEKDGSNVFIDWVKNNQIKQILVAGICTDICVLDFVSSVLSVRNRGFLTPLENVIVSSQACATYDLPLHVAKTNKDFVSHPQELMHHVGLYIASGRGAHIASEVLFE

SEQ ID NO: 23345 - protein, 112 aa, Sinorhizobium meliloti
MKKIEAIIKPFKLDEVKEALQEVGLQGITVTEAKGFGRQKGHTELYRGAEYVVDFLPKVKVEVVLADENAEAVIEAIRNAAQTGRIGDGKIFVSNVEEVIRIRTGETGLDAI

SEQ ID NO: 23346 - protein, 439 aa, Xanthomonas axonopodis
MSSTVPPLSFVRILALNAGFFGVQYSFGLQQSNMSPIYNYLGADHANLPYLWLAGPITGLVLQPFVGAWSDRSVTRWGRRMPYMVLGALVCSLCLLAMPFSTALWMAVCLLWVLDAANNVAMEPYRALVSDVLTPPQRPLGYLTQSAFTGLAQTLAYLTPPLLVGMGMNQDAANAHHIPYVTIAAFVIGAGFSAGSILLTARSVREPAITPAEIARIRQSGAGLGATVREIGSALREMPPTMRQLAPVMLFQWYAIFCYWQYIVLSLSTTLFGTTDPTSHGFREAGLVNGQIGGFYNFVAFLAAFAMVPVVRRFGPKYTHAACLVAAGIGMWLLPGIENRWLMLLPMIGIGLAWASMMGNPYLMLADSIPPERTGVYMGLFNLFIVLPMLIQIVTLPLYYEHVLHGDPRNVVRLAGALMLAAAAAMLCVRLRKPKAVAA

SEQ ID NO: 23347 - protein, 238 aa, Oryza sativa
MAATALLRRARWALVDHPAVASFRWEPGRTPASTPSFAAAVICAYLATVFLLHRRVVPLPSPHPRALRAVSGAPQRGPPGALRRHGRRVYELGDTLLILLGRRPLTLLHVYHHAAVIAMCYLWLATRQSLMPIALATNAAVHVAMYGYYLCCSLGLRWPPRWKRAVTELQIAQFLFSFAASAVMLWRHFAAGGCEGMAGWAFNAVFNASLLALFLDFHGAAYAAAKGKKSRSEVVKEE

SEQ ID NO: 23348 - protein, 653 aa, Unknown
  Malus x domestica
QIKTQLEPHENSLLRQENNKLRAENMSIREAMRNPICSNCGGPAIIGDISLEEQHLRIENARLKDDLDRVCALAGKFLGRPISSLGASMGPPLPSSTLELGVGSNGFGGMSNVATSMSMGNDFGGGIGSAMSVVSHGRPSVTGLDRSMERSIFLELALAAMDELVKMAQTDEPLWLRSLEGGREVLNHEEYMRNFTPCIGLKPNGFVSEASRESGTVIINSLTLVETLMDSNRWLEMFPGVLARTSTTDVISSGMGGTRNGALQLMHAELQVLSPLVPVREVNFLRFCKQHAEGVWAVVDVSVDAIRDTTGVPTFMNCRTLPSGCVVQDMPNGYSKVTWVEHAEYDESQVHHLYRPLLSSGMGFGAQRWVSTLQRQSECQAILMSSCVTSRDHTAITASGRRSMLKLAQRMTDNFCAGVCASTVHKWTKLNAGNVDEDVRVMTRESLYHPGEPPGVVLSAATSVWLPFSPQRLFDFLRDERLRSEWDILSNGGPMQEMAHIAKGQDPGNCVSLLRARANANQGSMLILQETCIDAAGSLVVYAPVDIPAMHVVMNGGDSAYVALLPSGFAIVPDGPGSRGPMFGKGGSHGSGNSGGGVDDGGHRVSGSLLTMTFQILVNSLPTAKLTVESVETVNHLISCTVQKIKAALHCES

SEQ ID NO: 23349 - protein, 376 aa, Myxococcus xanthus
MDLEAEADLTRCGALKDFWYVACLSTELKPGEPLARTLFGTGVVLFRDVQGQPTALRDRCLHRNARLSRGAVFNGRIGCPYHGWVYDASGAVVEVPSLGPSQRSELLDADACAREGLATAPCALGRLTRFPTLEQDGLVFVYMGGAEPARSAPFRVPYWDQEGWTVYFMVTRFPNGVTNLVENFMDVPHTLFVHPGWFRRPASKRVPATVRRTAGSVLVTYKQAQDTVTGLGRLFNPRGLPLLHTDKFYVPNVTRVDYLWGEHGFVINSQCTPIGPTDSLVYTAISYRLPVDVPGALVGRAMMPLVRWYTRQVIQQDVVIMDIQREALLDGPGGGVYSGTEADLHHADIEAYRRWLREGGQGSGPEDAERDMAFWI

SEQ ID NO: 23350 - protein, 306 aa, Musa acuminata
MAIPVIDFSKLDGKERAETMARIANGCEEWGFFQLVNHGIPVELLERVKKVSSECYKLREERFEGSKPVQLLDTLVKEGDGQRLDNVDWEDVFVLQDDNEWPSNPPDFEETMKEYREEIRKLAEKMMEVMDENLGFEKGCIKKAFSGDGQHPPFFGTKVSHYPPCPRLDLVKGLRAHTDAGGVILLFQDDQVGGLQMLKDGRWIDVQPLADAIVINTGDQIEVLSNGRYKSAWHRVLATSHGNRRSIASFYNPSLKATIAPAAGAATEEAAPPALYPKFLFGDYMDVYAKQKYEPKEPRFEAVRAI

SEQ ID NO: 23351 - protein, 732 aa, Mycobacterium avium
MSSNEPASAAGGGTHQPEVPTVWPGSPYPLGASYDGAGTNFSLFSEIAEKVELCLIDSRGAETRIPLDEVDGYVWHAYLPNINPGQRYGFRVYGPFEPSAGHRCDPSKLLLDPYGKAFHGDFTYGQALFSYDLKAVAAGGDDADPGIPPMVDSLGHTMTSVVSNPFFDWGSDRAPLTPYHETVIYEAHVKGMTQTHPSVPEQLRGTYAGLAHPAIIDHLKSLNVTAIELMPVHQFMHDSRLLDLGLRNYWGYNTFGFFAPHNQYAANRNSSVAEFKSMVRSFHEAGIEVILDVVYNHTAEGNHLGPTINFRGIDNAAYYRLVDTDLRRYKDYTGTGNSLNPRHPHVLQLIMDSLRYWVTEMHVDGFRFDLAATLARELHDVDRLSAFFDLVQQDPIVSQVKLIAEPWDVGEGGYQVGNFPGLWTEWNGKYRDTVRDYWRGEPATLGEFASRLTGSSDLYEATGRRPSASINFVTAHDGFTLNDLVSYNEKHNMANGEDNRDGESHNRSWNCGVEGPTDDPDITELRYRQMRNFWATLMVSQGTPMIAHGDEFGRTQNGNNNVYCQDSELSWMDWSLVDKNSDLLAFARRATTLRTKHPVFRRRRFFEGEPIRSGDEVRDIAWLTPGGREMTHEDWGQSFHKCVAVFLNGDAITAPNARGERVVDDSFLLCFNAGEQPVQFVMPGGDYAKEWTVELDTNEPTGRKEGAEPLVVHTEEELTLPSRSLLILRKTL

SEQ ID NO: 23352 - protein, 472 aa, Escherichia coli
MTTHLVWFRQDLRQHDNLALAAACRNSSARVLALYIATPRQWAAHNVSPRQAELINTQLNALQIALAEKGIPLLFREVDDFAASVEIVKQVCAEYRVTHLFYNYQYEVNERARDVQAERTLRNVVCEGFDDSVILPPGAVMTGNHEMYKVFTPFKNAWLKRLREGMPECVAAPKVRSSGSIEPAPSITLNYPRQSFDTAHFPVEEKAAIAQLRQFCLNGAGEYEQQRDFPAVEGTSRLSASLATGGLSPRQCLHRLLAEQPQVLEGGPGSVWLNELIWREFYRHLMTYYPSLCKHRPFIAWTDRVQWQSNPAHLKAWQEGKTGYPIVDAAMRQLNSTGWMHNRLRMITASFLVKDLLIDWREGERYFMSQLIDGDLAANNGGWQWAASTGTDAAPYFRIFNPTTQGEKFDREGEFIRQWLPELRDVPGKAVHEPWKWAEKTGVTLDYPQPIVDHKEARLRTLAAYEEARKGA

SEQ ID NO: 23353 - protein, 442 aa, Acidobacteria bacterium
MEQAPVSTIHEIGKHDGQSVTIKGWLYNLRESGKLLFPIFRDGTGLLQGVLFKKNVSPELFDLVKNLTQESSVIVTGNVRAEQRAPGGYEMDVTALEVVQRVPENEPYPITPKEHGIEFLMEHRHLWVRSQRQAAILRIRGEIVRSAHEFFDKQGFTLTEPPILTPAACEGTSTLFPVDYFGDPAFLTQSGQLYIEATAMALGKVYSFGPTFRAEKSKTRRHLTEFWMVEPEVAFAELDDIMKLAEDFITHIVKSVLERRRDDLKTIERDLSKLENIDTPFPRISYDEAVQMLQEGHAKGELESRFEWGGDLGSPDETYISSKFDRPVMIHRYPVEVKAFYMEPDPNNSKVALCVDVLAPEGYGEVIGGSQRMGSYEKLLARIHEHQLPEESFKWYLDLRKFGGVPHSGFGMGIERAVAWICGLDHVRETIPFARTLHRIYP

SEQ ID NO: 23354 - protein, 369 aa, Gibberella zeae
MKAIIPLSLATLAAALPGNIQPRQAKAPVFNIDGKSQYFAGTNTWWMSHLTSDADVEQAMFQIAKSGLKVTRVWAFGNTNTGTDQPVYFQFLDTAKKTITINKGTNGIARLDAAVAAAEKHNIQLVLPMLNNWDDLGGINIYCAYFGCTHETFWTHADAQEAYKDYVSFIVNRYKDSPAIFSWQLCNEPRCQNCDTSVITKWATEISSFIKSLDSKHRVSLGDEGWLCSDDSSLGYAYSCSEGIDFEANLKISTLDYGTVHMYPIGWGYNYPWGNQWIRDHAALASKYGKPIVMEEYGVESTTSNRTAVLKEYQETILSTEIAYDSFWQFASNLPSGANPYDAYAIFYGTQEYQDVVIDHAKTISAKAV

SEQ ID NO: 23355 - protein, 775 aa, Photorhabdus luminescens
MTKYSLRIRMMSLILVPILLVGMFFSISFLCYHYRELENQIVRSGISIIEPLSIASEIGINLHNRESVNSLITRLHRRNSEIVRAIAIFNDDNQLFDISNYKYNSAQLQISPDMPLPTTLTKTEVKNSIILRMPIISEHHLSQNQPHSDTPSLRPIGYIAIDLDLRSAHLQQYKEIVIFILLLLICLGWASLFAYHLVRKITKPISDIVSTVDRIRQGQLNSRVSGKYFGELDMLKNGINAMAKSLSSYKEEMQNDIDQATSDLRETMEQFEIQNVELAIAKKRAQDAARIKTEFLANMSHELRTPLNGVIGFTRQTLKTPLTIQQTEYLYIIERSANHLLNIINDILDFSRLEADKLVLENVPFLLQDTIDEVMVLLTLSAKSKNIQLTHHVDPQIPNLVVGDPTRLQQIFTNIIGNAIKFTDQGSVEIKINLLQQKHHKINLEITVSDTGIGISPEQQPHLFQAFHQANASISRHYGGTGLGLVITRKLIQEMGGNISFTSEPKKGSVFRFDLWLGKDDFILTGSVVPQKTLIHPPRLPMTVMAVDDNPANLKLIGSLLDEIVEKTVLCNSGEEALQSAASHHFDLILMDIHMPGMDGICTSNHIHQLPQHYSTPIIAVTAYTCRPKSDTHSPFEDFLTKPLDEHRLRVVLDRYVKTPKSQHINWPLALQQATGKEPLAIDMLQMLVDLLPTIKTITEKVLSGETVENYQQQIHKLHGSCCYSGVPQLKALCQLIEQQLQQGVQLTDIEPELLELTDEIDHVLTAAQKILSRG

SEQ ID NO: 23356 - protein, 251 aa, Prochlorococcus marinus
MSRISIVGAGPGATDLLTLRAAEHLKQAEVLVWTDSLVSPDIAALAPESCERIRTSSMTLEDVLPLLVNRAQAGKRVVRLHDGDPCLYGALSEQICGLADAGIEVEVVPGLSAYQATAAALKAELTIPGLVQTIVLSRAGGRTGVPERENLQHLASIGASLCLYLSARHVEEVQATLLQHYSAETPVAIGYRVSWPDQWLSVVPLKQMATTSREHELIRTTLYVVSPALAAGRQRSKLYSPDHKHLFRQKG

SEQ ID NO: 23357 - protein, 549 aa, Geobacter metallireducens
MGMFCNQCEQAAKGVGCDIIGVCGKNPEVAALQDLMLYGLKGLAIYADKARELGVKEEKIDYFVLEGLFTTVTNVDFDPVQIAGKLRTCYDYKERIKALYETAYREKNGSSAPQITAGPAAWVIAGDLEGLVKQGQEHGINTHHADADIRSAIEILIYGLKGMAAYADHAYILGKKDEEVFAFFHKAMAATADPAKGLMDFVGLAMECGKLNIKVMGMLNEGHVAHYGHPVPTKVPTGTRKNKGILVSGHDLRMLEELLKQTDGKGIDVYPHGEMLPAHGYPGLKKYAHLYGNFGGAWQDQAKEFPHFPGAIIFNTNCIQRPADSYKDRLFSWGQVGWPGVKHINGWDFSEVINKALECPELADAPAKEILTGFGHNAVLGVADKVIEGVKAGAIKHFFLIGGCDGAKPGRNYYTELAEKVPQDCVILTLACGKYRFNKLEFGDIGGIPRLLDIGQCNDAYSALQIALALADAFKCGVNDLPLSMILSWYEQKAVVILLSLLHLGIKNIKIGPSLPAFVTPNVLNFLVENFNLGPITTVDADLKAALGQ

SEQ ID NO: 23358 - protein, 558 aa, Gibberella zeae
MTSSQNQKLGSDVCVVGTGALGLLALKNLREQGLDARAFERHEHIGGTWHASQNVEQTTATEYTTANTSKQCCTITDFPMPDEFPMHPPQKDLERYFESYATKFDLFRHIEFSISVDHIERDEQQKKWRVFTKNVKTGVEEVRSYSRVVVATGMLNTKHMPKVKGIEKFTGDAIHSRQFKDVSKYRGKNVIVVGVGATGVDSTSFLVKGGAKQVYASHRGTVFVLPRRVKGQGFEHNLSRRISMCIRALGNFSPTILATFMTKMMVSVRDKEWPLMKDILKDRPVDGVFHRIPLFSEDLADNLKSGSVKSVRGIQEITGPKTVALTDGTILDDIDAIIFCSGYGYDFSIIKGPGDPTDPAIAPDHNKKIEAAEYYKDEDKFARLYHGFMSEQFPDSLAFIGHVIIMRPPFVLYDIVTMALAGVWSGGYPIANEQERRKDIDDHYNFVVSILKRGPFPHLGFRFKMAKTYEFINQAAGTGVTDRLGCFTWEAWKLWWNDRNFYNLLMDGTDVPAVYRLFDTGRGRKPWAGAREQIIKTNAEIKELGEVWKRENEDKKTN

SEQ ID NO: 23359 - protein, 284 aa, Unknown
  Silicibacter sp. TM1040
MTKEVWNTERLHDHFAQSLRVSEMYYDSKTEHQRLKVFQNGTFGRVLTLDDVVQTTEGDNFIYHEMLTHVPILAHGAAKRVLIIGGGDGGIAREVLKHASVEHVTMVEIDAGVVDFSKEYLPMLSQGAFDDARLNLVINDGAVFMKETEDKFDVIIVDSTDPIGPGEVLFTDTFYGHAARALTEDGIIVTQNGVPFMQGDELTNTMRAFQALFQDATCYLATIPTYVGGPMALGWGSHSTKARSVDLTTLEARFAAAGLSPDYYTPEVHKAAFALPGYVKKLFP

SEQ ID NO: 23360 - protein, 419 aa, Solanum lycopersicum
MTSLTGATSHLLPSATIAAISASTTARLAISFSSSSSSSLKCIRSSPLLPHIFRYQKRSLIGTTSSGRFSTFASPKCAASDPDQLKSAREDIKELLKTTFCHPILVRLGWHDAGTYNKNIEDWPQRGGANGSLRFEVELKHGANAGLVNALKLLQPIKDKYAGVTYADLFQLASATAIEEARGPKIPMKYGRIDVSGPDECPEEGRLPDAGPPNPSSHLRDVFYRMGLNDKEIVALSGAHTLGRSRPERSGWGKPETRYTKDGPGSPGGQSWTVQWLKFDNSYFKDIKEQRDEDLLVLPTDAVLFEDSSFKEYAEKYAVNQDVFFKDYAEAHAKLSNLGAKFDPPEGFSIDNNPTQVQPEKFVAAKYSTGKRELSDAMKQKIRAEYEGLGGTPDKPLPTNYFLNIIIVIGVLAILTYLL

SEQ ID NO: 23361 - protein, 350 aa, Zea mays
MASRQGVAASMFATALLLGVFASIPQILLKIFYRSNVARRSAEAIGVCYGMSANNLPAASTVVSMYKANGISAMRLYAPDQGALQAVGGTGISVAVGAPNDVLSNIAASPAAAASWVRNNIQAYPSVSFRYVCVGNEVAGGAAQDLAPAMENVHAALAAAGLGHIKVTTSVSQAILGVYSPPSAAEFTGEARGYMGPVLQFLARTGSPLMANIYPYLAWAYNPSAMDMSYALFTSSGTVVQDGAYGYQNLFDTTVDAFYVAMGNNGGSGVPLVVSESGWPSGGGVQATPANARVYNQYLINHVGRGTPRHPGAIETYLFSMFNENQKESGVEQNWGLFYPNMQHVYPISF

SEQ ID NO: 23362 - protein, 220 aa, Saccharomyces cerevisiae
MTEQKALVKRITNETKIQIAISLKGGPLALEHSIFPEKEAEAVAEQATQSQVINVHTGIGFLDHMIHALAKHSGWSLIVECIGDLHIDDHHTTEDCGIALGQAFKEALGAVRGVKRFGSGFAPLDEALSRAVVDLSNRPYAVVELGLQREKVGDLSCEMIPHFLESFAEASRITLHVDCLRGKNDHHRSESAFKALAVAIREATSPNGTNDVPSTNGVLM

SEQ ID NO: 23363 - protein, 310 aa, Oryza sativa
MVVEEIGVCMVRASFKAWLGELLSPNHSRRSSGSSNELEIRYILGSIASHISHKFTTPKPSNHPGDHHLPVSVPSSSLFETVTVRCGHCSSLLTVNMRGLLLPTTAAAAPPPPPPPPPPPPPPAAHFPHSLNLAPANPPHHHSLLDEISTANSPTQLLLEQHGLGGLMASAASCRNNNSPAAAAAPPPPTSQGKAAAKEPSPRTNTAVINRPPEKRQRVPSAYNRFIKDEIQRIKAGNPDISHREAFSAAAKNWAHFPHIHFGLMPDHQGLKKTSLLPQDHQRKDGLLKEGLYAAAAAAAAAANMGVAPY

SEQ ID NO: 23364 - protein, 566 aa, Xylella fastidiosa
MLAAAMRGMAVTFFSQFMVSCMHSIQIVLAMLLVVAASGYLVRIIPFSMPLPLLQIALGAVISGVFDGGYELQPEAFFLLFLPPLLFLDGWRIPKQGLFRDKNVILELALGLVVFTVLGIGFLIHWMIPTMPLPLAFALAAILSPTDPVALSSITSRVPIPKRMMHILEGESLLNDATGLVCFQFAVAAVLTGHFSLATASLTFVWVLVVGLSLGIATTYVLSRVQRWVWRHFGGEPAAAILFNLLTPFAAYLLAEGMQASGILAAVAAGITMSYVELSGNAQATIRVQRWAVWETVQFTFNGIIFVLLGEQLPGILDDLVHSAQQAGHMNVGWLLVDVAVISAGLMLLRFLWVWLSLQWNLFKAVCCGKQRISPPWQIVVAMSLSGVRGAVTLAGVLTLPLLMPDGTPLPARQLVIFLAASVILVSLLLASVALPYLLRGLELPEKSSYDKEEDFARRVSAQAALEAVERLRQRLVEDSANAERYNEAAHQVSQLYQRKLGAVDLANVDPQETKVFEQVVRRFRQVGLAAERDELFRLAREHNISDELLQRMVRNLDLIEARRRS

SEQ ID NO: 23365 - protein, 557 aa, Photorhabdus luminescens
MTESFAQLFEESLLSIETRPGAIVRGIVVAIDKDVVLVDAGLKSESAIPVEQFKNVQGELEIQVGDEIDVALDAVEDGFGETVLSREKAKRHEAWLMLEKAYEDAETVTGIINGKVKGGFTVELNGIRAFLPGSLVDVRPVRDTTHLEGKELEFKVIKLDQKRNNVVVSRRAVIESENSAERDQLLENLQEGMEVKGIVKNLTDYGAFVDLGGVDGLLHITDMAWKRVKHPSEIVNVGDEIAVKVLKFDRERTRVSLGLKQLGEDPWVAIAKRYPEGTKLTGRVTNLTDYGCFVEIEEGVEGLVHVSEMDWTNKNIHPSKVVNVGDVVEVMVLDIDEERRRISLGLKQCKANPWQLFAETHNKNDRVEGKIKSITDFGIFIGLDGGIDGLVHLSDISWNVAGEEAVREYKKGDEIAAVVLQVDAERERISLGIKQLAEDPFNNYLSVNKKGAIVTGKVTAVDAKGATVELADGVEGYLRASEASRDRVEDATLVLNVGDAVEAKYTGVDRKNRVINLSVRAKDEADEKDAIASVNKQEDANFANNAMAEAFKAAKGE

SEQ ID NO: 23366 - protein, 192 aa, Staphylococcus epidermidis
MNYQIKRNTEETQLNISLANNGTQSHINTGVGFLDHMLTLFTFHSGLTLSIEATGDTYVDDHHITEDIGIVIGQLLLELVKTQQSFTRYGCSYVPMDETLARTVVDISGRPYFSFNSKLSAQKVGTFDTELVEEFFRALVINARLTVHIDLLRGGNTHHEIEAIFKSFARALKISLAQNEDGRIPSSKGVIE

SEQ ID NO: 23367 - protein, 1118 aa, Unknown
  Shewanella sp. MR-4
MGLKYMAFDWFSQFFISSQDSLLLNVYYNPLLVTISILIAIFSAFMAFQVTTQAVLSQSKSRQQIMLLTGSVVLGGGVWSMHFIGMLAFDLCSPVTYDFGLTALSLLPSIGASWVALNLLSKPSFKFSQVLISGILVGAGIGTMHYVGMAAMDMAPLLRYDPWIFALSIVVAVLLAIIALWVRTGLNQLIASNMSAITSNFIASIVMGLAISGMHYTGMAAARFVKPEGLELSEQSSEISFYLALGVSVTTVIIICLVLIVNVIFKYKDLSLLAKSNEDRMRAMMNTAVDGIITIDGQGIIVNVNKAVTTILGWSPAELLGENVKKIVPESIRPHHDGYLARYINTREAQIIGTGREVEAQHKAGHSVPVRLSIGHVMQGKAHYFVGFLSDLSLRNEMEQELKNNEAKFRSLITNIPGIAYRCKSTEGWPMVFISEAVLNITGYPAEDFELPHPKRFFSDLYYPDDIESIYAQAQPPTFSMEYRIIRADGEVRWLFEHGNYILDETSNEVWIDGFLMDITERKVMEQDLVTAKNNAEQAAAARAAFLANMSHEIRTPMNAIIGFSDILLESVLDTEQHKQLSTINRSAKSLMHLLNDVLDSAKLDKGKLELENRVFCLTDEIDTVISTLWLQAKKQRLSLEVDIAPSMAANFIGSPERIRQVLINLIGNAVKFTCEGKVTVSVFPQNDNLVTFEIIDTGIGMTPEQLNRVFEAFAQADASMSRKYGGTGLGTTISKQLVELMGGQLEAESTLGQGSTFRFTIPLQSSSEPLETERADHGSLPPLTLLVVDDIQQNIDLLSVWLTRQGHKVITARDGEQALLRMQKADIDITLMDLQMPVMDGLTAAKMRREQEAESQLPHMPIIALTASVLEQDKSAAEQAGMDGFANKPIDFALLTREIARVLQLNPPQAEAESLQPLGSQLVDEAKGVKLWGSKPQFIKELMKFIAQWPEKSQALQQAISEQDTATIKLLSHSLKGVSGNLGLLQWMSYFAQLEKLTQAESLSFEAMEAIIAKISDSLVEIGDYIESTTVSSASGSELAQSGTDDPAQLLAHIDALLASVVHHSFDESDLEALTARIDEHLRLSVTIITEALDNFDFDIAHNELLELRRIITANQE

SEQ ID NO: 23368 - protein, 156 aa, Unknown
  Frankia sp. CcI3
MARIDYFNDPNAPKANSVVPSVTAVVTDEAGRILMVHKTDNNLWALPGGGMDLGESITDAAVRETKEETGIDIEVTGLIGVYTNPRHVLAYDDGEVRQQFSLCFTTRNLGGELRTSSETKEVKFVAPEDLDGLNIHPSMRLRIDHYLENRATPYLG

SEQ ID NO: 23369 - protein, 285 aa, Nocardia farcinica
MAVVTMKQLLDSGAHFGHQTRRWNPKMKRFIFTDRNGIYIIDLQQTLTYIDKAYEFVKETVAHGGTVLFVGTKKQAQESIAAEATRVGMPYVNQRWLGGMLTNFSTVHKRLQRLKELEAMEQTGGFEGRTKKEILMLTREMNKLERTLGGIRDMQKVPSAIWVVDTNKEHIAVGEARKLNIPVIAILDTNCDPDLVDYPIPGNDDAIRSAALLTKVVASAVAEGVQARAGLASGDAKPEAGAGEPLAEWEQELLAQANPNAEGSAEAAPAAATEEAPAAQTPADF

SEQ ID NO: 23370 - protein, 191 aa, Alteromonadales bacterium
MLKKMIIGFTALLVSSTLMAQTQPNNEAVNPQACDDFTNVDIRKLRSKESINLCDYKNKPLLIVNTASNCGFTPQFESLEKLHKTYKDEGLVILGFPSDDFFQEEDNEKETAKVCFINYGVTFPMFATSEVRGSDANPIFKHLNEQTSSPNWNFYKYLVSADRKTILRFNSKVKPDSEKMIKAVENSLSKI

SEQ ID NO: 23371 - protein, 466 aa, Vibrio angustum
MTYAPVTDVLSGKLAVDSEVTVRGWIRSRRDSKAGISFLAIYDGSCFDPIQAVVPNELNNYQEEVLKLTTGCSVEVTGTIVASPAKGQDFELAATNVKVVGWVEDADSYPMAKTRHSIEYLREVAHLRPRTNVIGAVARVRNCLSQAIHRFYHEQGFIWMSAPLITASDCEGAGEMFRVSTLDLANVPMTVEGNVDFDKDFFGKETFLTVSGQLNAEAYACALSKVYTFGPTFRAENSNTSRHLAEFWMVEPEVAFAELDDVAKLAEDMLKYVFKAVLEERRDDLEFFASRIDKEAITRLEQFVTSDFAQVDYTDAIKILQDSGRKFEFDVEWGIDMSSEHERFLAEEHFKAPVIVKNYPKDIKAFYMRMNDDGKTVAAMDVLAPGIGEIIGGSQREERLDILDARMIEMGLDPEHMGWYRDLRRYGSVPHAGFGLGFERLVSYVTGMGNVRDVIPFPRTPRSANF

SEQ ID NO: 23372 - protein, 310 aa, Thermobifida fusca
MSDVRNVIIIGSGPAGYTAAIYAARAELKPLVFEGAITAGGALMNTTEVENFPGFPDGIMGPELMDNMRKQAERFGAELVPEDVTEVDLTANPKVVKAGDQTFYARAVIVATGSGYRKLGVPGEEEFSGRGTSWCATCDGFFFRDQDIAVVGGGDSAMEEAIFLTRFARSVTVIHRRDQLRASKIMQERAFANEKISFLWNTEVVEILGDTRVHAVRLRNRVTGEESTLNISGLFIAIGHDPRVELFKGQLELDEQGYLKVDSPTTHTNIPGVFACGDVVDHRYRQAITAAGSGCAAALDAERYLTEEAG

SEQ ID NO: 23373 - protein, 107 aa, Thermobifida fusca
MATIQNVTDDTFEEVVLKSKLPVLVDFWAEWCAPCKMIAPVLEQIAEEQEGKLTVVKINADQNPDTVRQYGVMGLPTLNLYKNGEVVKQLVGAKPKRVIEKELEEFL

SEQ ID NO: 23374 - protein, 578 aa, Fusobacterium nucleatum
MDKMFCYQCQETAKGTGCTSIGVCGKTSETSGLQDLLLYTEKGVAAYSAIFRKEGKAKELIKNKVNRYLINSLFITITNANFDDTAILDEIKAGLKLREELKALATDEEKKEAEKYGTNLVNWYYESDEDLIKFSENQSVVGVLRTENEDVRSLRELIMYGLKGMAAYAEHAFNLGKTSEEIFAFIEEALLGTMDDSLNAEQLVALTMKTGEYGVKVMALLDEANTSALGTPEITKVKIGAGKRPGILISGHDLWDLKQLLEQSKDSGVDIYTHSEMLPGHGYPELKKYSHFYGNYGNAWWDQRKDFTNFNGPIVFTTNCIVPPLNNASYKDRVFTTNAAGYPGWKRIKVNADGTKDFSEIIELAKTCQPPKEIESGEIIVGFAHNQVLSLADKIVENIKSGAIKRFIVMSGCDGRMKQRHYYTEFAENLPKNTIILTSGCAKYKYNKLNLGDINGIPRVLDAGQCNDSYSWAVVALKLKEVFGLNDINELPIVFNIAWYEQKAVIVLLALLYLGIKNIHVGPTLPGFLSPNVAKVLVENFGIAGITTVEEDLKKFGLYEGSVLANISNKETSNEARI

SEQ ID NO: 23375 - protein, 294 aa, Brassica napus
  misc_feature (219)..(219): Xaa can be any naturally occurring amino acid
  misc_feature (271)..(271): Xaa can be any naturally occurring amino acid
MAVQPTRIGLAGLAVMGQNLALNIASKGFPISVYNRTTSKVDETVERAKKEGNLPVYGFHDPESFVNSIQKPRVIIMLVKAGAPVDQTIKTLSAYLEKGDCIVDGGNEWYENTERREKAVSENGFLYLGMGVSGGEEGARNGPSLMPGGSFEAYKNIEDILLKVAAQVRDSGPCVAYIGKGGSGNFVKMGHNGIEYGDMQLIAEAYDVLKSVGKLTNEXELHGVFTEWNKGELESFLVEITADIFGIKDDKGDGHLVDKVLDKTGMKGTGXKWTVQQAAELSVPSPTIESSLDA

SEQ ID NO: 23376 - protein, 137 aa, Yersinia pseudotuberculosis
MSDNYAEVKRILANIRTIRTFVREVDYLFLVEAHEKLGVALEERKAEFECEQEELNKKEAKKKELLAFIASEGFTLEELNGNGITKRKKPPVHRKPKYTFEENGEMKVWSGVGRKPKPIEVALNEGKTLSDFLICSV

SEQ ID NO: 23377 - protein, 610 aa, Aspergillus oryzae
MSPLVGPDNDNDVDLITAQEMQNDFGAEDPGHSSETKSTWYLFLLTLSIGGLQIVWSVELSNGSPFLLSLGMSKALLAFVWIAGPLTGTLVQPYIGICSDNCRSSWGKRKPFMVVGGLATVVALLALAWVRELVGGFLGIFGADQASTGTKTAIIVFATILMYCLDFAINTVQAGIRCFIVDNAPAHQQESANAWASRLTGVGNILGYIFGYIDLPRYLPFLGNTQFKVLCALASLSLVITLLISCLYIQERDPRLEPSASTGNPGIVAFFRQVFKSIRYLPPQIAKVCEVQLAAWVGWFPFLFYATTYIGQLYVNPIFDEHPNLPDNELDKAWEEATRIGTFALLVYAIISFVTNITLPIFVVPTYRSVVSPEETDTPSDERRPFLGARRMSCSSLPVGTASEPPPALPDKQNVEATVGSTWLSKLQIPGFTLRRAWLLSHVLFALCMFSTFFIYTYQAATVVIGIVGISWALTLWAPFALISAEVARIDAERRVRRHRSGMAEHHSADNSTQPNLATNVGDLEDGPRKPTDEEENLAQAGIILGLHNVAVSSPQILSSLICSAIFKVFQKPRGEPWDDSVGWVLRFGGCAAVLAAWLTSRLAEGRRLK

SEQ ID NO: 23378 - protein, 462 aa, Oryza sativa
MGKGTVVGTAVVVCAAAAAAVGVAVVVSRRRRSKREAEEERRRRAAAVIEEVEQRDEHGLFYALDLGGTNFRVIRVQLGGREKRVVSQQYEEVAIPPHLMVGTSMELFDFIAAELESFVKTEGEDFHLPEGRQRELGFTFSFPVHQTSISSGTLIKWTKGFSINGTVGEDVVAELSRAMERQGLDMKVTALVNDTVGTLAGGRYVDNDVAAAVILGTGTNAAYVEHANAIPKWTGLLPRSGNMVINMEWGNFKSERLPRSDYDNALDFESLNPGEQIYEKMISGMYLGEIVRRILLKLAHDASLFGDVVPTKLEQRFILRTPDMSAMHHDTSHDLKHLGAKLKDILGVADTSLEARYITLHVCDLVAERGARLAAAGIYGILKKLGRDRVPSDGSQKQRTVIALDGGLYEHYKKFRTCLEATLADLLGEEAASSVVVKLANDGSGIGAALLAASHSQYASVE

SEQ ID NO: 23379 - protein, 153 aa, Bacillus anthracis
MANYIKELREKVGHDYVFLNFAGGCVFNKEGEVLLQKRGDFNAWGFPGGAMEIGESAAETAIREIKEETGYDVEINELIGVYTKYFQSYPNGDKAQSIMMCFSCSIVGGDKKVDGDETLDLKFFPLDDMPPLFCKQHEDCLQDLLEKRVGVYR

SEQ ID NO: 23380 - protein, 302 aa, Bacillus clausii
MKRARLIYNPSSGREQLRKNLAYILERLEKAGYETSAHATTPEEGCAIRAARQAGERGFDLVIAAGGDGTIFEVVNGLAGLEKRPMLGIIPAGTTNDFARALGISRDIEKACDVLCEGHFEPIDIGRMNQKYFTNIAAAGTLTELTYEVPAKLKTIVGQLAYYIKGLEKLPQVKPTFVHVEYDGKQFEDEIMMFLIANTNSVGGFEKLCPAASIQDGLFDFIIVKKTSFPEFVHLASLALRGEHINHPKLMYVKAKRIKVSVMRDDEMKLNLDGERGGVLPAEFENLYHHFQMLMPKDRKRN

SEQ ID NO: 23381 - protein, 658 aa, Arabidopsis thaliana
MDTPQKSITQIGTPISKSRFEDSPVFNYINSLSPIRPVRSIPNPNQFSSLNFTSPPSVFTSPHLTSSHKESRFFKTHNSSSSDPTNSVESQEDESTSHEEVPAEGEDTKGLNIDDCMREEASVETNLDDSVASPCGGNTTDLSLVPYAPTRGEDGSCEDNGMELQKMHDNVQGKTETPDWESLIADASELLIFDSPDASEAFRCFMMQRASNSEARFRNGVEKQTMQHDSNKEPESANAIPYEVNSGVISQAVSLLHRGIRRRCLDFEMPGNKQTSSENNTAACESSSRCVVPSIGLHLNAILMSSKDCKTNVTQDYSCSANIQVGLQRSISTLQDSLDQTENEIREDADQDVPVEPALQELNLSSPKKKSYCECFAAGVYCIEPCSCIDCFNKPIHEDVVLATRKQIESRNPLAFAPKVIRNSDSVQETGDDASKTPASARHKRGCNCKKSNCLKKYCECYQGGVGCSINCRCEGCKNAFGRKDGSSIDMEAEQEEENETSEKSRTAKSQQNTEVLMRKDMSSALPTTPTPIYRPELVQLPFSSSKNRMPPPQSLLGGGSSSGIFNSQYLRKPDISLSQSRIEKSFETVAVDGAEQMPEILIHSPIPNIKSVSPNGKRVSPPHMESSSSGSILGRRNGGRKLILQSIPSFPSLTPQH

SEQ ID NO: 23382 - protein, 377 aa, Bifidobacterium longum
MSTPSQAEVRRMIAAAGTIVVKVGSSSLTQPSGHLDPDKLDALAAALAQVRLMGGRVVLVSSGAIAAGFGPLGFDSRPVDVATQQATAAVGQGLLMARYETAFGRFGIRVGQILITAEDTIRATQYRNVERTLDRLLDLGVVPIINENDSLASNEIRFGDNDRLSALVANLVRAEALVLLTDVDALYTAPPSQPGSRRVEYVPNVIDALGDIQVSGSGSKVGTGGMVTKLEAARVAAVSGIPTVLTCASNAGPAMMGDPVGTVFAPVKARGSSRRLWIGFAADPRGTIVVDAGAGQAIRGGRASLLAAGALEVHGDFSAGDPVWIDAESGEHLARGLAGFDSEEIPQMLGRNTAQLKRFLGPQYAHPLVHRDNLVLV

SEQ ID NO: 23383 - protein, 639 aa, Brassica napus
MERARRLAYRGIVRRLVNESKRHRNGEITPHHVPSVVPHAPSRYISSLSPFLSNNHHRSVNLPKHHHHHHNQTRSISVDAVKAGDTFPRRHNSATPDEQAHMAKYCGYDHIDSLVDDTVPKQIRIDSMKFSKSTEASAESEMIAHMTELASKNKVFKSFIGMGYYNTHVPTVIIRNILENPAWYTQYTPYQAEISQGRLESLLNFQTMITDLTGLPMSNASLLDEGTAAAEAMAMCNNIQKGKKKTFVIASNCHPQTIEICKTRADGFDLKVVTKDLKEIDYSCGDVCGVLVQYPGTEGEVLDYGEFVKNAHANGVKVVMATDLLALTVLKPPGEFGADIVVGSAQRFGVPMGYGGPHAAFLATSSEYKRMMPGRIIGVSVDSTGKPALRMAMQTREQHIRRDKATSNICTAQALLANMAAMYAVYHGPAGLKSIAERVHGLAGIFSLGLKKLGVAEVQDLPYFDTVKIKCSDAHAIADAAVKSEMNLRVVDSNTITASFDETTTLDDVDKLFKVFASGKPVPFTAESLAPEVQNSIPSNLTRESTYLTHPIFNMYHTEHELLRYIHKLATKDLSLCHSMIPLGSCTMKLNATTEMMPVSWPSFTDIHPFAPVDQAQGYQEMFSTLGDLLCTITGFDSL

SEQ ID NO: 23384 - protein, 808 aa, Geobacter sulfurreducens
MAKKMLINVMHPEESRVAIVEDGKLVDLDIEIEGSEQTRGNVYKGVVVRVEPGLQAAFVDIGLKRLGFLQMGEIHPSFWQWRSDIPEESRSRRPRIQEVIRRGQELIVQVEKGERDMKGAALTTYMSFPGRYMVLMPGSDSAGISRKVESESDRKKLKEKVAELEIPEGYGYIVRTEALGKTKTELAKDLQYLVKLHQGIVDKAAAAKGPTLLHRELDVVIRTIRDYFTAEIDEVLVDSKDVYKQAREFFKQTMPKFEKLVKLHTEKRPIFSRYQIEEQIDLIYEKKVPLKSGGYLIIEPTEALVSIDVNSGKTTGEKGVEDTAYKTNLEAAEEAARQLRMRDLGGLIVLDFIDMRDKKHITAVEKTLKAALKGDKARVTVGRISQFGMLEMSRQRIRQTLEQGSTLECPHCSGRGKVKSVENMALSFLRKVHAAAAKGTVAEVHGGLPLEVAYYLLNRKKRELAQIENEYDIVVTVKGKTSFLMNQLELELVRREKPAHVETHEEHAEKVAEALAEGLPEAAEGTDVPAEASTAETEGKKKKRRRSRRKGKAEAEEMVESVAAAEIEEPEELEAGGGEEPEAAAGEETAEGEAPGEEARKKRRRKRRRGKKAKADETAAEEASAPEIAEEPAEEETTEAPIPAEEAGEASEEVKKKRRRRKRRTPKRAGEATEAPATEVEPAEPRAAEPEPELAPAEASPESAEPAPKKTRAPRSRKKAAEKPEKTEPAVALPEEQQAPAAAEATPVTPAEAKPAKKRATRKKTTSEPAPAPVQPPVPEPAADEPPKKKRAPRKKKEAPTEGTPEAG

SEQ ID NO: 23385 - protein, 50 aa, Glomerella cingulata
AIRRLARRGGVKRISAVIYEETRGVLKSFLEGVIRDAVTYTEHAKRKKVT

SEQ ID NO: 23386 - protein, 1033 aa, Oryza sativa
MERARRLANRALLRRLLAAAASTMSPAPSRGISTLAKAPGAGSRPRAPRPAPHQYTTGRPVSASALQPSDTFPRRHNSATPAEQAAMASECGFNTLDALIDATVPAAIRAPTMHFSGKFDAGFTESQMIDHMQRLAAMNKAYKSFIGMGYYNTHVPAVILRNLMENPAWYTQYTPYQAEIAQGRLESLLNYQTMVADLTGLPMSNASLLDEATAAAEAMAMCNGILKSKKKTFLIASNCHPQTIDVCQTRAAGFDLNVIVADAKDFDYSSGDVCGVLVQYPGTEGEVLDYAEFVKDAHAHGVKVVMATDLLALTSLRPPGEIGADIAVGSAQRFGVPMGYGGPHAAFLATSQEYKRLMPGRIIGVSVDSSGKPALRMAMQTREQHIRRDKATSNICTAQALLANMAAMYAVYHGPEGLKAIADRVHGLAGTFAHGLKKLGTVTVQELPFFDTVKVKDADANAIAQEACKNEMNLRVVDATTITVAFDETTTLEDVDKLFKVFNGGKPVNFTAESLVSEVSSSIPSSLVRKSPYLTHPIFNMYHTEHELLRYLHKLQSKDLSLCHSMIPLGSCTMKLNATVEMMPVTYPSFANMHPFAPTEQAAGYHEMFDDLGDLLCKITGFDSFSLQPNAGASGEYAGLMVIRAYHRARGDYHRDVCIIPVSAHGTNPASAAMCGMKIVAVGTDSKGNINIEELRKAAEANKDNLAALMVTYPSTHGVYEEGIDEICRIIHENGGQVYMDGANMNAQVGLTSPGFIGADVCHLNLHKTFCIPHGGGGPGMGPIGVKKHLAPFLPSHPVITTGGFPLPEKTDPLGTISAAPWGSALILPISYTYIAMMGSKGLTDASKIAILNANYMAKRLEKHYPVLFRGVNGTVAHEFIIDLRGFKTTAGIEPEDVAKRLMDYGFHAPTMSWPVPGTLMIEPTESESKAELDRFCDALISIREEIAEIESGKADVNNNVLKSAPHPPQLLMSDSWTKPYSREYAAFPAAWLRGAKFWPTTCRVDNVYGDRNLICTLQQGSQVAEEAAAATA

SEQ ID NO: 23387 - protein, 922 aa, Staphylococcus carnosus
MKLDLHYNLKQLHVNTLPYTNYFVPYHRKTEVHDNKKDLDKACVTPLNGDWNFDYYESVKEYEAASTKKSKGELPVPGVWNLFGYDQIQYVNIKYPIPFDPPNVPEEKPCGLYRRQFELNKLYKKKERQYILNFDGVSSAYYVWVNQKFVGYSQVSHSISRFDITDFVKGGRNSIAVLVVKYSDGTYLEDQDMFRHSGIFRDVYIVERPEARIEDFKIDTKVDTVENTGEILIDIRKIAGDPSIEYALYNPNKKVIKSGEVGDERQIVIPLSQPELWSAETPNLYTLYLITKDEVIKQKIGVREVKIEDQQLWINGQSVKLRGVNYHDTDPPQGYVVSEQRLITDLKLMKEANFNAIRTAHYPKSPYFYELADKYGFYVMSEADLETHGVVMLYGKENIDDFNIIADNPKYEKAILDRVEASIVQLQNYSSIIMWSLGNESGYGQNFKKAAALAHDLDDTRPVHYEGAFYARGGEDYSKLDVISRMYPSPEEIERRYLDNKQVTKPFILCEYAHAMGNSPGGLEAYHDLMEKYPAFIGAFVWEWCDHAVTAGMQHGLYRFRYGGDSGETLHDGNFCVDGIVNPDRIPHEGFYEFQEIHRPLVLKKYDGLTWTVRNQLDFLNINQFIEAAVSLTTIGGESKKFSFELPELLPHEEREIDFTSILKDSHFKPEELSSIMLTYRLKSATGLLSAKTYLGHDQVIYQRQVINKVEDRNAPITEQAAINISANSISVQLKEWEYHFDKKTAALNLIKHNNKRLLDEPTKIVIWRAPTDNDIHLEERWKEMGYFNPITRILGYSIDEQDNRIIISFDIGFYSTNTPKILSVDCKWTIYPGGHIEVDIHMGRNMRMPALPRFGMIWKLQREYERVRYCGNGPFSSYSDKVLACHLGWFNTTVDENARPHIRPQEDGSHDNVTSMSVRAG

SEQ ID NO: 23388 - protein, 64 aa, Glomerella acutata
AIRRLARRGGVKRISAVIYEETRGVLKSFLEGVIRDAVTYTEHAKRKTVTSLDVVYALKRQGRT

SEQ ID NO: 23389 - protein, 237 aa, Unknown
  Synechococcus sp. CC9311
MLSGLSSSSDLSVDQLLEKFSSGSSRQKRSLIPAVEKAADQLAAMGEAALSSFDREGDEWAAGWILQTLHRHQPSALSSLFDASRGWFTTGSESDLDYSPLQQALLEERFEEADRLTSAFLRKLAGEQAERRGYVYFSEVLSMRGLDLVTLDRLWIAYSQGRFGFTVQARLLATLNGRYDKLWPRIGWKQEGVWTRYPNAFDWSLKAPEGHMPLINQLRGVRLIDALLNHPSLVARQ

SEQ ID NO: 23390 - protein, 431 aa, Lactobacillus plantarum
METISIINAADHVNEQVKIGVWLSNKRSSGKIAFLQLRDGTATFQGVALKNELGETAFAQLTDLAQETSLWVTGTIHADTRSPFGYELAISQFEVVGTSHDYPITPKDHGIDFLLDHRHLWLRSSRPNAIMRIRNEVIRAVYEFFNDRGFIKIDAPILTGSAPEGTTELFKTDYFGQDAYLSQSGQLYGEAGAMAFGKIFTFGPTFRAEKSKTRRHLTEFWQLEPEMAWMHQDESLEVQEQLVAYLGQAVIDHCPHELAVLDRDVATLQKYTKLPFPRVSYDDAITLLQANGFDVDWGVDFGSPEETFLAEHFDQPVFVLNYPKAIKAFYMQAHPTRDDVVIAADLLAPEGYGEIIGGSERSTDYDYLKERLLASGQDLQDYEWYLDLRKYGSVPHSGFGMGLERFLAWITLQDHVRETIPFPRMLHRIYP

SEQ ID NO: 23391 - protein, 264 aa, Magnetospirillum magnetotacticum
  misc_feature (247)..(247): Xaa can be any naturally occurring amino acid
  misc_feature (252)..(254): Xaa can be any naturally occurring amino acid
  misc_feature (256)..(257): Xaa can be any naturally occurring amino acid
  misc_feature (260)..(264): Xaa can be any naturally occurring amino acid
MFARLKTGRDFTDIRGVYTRDSIGRHLDNPVRDKRFLARVTVPAAYVEDIDALPMLNRAYIRQYRYHNIIGSTDDLATILSSRGCPYRCTFCDVPIKSYRERSPAAVCDEIEACLAMGYKEFRFYDDLFNINERKVIAFCDELDRRGLRITWDFRGRVNAVSRESLVRARASGLRMISFGVETGSDDGLRILKKATTTAKIRQAFAWCRELGILTVADYIIGQPFEKTPDDIRRNIDFLVALEPPEXLMASXXXSXXPSXXXXX

SEQ ID NO: 23392 - protein, 321 aa, Coxiella burnetii
MNKPQHHSLIILGSGPAGYTDAIYVARANLKPIMITGMEQGGQLMTTTDVANWPGEAPGLQGPKLLERMQKHAGGALNTQFIFDHINKPDLNPRPFLLQGDNATYSCDALIIATGASARYLGLPSEKPYMGKGVSACATCDGFFYRAKKVAVVGGGNTSVEEALYLSHIASHVTLIHRRDKLRAEKMLSAQLIKKVEEGKVAIVWSHVIEEVLGDDQGVTGVHLKHVKEEKTQDLTIDGLFIAIGHDPNTKIFKEQLEMDEAGYLRAKSGLQGNATATNIPGVFPAVVVRGQLYRQTIAAAGMGCMPALDAERYLDSLNQA

SEQ ID NO: 23393 - protein, 237 aa, Aspergillus nidulans
MANDEYDVSPRPLTFLFKVVLIGDSGTGKSNLLSRFTRNEFNLDSKSTIGVEFATRSIQVDSKTIKAQIWDTAGQERYRAITSAYYRGAVGALLVYDISKHQTYDNVNRWLKELRDHADSNIVIMLVGNKSDLRHLRAVPTEEAKQFASENNLSFIETSALDASNVELAFQNILTGIAPVGISKRRSLTAILFFVEIYRIVSSKALEGESGGASVGERRQIIDIEKTQDTENKGGCC

SEQ ID NO: 23394 - protein, 465 aa, Vigna radiata
MAVARSDSNSEPCTSYNCYNVAALTETILETSQVSNLKDRYVLGEQLGWGQFGVQDCSDKLTGEVLACKSIAKDRLVTSDDLRSVKLEIEIMARLSGHPNVVDLKAVYEEEGFVHLVMELCAGGELFHRLEKHGWFSESEARVIFRHLMQVVLYCHENRVVHRDLNPENILLATRSSSSPIKLADFGLATYIKPGQSLHGLVGSPFYIAPEVLAGAYNQAADVWSAGVILYILLSGTPPFWGKTKSRIFEAVKAASLKFPLEPWDRISESAKDLIKGMLCTDPSRRLTAQEVLDHCWMESNQTNQEQLGENQIQSCKQWDVGGSSFSASFSPGIRTLAFSLALLHVMLNRPTFTCRSSFSSFLEEPVTPCVLSAGFSFKSVGDSSGLEFSSPIPSMLSFSFLSPSPVVEHKSCKLGCSANMSDVDAIAGEASLESYFYYKILNLCIEHDAKETNRKPTEAKRSIE

SEQ ID NO: 23395 - protein, 436 aa, Glycine max
MPTFTAIAFDRLIEPGASKPAYKSAPVPMPVPKKIERRTSEPTIRKKPRPRPQLKPALYATPEVTPLPDAPSSFPPSPYIINHKRRGPRLLKSYSEANVQAKQENLDNENANVKSNDGVITSLDGDLQVTFTNIEPVKEEQVNGVHDTDLSSSSNNKGDLGEAHRESESSGILNGSHLDKVVALNLEREGESEDFFDPHDSMSLKSCTDGEDNTGTDQALKFSAAGGEFFDAWEELSSDGGTQNSHRDIEAELREIRLSLLMEIEKRKQVEETLNSMQSHWERLGQRLSHIGIVLPSDLTAEGGQLSSDPMEDVCQQLYITRFISNTIGRGIARAEAEIEMEAQLQSKNFEIARLLERLHCYETMNREMSQRNQEAVEMARRERQRRSRRQRWIWGSITTAIAVGTAAIAWSYLPVGRGSTSAVHDQVPEHDDAAN

SEQ ID NO: 23396 - protein, 178 aa, Brucella melitensis
MPEVGGKTIEVLFSPDEIAKRNLELATIIAERKFHNLLTISILKGSFIFAADLIRAMHDAGVEPDVEFITVSSYGKGTTSTEVRLLRDIDSDVRDRDVLLIDDILESGKTLKFVRELMLERGARSVSIAVLLDKSMRRKVDLDADFVAFECPDYFVVGYGMDVGHAFRQLPYVGRVME

SEQ ID NO: 23397 - protein, 591 aa, Cryptococcus neoformans
MSFPRQISTLVVGGGPAGIVSLKYTVEYGEAWSEGEEPLLIDMESEIGGTFRWRGYQNAELVSSKQLTCFSDFRYPLDSPDHPSLPNFVDYLNCYIDHFDLRHMIRTSIKLVSLEYASSDSKDFYKHRATIQPLNDNGLPQGDPLIVLAKRVIITTGLHVTPNIPLIPGLNSTPCIPEPPKWIHSSAYKSRNQLKDKKVLVLGCGETGMDVGYEAIMAPAKKVWLGVRTGFLSFPKLFETAYVHPWVAASHIRWFISDLVIKRLLWVLTGTMAGCNQWAGELPPERQGRAYVFLNKSAKAMQFINRPFYSLSPIHRWIAHYIDPPPPPGDPKIDIVPFPQGFDSEGRAVFPAPPEHRRKETAWKDECKPDLVVLCTGYRQDWSWLGEGYPRGPEDCEIRGITSTKDLSIAFIGFVRPGVGAIPPIAEMQAQLFILLTEKRVPIPVSPETYHLLHSPTSRIQYGVDYSTYMSTLAKDIGSAPGLLRLWWDYGLFVLFVYCFGAAFPTFYRLTGPFKITKAREIVETELWDTIRRRGVIGNIFMGVIPMVFYAYLNIGAYILEFVWRVVTPIFDLPASPLELFQEKSTTVKSI

SEQ ID NO: 23398 - protein, 525 aa, Unknown
  Shewanella sp. MR-4
MLDANLKNQLQTYLQNLKRPVELVVSADESRKSQELTSLANDIVSLSTLVSLKEAQGPRTPAMTVVNPELNTQISFAGLPMGHEFTSLVLALLHTGGHPIKLSDEIIEQIRNLPGKYEFETYVSLTCQNCPDVIQALNMMAAINPNITNVMIDGALFQDEVASRNIMAVPSVYLNGEVFAAGRISIGEILNKLDTGAASRKAEELSQKAPYEVLVVGGGPAGAAAAIYAARKGLRTGVVADKFGGQVAETVGIENFISVKATEGPKLVANLEAHVRDYEVDIMDNQKAVKLASDGLFELELASGAKLRSRTILLATGARWREMNVPGEKEYRGKGVAYCPHCDGPLFKGKRVAVIGGGNSGIEAAIDLANIVEHVTVLEFDSKLRADDVLQRKAASMGNIKIITQAMTTEVTGDGTRVDGLNYTDRATGESHHIALAGIFVQIGLVPNAEWLKGTVDLTPRGEIIVDERGQTSVPGVFAAGDVTNSPYKQIIIAMGSGANASLGAFDYLIRHSDDSTETTATKAA

SEQ ID NO: 23399 - protein, 566 aa, Fusobacterium nucleatum
MDKMFCYQCQETAKGTGCTSIGVCGKTSETSGLQDLLLYTEKGVAAYSTVFRKNGKAKELLEGKVNRYLINSLFITITNANFDDNAILDEIKAGLKLREELKALATDEEKKEAEKYGADLVNWYYESNEDLIKFSENQSVVGVLRTENEDVRSLRELIMYGLKGMAAYAEHAFNLGKTSEEIFAFVEEALLGTMDDSLNAEQLVALTIKTGEYGVKVMALLDEANTSALGTPEITKVKIGAGKRPGILISGHDLWDLKQLLEQSKDSGIDIYTHSEMLPGHGYPELKKYSHFYGNYGNAWWDQRKDFTNFNGPIIFTTNCIVPPVKNATYKDRVFTTNAAGYPGWKRIKVNADGTKDFSEVIELAKICQAPVEVESGEITVGFAHNQVLSLADKVVENIKSGAIKRFVVMSGCDGRMSQRHYYTEFAENLPKDTIILTSGCAKYKYNKLNLGDINGIPRVLDAGQCNDSYSWAVVALKLKEVFGLNDINELPIVFNIAWYEQKAVIVLLALLYLGIKNIHVGPTLPGFLSPNVAKVLVENFGIAGITTVEEDLKKFGLYEGSGLDN

SEQ ID NO: 23400 - protein, 110 aa, Arabidopsis thaliana
  misc_feature (83)..(83): Xaa can be any naturally occurring amino acid
MPSSMLSSATMVASPAQATMVAPFNGLKCYAAFPATLKANNDITSITSNGGRDNCIAVWPALGKKKFETLSYRSDLTDSELAXGVHYLIPNQGVSCVKFEVEHGFVYPEH

SEQ ID NO: 23401 - protein, 450 aa, Zea mays
MAAVAAAPRPQLPMLSGGGGAALSSLTLQTLAFISPLPISRCHRCVLRSNASSSPSPPPSQEEAAAAEVVPTAESCVNLGLQLFSKGRVKDALEQFENALELNPTSIEAQAALYNKACCHAYREESKKAAECLREALRDYNLKFGTILNDPDLAPFRASPEFKELQEEALRGGEDIGSGFRRDLKLISEVQAPFRGVRRFFYVALTAAAGISTFFTIPRLVLAVRGGDDAPDLLETAGNAAINIGGIVVLVALYFWENKKEEKQITQISRNETLSRLPVRLSTNRIIELVQLRDITRPVILAGSKASVTRALQRAERYRTELLKRGVLLIPVIFGASQKDQTKPRGFGARRAAASVPSVGGDFEKRTESIAAKSRLKTEVRFKADIVSPEQWESWIRDQQVSEGVTPGEDVYIILRLDGRVRRSGIGMPNWNDILQELPRLEDLMSKLER

SEQ ID NO: 23402 - protein, 271 aa, Unknown
  Synechococcus sp. RS9917
MTEATVTESPVGDVEVGTVYLVGAGPGDPDLLTVKAHRLLCCCDALVYDSLVPREVLDLVPDACERHFVGKRRGHHSVPQPSTNAVLVDLASRHRCIVRLKGGDPFLFGRGGEEAAHLVRHGVPVKVVPGVTAGIAAPAYAGIPVTHRRAGSSVTFVTGHEEIDKRRPAVNWRSLAAASDGLVIYMGLHNLPRIAEELIAGGLSAATPVAVIQQGTVAGQRCLRSRLDAVAQEARQQQFASPSIVVVGDVVAEQIEACAPQPAAVTMPIPF

SEQ ID NO: 23403 - protein, 274 aa, Glycine max
MWSALKRNYEVSEEIGRGRFGTIFRCFHPLSNQPYACKLIDKSLLLDSTDRHCLQNEPKFMSLLSPHPNILQIFHVFEDDHYLSIVMDLCQPHTLFDRMLHAPFSESQAASLIKNLLEAVAHCHRLGVAHRDIKPDNILFDSADNLKLADFGSAEWFGDGRSMSGVVGTPYYVAPEVLLGREYDEKVDVWSCGVILYIMLAGIPPFYGDSAAEIFEAVVRANLRFPSRIFRTVSPAAKDLLRKMISRDSSRRFSAEQALRHPWILSAGDTAELT

SEQ ID NO: 23404 - protein, 417 aa, Aspergillus nidulans
MGSLGPYKQKHKVTVVGSGNWGTAIAKIVAENTASNPAVFEKDVQMWVFEEKVEIPKSSKHYDPASSLCQGPQNLTDIINHTHENIKYLPGITLPENLIANPSLVDAVQDSTILVFNLPHQFIINICEQIKGKIVPYARGISCIKGVDVNEEGVHLFSETIGKILGIYCGALSGANIANEVAQEKWSESSIGYDPPHFDSKAPSPPNRSPSASTDNILHFEHKDVSGQLSRVKLQALPSEFPPIDHALLKSLFHRPYFHIGVVSDVAGVSLGGALKNVVAVAAGWVVGKGWGDNAKAAIMRVGLLEMVKFGEQFFGATINTRTFTEESAGVADLITSCSGGRNFRCAKLSIERNQPIEKIEETELNGQKLQGTLTAVEVNSFLKKQGLEEEFPLFTAVYRVLQGTMSVDEIPSFIER

SEQ ID NO: 23405 - protein, 140 aa, Unknown
  Frankia sp. CcI3
MPQNGRVNQSPPRTLPISSFYDAAGGEPTFRKLVARFYQGVANDPVLRPLYPEEDLTGAEERLRMFLIQYWGGPTDYQEQRGHPRLRRRHAPFAIGPTQRDAWLKIMRAAVDSLDLPPDLDRQLWDYLSMAANSLQNRPD

SEQ ID NO: 23406 - protein, 749 aa, Rickettsia conorii
MFNEITKSVTWNGQVLELSTGKIARQADGAVTVKMGNSVLLCTAVVANKAKEGIGFLPLTINYREMAYAAGKIPGGFFKHEGKASDREVLVSRLIDRPIRPLFHPAFVNETHVTCSVLSYDPETPVDILAIIGASAALSLSPAPYLEIVAASKVGLINGEFVLNPTLALLKTSQLDLVVAGTSDSVMMVESEAHLLSEEQMLEAVKFGFESFQPVIKIIKELAEEAKKPKLEMQALYPASLKKEIEKLFVKEIEQAFAIKSKQERSTNLDLIPEKVLTHFVSDIENKKYSNYQIESALKAIESDILRNEILEKNRRIDGRSTTDIRQIACEIGLLPSAHGSALFTRGETQSLVSTTFGTSLDEQIVDSLEGEYKERFMLNYIFPPYSVNEAMPMKAPSRREVGHGKLAWRAINPILPNKVQFPYSIRVVAETTESNGSSSMATVCGSSLALMYAGVPIKAPVAGIAMGLVKEGKNFAVLSDILGDEDYFGDMDFKVAGTSEGITALQMDIKISGVDFKIMKVALEQARLGRLHILEQMNKVISKPNNELSKNAPSTTTIKIDKDKIRDIIGPGGKIIKEICETSGAKIDISDDGTVSVYASDRDKLKVALDKIKAIVVEPEIGEIFNGTVVKVLDSGAFINYVGNKDGFVHISEVSGERIETVSSVLKQGDIVKVKLIGFDNKGKAKLTIKNADKDKSSNNTKPKTNVNNTNKDNSEPEQRRDSSKKRAWNEDNNAETAEVITERKYFN

SEQ ID NO: 23407 - protein, 372 aa, Methylobacillus flagellatus
MTSLLLNAKCLVVKVGSSLVTNNGAGLDKGAIAAWADQIARLVKSGRQVVLVSSGAVAEGMQRLGWKKRPVAINELQAAAAVGQMGLVQMYESCFASHGLHTAQILLTHADLADRKRYLNARTTLRTLLDLGVIPIINENDTVVTDEIRFGDNDTLGSLVANLIEADALVILTDQPGLYSADPRKHPDAQFIQYETAGNPALEKMAGGAGTLIGSGGMLTKILAAKRAARSGAHTVIASGREPDILVRLAQGEVVGTHLKAGQVKTLARKQWLADQLRVAGKVVVDEGAAKALREGGRSLLPIGVMAVEGSFERGEVVSCVNTAGEEIARGLVNYSALETARILRQPSHEIEHILGYIDGPELIHRDNLILV

SEQ ID NO: 23408 - protein, 250 aa, Ostreococcus tauri
MPSAAEAVTLYVAPALGTVLAMFMFGSPLPEISRSREKGTIGSLNPTPYPIVAANCASWMMYGAISGNYWVYCPNFTGLLAGAYYSGVSYALSERHRPVLEKLSGGLIFLVSLIGMVLSCVMRGSSENSRLMVAGIQANTILAVYYVSPMSTMSEVVRTRDSKSMHFPLVVTNFLNGLCWFAFGIGLNDWWLAAPNLFGACVSVVQIGLIMVFPNSERRAGISTTPSTDGLMELNPTSSFSESPRSSTAV

SEQ ID NO: 23409 - protein, 169 aa, Arabidopsis thaliana
MADESPKSIYDFTVKDIGGNDVSLDQYKGKTLLVVNVASKCGLTDANYKELNVLYEKYKEQGLEILAFPCNQFLGQEPGNNEEIQQTVCTRFKAEFPIFDKVDVNGKNTAPLYKYLKAEKGGLLIDAIKWNFTKFLVSPDGKVLQRYSPRTSPLQFEKDIQTALGQASS

SEQ ID NO: 23410 - protein, 470 aa, Chlamydophila abortus
MKKQKRFLSLLFLTFVLLGIWFCPHPEAINPNAWHLFAVFTTTILGIILQPVPMGAIVIIGISTLLLTQTLTLEQGLSGFHDPIAWLVFLSFSIAKGIIKTGLGERVAYFFVSILGKNPLGLSYGLVITDFLLAPAIPSVTARSGGILYPVVMGLSESFGSSAEKGTESLIGSFLIKVAYQSSVITSAMFLTAMAGNPLLAALASNAGIALTWATWAKAAVFPGLLSLVLMPIVLYKLYPPTITSCEEAIRTAKLRLKEMGPLKKGEKIILMIFTLLVVLWTFGDLLRISATTAALIGLSLLILTNILDWHKDVMANTTAWETFIWFGALIMMASFLNQLGFIPLIGDSVAAGVAGLSWKIGFPILFLMYFYSHYLFASNTAHIGAMFPVFLAVSIALGTNPIFACLVLAFSSNLFGGLTHYGSGPAPLYFGSQLVSIKDWWQSGFILSIVNIAIWVGIGSLWWKILGLI

SEQ ID NO: 23411 - protein, 260 aa, Triticum aestivum
TSLYKKAGWYRSGIPGISSTHASAQSVESIGVCYGMSANNLPAASTVVSMFKSNGINSMRLYAPDQAALQAVGGTGVNVVVGAPNDVLSNLAASPAAAASWVRSNIQAYPKVSFRYVCVGNEVAGGATQNLVPAMKNVQGALASAGLGHIKVTTSVSQAILGVYSPPSAGSFTGEADAFMGPVVQFLARTGAPLMANIYPYLAWAYNPSAMDMSYALFTASGTVVQDGSYGYQNLVDTTVDAFYTAMAQHGGSNVELVVS

SEQ ID NO: 23412 - protein, 978 aa, Bacillus cereus
MAEQTVRVTVDGKEFSASGEKTILQLFNESNLEHPQICHVPEVDPIQTCDTCIVEVDGKLMRACSTQIENGMHIERQSQRAKEAQTEAMDRILENHLLYCTVCDNNNGNCKVHNTVHMMGIEEQKYPYEPKVSACEVDMSHPFYRYDPNQCIACGQCVEVCQNLQVNETISIDWSLDRPRVIWDHGVSINDSSCVSCGQCVTVCPCNALMEKSMLGEAGFMTGLKPDVLDPMIDFVKDVEPGYSSILAVSEVEAAMRKTKVNKTKTVCTFCGVGCSFEVWTKDRHILKVQPVSDAPVNGISTCVKGKFGWDFVNSEDRITKPLIRQGDMFVEASWEEALEVVASNMQHIKSEYGSDAFGFISSSKVTNEENYLMQKLARQIYGTNNVDNCSRYCQSPATDGLFKTVGMGGDAGTVKDIAEAGLVIIVGANPTEGHPVLATRVKRAHKLHEQKLIVADLRKHEMAERADLFIHPRQGTDYVWLAGITKYIIDQDWHDKKFIAENVKNFDEYSKMVEKYTLDYTEEITGISKENLKEMARMVYEADGTCVLWGMGVTQNTGGSTTSAAISNLLLVTGNYRRPGAGAYPLRGHNNVQGACDMATLPNWLPGYQAVSDDTLRAKFEKAYGTTIPKAPGLNNIAMLLAAEEGKLRGMYVMGEEMALVDSNANHVQHILANLDFLVVQDMFLSKTARFADVILPAAPSLEKEGTFTNTERRIQRLYEVLKPLGDSKPDWWILQKVARALGGDWNYESPSEIMDEIASLAPIYSQATYDRLEGWNSLCWGSHDGSDTPLLYVDGFNFPDKLARLSLDEWIPPVVAPDEYDLLLNNGRMLEHFHEGNMTNKSAGILSKVSEVFVEISPELAIERNVKDGGLVELASPFGKIKVQALITDRVTGKELYLPMHATINEEAINILTGTATDLYTCTPAYKQTMVKMRVLREKGNRPLPSSNPRDKNRNPQNGVEIEQKWQRKQYVSLVD

SEQ ID NO: 23413 - protein, 410 aa, Bordetella parapertussis
MEQQHTIVIIGAGQAGGWAARTLRAEGYAGRVLLCGDETAPPYERPPLSKEQLAAQAPALPSLMDAAQLAELHIDWLGGAAATRIDRAGRRVLLGDGQALRYDALILCTGGRPRLPPLPGADLPCVHTLRTIDDAARLRAAFDGTPRVAVLGGGWIGLEVAAAARQRGGAVVLLEAADRLCARSGPGLLSETLARLHAGQGVDLRLNARVQRIDAHGRGCRLALADGQGIEADIVVAGVGLVRNDELARQAGLACDHGVIVDGACRTSDPDIYAAGDVAVMARPDGKLAGLESWQNAQDQGIAAARAALGQAVRYAPLPFFWSQQYDTLVQMAGASEPGAALVLRQGGPAQLLCVEMRADGRAAAVLGVNAAREFRQLRKYIAEGARLDARRLADPRSPLAGAVLGEAAA

SEQ ID NO: 23414 - protein, 114 aa, Vibrio cholerae
MNMKKIEAIIKPFKLDDVREALAEVGITGMTVSEVKGFGRQKGHTELYRGAEYMVDFLPKVKLEIVVTDDVADRCVDTIIETAQTGKIGDGKIFITNVERVVRIRTGEEDEDAI

SEQ ID NO: 23415 - protein, 622 aa, Saccharomyces cerevisiae
MSFSTINSNVNKTTGDSNNNTTENSSTADLLGMDLLQSGPRLMNTMQPNNSSDMLHINNKTNNVQQPAGNTNISSANAGAKAPANEFVRKLFRILENNEYPDIVTWTENGKSFVVLDTGKFTTHILPNHFKHSNFASFVRQLNKYDFHKVKRSPEERQRCKYGEQSWEFQHPEFRVHYGKGLDNIKRKIPAQRKVLLDESQKALLHFNSEGTNPNNPSGSLLNESTTELLLSNTVSKDAFGNLRRRVDKLQKELDMSKMESYATKVELQKLNSKYNTVIESLITFKTINENLLNNFNTLCSTLANNGIEVPIFGDNGNRNPTGNTNPATTTAIQSNNNTNNASPATSTVSLQLPNLPDQNSLTPNAQNNTVTLRKGFHVLLVEDDAVSIQLCSKFLRKYGCTVQVVSDGLSAISTLEKYRYDLVLMDIVMPNLDGATATSIVRSFDNETPIIAMTGNIMNQDLITYLQHGMNDILAKPFTRDDLHSILIRYLKDRIPLCEQQLPPRNSSPQTHSNTNTANSNPNTINEQSLAMLPQDNPSTTTPVTPGASISSAQHVQQGQQEQQHQIFHAQQQQQHHNAIANARSDVAIPNLEHEINTVPHSSMGSTPQLPQSTLQENQLS

SEQ ID NO: 23416 - protein, 378 aa, Prochlorococcus marinus
MADYYDLLGVSKDADGDTLKRAYRRLARQYHPDINKDPGAEDRFKEIGRAYEVLSDPQTRGRYDQFGEAGLGGAGGMPDVGDMGGFADLFETFFSGFGGAGGSGGGRPRRRGPQQGDDLRYDLKIDFEQAVFGQEREIKIPHLETCDTCNGTGAKVGSGPTTCSTCGGVGQVRRATRTPFGSFTQVAECPSCEGTGQVISDPCGACAGQGVRQVRKKLRINIPAGVDTGTRLRVAGEGNAGLRGGPSGDLYVFLTVKSHPQLRRDGITVLSEVNVSYLQAILGDIIEVDTVDGNTSLEIPAGTQPNAVLTLENKGIPKLGNPVARGNQRISINVKLPLRLSDEERGLLEDLAGHHSAKGRQHHHHNSGLFARLFGQKG

SEQ ID NO: 23417 - protein, 482 aa, Geobacter metallireducens
MERELFDKPLKIDTRPLWLILIDRSARYQVFAGLIIACAILFRLTPPEGLSAAGYHALIVFGATIFLWISGLLPIAVTALFSMALLPLLGIMEAKKTYALFGNEAVFFIIGAFILAAAMTGTGLSARLARAMLARFGKTPRSLALTVFLLSAILSFCMSEHAVAAMMFPVVEEIGTSLGLERGRSRYAKLLFMSMAWGCIIGGIATFLGGARAPLAVGMLRETSGLDYTFFEWTVAAIMIVAPLLVIGFLLLLLFFPPDIAGVDEGLRFLNRKRLETGKMGYGEMTVAAVMVVTIACWMALGKELGLANIAILAMVALFVFRVVSWQTIEEYVNWGIILMYGGSIALATALEKTGAALWIVERGLGAFSPSPLMVIAVISLVSILLTECISHAAVVAILMPIGMSLAKSLGMDLKVMTLAIALPAGLAYCLPMGTPATAIAYASGYLRSKDIIIPGALVMAISWLLFMAAAIFIWPLIGLNI

SEQ ID NO: 23418 - protein, 698 aa, Staphylococcus aureus
MSQEKKVFKTEWAGRSLTIETGQLAKQANGAVLVRYGDTVVLSTATASKEPRDGDFFPLTVNYEEKMYAAGKIPGGFKKREGRPGDDATLTARLIDRPIRPLFPKGYKHDVQIMNMVLSADPDCSPQMAAMIGSSMALSVSDIPFQGPIAGVNVGYIDGKYIINPTVEEKEVSRLDLEVAGHKDAVNMVEAGASEITEQEMLEAIFFGHEEIQRLVDFQQQIVDHIQPVKQEFIPTERDEALVERVKSLTEEKGLKETVLTFDKQQRDENLDNLKEEIVNEFIDEEDPENELLIKEVYAILNELVKEEVRRLIADEKIRPDGRKPDEIRPLDSEVGILPRTHGSGLFTRGQTQALSVLTLGALGDYQLIDGLGPEEEKRFMHHYNFPNFSVGETGPVRAPGRREIGHGALGERALKYIIPDTADFPYTIRIVSEVLESNGSSSQASICGSTLALMDAGVPIKAPVAGIAMGLVTREDSYTILTDIQGMEDALGDMDFKVAGTKEGITAIQMDIKIDGLTREIIEEALEQARRGRLEIMNHMLQTIDQPRTELSAYAPKVVTMTIKPDKIRDVIGPGGKKINEIIDETGVKLDIEQDGTIFIGAVDQAMINRAREIIEEITREAEVGQTYQATVKRIEKYGAFVGLFPGKDALLHISQISKNRIEKVEDVLKIGDTIEVKITEIDKQGRVNASHRALEE

SEQ ID NO: 23419 - protein, 311 aa, Oryza sativa
MGGGGGVEADCDRIRGPWSPEEDEALRRLVERHGARNWTAIGREIPGRSGKSCRLRWCNQLSPQVERRPFTAEEDATILRAHARLGNRWAAIARLLQGRTDNAVKNHWNCSLKRKLAVATTTTTTTTGAAAAPGVVADAAELVERPCKRFSPTPDSPSGSGSGSDRSDLSHGGGFGQIFRPVARTGAFEPVDCAISRRQEEDPFTSLSLSLPGTDQRFNHDSAHSHFQELPSSPSPPPPPPPAAAASTTQYPFTPEFAAAMQEMIRAEVHKYMASVGVRAGCGDAGGADLHMPQLVEGVMRAAAERVGRMH

SEQ ID NO: 23420 - protein, 509 aa, Lactococcus lactis
MILDETLRAQLMPYMDLLENPIILKVDADLESENGKKIVEFTDELASLSEMISKETAKLNRKTAFSIEREGVSGVLFSGLPLGHELNSLVLALVQVSGRPPRIEQELVERIQAIQNPLHFETYVSLTCHNCPDVVQALNTMSILNPNISHTMIEGGMFQEEVEAKGIMAVPTVFKNGEEFHNGRASLEELLEKITGPESSEAFFDKDPYDVLVVGGGPAGASAAIYAARKGIRTGLIAERFGGQPLETLGIENLIGTPYVEGVQLGRQLEEHVKKYPVDLMNLQKAVKLEKKDLIEVSLENGALLKSKSVIISTGARWRDLGIPGEQEFKTKGVAYCPHCDGPLFAGKDVAVIGGGNSGIEAAIDLAGLVRHVTVLEFLPELKADKILQEKLATLNNVTVLTNVETKEILGDDKVRGLNYQVRGSKETVHLELAGVFVLIGLVPNTQWLEGTIDLSARGEILTDKVGATNLPGVFAAGDCTDSVYKQIIISMGTGATASLGAFDYLIRN

SEQ ID NO: 23421 - protein, 356 aa, Arabidopsis thaliana
MSSLADLINLDLSDSTDQIIAEYIWIGGSGLDMRSKARTLPGPVTDPSQLPKWNYDGSSTGQAPGDDSEVIIYPQAIFKDPFRRGNNILVMCDAYTPAGEPIPTNKRHAAAKIFEDPSVVAEETWYGIEQEYTLLQKDIKWPVGWPVGGFPGPQGPYYCGVGADKAFGRDIVDSHYKACLYAGINVSGTNGEVMPGQWEFQVGPTVGIAAADQVWVARYILERITELAGVVLSLDPKPIPGDWNGAGAHTNYSTKSMREDGGYEVIKKAIEKLGLRHKEHIAAYGEGNERRLTGKHETADINTFLWGVANRGASIRVGRDTEQAGKGYFEDRRPASNMDPYTVTSMIAESTILWKP

SEQ ID NO: 23422 - protein, 490 aa, Saccharomyces cerevisiae
MFPRASALAKCMATVHRRGLLTSGAQSLVSKPVSEGDPEMFDILQQERHRQKHSITLIPSENFTSKAVMDLSGSELQNKYSEGYPGERYYGGNEIIDKSESLCQARALELYGLDPAKWGVNVQPLSGAPANLYVYSAIMNVGERLMGLDLPDGGHLSHGYQLKSGTPISFISKYFQSMPYHVDHTTGLIDYDNLQVLAKAFRPKVIVAGTSAYSRLIDYARFKEISQGCGAYLMSDMAHISGLVAANVVPSPFEHSDIVTTTTHKSLRGPRGAMIFFRKGIKSVTKKGKEIPYELEKKINFSVFPGHQGGPHNHTIGAMAVALKQAMSPEFKEYQQKIVDNSKWFAQELTKMGYKLVSGGTDNHLIVIDLSGTQVDGARVETILSALNIAANKNTIPGDKSALFPSGLRIGTPAMTTRGFGREEFSQVAKYIDSAVKLAENLKTLEPTTKLDARSRLNEFKKLCNESSEVAALSGEISKWVGQYPVPGDI

SEQ ID NO: 23423 - protein, 430 aa, Oryza sativa
MGKHEFLTPKAIANRIKAKGLQKLRWYCQMCQKQCRDENGFKCHCMSESHQRQMQVFGQAPDRVVEGFSEEFLDAFLTLLRRAHRHSRIAATVVYNEFIADRHHVHMNSTRWATLTEFVKFLGREGHCKVEDTPKGWFITYIDRDSEQAVKARLKRKRIKSDLAEDERQERMIARQIERAQQSMGKTNGELGDDASPDGSEGESGSEDEYSDSENDHEGQEEDAKEANKAAGKIAIALQRAVPGPKVNPLDDKPKVKFGFEEEDEVSARDKEKEELAKKKGKDAINAAEARRSALDELMKEEEKAKERSNRKDYWLCPGIVVKVMSKSLAEKGYCKQKGVVKRVIDKYVGEIEMLESKHVLRVDQDELETVIPQIGGLVRIVNGAYRGSNARLLSVDTERFCAKVQVEKGLYDGKVLKAIEYEDICKIFH

SEQ ID NO: 23424 - protein, 196 aa, Unknown
  Dehalococcoides sp. CBDB1
MTKRTASIKRQTTETTISLSLNLDGTGQADMCTGVRLFDHMLSQLAKHGLFDINISANGDDIHHLVEDVALTLGKAFNEALGERKGIVRMADATVPMDDSLASVALDLSGRGYAVMDLSFAKNDLTGFPTDLVRHFLETFAIEGRLNLHARILYGSNDHHKAEALFKALARALDKATSIDPRREGVAPSTKGMLEN

SEQ ID NO: 23425 - protein, 593 aa, Unknown
  Comamonas sp. SFCD1
HGPQAMTPSEAFVETMVANGVTDMFGIMGSAFMDAMDIFAPAGIRLIPVVHEQGAAHMADGYARASGRHGVTIGQNGPGISNCVTAIAAAYWAHSPVVIVTPETGTNGMGLGGFQEANQLPMFQEFTKYQGHVCNPKRMAEFTARCFDRAMSDMGPTQLNIPRDYFYGTIECEIPKPIRIERGAGGEKSLNAAVELLSTAKFPVILAGGGVVMGDAVKELQALAERLGAPVATGYLRNDAFPASHPLWAGPLGYQGSKAAMKLIAQADVVIALGSRMGPFGTLPQHGMDYWPKNAKIIQVEADHTNIGLVKKITVGIHGDAKAVAKALVERLAGKTLAADATKAERAQAIKAEKDAWEQELDGWTHEKDPYSLDMIEEAKGEKPFSGGEYLHPRQVLRALEKAMPPRVMVSTDIGNINSVANSYLRFEEPRSFFAPMSFGNCGYALPTIIGAKLACPDRPAVAYAGDGAWAMSMVEIMTAVRHDIPVTAVVFHNRQWGAEKKNQVDFYNRRFVAGELDNESFAAMAKAMGAEGIVVDRLEDVGPALQKAIDMQMNEGKTCVIEVMCTRELGDPFRRDALAKPVRMLDKYKDYV

SEQ ID NO: 23426 - protein, 510 aa, Corynebacterium glutamicum
MVVGDRREWRRQATGIIAGLVLAALVYLLFPSNSVETVMQSSGVDPETEYTNNAMRLTAAVTILMAVWWMTEAIPLAATALIPLVAFPAFQVVDFGKAAAPYANPTIFLFLGGFLMALGLQKWNLHRRMALAVVLAVGTKPKQLVLGFMVATGFLSMWVSNTATAVVMLPIGMSVLALTAETVGGMKNQKKFATGLMLSIAYSASIGSLGTLIGTPPNALLAAYMSESHDIHIGFGQWMILGVPIAVVFTIIAWLVLTTVFKPEMKEIPGGRELIKREIAEMGPWTAPQVTVGVIFAAAALAWVFIPLTLDWTGSQLSINDSLIGIAAGLLMFIVPANFKTGERILDWRTAGELPWDVLLLFGGGLSLSAMFTSTGLSLWIGELAKGLDALPIFILIFAIAVLVLFLTEFTSNTATAATFLPIMGGVAVGIGLTAGGEQNVLLLTIPVALSATCAFMLPVATPPNAIAFGSGYIKIGEMVKGGLWLNIIAVILITIFTYFVAIPLFGIML

SEQ ID NO: 23427 - protein, 963 aa, Alteromonadales bacterium
MSNAKSLEQLEQKQDFIRRHIGPSPAQVSDMLSALEVSSVQELIDQTVPANIRLEQPLSIGESRTEVETLSYLKSVASKNKVFKSYIGQGYHPTHVPHVILRNVLENPGWYTAYTPYQPEIAQGRLESLLNFQTMTLDLTGLDLASASLLDESTAAAEAMGLAKRVSKAKKANAFFIADDVHTQTIDVVSTRAEQFGFEIIVGKAADAVNHDIFGALFQYPSTSGEIVDVTDLIAGVQSKKAIACVAADIMSLLLLKAPGKLGADVVLGSAQRFGVPMGYGGPHAAFFATRDAYKRSLPGRIIGVSKDRLGNDALRMAMQTREQHIRRDKANSNICTAQVLLANMAAFYAVYHGPQGLKTIAQRIHRFADILAAGLKTKGVALKHSTWFDTLTIVGDNKDDVIARAFAKGVNFATNHDGEYSISVSETTTRADVAELFDIVLGEGHGLSVDSIAADIEANGSDSIPASLVRDDEVLTHPNFNSYHSETDMLRYIKRLENKDLALNHSMISLGSCTMKLNATAEMIPVTWPEFANLHPFCPLDQAEGYQIMINELHDWLVNITGYDAVSLQPNSGAQGEYAGLIAIRKYHESRGDAHRNVCLIPSSAHGTNPASAQMASMKIVVVNCDKNGNIDMEDLKAKAEDVSENLSCAMITYPSTHGVYEETIRELCDIIHEHGGQVYMDGANMNAQVGVTSPGFIGSDVSHLNLHKTFCIPHGGGGPGVGPIGVKSHLAPFMPNHSVINVPGTNIDNGAVSAAPYGSAAILPISWAYIAMMGSEGLKQATEMAIVNANYLTHELSQHFPILYRGRNNRVAHECIVDLRPLKEASGITEMDVAKRLQDYGFHSPTMSFPVAGTLMIEPTESESKGEIDRFIEAMVSIKGEIDKVISGEWSIENNPLVFAPHTQADVLGNEWDRAYDRFYAAFPVPSVAKDKFWPTVTRIDDVYGDRNLVCSCPAVETYRD

SEQ ID NO: 23428 - protein, 713 aa, Clostridium difficile
MEKKILTVCPYCGAGCQLYLVVKDNKILRAEPANGRTNQESLCLKGRYGWDFLNDPKILTPRLKKPMIRKQGVLEEVEWDEAINYTASRLNEIKEKYGPDSIMGTGSARGPGNEANYIMQKFMRATIGTNNVDHCARVHAPSVAGLAYSLGSGAMSNSIPEIENADVLFIFGYNGADSHPIVANRIVKAKKNGAKLIVTDPRVTESARIADIHLPIKGGTNMVLVNAFGNVLIEEGLYNKEFVQNHTQGFDEYKEIVKPYTAKYAEKITGIPEELIRKAMREYAKGKKAMILYGMGVCQFGQAVDVVKGLASIALLTGNFGRESVGIGPVRGQNNVQGACDMGALPNVYPGYQNVTDDKIREKFEKAWGVKLSPNNGYSLTQVPNLVLKEKKLKAYYIFGEDPVQSDPDASEVREALDELEFVIVQDIFMNKTALHADVILPATSWGEHEGVYTCADRGFQLMRKAIEPQGDVKPDWQIISEISTAMGYPMNYKNTKEIWDELRQLCPSFLGATYEKIETQGCVQWPCKSESMEDKGTMYLYEGQKFSTPNGKGNLFAAEWRPPMEVEDDEYPFSLCTVREVGHYSVRTMTGNCRTLSSLEDEPGRVQINSNDAEKLGIEDDELVRISSRRGSVITRATVTDRVKEGATYMTYQWWVGACNELTIANLDPISKTPEYKYCAVKLEKLEDQELAEKCVREEYQSLKDKMTATNI

SEQ ID NO: 23429 - protein, 132 aa, Lupinus albus
LIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDT

SEQ ID NO: 23430 - protein, 344 aa, Arabidopsis thaliana
MANPAPNLECRMYESRYPDVDMAVMIQVKTIADMGAYVSLLEYNNIEGMILFSELSRRRIRSISSLIKVGRTEPVMVLRVDRERGYIDLSKRRVSDEDKEACEERYNKSKLVHSIMRHVAETVGVDLEELYVNIGWPLYKKHGHAFEAFKIVVTDPDSVFDALTREVKETGPDGVEVTKVVPAVSEELKDAFLKDIRRRMTPQPMKIRADIELKCFQFDGVLHIKEAMKKAEAVGTDDCPVKIKLVAPPLYVLTTHTHYKEKGIVTLNKAIEACITAIEEHKGKLVVKEGARAVSERDDKLLAEHMAKLRMDNEEMSGDEGSEDEEEDTGMGEVDIDGGSGIIE

SEQ ID NO: 23431 - protein, 207 aa, Mycobacterium avium
MTAVQAARRARIERRTKESDIVIELDLDGTGRVDVETGVPFYDHMLTALGSHASFDLTVRTTGDVEIEAHHTIEDTAIALGAALGQALGDKRGIRRFGDAFIPMDETLAHAAVDVSGRPYCVHSGEPDHLQHSTIAGSSVPYHTVINRHVFESLAMNARIALHVRVLYGRDPHHITEAQYKAVARALRQAVEPDPRVSDVPSTKGVL

SEQ ID NO: 23432 - protein, 713 aa, Myxococcus xanthus
MRRAEVLPGKPYPLGATFDGQGVNFAVFSEHAKKVEVCLFDPEDPAKETRRFPLLETTHQVWHGYVPGLAAGALYGLRVHGPYEPKKGLRFNPHKLLVDPYARAIHGQVDYQAPIYAYTPGTKEDDLAFDTRDDAAAVPKGVVMGADTFDWEGDTPPGVPWHDTLIYEVHVKGFTQLHPRVPEALRGTYAGLAHPASIEHLKKVGVTAVELLPIQHIVDEPFLIQREKVNYWGYNTLGFFAPDARYSGSGSLGGQVDEFKRMVKQLHRAGIEVLLDVVYNHTCEGNQLGPTLSFKGVDNAAYYRLTEKDPRYYLDVTGCGNSWNATHPYALKLVADSLRYWVEEMHVDGFRFDLATTLGRDRHGYDTRAAFFQIIHQDPVLSRVKLISEPWDVGDFGYQVGNFPVLWSEWNGKYRDTIRRYWKGDDRQAAEIGYRLTGSSDLFSLSGRKPAASVNFVTAHDGFTLHDLVTYNDKHNEANGEENRDGANDNHSWNCGVEGETTDAEINALREQQKRNFLATLFLSQGVPMLVAGDEMGRTQKGNNNAYCQDNELSWVDWELNDTQRALLDFTCALTKLRREQPVLHKRRFFRGAHMWDSELKDLAWFRPDGQEMRKDDWEKPYVRSLGFLLGGDAITAPDDEGNRIVGDTILVLMNAHHEPITFRLPAVEWGADWELVVDTALAGESLRTHTPAGGTVQVVGRSLAVLRRPATE

SEQ ID NO: 23433 - protein, 750 aa, Trichodesmium erythraeum
MKILTKFILSTSISLGLVTSLLGVSRLLIGRTEKSIEKARNHTNQAVYITHALMLSLETQTSFLKDYLLFNRGVFYLNSYQQEKLKFLASLEKIKELIPESQKTEVVGRRYQLLVRLANEIINNQDYSTSSIKQDIKAIKSFGGDIRLFLSFLLEEVRVKNDQSQQFAIQFKQNAAILTYCLILVVLLIFIGEFYLTLLPVIRSIQTLKTAATKLDIGTLNYHLDIQTGDEIQQIAQQFNQMAVKLANSYYSLDFLEQKRQVADAANKAKSEFLANMSHELRTPLNGILGYTEILSRSEAWGEKEKKGIDIIHQCGSHLLTLINDILDISKIEARKLELQPQAIHLPSFLQGIGEIICIRTEKKGVDFVYLPDANLPEGIVTDPKRLRQVLINLLGNAAKFTEKGQVTFKVRIIDSMAEQKKDKAQIPQDNVRLSFQIKDTGIGISPDSLEKIFQPFEQVGEGKRHSEGTGLGLTITDNILSLMGSNIQVKSELGVGSTFTFEIDFPLALEWQDQVITDTKKQLIGYEGDLQTLLVVDNKWENRSVIVNLLEPLKFNVIEAENGEDGLNKANKFRPNLIITDLMMPVMDGYEFMKHIRTSEILKPIPVIVSSASVISTVRQKSLDAGGDGFLEKPVGSDELFKLLQEHLQITWKYESILTPGSSDLQHQQNSRKQKTTAVDVLPPLVVLEDLFQLAQQGRLKKLVAVAQELEKENQEYGAFVDHIVQQAKDFEIKKITIFIQESLEKSNN

SEQ ID NO: 23434 - protein, 785 aa, Yarrowia lipolytica
MVDDVFKRNRSTSASAALTLGPGDDTTTAKDSGKEITFPQRLKSFFKFNNTNSPVANSGNGPDEEIAFPKYDPTPTIHVQGVPGASNTSPPPDDKETKSSFKQRFLRGRSPSTPSTKDTNTPDQHNQHHGSVPTVPDIPSEFAPKLHYPKHLAAHTPEDEAVDPMDSTKPVPVVDEWPVQPAHMSGSASPNSPNFHSPPSSPSPNNNSNNYNYNNNNSSNYGGLGVPGQHPRKNIRRVASEPNVKNAISNSHSHSGGHHQQHLPIIPAGSEDVRLQDLVREEQQHPSDPITDRDRTHSAPLNDGINHGNGSHGQNSRSGSATPQSRSRTNSKSFARTYSSNSIKVCDVEVGPSSFEKIRLLGRGDVGKVYLVKEKKSTKLYAMKVLSKKEMIKRNKIKRAFAEQEILATSNHPFIVTLYHSFQSNDYLYLCMEYCMGGEFFRALQTRERKCVAEADAQFYAAEVTAALEYLHLMGYIYRDLKPENILLHQSGHIMLSDFDLSKQSEQLGAPTIQSSTNVPQLDTKSCIANFRTNSFVGTEEYIAPEVIRGNGHTSAVDWWTLGILIYEMLFGMTPFKGKNRNLTFSNVLKQEVNFPSGSGYQSISSSCKNLIRKLLIKDEHKRMGSKAGASDIKNHPFFKNTQWALLRNQTPPLVPVPSRGADAVNFRTMKDSSSVDFVTDKKQDKSISSVLSVNTDRSSTNSVAGPRSYGREGDYDPFQNFNSVTLHHVGADSEGEDDDGDITITNQDIPHTFQPNPAKSPNMKNSSGFFFGGQKDKLWKTNRT

SEQ ID NO: 23435 - protein, 347 aa, Unknown
  Petunia x hybrida
MEGGGNSSGNNTSSLMAYGDHENNNNAICPPMMMMMMPPPPLSITNTSNNGESSSNNNNNILFLPFMENNSNTIHEDGNSCSSNIKAKIMAHPHYPRLLAAYINCQKIGAPPEVVARLEEVCATSAHMGRNGGGGGGGGNNVIGEDPALDQFMEAYCEMLTKYEQELSKPFKEAMVFLSRIECQFKALTLASTSESVAAFGEAMDRNGSSEEEVDVNNSLVDPQAEDRELKGQLLRKYSGYLGSLKQEFMKKRKKGKLPKEARQQLLDWWTRHYKWPYPSESQKLALAESTGLDQKQINNWFINQRKRHWKPSEDMQFVVMDAAHPHYYIDNVLGNPFPMDMTPTLL

SEQ ID NO: 23436 - protein, 112 aa, Geobacter sulfurreducens
MKLIEAIIKPFKLDEVKDALNEIGIEGITVSEVKGFGRQKGHTELYRGAEYVVDFIPKVKLEIAVADELVAKVVETIESTAKTGRIGDGKIFILSLDEAVRIRTGEKGNEAI

SEQ ID NO: 23437 - protein, 379 aa, Streptococcus agalactiae
MNNTEFYDRLGVSKDASQDEIKKAYRRMSKKYHPDINKETGAEEKYKEVQEAYETLSDTQKRAAYDQYGAAGANGGFGGFDGGGFGGFDGGGFGGFEDIFSSFFGGGGMRNPNAPRQGDDLQYRVNLSFEEAIFGAEKEVSYNRESSCHTCSGSGAKPGTSPVTCQKCHGSGVINVDTQTPLGTMRRQVTCDVCQGSGQEIKEKCPTCHGTGHEKKTHKVSVKIPAGVETGQQIRLTGQGEAGFNGGPYGDLFVIINVLPSQQFERNGSTIYYTLNISFVQAALGDTIDIPTVHGAVEMSIPAGTQTGKTFRLRGKGAPKLRGGGQGDQHVTVNIVTPTKLNDAQKEALHAFAEASGDKMVHPKKKGFFDKVKDALDVD

SEQ ID NO: 23438 - protein, 309 aa, Triticum aestivum
VESIGVCYGMSANNLPAASTVVSMFKSNGINSMRLYAPDQAALQAVGGTGVNVVVGAPNDVLSNLAASPAAAASWVRSNIQAYPKVSFRYVCVGNEVAGGATQNLVPAMKNVQGALASAGLGHIKVTTSVSQAILGVYSPPSAGSFTGEADAFMGPVVQFLARTGAPLMANIYPYLAWAYNPSAMDMSYALFTASGTVVQDGSYGYQNLFDTTVDAFYTAMAKHGGSNVKLVVSESGWPSGGGTAATPANARIYNQYLINHVGRGTPRHPGAIETYVFSMFNENQKDSGVEQNWGLFYPNMQHVYPISF

SEQ ID NO: 23439 - protein, 834 aa, Unknown
  Pseudomonas sp. G-179
MTAELTRRDVLKAQAAAIAASTAGIAMPAAAQSVPGGVAALEIKWSKAPCRFCGTGCGVMVGVKENHVVATHGDMEAEVNRGLNCVKGYFLSKIMYGKDRLTTPLLRKRNGVFDKEGEFEPVTWEEAFDIMAEKAKKTLKEKGPTALGMFGSGQWTIFEGYAATKLMRAGFRSNNLDPNARHCMASAAYGFMRTFGMDEPMGCYDDFEHADAFVLWGSNMAEMHPILWTRLADRRLGHEHVKVSVLSTFTHRSMDLADIPLVFKPGTDLAILNYIANHIIQTGRVNQEFIDKNTKFMQATTDIGYGLRAEHPLEVKATGAAKAAEMTPIDFEAFKKHVSEYTLEKVAELAGVDKGFLEQLAELYADPKVKVMSLWTMGFNQHVRGVWANQMVYNIHLLTGKISEPGNSPFSLTGQPSACGTAREVGTFAHRLPADMTVTNPEHRKHAEELWNIPHGIIPEKPGYHAVQQDRMLHDGKLNFYWVQVNNNMQAAANNSNEAYIGYRNPDNFIVVSDAYPTVTAMTADLILPAAMWVEKEGAYGNAERRTHVWHQLVNAPGEARSDLWQLVEFSKRFTTDEVWPQDILDQNPEYKGKTLYDVLFQNGNVDKFPVSEISSDYENREAKAFGFYLQKGLFEEYASFGRGHGHDLGPYDLYHQVRGLRWPVVNNQETKWRYREGYDPYVKEGEGVKFYGQNDGRAVILAAPYEPPAESPDDEFGFWLVTGRVLEHWHSGSMTMRVPELYKAFPGARCFMNGDDARRLGINQGGQVKIQSRRGEIISRVDIRGRNRMPHGVIFVPWFDASQLINKVTLDATDPISKQTDFKKCAVKILPVA

SEQ ID NO: 23440 - protein, 421 aa, Zea mays
MGLLPTDRMDSLFSPRCVWVTGPIIVGAGPSGLAVAACLREQGVPFVVLERADCIASLWQRRTYNRLKLHLPKQFCQLPRMPFPEDYPEYPTRRQFVDYLERYAAEFEIKPEFGTTVLSARYDETSGLWRVVTNGGAGGDMEYIGRWLVVATGENAEAVVPDIPGLAGFDGEVTHVSEYKSGEAYAGKRVLVVGCGNSGMEVSLDLAEHGARPAMVVRDAVHVLPREVLGTSTFGLAVLLMRWLPLWLVDWLMVLLAWLVLGNLARLGLRRPAAGPLQLKETHGRTPVLDYGALARIRAGDITVVPAVTRFAGKGGQVEVADGRTLGFDAVILATGYRSNVPQWLQGNDFFNKDGYPKTAFPHGWKGESGLYAVGFTRRGLSGASADAVRIATDLGNVWREETKPTKRAGACHRRCISVVF

SEQ ID NO: 23441 - protein, 211 aa, Methanosarcina mazei
MIYLKYNCPLTYLILLKLEGGKTVEEKTDAEQRNATSEEDTEIFENPGEGLEKATFAAGCFWGIEEAFRQIKGVVATAVGYSGGHFKRPTYEQVCTLDTGHAEAVRVIFDPEIVSYKTLLDVFWKIHDPTTKDRQGPDVGKQYRSVIFYHSDEQKAAALASKEELEKSGAFKNPVVTEIVPVSEFYMAEDYHQQYFEKKGFLQNIFRSFKK

SEQ ID NO: 23442 - protein, 635 aa, Ostreococcus tauri
MLLVLQLVFAFASVVSADHDADWFRSTNSGRHNSLDLSKGLEDQVAATTCLSDSFVRVNGRRFEVGGEEFIFAGWNQWEMMEQATGAGPPARHTPLSGREHIVRLLNEGVKTGLKVIRVWAHLITPGQEVQSEPGVWNEERLRGLDFFIDEARKRRLRLVIVLADNWYVSGGVDNYVKWSGSAQTHQDFFIDSGAKRIFKDMISTITNRQNTITGIRYADDPTIMSYNLINEARCQNCPAETMGRWIDEMARFLKLNAPNQLVGLGYEGFFHESDPEDLRATNPGVGSNWAAKEGQSWLRHSRLKSIDYTSIHVWPDNWSPKTVEFMKSFIRSRIDLAQSVGKPFVLEEFGKKVDRSAGEAGFVERDQYFSAAFEIAERAARDGELSGTIFWHWYDRGIGLTSRYGIHSDETTFELVKRHAKRMNIIGNVPTHCHAKFSRNSSPPPSRTGADELSLISASHTHETFSNSLKLSRMLSSSLSASRSEYDVTTSGVSSRTTTRSIVGSQSSGSYPHTPALNAKATPHRNSTVTAARFAVASSAVTARPNSTPSSTRTFGPTHTTETSSTPSSLAIVASPPNDRATSSGVVPSRLSAPSTKTCSARRPDRLATSSSVPNRRTASHIVDTGARTREAIG

SEQ ID NO: 23443 - protein, 683 aa, Hordeum vulgare
MDASAGSSPPRHPQGSAPRRGKGPAVEIRHGEDDFMFAQDTFPALPDFPCLSSPSSSNFSSSSSSNSSSAFAAPAGVGGRGGEGTRGEPSEPAAAGDGVDDLSDIDHLLDFASINDDVPWDDEPLFPDVGMMLEDVISEQQQQQQQHPLAGYGAGGRVASDAAGGGGEDAFMGGGGSGSAADDLPRFFMEWLTNNRDCISAEDLRSIRLRRSTIEAAAARLGGGRQGTMQLLKLILTWVQNHHLQKKRPRVGAMDQEAPPAGGQLPSPGANPSYEFPTETGAAAATSWMPYQAFSPTASYGGEAMYPFQQGCSTSSVVVSSQPFSPPAAADMHAGAWPLQYAAFVPAGATFAGTQTYPMPPPGPVPQPFAAPGFAGQFPQRMEPAATREARKKRMARQRRLSCLQQQRSQQLNLSQIQTGGFPQEPSPRAAHSAPVWGGHWSPPAVQAQPHGQLMIQVPNPLSTKSNSSRQKQQKPSPDAAARPPSGGAASQQRQGQAAASDKQRQQGGIKDGGGAAGRRQEPAVPAAEGAEAERRRNPRPHRAPQRKEAETHLPELKTGDGISIPIEDIGTSQVWSMRYRFWPNNKSRMYLLENTGDFVRSNELQEGDFIVLYSDVKSGKYLIRGVKVRAAQELAKHKNGSPEKGGASEVKAEDGGCKEKSPHGVRRSRQEAASMNQMAVSI

SEQ ID NO: 23444 - protein, 440 aa, Vibrio vulnificus
MKVVVVGGSAAGMSFAAKYKRNQPSDEVIVLDKRDYISFGACGLPYFAGGMFDDTERMISRTPEQAIKSGLDVRIETEMVALERIEKQITVRHQGEETILDYDMLVIATGARPIIPSFGEFNPEHVYTLTSMEDGLAVKQALKDSNKQRVCVIGGGFIGLEVFDAAHLLGKHVTIIEREQHVMSRQFSPEMIDVVEGAIRESGAELKTSCSVSAIRDAEQGGYLVETDNGSVAADVVIMSLGFKPNTEAFELPKAANGALLVDEFGATEDEHIYAVGDCAVVHHMALGKTVYVPLATTANKQARMMADKLAGKDTYMNGFLGSSCLKVLDYELACTGVSELLAKEHGLDVRVSTISDKNQTDYYPGQEDIKVKLVYHPETKVLLGGEIVGKKGAVGRINALAVAITAKMTTQQLGYMDFCYAPPFARTWDALNVAGNVAK

SEQ ID NO: 23445 - protein, 464 aa, Oryza sativa
MEGSGAHPVGELHLGVSDAGGGIRHDQQVQRGVPRREILRWKRCLMGVNDVNFWWLWVFLACRYIDMAESLCQKRALEAFRLDPAKWGVNVQPLSGSPANFHVYTALLKPHERIMALDLPHGGHLSHGYQTDTKKISAVSIFFETMPYRLDESTGLIDYDQMEKSAVLFRPKLIVAGASAYARLYDYDRMRKVCDKQKAILLADMAHISGLVAAGVVPSPFDYADVVTTTTHKSLRGPRGAMIFYRKGVKGVNKQGKEVMYDFEDKINAAVFPGLQGGPHNHTITGLAVALKQATTPEYRAYQEQVMSNCAKFAQSLTAKGYELVSGGTDNHLVLVNLKSKGIDGSRVEKVLENVHIAANKNTVPGDVSAMVPGGIRMGTPALTSRGFVEEDFAKVADFFDAAVNLALKVKAAAGGTKLKDFVATLQSDSNIQSEIAKLRHDVEEYAKQFPTIGFEKETMKYKN

SEQ ID NO: 23446 - protein, 183 aa, Solanum tuberosum
MGCFNSKVKKQFRGHEDPIALASQTAFSVSEVEALFELFKSISSSVIDDGLISKEEFQLALFKNRKKENLFANRIFYLFDVKQKGVIDFGDFVKGLHVFHPNAPQEEKVNFSFKLYDLDGTGFIERQEVKQMLIALLCESEMKLADETIESILDKTFVEADSNQDGKIDKSEWQIFVSQNLHY

SEQ ID NO: 23447 - protein, 556 aa, Vibrio parahaemolyticus
MTESFAQLFEEFLNETEFQQGSIVKGTVVAIENGFVLVDAGLKSESAIPAEQFKNAAGELEVEVGAEVDVALDAVEDGFGETQLSREKAKRHEAWIVLEKAYEEAETVVGIINGKVKGGFTVELNGIRAFLPGSLVDVRPIRDTAHLENKELEFKVIKLDQKRNNVVVSRRAVIESENSVERDELLETLQEGSEVKGIVKNLTDYGAFVDLGGVDGLLHITDMAWKRVKHPSEIVNVGDEIQVKVLKFDRERTRVSLGLKQLGEDPWVAIAKRYPEGHKLTGRVTNLTDYGCFVEIEEGVEGLVHVSEMDWTNKNIHPSKVVNVGDEVEVMVLEIDEERRRISLGLKQCKANPWQSFAEAQAKGDKVTGKIKSITDFGIFIGLEGGIDGLVHLSDISWNVAGEEAVREYKKGDEISAVVLAVDAERERISLGIKQMENDPFNAYVADNKKGTLVNATVTAVDAKGATVEIAEGVEGYIRASEVSRDRVEDASLILSAGDVVEAKFTGVDRKNRVINLSIKAKDEAEEQEAMASINKQDEAAFGNAMADAFKAAKGE

SEQ ID NO: 23448 - protein, 329 aa, Synechococcus elongatus
MSTSGTFFADNSQTIGKTPLVRLNRIVKGAPATVLAKIEGRNPAYSVKCRIGAAMIWDAEQRGLLGPGKELIEPTSGNTGIALAFVAAARGIPLTLTMPETMSLERRKLLAAYGAKLVLTEGVKGMTGAVRRAEDIAASDPDRYVLLQQFRNPANPAIHEQTTGPEIWEDTGGAIDILVSGVGTGGTITGVSRYIKQTQGKPILSVAVEPEASPVISQQRSGLPLKPGPHKIQGIGAGFIPENLDLSLVDQVERVSNEEAIAYARRLAQEEGLISGISCGAAVAAAVRLAQQSEHAGKTIVVVLPDSGERYLSTALFDGIFNEQGLAVV

SEQ ID NO: 23449 - protein, 489 aa, Vibrio parahaemolyticus
MSAELLLNVTPSETRVAMIEGGVLQEIHIERESRRGIVGNIYKGKVSRVLPGMQAAFVDIGLDKAAFLHASDIVPHTECVAENEKQQFQVRDISELVRQGQDIVVQVVKDPLGTKGARLTTDITLPSRYLVFMPGASHVGVSQRIESESERERLKKVVNHYCDEHGGFIIRTAAEGADEKELSQDAAFLKRLWLKVMERRSKYKTRSTLYGELGLAQRILRDFVGTELDKILVDSRLEYENLKEFTSEYVPELTDKLELYEGDKPIFDMYDTENEIQRSLERKVELKSGGYLIIDQTEAMTTIDINTGAFVGRRNLEETIFNTNIEATQAIARQLRLRNLGGIIIIDFIDMASEEHRQRVLTSLEAALSKDRVKTNINGFTQLGLVEMTRKRTRESIEHILCSGCPTCEGRGTVKTVETVCYEILREITRVNRAYDADNFVVYASPFVAEALLGDESHALAELEVFIGKQVRIQAEPLYIQEQFDVVMM

SEQ ID NO: 23450 - protein, 254 aa, Thermoplasma volcanium
MNIKLLPEVGDLVVVKITEVKNFGANGILEEYPGVEGYIHISEVATGWVKHIRSYLREGQRVVCKVINVNQERKNVDLSLKRVNQHQSREKIAEWKNEQKADKLFEIVCSKLNKDLEACKKEFGVRLVELYGTLFAAFESAAAAEGEWLPDINGDWKDTFVEVAKENITIPEVSVAGYFEAYSLASDGVEKIKEVLTIPPEIGKAELEYVGAPRYRIVVRDKDYKKAEETLKKIVQSVTDKAKKLQVELEFSRQ

SEQ ID NO: 23451 - protein, 207 aa, Azospirillum brasilense
MDQSLANGVGGASIERNTTETRIRVAVNLDGTGVYDVKTGVGFLDHMLEQLSRHSLMDLSVAAEGDVHIDAHHTTEHSGIAIGQAVAKAVGDRKGIQRYGHAYVPMDETLTRVALDFSNRPYLIWKVSFSRDKIGDMDTELFREWFQAFAMAAGVTLHVECLYGENNHHIVESCYKALARALRAGIEIDPRKRDAVPSTKGTLGGSL

SEQ ID NO: 23452 - protein, 321 aa, Ureaplasma parvum
MNQVNFLNLDKNILIITSGGDAPGMNASLISLIHRLMNNNFNVFIGIEGLLGLYNNLIEPIKDKRVFDVYFNEQGTVIKTSRFIKLDINDKKTQIIKDNLLSHNIQKIIILGGQGSMQAGLVLTKMGFEVFGILHTIDNDFSETQMCIGALSAASFNQKLLKCLNYTAKAHCAFNLVELMGRECSWLVNNSVGKLKPILMLTNQDNKYTVDEVIDLIKDKINSIKEYDPLIIVQELIYDQKWYELLVKTFEQKLHKSLRITILNYLQRGAPVSDFDLQLAKDSANVLVDFIVNQNDIKNTNNMYVVINKFDNKLEVIKFNK

SEQ ID NO: 23453 - protein, 90 aa, Clostridium pasteurianum
  misc_feature (2)..(2): Xaa can be any naturally occurring amino acid
MXIDKLEKQKKIALVAHDNRKEALISWAEENKDVLCKHFLCGTGTTAKLITERTGLQVNGFKSGPMGGDQQIGANIVEGNIDFMIFFWDP

SEQ ID NO: 23454 - protein, 634 aa, Rhodopirellula baltica
MCGFTGGLWQRDDQAINADLLSRMTNEIAHRGPDDSQIWMDPEHRDATGRPMGVGLGFRRLSIIDVEGARQPLSNEDGRVRMVFNGEIYNYEVLRKRLQGAGHQFATQGDGESIVHLYEDIGTDCFSSLNGMFAIAIWDARRNRIVLARDRIGQKPLYYSYKNGRLVFASELKALRLVPGVCEEVDPNAIDEFLTYQYIPHPGTIFKGVHKLPPGHFAVLDERGLRVERYWNFDPSIERPLGREEAIEKVRDLLADSVRLRMRSDVPLGSFLSGGIDSSLITALAGDHTDTPLRTFSIGFPVADFDETRYAAQVAEHLQTDHTRFEVQPSGIDILEKLVWHYDEPYGDSSAVPTWYLSKLTRESVKVALSGDGGDELFAGYERYRALWMSQKIARLFPLNKFPGIGLIQRLPDSNRRRSVVRRAKRFLEAIDQPVVRRYMNWLQIFPESMRASMYNDEFVQALPGHDPVDFLESVWARSEGRDVVTRASTSDIQSYLPCDLCTKVDIASMAHGLEVRQPMLDYRFVELAASMPVEHKFRGRRGKLILQDAFGDRIPSSIFTRPKMGFGIPIGQWFREDFKPLVHDTMLASDARINAYFRPEAIADLVRSHETGEQNHGYRLWNLLVLETWLRQL

SEQ ID NO: 23455 - protein, 452 aa, Phytophthora parasitica
  misc_feature (405)..(405): Xaa can be any naturally occurring amino acid
MASPVQALLLDMDGVMAEVSQSYRQAIIDTARHFGVSVTHEDIDHTKLAGNANNDWQLTHRLVVDGLNGASSAPTLEAVTAQFEALYQGVGNTLGLCELETLLTPKGLLRELHRRQPKGMAVVTGRPRKDCAKFLTTHGIEDLFPVQIWLEDCPPKPSPEPILLALKALGVEACHAAMVGDTVDDIIAGRKAGAVAYGVLTPQTYAKSILEQTPAAIGKVLEQVGASVVLTPGLGELLDLVPAVPTASKAPTVNGKSGVREANISRVTKETSISVKLSLDGTGKSKVSSGIGFLDHMLTALAKHSRFDLELDCKGDTWIDDHHTTEDCALTLGEAFDVALGDRAGIARFGSACVPLDEALSRAIVDISSRAHSEINLQLVRPSVGELSSEMITHFFESFASAALXTLHVDVLRGRNDHHRAEASFKALAVALRTAVKHDATAGVPSTKGVLA

SEQ ID NO: 23456 - protein, 633 aa, Lactobacillus plantarum
MCGFAGCLTDRTKADNAAYDQTIHEMTKMIVHRGPDDDGYFADDNITMGFRRLSIIDLAGGHQPLSYDNERYWMTFNGEIYNYVELREQLKQEGYEFKTSSDSEVILAMYAKYHADATKYLRGMFAFVIWDKQEKTLFAARDQFGIKPFYYAISGDDFYYASESKAIYKILKDKTFDKNALQDYMTFQFVPEPETLTKEIKMLAPGCSLTKKLGSAPRIDRYYHREFHPVERSEDEYAQKIKDALIDSVKIHMRSDVPVGSFLSGGIDSSIIVAIAKNFNPNLETISVGFEREGYSELDVAQETAEKLGVKNYSMTITPEAFMKAFPHFVWSMDDPLADPAAVPQYFLAKEAVKHVKVCLTGEGADELFGGYTIYHEPESLKPFRYTKPINGALKRIALMMPEGMRGRSFLLRGTTPLENRYVGNAFIFGEQEKQAFFKNYNQNHPFQSITQPLYDESVDYDPISRMQFIDMHTWLNGDLLHNADRTTMAHSLELRTPFVDREVYNLAAEIPADLRISHGTTKYILRKAVEDIVPAHVLHRKKLGFPVPIRFWLKDEMYDWAKQIINDSQTDQYFNKDYFLKLLDDHKAGVRDNSRKLWTVLTFMMWHRLYVESDHLMDSPEANAVAEKVEEF

SEQ ID NO: 23457 - protein, 273 aa, Thermoplasma volcanium
MKLIENWFSERYSDNLQLSFRVSDQLLSIKTDYQRIDLFDTYDFGKLLAIDGTVQLTERDEYIYHELITMIPYHMTKNPPQSALVIGGGDGGAARRLLDLGLNKIVNVEIDGQVVEVSKRFFPDLSSAFTDKRVNLIIDDGIKYVRKCNEKFDLVIIDSTDPEGPAEGLFSMEFYSDITKILSDGGVIVSQSGSPFYQPKALKLAYTGMRRLFKDVKVYTGFIPTYPSGFWSFTIASEDAMNPRKPAIKGKYFNEDVLDGVFKLPQFVKDLIT

SEQ ID NO: 23458 - protein, 996 aa, Arabidopsis thaliana
MGKECYYLSWILKFHLLLVLIQLVDSGSTIRFLPGFQGPLPFELETGYIGVGEAEKDQMFYYFIKSESNPEKDPLLLWLSGGPFCSSFTALIYENGPIAFKAEEYNGSIPSLVSTTYAWTKVASILYLDQPVGTGFSYSRNPLADIPSDTGVAKPVNEFLHKWLDKHPEFLSNPLYVAGNSYSGIVIPTIVQEISNGNHLDSKPQINLQGFVLGNPATDTDIDLNSRIPFAHGKALISDEHYESLKRSCQGNYISVNPRNTKCLKLLEDFKKCVSGISEEYILKPDCMWLYSCMANLHSLSEYWANEKSVRKALLVNEGTVRKWIRCNTEIAYNKDIRSSVPYHKYISIEGYRSLVFSGDHDMLVPFLGTQAWIRSLNYSIVDDWRPWMVQNQVAGYTRTYANKMTFATVKASCFCMLFFSGKEEHKFTLDNYHVVEQVRRGKSSSDFVVLHDIEDKKYAMKKICLAKHTDKLKQTALQEMKLLSSLKNPYIVHYEDSWIDNDNNACIFTAYYEGGNMANAIKKARGKLFPEERIFKWLAQLLLAVNYLHSNRVVHMDLTNGFSDYRLSMQCSNIFLPKDDHVQLGNYGLAKLINPEKPVSMVSGISNSMCPEVLEDQPYGYKSDIWSLGCCMYEITAHQPAFKAPDMAGLINKINRSLMSPLPIVYSSTLKQMIKLMLRKKPEYRPTACELLRNPSLQPYLLQCQNLSPIYLPVFPIKPVNSPKDKARRNSLPGKFGKERVSREKSEVSRSLENLYPFWTNTETGSSSSSQPASSTNGAEDKLETKRIDPSCDTLKISEFTSQKSDESLIDPDIAVYSTETPAEENALPKETENIFSEESQLRDVDVGVVSAQEVACSPPRAIEEAETQEALPKPKEQITVPISSVAHSSTEVAAAKDHLSGSLEGDKAKMVKLTASEMSSVLSKLTKLGPPQSKERADALECLLEKCAGLVKQEKYEELAGLLTPFGEDGVSARDTAIWFAKTLLSSDKLNQGT

SEQ ID NO: 23459 - protein, 547 aa, Lactococcus lactis
MKFSELGLSEGIVNTLTEIGYEQPTPIQEQTIKLALEGRDVLGQAQTGTGKTAAFGLPTIEKIDASNPAIQALVIAPTRELAVQGQEELFRFGKSKGLKVRTVFGGSSIEKQIKGLKAGAHIVVGTPGRLVDLIKRKAIKLDQLETLILDEADEMLNMGFLEDIHFIIEKTPEARQTLLFSATMPNDIKKIGVKFMKNPEHIKIAAKEMTADRIDQYFVKTKEFEKFDVLTRLLDVERPELAIVFGRTKRRVDELIRGLKLRGYRAEGMHGDLDQNKRLAVLRDFKAGHIDVLVATDVAARGLDVSGVTHVYNYDITQDQESYVHRIGRTGRAGKSGRSVTFVSYNEMGYLRAIENMTKKPMKGLKPPTKEEAYQASLSVAMDDVLRDLSDDSAKAKLAKFDKQAASLLEKFDAKELVALLLQGRVKDPDNQEEVKITAERPLPYNGEGKGFKKKGKGGGGRYKGRGNGDRDGNRGGYRGNRDGKDGDRGGDRKRNWKDRDDNRGGYRGKRDDRRFDDRKQGEKTPRKRTTGTEKSAGFVMRSRGDK

SEQ ID NO: 23460 - protein, 1753 aa, Arabidopsis thaliana
MASLSGLYSSSPSLKPAKNHSFKALPAQSRDSFSFPHTSKPTNLPLTLSSARSVARDISHADSKKELLKDPDALWKRYLDWFYQQKELGLYLDISRVGFTDEFVAEMEPRFQAAFKAMEDLEKGSIANPDEGRMVGHYWLRNSKLAPKPTLKTLIENTLDSICAFSDDIISGKIKPPSSPEGRFTQILSVGIGGSALGPQFVAEALAPDNPPLKIRFIDNTDPAGIDHQIAQLGPELASTLVVVISKSGGTPETRNGLLEVQKAFREAGLNFAKQGVAITQENSLLDNTARIEGWLARFPMYDWVGGRTSIMSAVGLLPAALQGINVREMLTGAALMDEATRTTSIKNNPAALLAMCWYWASNGVGSKDMVVLPYKDSLLLFSRYLQQLVMESLGKEFDLDGNTVNQGLTVYGNKGSTDQHAYIQQLRDGVHNFFATFIEVLRDRPPGHDWELEPGVTCGDYLFGMLQGTRSALYANGRESISVTIQEVTPTSVGAIIALYERAVGLYASIVNINAYHQPGVEAGKKAAAEVLALQKRVLSVLNEATCKDPVEPLTLEEIADRCHAPEEVTSKSLKLVFSLVFFCCINKQKLKLISRLEMLNNFLPCEKDFISSILATSSTSFYSHCASISTSHFTMIPNGELRLPALKVREDRVSPSAPIPVTRTLVADTDVTSDDDMSTNSEDVSLDSSPENSRVSSAVGRSYGRNSSYYTYSEVSSSRETLVGAREQTGPRFDGDTEEDESTDSASSTQFSPPPAAGRINDGVSQVEQTHFPKTDRRATVEKEFDETFSSEEVSDIPSAPPFSGAAEESEEIKPATSSVQVSEVKTGDCVESRKTGHFTRPSAASESSGPPDQHPARLPTFHARLQQLLLQSEEELLAKRSSQAPHEGVAPKPKKNIGKMKVQVRRVKTVMDGPTGCSISSLKPSLIKFEKIRIHFSNMSTRLFSGWRALRKIHVRVPANGSSLPRQSLAYVHASTQYLKQVSGLLKTGVTSLRNNSTSYDIVQETYSCKLRLKSLAEDNAIMMQPGSGESHVFFPDSHGDDLIVEILDPMGKDFGRVLVQLANISEDSYVSSDSNEETIQAEKLRWWSVFREPEHQHVGKLQLYIDYSASFDDNSHLKCASVAETVAYDLVLEVALKMQRFQQRNLLLYGSWKWLLEEFATYYGISDVYTKLRYLSYVMDVATPTSDCLHLVHDLLTPVIMKGNGKSALSHQENRILNEIKDQIEQILKLVFENYKSLDESSFSGMIDVVNSASGVPAPALIPAVKLYTLLHDVLSPEDQTHLCHYFQAAAKKRSRRHMGETDEFVANNSEPNFWDMSAMSAAYQKMTMACKNVKNEIYTDIEIQNEDILPSFLDLPNLSASIYSTDLCNRLRAFLVACPPSGPSPTVAELVIATADFQRDLSSWNISPIQGGVDAKELFHLYIMIWIQDKRLSLLESCKLDKVKWSGVRTQHSTTPFVDEMYKRLNETIQDYQVIISRWPEYIFVLESAIADVEKATVEALEKQYADVLSPLKENLAPKKLSFKYVQKLTKRSVIPYVVPDELGILLNSMKRMLDVLRPNIEAKFKAWSSCIPDGGNAAPGDRLSEVTVMLRAKFRSYLQAVVEKLVENSKLQKTTMLKKILQDSKESVGESDIRSKMNNLKEQLTNTVNHLHSVCETHVFIALSRGYWDRMGQIVLSFLENRKENRAWYKGSRVAVSILDDTFAAQMQQLLGNSLREQDLEPPRSIMEVRSILCKDPADNKAKSFYY

SEQ ID NO: 23461 - protein, 123 aa, Thermobifida fusca
MTFYEAVGGEETFTRLARRFYEGVAADPVLRPMYPEEDLGPAEERLRLFLMQYWGGPRTYSERRGHPRLRMRHFPYRIGAEERDRWLTHMRAAVDDLALPAHLEQQLWEYLVYAAYAMVNVPE

SEQ ID NO: 23462 - protein, 336 aa, Brucella melitensis
MRDSNGEYAMNKPLGSKDAEAAGRGRIYDSILDTIGNTPLVRIDKFARENGVKANLLVKLEFFNPLASVKDRIGLAMIEALEKQGKAVPGKTVFVEPTSGNTGIALAFAAAAKGYRLILTMPETMSMERRKLLRLLGAELVLTEGAKGMKGAIAEAEAIAEGNPNAIIPQQFENPANPEIHRLTTAEEIWNDTNGEADILISGIGTGGTITGVGQVIKARKPSFKVVAVEPKDSPVLSGGAPGPHKIQGLGAGFAPKTLDTGIYDEIVQISNEDAFTNARLVARLEGIPVGISSGAALAAAIEVGKRSENAGKNIVVVIPSFAERYLSTALFEGLE

SEQ ID NO: 23463 - protein, 530 aa, Lactococcus lactis
MCGFLFMETSDLTIEEFKSNLELIEHRGPDDQQHVRDTLGNDFGFCRLSIMDLSDLGRQPFGLNGKRVMCNGEIYNFLSLRKFLETKGYKFTGDSDCEVLLPLFETTGIETMVKMLDAEFAFVLVDENTAEIFAARDPFGIRPLFYGYNKVTGKISFSSEAKALISTCNDVTPFPPGYYYANGEFHVFNDIAEVSTIVEEPLAEISGHIRRKLERAVKKRLHADAPMGYLLSGGLDSSLVCAIAAKELESPIKTFAIGMETDPIDLKYAREVADFLRTDHTEILMTKEDVLSAVREVIWHLETWDITTIRASIGMYLICKYIHENTELKVLMTGEVSDEMFGYKYTDFAPSAGAFQKEAQKRVHELYMYDVLRADRCLAAHSLEARVPFADLDFAAYVMSINPSRKLNTYGKGKYLLRHAFEGTELLPDEILFREKAAFSDAVGHSMVDYLKEFADEKYSDEDLAKASEKYPKHTPFTKESLMYREIFEEFYPGYEDWILDFWMPNRDWVGAEVTDPSARVLSNYGDSGK

SEQ ID NO: 23464 - protein, 828 aa, Coccidioides immitis
MGQAGSSQRADFFRRTSSTSDQQIGDDHIGLSSSLPSMQISRNASEPTSGSEATTPSISELPASRGSTSTRISIENQERIGSFVHDGHEDLAMEGLSTQGSIHTRQSAQSSSSRQSTMSRLGSRIIPSSIRRSLHSRGSESSGESQPNRPTLFSRSGLSFRQDGRNRPQSPSLRNLGSRGIARRRSIRGPYALPRGESALLPESPPNPTFLSPDRAAERRRFSWRRHSRLGHVRSSIASPMSHIFGQGSPSTTSHASTAPPRRPSRSGFTEDSDGSLPPLRQMDSAMDLDEPHELDSVEPAARHVRSNSASSRYVPAVSEARRSPGAIRSRATRLLRRDESTQTPLSHILHLAASALAAQISGNATPGASNLQNIGADGLDGPLESLLQGLQHIASSQEEAGAGENSAEGGFPNVNFLRVFRFVNADNAHNSPSQSNSSESQEDAGDSMETGHHDPGEENPERRLLTLVVVGVRSIPANGSTGNESGTNARLNAESLLRLPFLSAGNLLRSDRGSSGFLRRGDGRTRFTSNRNSVAGPPIQTNHDSQRHQSTSSGGRSDAGSLADLSSSLPTVFSESPPGPNPPPSTPADPGLSGASSTVNTPSRRPSSASAFLPQLNEDSSGEAEAAAEQSTTFNFPRQRRRSDSEAARHRGLGSGAARRNGVVEPDDPSPSTTRSWLIYVVGANLAENHPALAAPSLFTDNPTYEDMMLLSSLLGPVKPPVASEEDVALAGGLYRLVQYPESLVAENAEDGERIQISENDRCLICLSDYAAEEEVRLLAKCGHIYHRECIDEWLTTGRNSCPLCRGEGVSNSDNHGNTAEPESNST

SEQ ID NO: 23465 - protein, 477 aa, Oryza sativa
MSLRLRLAFRLLFCYCLLLAAAHPSSRRLLPLLVVSAAERTNVASLPGLDGALPSRFETGYVTVDEENGGELFYYFIESEGDPGADPVLLWINGGNRCSVLSALFFEIGENLNHHRSPAGAPPLTRLCAAGPVKLAIEPYDGGVPRLRYNPYTWTKVASVLFVDSPVGAGFSFSRDPRGYDVGDVSSTLQLTKFVNKWFSQHREFLSNPLYVGGESYAGKLVPFLLQKISEDVEAGVKPVLNLKGYLVGNPGTGESIDYESKVPYAHGVGIISDQLYETILEHCGREDYANPKNATCAQALNRFSELMGEVSEAHILYKKCIYVSPKPDDGTIGRKILEEIVVGNHRPPRPPMDCSGTVDEWVRCHDDGLPYSQDIESSIKYHQNLTSRGYRVLVYSGDHDSVVPFLGTQAWVRSLNYPIVDDWRAWHIDGQSAGFTITYANDLTFATVKGGGHTAPEYQPERCLAMFGRWISEKSL

SEQ ID NO: 23466 - protein, 544 aa, Unknown
  Oceanospirillum sp. MED92
MPANESVAWNDLQSHAYYMSQSHISTLFREETDRFSLYTFEQNKFLLDLSKQRITEETLALLIKLAEEKGLQQWIQKLFDGDHVNDSEDRPALHTALRTPADRILSINDKNIIDEVHSNLSRMEEIVERIHSGQWRGFTGHSIDTVVNIGVGGSDLGPFMACKALAENQADTAKSLKIHFVSSMDGSQLAELLSELNPARTLFVISSKSFTTIDTLANAQTAKEWLKKSSYAASEETLISRHFIGVSANPDKVCEWGIPKSNQLEFWDWTGGRYSMWSTIGLPIALKLGMSGFREFLNGAHEMDEHFRNAAFSENLPVLLAMAGIWNINFLNINAHAILPYDGRLSHIPAYLEQLEMESNGKSVDRQGNNVDYKTCPILWGEVGTNAQHAFYQLLHQGTEAVMCDFIVAARRYHDTNNPELQHQHQLNLANCLAQSRILALGDSVLEGAESAPAFKRYKGNQPCTTIMLDELNPFSFGQLIALYEHKVFVQSVIWDINPFDQWGVELGKKVATSLLDALGTERKQPDFDSSTNGLINRITERGE

SEQ ID NO: 23467 - protein, 185 aa, Lupinus albus
YVGEGARMVRELFQMARSKKACIVFFDEVDAIGGARFDDGVGGDNEVQRTMLEIVNQLDGFDARGNIKVLMATNRPDTLDPALLRPGRLDRKVEFGLPDLEGRTQIFKIHTRTMNCERDIRFELLARLCPNSTGADIRSVCTEAGMYAIRARRKTVTEKDFLDAVNKVIKGYQKFSATPKYMVYN

SEQ ID NO: 23468 - protein, 112 aa, Nocardia farcinica
MKLITAIVKPFTLEDVKTGLEQAGVFGMTVSEVQGYGRQKGHTEVYRGAEYSVDFVPKVRVEVVVDDASVDKVVDVIVEASRTGKIGDGKVWVTPVESIIRVRTGERGTDAL

SEQ ID NO: 23469 - protein, 338 aa, Streptococcus pneumoniae
MEKQTVAVLGPGSWGTALSQVLNDNGHEVRIWGNLPEQINEINTHHTNKHYFKDVVLDENIIAYTDLAETLKNVDAILFVVPTKVTRLVAQQVAQTLDHKVIIMHASKGLEPDSHKRLSTILEEEIPEHLRSDIVVVSGPSHAEETIVRDLTLITAASKDLQTAQYVQELFSNHYFRLYTNTDVIGVETAGALKNIIAVGAGALHGLGFGDNAKAAIIARGLAEITRLGVALGASPLTYSGLSGVGDLIVTGTSIHSRNWRAGDALGRGESLADIEANMGMVIEGISTTRAAYELAQELGVYMPITQAIYQVIYHGTNIKDAIYDIMNNEFKAENEWS

SEQ ID NO: 23470 - protein, 1432 aa, Unknown
  Shewanella sp. MR-4
MIELRIDNQIVTAEPNDNLLRAASKAGIAIPSLCDPTDATRQLGAAPHADKQDCNLCLVQIENTDASLRCVKACETPAEAGMKVITQSAYLTKQRQAALSTILSDHFADCEAPCQQACPAGVDVQSYLYHIAQGDHSQAIKVIKDTLPLPLSIGRVCPAFCETECRRGLVDDPIAIRQLKRHAADLDLADDEQGGSYQPPRLADTGKKIAIIGAGPAGLSAGYYLSNQGHSVEIFEAMPKAGGWLRYGIPEYRLPKAILDKEIELLCRNGLTIHTDTRLGHEIHLAQLVADFDAVCLAIGAQKAVPMNYKGSELAGCYLGVGFLKEHCLDKQLKLGKKVAVIGGGNTAIDCARTAVREGCDVTLIYRRTRAEMPAEAYEVHEAEVEGVKFHFLTNPIENHSDANGQVEAVTFSKMALGEADASGRRAPVDTGETFTEAFDTVIAAVSQAPDLSFMQDPMGQLSHGELALSRWNTLIGCEQTMSSGVEKLFVMGDARRGPATAVAAIGDGRKAAIAIDKMLKIGLSCDLHAHEFNSVKTIPSALIPNALKQTETSSKAGSTHYPHTPRQPRLKMPELTALQRLLNYSEVELGFPADAAMQEAARCLECACQANTDCKLRDYATDYGVEAKSLATENARHFSVDKSAPFIQFDANRCISCGKCVDVCQQQSGHCAIQFSQDSYQALPQEMTQHMERRAPRVGFSASMADSLCVQCGNCVQVCPTGALVDARDKRQGDSTELKTASTICTYCGVGCRLDLKIDSNANRIRHIEGNKDSVVNQGMLCVKGRFGFDFIHSDKRLTTPLIRKNGELQPSSWPEAIAYVAKRLTEIKQKDGSNALASLASAKATNEDNFVLQKFVRSVLGTNNIDHCARLCHSSTVTGLQQSIGSGAMTNDIPSIKDSDVIFILGSDTTCAHPIIASKIQQAVMQHGARLLVADPKRVGIAEKAELYVAHRPGTDVMLLNAIMAEIIRNDWQDKDYIAERTEGIVALYAELSKEDYSLENAALITGVKAEDIARLARTIGTAQKTAVYYAMGITQHTTGHDNVTAISNLQLLCGNIGVSGAGINPLRGQSNVQGACDMGALPNYFTGYQKVTDIHARMRFEDHWQTPLSEEIGVTATHMMHDIAKGNIKALYVMGENPVLSDPDQAHVLNALSKVEFLVVQDIFLTETAELAHVVLPAAAFVEKRGHFTNTERRVQRLEQALASPGEALPDWQIVQAVANAMGANWDYANEEAIWCEINELTPQYRGIRWDRLSANAEGQISQGIQWPCPDETHPGTPIMHQSQFTRGLGLFTPVSYRLPAEMPCNEYPLTLSTGRLLEQFHTGTLTRKTPGLDLLGAPKVMISVYDAEQLGIHNGDKLRLTTRRGEIEIDAFVTKRAQAGVLFLPFHFVEAAANKLTINALDPVAYIPEYKVCAVRAEKVTTSVSEPA

SEQ ID NO: 23471 - protein, 146 aa, Triticum aestivum
  misc_feature (24)..(24): Xaa can be any naturally occurring amino acid
  misc_feature (34)..(34): Xaa can be any naturally occurring amino acid
VASKEVIQDTKWLEEDFTITVQKXRGGVLIENWXRSSAASTAVSIFDAMRSLVTPSSEGDWFSTAVYTTGNPYGIAEDLVFSMPCRSKGDGDYELVQHVAMDDFLWDRIKKSEAELIAEKRCVAHLIGEGNALSDLPGDTMLPGEM

SEQ ID NO: 23472 - protein, 558 aa, Candida albicans
MIYIWHALVYISCLSSCVLSQENSSDTSTSLVNKSDLYTPRSNRTLDYSPLIQYIPVFFQKNYSSIDTPHNNDFLALQSPATTQTDSNKNSQKNDSVLDECHFMSFEEWKKQKIESNTTTSNNYSMNGSSESKSITPSNHSSVISTNVTLMEADGKVYKDKFNFASVDCAATIMKTNAQAKGASAILKENKDSYLLNECSVKHKYVIIELCQDILVDSVVIGNFEFFSSIFKDIRISVSDRFPSQNWKELGQFTASNIRDVQTFKIENPLIWARYLKLEILSHYGNEFYCPISIVRVHGKTMMDEFKEDEEGNQHMGAIKEEEPPTPQTIEEDVLLINQTTLNECRVRLPHLQLNEFLKSFNSSNQEFCVPSDAEPQVTTAKTTTAITTQESIYKNIMKRLSLLESNATLSLLYIEEQSKLLSTAFSNLEKRQTTNFNTLISSVNSTLMNQLMVFKESYYELYEQYGNLFKMQENSHRQLLAETNKKVGLLSSELTFQKRVSIFNSIIIICLLVYVILTRDVAIEYPEDELNEKSPSPQSKKLSSPFIPIRYKKSKKR

SEQ ID NO: 23473 - protein, 543 aa, Gossypium hirsutum
MVAPQLAAVFTKLQTLSTSDHASVVSMNIFVALLCACIVIGHLLEENRWMNESITALIIGVFTGVIILLTSGGKSSHLLVFSEDLFFIYLLPPIIFNAGFQVKKKQFFRNFITIMLFGAVGTLISCTIISLGVINFFKEMDIGSLDIGDFLAIGAIFAATDSVCTLQVLNQDETPLLYSLVFGEGVVNDATSVVLFNAIQSFDLVNTSPRILLEFIGSFLYLFLASTMLGVIVGLVSAYIIKKLYFGRHSTDREFALMMLMAYLSYIMAELFYLSGILTVFFCGIVMSHYTWHNVTESSRVTTKHAFATLSFVAETFLFLYVGMDALDMEKWRFVSDSPGTSVAVSAVLMGLVMVGRAAFVFPLSFLSNLAKKSTSEKISFREQIIIWWAGLMRGAVSMALAYNQFTRGGHTQLRGNAIMITSTITIVLFSTVVFGLMTKPLIRFLLPHPKPTASMLSDQSTPKSMEAPFLGSGQDSFDDSLIGVHRPNSIRALLTTPAHTVHYYWRKFDNAFMRPMFGGRGFVPFVPGSPTERSEPNLPQWQ

SEQ ID NO: 23474 - protein, 370 aa, Triticum aestivum
  misc_feature (76)..(76): Xaa can be any naturally occurring amino acid
  misc_feature (82)..(82): Xaa can be any naturally occurring amino acid
  misc_feature (110)..(110): Xaa can be any naturally occurring amino acid
  misc_feature (115)..(115): Xaa can be any naturally occurring amino acid
  misc_feature (223)..(223): Xaa can be any naturally occurring amino acid
  misc_feature (360)..(360): Xaa can be any naturally occurring amino acid
  misc_feature (363)..(363): Xaa can be any naturally occurring amino acid
FGTRPFLYSLVFGEGVVNDATSVVLFNALQNFDPNQIDAIVILKFLGNFCYLFVSSTFLGVFTGLLSAYVIKKLYXGRHSTXDREVALVMLMAYLSYMLAELLDLSGILXTVFFXGIVMSHYTWHNVTESSRVTTKHAFATLSFIAETFLFLYVGMDALDIEKWKFASDSPGKSIGISSILLGLVLVGRAAFVFPLSFLSNLTKKTELEKISWRQQIVIWWAXGLMRGAVSIALAYNKFTRSGHTQLHGNAIMITSTITVVLFSTMLFGILTKPLIRFLLPASSNGAASDPASPKSLHSPLLTSQLGSDLEAPLPIVRPSSLRMLITKPTHTIHYYWRKFDDALMRPMFGGRGFVPYSPXSPXDPNVLVE

SEQ ID NO: 23475 - protein, 458 aa, Myxococcus xanthus
MSIHPAGASTAAPLPPLSPGAPLIGHLRALRKDPLHFLQAQAREYGDVVRLPMGPADLVLVAHPDGVRHVLQDHARNYSKQSRGFRVLQELLGHGLLTSDGDHWLRQRRLAQPAFHRQRVAGFTRTMVDAAADLAATMEARADTGAAFNVAEDFTRLTLRIASSTLFGADVSSATHDIATVMSRLQVFVYKRLTQPVPLSLRLPLPAHRQFERDVGSLNRVVHGIIAKRRRESGEHHDLLQMMMEAHDDDTGERMSDSQLRDEVLTLLLAGHETTASALAWTIMLLSQHPGVRRDMESELARELGGRNPTHEDLPRLELTHRVVDESLRLYPPAWALSRIATKEDLVGGFRIPKGAHLLIAPWVTHRHPSIWDNPEGFDPDRFLPEREQARPRFAWFPFGGGPRQCIGNQFALMELVLVLATLLQRVRLNLTPGQVIHPTPAITLRPRPGVWVTASRP

SEQ ID NO: 23476 - protein, 469 aa, Solanum tuberosum
MEFVSMLCLFTFISFTLLLIHSIFKFLAFASKKLPLPPGTLGLPYIGETLQLYSQNPNVFFASKVKKYGSIFKTYILGCPCVMISSPEAAKQVLVTRANLFKPTFPASKERMLGKQAIFFHQGDYHAKLRKLVLQAFKPDSIRNIIPDIESIAITSLESFEGRLINTYQEMKTYTFNVALISIFGKDEFLYREELKKCYYILEKGYNSMPINLPGTLFNKAMKARKELAKIVAKIISTRREMKIDHSDLLGSFMGDKEGLTDEQIADNVIGVIFAARDTTASVLTWILKYLGENPSVLQAVTEEQENIMRTKEVNDEEKVLNWQDTRQMPMTTRVIQETLRVASILSFTFREAVEDVEFEGYLIPKGWKVLPLFRNIHHSPDNFPEPEKFDPSRFEVSPKPNTFMPFGNGVHSCPGNELAKLEILILVHHLTTKYRWSMVGPQNGIQYGPFALPQNGLPIKLSLKTSST

SEQ ID NO: 23477 - protein, 420 aa, Aspergillus oryzae
MTGDPSSEPHQQKESSTRQRIGSTDQTSRADDDMEPRLKHGIPMQVFRSLLLATWFNCCCVVILVTQVLGAPLYLISKDYYYAYMAYTKQSFGLVITALTQWGCPTFVRVSGDKSVQGQIHLTEDGRLKTEFPERLVLIANHQVYTDWIYLWWVAYTNIMHGRIFIILKESLKYIPIVGQGMTFYGFIFMARKWLSDKPRLQHRLEKLKTRHSGSKSESSEYDPMWLLIFPEGTNLSINTKRRSDEYGQKQGFPPLKHEVLPRSTGLFFCLQHMRGTVDWVYDCTVAYEGPPKGSYPDKYFTLRSTYLQGRPPTSVNMYWRRFAVSDIPLNDQKEFDAWLRARWTEKDQLLDEYFETGRFPSDLAGFVDNVDVSESLKAAAAAGYVEVFVRLGHWSEIGRIFMVLIGAALLCKVPKLLGF

SEQ ID NO: 23478 - protein, 494 aa, Myxococcus xanthus
MTEPEKQRRFSGVKLVIAVAVAAALAAAGVTALLVNIMERKQEAKNPFYRVVELDDTITDPEVWGRNFPLQYDSYKRTVDQQRTRYGGSEAVARTPSQADPRTVVAQSRLEEDPRLVTMWSGYAFATDFREERGHAHMLDDQVYTERQHVTQQPGTCIHCHASVYVPYKKLGDGDLIKGFEKMNQMPFMEARKLVEHPVSCIDCHDPTTMQLRVTRPGFIEGIAALKASQGVPNFRVNQDATRQEMRTYVCGQCHVEYYFKGKEKRLTYPWAKGINIDQIMAYYDEDGHSDWTHELTGAKVLKAQHPEFEMYNQGIHAKSGVACADCHMPFMREGAMKVSDHQVRSPLLNINRACQTCHKWSEAELLQRAETIQTRTFETRNIAMDALVDLIHDIEAAQKAGQSEEALAKARDLQKRAQFYLDFVEAENSMGFHADQEAVRILSNSINFSRLGQNALRPSGGASTSPTTRPQGAPAPLTPVSTDGAGETQQGSK

SEQ ID NO: 23479 - protein, 417 aa, Zea mays
  misc_feature (310)..(310): Xaa can be any naturally occurring amino acid
DSNLSCPSLLFLSHPLFLATRHPVAMSSADSCVSSPASPIGFEGYEKRLEITFSDAPVFEDPCGRGLRALSREQIDSFLDLARCTIVSQLSNESFDSYVLSESSLFVYPHKVVLKTCGTTKLLLAIPRILELAAGLSLPLLSAKYSRGTFIFPGAQPAPHRSFSEEVSVLNAFFGNLKSGGNAYLIGEPFKPNKKWHVYYATEEPERPMVTLEMCMTELDVKKAAVFFKNSTGGSCTSAKEMTKLSGIHEIIPEMEICDFEFDPCGYSMNGVFGPAASTIHVTPEEGFSYASYEAMNFDPSSLVYSDVIXRVLAGFSPSDFSVAVTIFGGRGFAKSWATGADIDSYMCGDPVEQELPGGGLLMYQSFTAVPSGSVSPRSTLQTDGWSSDGMEMASNDEMCIGCWNAVKKVVKKDLDA

SEQ ID NO: 23480 - protein, 264 aa, Triticum aestivum
MGRQPCCDKVGLKKGPWTAEEDQKLVGFLLTHGHYCWRVVPKLAGLLRCGKSCRLRWTNYLRPDLKRGLLSDEEQQLVIDLHAQLGNRWSKIAAQLPGRTDNEIKNHWNTHIKKKLRKMGIDPVTHRPLGQEAPPPLQHPPPPPTATSWQQLDGAERSQQAEEEDVKAVPLIQPHEVTAVPPTASSNCSVSPASVISPSCSSSSAASGLEAAEWPEPMYLLGMDGIMDVGSGWDAGFVVPGGLGVDPFDHYYPDPAGFDQGAWP

SEQ ID NO: 23481 - protein, 543 aa, Unknown
  Malus x domestica
MGCYSSKENAPKPGSKGFGSSQPYQQPQTAAQPQKVSSQQPHNPPPPPRPQPQQRAQPAPQPRAQYQQPSPPPAKPAPQPNSILGKPFDDIKQYYTLGKELGRGQFGITYLCTENSTGHSYACKSILKRKLVSKNDRDDIKREIQIMQHLSGQPNIVEIKGAYEDRYSVHLVMELCAGGELFDRIIAQGQYSERAAAAILRDIVNVVHICHFMGVLHRDLKPENFLLSSKDEKAMLKATDFGLSVFIEEGKVYRDIVGSAYYVAPEVLRRSYGKEIDIWSAGVILYILLSGVPPFWAETERGIFDAILEGVIDFDSQPWPSISDSAKDLVRKMLTQDPRKRITSAEVLEHPWLRVGGVASDKPLDSAVLSRMKQSRAMNKLKQLALKVIAENLSEEEIKGLKTMFTNMDTDKSGTITYEELKTGLARIGSRLSEAEVRQLMDAADVDGNGSIDYIEFISATMHRQRLERDEHLYKAFQYFDKDSSGYITRDELEAAMKEHGMGDDNTIREIISEVDADNDGRINYSEFCAMMRSGAQQPAKLF

SEQ ID NO: 23482 - protein, 409 aa, Bordetella bronchiseptica
MAMDSIAIIGAGQAGAALAARLRQAGFQGGIDVFGAESAPPYQRPPLSKKYLAGDWEQERLWLRPAQFWREQGIALHLGGTVEALDLASRTLRCGGRRHGWRKLALTTGAALRPLPAAFAGRSNVFELRNLADVQRLQPAFLAGRRLLVLGGGYIGLETAAVAAQAGLSVQVVERASRVLERVACPATAAAIRALHQRHGVLIHEGRTVVGTEGDEALTGVELDNGLRIACDLVVAGVGVAPQTALAEAAGIDCDDGILVDAYGRTSAPDVWAAGDCARFVLGGEPARLESVQNAIDQAEAVADDMLGQGRPYQPVPWFWSDQYDMKLQIVGLNRGYDAVVSHASAKGESHWYFRADRLISVDALNDGRAYMVGKKLLEAGRAVGRGEVERPGFEPMQLLRDQAEGRLR

SEQ ID NO: 23483 - protein, 1008 aa, Unknown
  marine gamma proteobacterium HTCC2207
MKRMLINASHTEEVRVAMVDGQKLYDLDIENRTREQKKANIYKGKITRVEPSLEAAFVDYGADRHGFLPLKEISREYFKGKSSDGGRVNIKDAIREGQEIFVQVEKEERGSKGAALTTFISLAGRYLVLMPNNPRAGGISRRIEGEERADLREAMRGLDIPEGMGAIVRTAGIGRATEELQWDLDYLLQLWNTIEAEAEGAKAPHFLFQESNVIVRAIRDYLRQDVGEVIVDSQDAYNLAAAFIGTVMPDFTNKVKFYQEQIPLFNRYQIENQIETAFRREVSLPSGGSIVIDITEAMVSIDINSARATKGGDIEETAFNTNKEAAEEVARQLRLRDVGGLIVIDFIDMLNTRHQKEVENTIREALKIDRARVQVGRISRFGLLEMSRQRLRPSLEETMSKICPRCKGQGTIRGTRSLALSILRLIEEEAQKEFSKEIRAIVPVSVATFLLNEKRSEIADIESRNKINVVVLPNTQMETPHFEVVRIRAQDDDDSDGEFSYKLAHELSSKEPEQDLERTSAPLPISEPAVKTLVPHKPAPIMPEKAAPTAAAAVKTEKPGLLKRIWESIFGGSSTEAKKTEDEKKTRPRGSNSRRGGQNQDSRNRQGNRRPNNRNRNRNRNEGRNDSNRDAEGTETQAKSADKQGQGRGRNDQSRPAAKQDTREQKVDSASTATQTADKGPETGEGGELKKRPNDKRRGPRRRRQRQDVPANVTEQLSADIAVETSTVAADSSPSVESKTAAPETAAQVTTDTTAEATETKPARKRPARRRKPKADVVETGETAETGSTEATPTAPVVADTQDSAAAPEEKPAPKPRALRKAPAKPKKVEADASSSAAASEATAAPEKAEAPQSTEAEAPKPTEAEAPKPTEAEAPKPTKADAPKPAEKPKAPKKAAAVVEVIEKAAPKAEAKATAKPARAATARASNDPRFKPKPVSDVKVSTARVEKPAAVALDTSKPAPTAAPKAPVARASNDPRKNRASQATKADSAPSDTGSAKESTEKGPQA

SEQ ID NO: 23484 - protein, 516 aa, Escherichia coli
MFMATYMTFSLKQSGRAMSKHDTDTSDQHAAKRRWLNAHEEGYHKAMGNRQVQMIAIGGAIGTGLFLGAGARLQMAGPALALVYLICGLFSFFILRALGELVLHRPSSGSFVSYAREFLGEKAAYVAGWMYFINWAMTGIVDITAVALYMHYWGAFGGVPQWVFALAALTIVGTMNMIGVKWFAEMEFWFALIKVLAIVTFLVVGTVFLGSGQPLDGNTTGFHLITDNGGFFPHGLLPALVLIQGVVFAFASIEMVGTAAGECKDPQTMVPKAINSVIWRIGLFYVGSVVLLVMLLPWSAYQAGQSPFVTFFSKLGVPYIGSIMNIVVLTAALSSLNSGLYCTGRILRSMAMGGSAPSFMAKMSRQHVPYAGILATLVVYVVGVFLNYLVPSRVFEIVLNFASLGIIASWAFIIVCQMRLRKAIKEGKAADVSFKLPGAPFTSWLTLLFLLSVLVLMAFDYPNGTYTIAALPIIGILLVIGWFGVRKRVAEIHSTAPVVEEDEEKQEIVFKPETAS

SEQ ID NO: 23485 - protein, 242 aa, Vibrio cholerae
MASVSMRDMLTAGVHFGHQTRYWNPKMKQFIFGARNRVHIINLEKTVPMFNEALAELAKVGEKKGKVLFVGTKRAASESVKEAALASNQYYVNNRWLGGMLTNWKTVRQSIKRLKELEVQSTDGTFDKLTKKEALMRTREMEKLEKSLGGIKDMGGLPDALFVIDADHEHIAIKEANNLGIPVFAVVDTNSSPDGVDYIIPGNDDAIRAVQLYLNAAAQAINEGRNKDVAAVAEKDGFVEAE

SEQ ID NO: 23486 - protein, 589 aa, Saccharomyces cerevisiae
MTISSAHPETEPKWWKEATIYQIYPASFKDSNNDGWGDMKGIASKLEYIKELGTDAIWISPFYDSPQDDMGYDIANYEKVWPTYGTNEDCFALIEKTHKLGMKFITDLVINHCSSEHEWFKESRSSKTNPKRDWFFWRPPKGYDAEGKPIPPNNWRSYFGGSAWTFDEKTQEFYLRLFCSTQPDLNWENEDCRKAIYESAVGYWLDHGVDGFRIDVGSLYSKVAGLPDAPVIDENSKWQLSDPFTMNGPRIHEFHQEMNKFIRNRVKDGREIMTVGEMRHATDETKRLYTSASRHELSELFNFSHTDVGTSPKFRQNLIPYELKDWKVALAELFRYVNGTDCWSTIYLENHDQPRSITRFGDDSPKNRVISGKLLSVLLVSLSGTLYVYQGQELGEINFKNWPIEKYEDVEVRNNYDAIKEEHGENSKEMKRFLEAIALISRDHARTPMQWSREEPNAGFSGPNAKPWFYLNESFREGINAEDESKDPNSVLNFWKEALRFRKAHKDITVYGYDFEFIDLDNKKLFSFTKKYDNKTLFAALNFSSDSIDFTIPNNSSSFKLEFGNYPRSEVDASSRTLKPWEGRIYISE

SEQ ID NO: 23487 - protein, 656 aa, Rhizobium tropici
MSEPTTRSLGATLTDSGVEFAVYSRHAEQIDLCLLDAEGRKEIARLPIARDGDEHRLFVRDAGEGTRYGLRAHGSYDPDQGLWFDPSKLLVDPYTREIDRPFRYDPRLGIFGADTQDLMPKAIVSRDIAVKRAKPLFQPGGLIYEIAVKPFTMLHPDVPAKQRGTLGALAHPFVIAHLKRLQVDAIELMPITAWIDERHLPPLGLTNGWGYNPVAFMALDPRLVPGGMKELRETVAALHAEGIAVILDLVFNHTGESDRQGPTLSLRGLDNPTYFRHLPDQPGTLVNDTGTGNTVACDQPVTRKLIIDSLSHFVRNTGIDGFRFDLATVLGRNGKGFDPESMTLRTMLADEVLQDRIMIAEPWDIGPGGYQLGNFPAPFLEWNDRARDDLRRFWRGDAGIGDLATILAGSSSIFGRDGRTQTRCVNFLAAHDGFTLMDLVSYENKHNEANGENNRDGHNENSSWNNGIEGKTDDQAIQSKRRADIEAMLSTLFAARGTIMLTAGDERGRSQQGNNNAYCQDNAITWMDWNLLDEQLIGHTAWLAGLHRRFTAFADMNFFRGDGDVLWFSSARTPMTVPDWEAPGAAVLGMALQTGDRATHRSTRLALVFNRAADERSVTLPVSESGGWSRLTVAGETPAGEQIAIPARSVAFFVEN

SEQ ID NO: 23488 - protein, 475 aa, Glycine max
MESIAAQLKRGISRQFSSGSLRRNLSWQFTRQASLDPRRNNQRFSFGRQSSLDPIRRSPCSGNAELTVPENLDSTMQLLFMACRGDVKGVEDLLNEGIDVNSIDLDGRTALHVAACEGHVEVARLLLSRKANLDARDRWGSTAAADAKYYGNTEIYYMLKARGAKVPKTRKTPMTVANPREVPEYELNPVELQVRKSDGISKGTYQVAKWNGTKVAVKILDKDSYSDPDTINAFKHELTLLERVRHPNVVQFVGAVTQNIPMMIVREYHSKGDLASYLQKKGRLSPSKVLRFALDIARGMNYLHECKPDPVIHCDLKPKNILLDSGGQLKIAGFGTVRFSLISPDEAQLVQPEPNIDLSSLYVAPEIYKDEVFDRSVDAYSFGLILYEMIEGTQPFHPKSSEEAVRLMCLEGKRPAFKIKTKHYPPELKELIEECWDPTPVVRPTFSQVIVRLDKIVANCSKQGWWKDTFKLPWK

SEQ ID NO: 23489 - protein, 61 aa, Glycine max
  misc_feature (6)..(6): Xaa can be any naturally occurring amino acid
  misc_feature (23)..(23): Xaa can be any naturally occurring amino acid
  misc_feature (26)..(26): Xaa can be any naturally occurring amino acid
  misc_feature (32)..(32): Xaa can be any naturally occurring amino acid
  misc_feature (59)..(59): Xaa can be any naturally occurring amino acid
MGRRPXRCYRQIKNKPYPKSRFXRGXPDPKIXIYDVGMKKKGVDEFPFCVHLVSREKEXVS

SEQ ID NO: 23490 - protein, 269 aa, Cenarchaeum symbiosum
MARVAVAQLRASTDKDRNLRRIVKYVSEAAAGGAGLVAFPEFMMFYTPPGQTPAELARLAENIDGPFVKSVADAARDYSIEVVGTIYERSPRRGRVYDTSFLLGRDGSLLSSYRKIHLYDALGFKESAKLAPGDRMTVPSGSSVGSLGMLICYDLRFPEAARTLASSGAGVIVAPSAWVQGKNKEDQWITMNRARAMENGCYLVSPAHVGNIYCGRSLVVDPWGGIILDMGKRQGLGYATVSPEIIGEARRAMPLLKSRRTDVYPDFSL

SEQ ID NO: 23491 - protein, 217 aa, Oryza sativa
MGGRVDHEYSYLFKMVLIGDTGVGKSNILSRFTRNHFSLDSKSTIGVEFATKSLQMEGKTIKAQIWDTAGQERYRAITSAYYRGAVGALLVYDITKRQSFDNVHRWLRELRDHADSSIVIMMVGNKSDLIHLRAVSEDEGKALAEKEGLFFLETSAMEAVNVEEAFQTIITEVYGIVNRKALAAKEAAAASRPLPSQGKTISIDSAAGNTKRACCSA

SEQ ID NO: 23492 - protein, 269 aa, Oryza sativa
MVGDGEDPGSTRRGERRGGGGRWAGRRVVLNASDTVPPTFWRICKRKDVEEFKADPYLATLLNCMLWVFYGIPVVHPNSILVVTINGIGLLVEGTYLLIFFLYSPNKKRLRMCAVLGVELVFMLAVILGVLLGAHTHEKRSMIVGILCVFFGSIMYFSPLTIMGKVIKTKSVEYMPFFLSLVCFLNGVCWTAYALIRFDIYVTIPNGLGALFGAIQLILYACYYRTTPKKTKAAKDVEMPSVVVSGTGAAAAAGGGNTGGGSVSVTVER

SEQ ID NO: 23493 - protein, 508 aa, Clostridium perfringens
MTPFYVSPQKDNGYDIADYYKIDPRYGTMEDFEELVKEAKGRNIDIMLDMVFNHTSTEHEWFKRALKGEEKYKNYYIFKEGKKGEPPTNWISKFGGNAWEYVEELGEYYLHLFDVSQADLNWDNKELREEIYKVVNFWIDKGVKGFRLDVINLISKPEKFENDYEGDGRRFYTDGHRIHEYLKELNERTFGKDVEIVTVGEMSSTTIENCIKYSNPKEKELSMVFNFHHLKVDYKDGQKWSLMDFDFIELKKLFNNWQRGMINGGGWNAVFWCNHDQPRVNSRFGDVKKYFNESSKMLATSIHMMSGTPYVYQGEEIGMTNPGFESIEEYRDVESINYFNILKEEEIDEKEIMEILKSKSRDNSRTPVQWNEEKNAGFTTGTPWINIANNYREINVERALENKDSVFYHYKKLIELRKNEDVIAYGDYIQFLEDHPKVYAYERNYNGEKLLVINNFYGEECLVDLSKEIEGLENYNKSILISNYKDSTLDLLSLKLRPYESIVYKLEK

SEQ ID NO: 23494 - protein, 475 aa, Solanum tuberosum
MVNYFEIFFYISIFLLGILSYYFCFSKKYNSSSKKNAYKLPPGSMGWPYIGETLQLYSQDPNAFFINRQRRFGEIFKTKILGCPCVMLASPEAARFVLVNQANLFKPTYPKSKENLIGQSALFFHQGDYHNHLRKLVQASLNPESIRNQIPYIEELSISALNSWVGGHVVNTYHEMKKFSFEVGILAIFGHLDGHVKEELKKNYSIVDKGYNSFPINLPGSLYRKSLQARKRLGKILSEIIRERKEKKVLEKGLLSCFLNAKEEKGLLVLNEDQIADNIIGVLFAAQDTTASVLTWILKYLHDNPKLLECVKAEQKVILQSNEQENHGLTWTQTRKMPITNKVVLETLRMASIISFAFREAVADVEYKGYLIPKGWKVMPLFRNIHHNPEFFPDPQKFDPSRFENAPKPNTFMPFGSGVHACPGNELAKLEILIMTHHLVTKFRWEVVGSGSGIQYGPFPVPLGGLAARFWKEST

SEQ ID NO: 23495 - protein, 477 aa, Lactococcus lactis
MENQNQVKRNLKQRHITMIALGGTIGTGLFLTSGATISQAGPWGAVLAYCFIGIMVYFVMTSLGEMATYLPTSGSFSDYGGRYVDPAFGFALGWNYWLNGAITIAVDLTTAGLITQFWFPHLPSWIFSGIATVLIFIINVMAVGAFGETEYWLSTIKVITIVLFLAIGLLTIFGVLGQGNVDVVANLSAGNHGFVGGISGFVGVLLIAGFSFQGTELLGITAGESEDPGKSIPKAMNSIFWRILLFYIFSIIVIAAIINFKDPRLLNPNSTAVMSPFTIVFKNIGFAVAASVMNAVILTSVISSANSVMYASTRILYSLGQEKGAPKFFGRTAKNGIPFYALLATTIICFIAFLTGIFGTQIYLFLVDLSSLTGFLAWLGISISHIRFRRAYIAQGKKLEDLPYKAKWFPFGPIVALLMTAAIAINLDPAMLFSEHWGEGLALYAAIPIFIILYFGYKWKYNTKIIPLEEVDLSREK

SEQ ID NO: 23496 - protein, 104 aa, Clostridium perfringens
MVKHINQDEFEKEVLNQEGVVVVDFFATWCGPCKMLAPVLDEVQDEINNVKIVKIDIDENLDKAYEYGVKNIPTIKIFKNGEEITTNVGFVPKNLLKEMIEKTL

SEQ ID NO: 23497 - protein, 476 aa, Arabidopsis thaliana
MDNIAAQLKRGISRQFSTGSMRRTLSRQFTRQNSLDPRRNNMRFSFGRQSSLDPIRRSPESLSCEPHMSVPENLDSTMQLLFMASKGDVNGVEELLNEGIDVNSIDLDGRTALHIASCEGHYDVVKVLLSRRANIDARDRWGSTAAVDAKYYGNVEVYNLLKARGAKAPKTRKTPMTVGNPKEVPEYELNPLELQVRKVDGISKGTYQVAKWNGTRVSVKIFDKDSYSDPERVNAFTNELTLLAKARHPNIVQFVGAVTQNLPMMIVVECNPKGDLSVYLQKKGRLSPSKALRFALDIARGMNYLHECKPDPIIHCELMPKNILLDRGGQLKISGFGLIKLSKIGEDSAKVVNHEAQIDKSNYYIAPEIYKDEVFDKRADVHSFGVILYELTEGVSLFHPKPPEEVAESICIEGKRPTIRTKSKSYPPELKELIEECWHPEISVRPIFSEIIIRLDKIVTNCSKQGWWKDTFKFPW

SEQ ID NO: 23498 - protein, 195 aa, Aminomonas aminovorus
MRNAEVSRNTLETKIAVAINLDGTGVSKLNSGVGFFDHMLDQIARHGMMDISVECQGDLHIDAHHTVEDVGIALGQAFSRALGDKKGIRRYAHAYVPLDEALSRVVLDISGRPGLEFNVEFTRARIGEFDVDLVREFFQGFVNHAALTLHVDNLRGKNAHHQAETIFKAFGRALRAAVELDPRMVGIMPSTKGSL

SEQ ID NO: 23499 - protein, 133 aa, Arabidopsis thaliana
MDTKKKSKEHGLYRIVNAIGYAFGAGAVGGSVYHFVRGAYNSPIGARYVGGTQAASMNAPRLGGTFAVFGGLLSTFDYALVRIRKKEDPWNSIVAGAATGGVLSIRKGVVAASTSAVMFGFFLAVLNPPFGSK

SEQ ID NO: 23500 - protein, 111 aa, Lactobacillus delbrueckii
MKRIGILTSGGDAPGMNAAVRAVTRVAIANGLEVFGIRYGFAGLVAGDIFPLESEDVAHLINVSGTFLYSARYPEFAEEEGQLAGIEQLKKHGIDAVVVIGGDGSYHGALQ

SEQ ID NO: 23501 - protein, 238 aa, Aspergillus oryzae
MIRNIEPKHSLRDQDDGTDDDDLLKALENEDDSAYRAQRIEQLNAELASAQNNRSVAPGQTTITQDSIYPTLENDQILLSFTTDTHRCVIHFAHPDFSRCGTMDEHMRALATRHYDVRFARVDVRDIPFVVEKLKIRVLPCVIGFKDGIAAERVVGFEGLALGGRDGTDSFSTATLEKRLLWKGVLVQAKIKDGNDDSDMSDADDEDEDDGRRRIHGGGAIRGGGARYNRDDHDDDWD

SEQ ID NO: 23502 - protein, 138 aa, Glycine max
  misc_feature (40)..(40): Xaa can be any naturally occurring amino acid
  misc_feature (56)..(56): Xaa can be any naturally occurring amino acid
  misc_feature (99)..(99): Xaa can be any naturally occurring amino acid
  misc_feature (123)..(123): Xaa can be any naturally occurring amino acid
MSVLTREVKEVGHGGKEVTRAVPAVSEKVKDSLVKNIRRXMTPQPLKIRADIEMKXKCFQFDEILHIRMHLSKDEAAGNDDCPVKIKLVAPPLYVLTTXTLDKEQGILVINNAIASCTKAIEXHKGKLVVKEAARALS

SEQ ID NO: 23503 - protein, 554 aa, Clostridium difficile
MEKKWWQKEIVYQIYPRSFQDSNNDGIGDLQGIISRLDYLKDLGITSLWLCPIFKSPMDDNGYDISDYLDIASEFGSMEDLKELIKESKDRGIKIILDLVLNHTSDEHPWFQEALKNPESPYHDYYIFKKGNDLPNNWRSVFGGSVWEKVENRDEYYFHSFGKKQPDLNWENPILRSELYQMINTWSQMGVAGFRVDAITFIKKNLSFQSLESDGVDGLVKCTKTVRNQPGIEKMLYELKENTFKKYDCMTVAEAAGISYDQLGDFIGEDGFFSMVFDFKHADLDVASGSEWFKRISWTIPDLRKCILDSQMYVQEHGWAANFIENHDQPRATTKYLLQYERNDDAVKMLGAMYFFLRGTPFIYQGQELGMTNFKRDTINDFNDLSSIDQYYRSIDESYSEEEALEFVNLRSRDNARTPFPWADKENAGFSDTTPWLKVIENYKDINAQSQINNSESILEFYKKMIKLRQDSEYSDCLIYGSIEPIDIESDDIIAYRRQLDLVVIDCYYNFSDKPVEIRVEEKYDIVFQNLDDINLLNKTVRLKPFHAVLLKVR

SEQ ID NO: 23504 - protein, 595 aa, Xanthomonas oryzae
MVAITPQDHSGPCGAVVSSPVATRYGPVSALLCVAICDAARAAALSFRVFMHSIDVVLAMLLAVAASGYLIRILPFSLPLPLVQIALGAVVSGVFDAGHELEPELFFLLFLPPLLFLDGWRIPKQGLFRDKAAILELALGLVIFTVIGAGVFIHWLIPAMPLAVAFALAAIISPTDPVAVSSIASKVPIPKRLMHILEGESLLNDASGLVCFQFAVAAVLTGTFSVAAASLTFLWVALAGLALGVATTFGLSRIQAWIWRHFGEEPGSAILVNLLTPFAAYLLAEAFHASGILAAVAAGITMSYVEMAGNAPGNMRLQRSAVWDTVQFTFNGIIFVLLGEQLPGILDGAVRSVQEAGHLNPWWLAVYVATISASLMALRFVWVFLSLRWNIFKAQRRGEAHVSPPWRIVVAVSLAGVRGAITLAGVLTLPLMLEDGSPFPARQLAIFLAASVILVSLLVASVALPRLLRGLELPEEEDEQLKEDLAAKAASQAALDAVEKLRQRLVDGSKHAERYNAAANQVSQRYQRKLGSVDMAETDPEEAVAYEKALRQFRHAALVAERNELFKLARRREISDELSRRLVRNLDLIESRKRA

SEQ ID NO: 23505 - protein, 554 aa, Vibrio vulnificus
MCSVFGILDIKSDAAALRPIALEMSKKLRHRGPDWSGIYASDRAILAHERLAIVGLNSGAQPLYSPDKKLILAVNGEIYNHKEIRARYEGKYDFQTDSDCEVILALYQEMGADLLEELNGIFAFVLYDEEKDQYLIGRDHIGIIPLYQGYDEHGNYYVASEMKALVPVCKTISEFPPGSYYSSTDAGPQRYYIRDWNEYAAVQGNTSSKEELTAALEAAVKRQLMTDVPYGVLLSGGLDSSITSAVAKRYAAMRIEDDEQTEAWWPQLHSFAIGLDGAPDLKAAREVAAKIGTVHHEMTYTIQEGLDAIRDVIYHIETYDVTTIRASTPMYLMGRKIKAMGIKMVLSGEGADEIFGGYLYFHKAPNAQEFHEETVRKLLALNMFDCARANKSLAAWGVEGRVPFLDKEFIDVAMRLNPADKMCGNGKMEKHILRECFEHYLPDSIAWRQKEQFSDGVGYGWIDTLKAVAEEKVTDQQMEAAKFRFPYNTPTTKEGYVYREIFEELFPLTSAAECVPGGPSVACSSAKAIEWDESFKNCIDPSGRAVKAVHNEAY

SEQ ID NO: 23506 - protein, 836 aa, Unknown
  Rhodococcus sp. RHA1
MSRKSAVVIGHGMVGHRFVEALRARDESDDWSVTVLCEEPLPAYDRVGLSSYVGAWDPKELALVGNDYPDDAHVDLRIGRRAATIDRESRKVTTDSGEVVAYDALVMATGSYPFVPPIPGHDRPECFVYRTLDDLDGIRKRADAAGPGAVGVVVGGGLLGLEAANALKLMGMTPHVVEFAPRLMPLQVDEGGGALLANLVTDLGLTVHTGVGTAGITEGPDGISVELSDGSVIEAALLVFSAGVRPQDQLARDAGLEVAERGGIITDLGCRTSDESIYAVGECAAVEGRCYGLVAPGYTTAEIVADRLLGGAAEFPGADLSTKLKLMGVDVASFGDAHAQTPGALEVVLSDAAKGTYAKLVVSDDAKTLLGGILVGDASAYASLRPLVGRELPGDPASLISPAGEKPGAGSLPDDAEVCSCNGVTKGSICGAIVDGACDIAQVKSCTNAGTTCGGCLPTIKQLLASSGVVMSKALCEHFEQSRAELFEIVQVTDTRTFSALISKYGKGSGCDICKPVVASILASTDSDHILHRNQAGLQDTNDHFLANIQKNGTYSVVPRMPGGECTPEQLIVIGEVARDFGLYTKVTGGQRIDLFGARVEQLPAIWKRLVDAGMESGQAYGKSLRTVKSCVGSTWCRYGVQDSVGMAVDLENRYRGLRSPHKIKFGVSGCARECAEARGKDVGVIATENGWNLYVGGNGGQSPKHAQLLAGGLDDETLVRYIDRYLMFYIRTADRLQRTAPWVESLEGGLDHLKAVVCEDSLGIAADLEAAMAKHVLGYKDEWAGVLEDPEKLSRFVSFVNAPEEADPTVSFDDTGVRKVPVLMGMPKFAASTSE

SEQ ID NO: 23507 - protein, 585 aa, Arabidopsis thaliana
MASQLDLIGGDYIAGISINPPTNSRVTSVYSEVQASRIDHTLPLPSVFKTPFKIIDGPPSSSAGHPEEIEKLFPNLFGQPSALLVPNQSNEVSSDQKLKIGVVLSGGQAPGGHNVICGIFGFKNLICDCIFVVGLIDYLQEYARGSSLFGFRGGPAGIMKGKYIELTSEFVYPYRNQGGFDMICSGRDKIETPEQFKQAEETVTKMDLDGLVVIGGDDSNTNACLLAEHFRAKNMKTLVIGCPKTIDGDLKSKEVPTSFGFDTACKIYSEMIGNVMIDARSTGKYYHFVRLMGRAASHITLECALQTHPNITIIGEEVFEKKLTLKNVTDNIVDVIYKRAENGYNYGVILVPEGLIDFIPEVQQLISELNEVLAEGNVDEEGQWKKNLKKETLEIFEFLPQTIQEQLMLERDPHGNVQVAKIETEKMLIQMVETELEKKKTEGTYEREFMGKSHFFGYEGRCGLPTNFDATYCYALGYGAGSLLQSGKTGLISSVGNLAAPVEEWTVGGTALTSLMDVERRHGKFKPVIKKAMVELEGAPFKKFASQREEWALKNRYISPGPIQFKGPGSDARNHTLMLELGAQA

SEQ ID NO: 23508 - protein, 371 aa, Ipomoea purpurea
MLSTITATVPSRVERLAGSGIQRIPKEYIRPEEERRSIRDIFEEEKIAGGPQVPTVDLKGINSEDLEVREKCREELRKAAVDWGVMHLVNHGIPEELTGRVKAAGEGFFGQPIEEKEKYANDQAAGNVQGYGSKLANNASGQLEWEDYFFHCIFPEDKTDLSIWPKNASDYIDATREYAKQLRALATKVLAVLSLGLGLEEGRLEKEVGGMEELLLQMKINYYPKCPQPELALGVEAHTDVSALTFILHNMVPGLQLFYGGKWVTAKCVPNSIIMHVGDTVEILSNGKYKSILHRGVVNREKVRVSWAVFCEPPKDKILLQPLPETVSEAEPPRFPPRTFARHIKHNLFRQSDQEAAHTPKPDNDDDHQSN

SEQ ID NO: 23509 - protein, 264 aa, Zea mays
MVAAGRNRAERWNLAGATALVTGGSKGIGHAIVEELAGFGARVHTCSRNAAELEECRRRWDEKGLQVTVSACDVSARADRERLVATVGATFGGRLDILVNNAGQSLFKRTAECTGEDYSRIMATNLESCFHLSQFVHPFLRLVSGRGGGSVVHVFSDAGFVGLPALAVYSMSKGALNQLTRSLAAEWAGDGIRVNCVAPGGIRTDISSDKTIDPELAKREMARVPMGRIGEPEEVASMVAFLCMPAASYMTGQVICIDGGRTIA

SEQ ID NO: 23510 - protein, 311 aa, Acidobacteria bacterium
MQKVALFYNPASGRRSAQRAHDVKIAADVLRAAGKQVHVEPTRGPGTAAAQVHEAKAQGADTVLIAGGDGTIHDALQGLAGSDLTLGVIPMGTGNVLAHDLAISHQPHEAAKQLLAFQSRRIALGKVTYRGIRGPESRWFVAVAGVGGSAKLMYDVHAGLKGAHGMLAYYAQMARLALLHRFDSFNVEYRSDDGQWIKCTAVEADAVRITNFGGLMRRWAWGANLQRDDAQLVLFQTGSRPRFLHYTFSRILGRHWHTPGVELIYAKEIRCTVSNPAQRLHVEADGEYIGGPPVTIEVVPNMLNLLMEAKG

SEQ ID NO: 23511 - protein, 533 aa, Ricinus communis
MQSSTSKENKQPPSSQPHPPPLMVAGAAEPNSSPLRKVVMVASIAAGIQFGWALQLSLLTPYVQLLGIPHTWAAFIWLCGPISGMLVQPIVGYHSDRCTSRFGRRRPFIASGAAFVAIAVFLIGYAADLGHLSGDSLDKSPKTRAIAIFVVGFWILDVANNMLQGPCRALLADLSGTSQKKTRTANALFSFFMAVGNVLGYAAGAYTHLYKLFPFTKTTACDVYCANLKSCFFISIVLLLSLTVLALSYVKEKPWSPDQAVDNAEDDTASQASSSAQPMPFFGEILGAFKNLKRPMWILLLVTCLNWIAWFPFLLFDTDWMGREVYGGDSSGSAEQLKLYDRGVRAGALGLMLNSVVLGFTSLGVEVLARGVGGVKRLWGIVNFVLAVCLAMTVLVTKQAESTRRFATVSGGAKVPLPPPSGVKAGALALFAVMGVPQAITYSIPFALASIFSNTSGAGQGLSLGVLNLSIVIPQMIVSVAAGPWDALFGGGNLPAFVVGAVAALASGIFALTMLPSPQPDMPSAKALTAAFH

SEQ ID NO: 23512 - protein, 351 aa, Parvularcula bermudensis
MKQQLNVVRTASLGATASAHPQFDTVTVLGAGAWGTALAIAFARAGRTVRLWGRNAEMMGDMARLRRNMAYIPGVLLPDTVIPISDLSAAVDGVDAVFIALPSKGVGAIADKIASDVKPLAPVISCAKGLDPETEELLTDRIQSAIPQARAMFLSGPSFAAEVARGEPTSVVIAGEGELAAEMAASLTSDSFHVEPVEDLIGAQIGGIMKNVIAIACGVADGLGHGSNTRASILARGLEEAASLADALGGSAHTLLGVAGAGDLALACTDPQSRNYSYGRALADPAAPLTATTFEGADSVAKVCAVMTAQGVSAPIACAVDAMLKRDLTPEAMVASLFRSVTAARTPEATQ

SEQ ID NO: 23513 - protein, 411 aa, Vitis vinifera
MNALAATNRNFRHASRILGLDSKLEKSLLIPFREIKVECTIPKDDGSLATYVGFRVQHDNARGPMKGGIRYHPEVDPDEVNALAQLMTWKTAVVDIPYGGAKGGIGCTPKDLSMSELERLTRVFTQKIHDLIGTHTDVPAPDMGTNAQTMAWILDEYSKFHGHSPAVVTGKPIALGGSLGREAATGRGVVFATEALLAQHGKSIKGLTFVIQGFGNVGSWVARLIGERGGKIIAVSDVTGAVKNQNGLDIVDLLRHKEETGCLTNFSGGDHMDPNELLTHECDVLIPCALGGVLNKENAADVKAKFIIEAANHPTDPEADEILSKKGGVILPDIYANAGGVTVSYFEWVQNIQGFMWEEEKVNNELQKYMTKAFHNIKAMCQSHNCSLRMGAFTLAVNRVACATTLRGWEA

SEQ ID NO: 23514 - protein, 474 aa, Unknown
  Silicibacter sp. TM1040
MADTRPVIWWIRRDLRLRDNPALRAAQEAGGPIIPLYIHDAQEEALGAAPKFRLGLGLERFAKTLEEKGSRLIVRRGDALEVLREVIAESGAGHVIWSRLYDPAATKRDAKIKEALKASDIKAKSTGGRLLFEPWTVDTKDGGMYRVYTPFWKAVRTRDVAELTAAPSRLAAPESWPSGEALADLGMDAAMRRGGAIVAQHCRVGEDAALAQLDDFLTERVSNYKAHRDFPARAATSELSENLAWGEISPHRMWHLGAQAMQDGQPGAEHFLKEVVWREFAYHLMHRSPRILTRNWREEWDGFPWQDDPGDALQRWQQGQTGYDFVDAAMRELYVTGKMHNRARMIVASFLTKHLMIHWKYGLQWFEDCLVDWDPASNAMGWQWVAGSGPDAAPFFRIFNPDGQLEKFDPKGDYARRWLPEGQANPPETAMAYFEAIPRRWSLHPDQSRVSPIIGLKEGRERALSAYKESRNQS

SEQ ID NO: 23515 - protein, 457 aa, Agaricus bisporus
MVLPHEPEFEQALHELETSLQPFLTTNPQYKKALEIIQVPERVLQFRVTWEDDQGKPQVNRGFRVQYNSALGPYKGGLRLHPTVNLSILKFLGFEQTFKNALTGLSMGGGKGGSDFDPKGKSDNEIRRFCVAFMSELFRHIGQDTDVPAGDIGTGAREIGFLFGAYRRLKNEFTGMLTGKGINWGGSFIRPEATGYGLIYYVEHMIAHACPEYSLDRPSTLVAISGSGNVSQFTALKVIELGATVLSLSDSKGSLISEKGYTKEAIEKIAELKLKGGALEAIVDDLGAGYTYHAGKRPWTLLPQVHIALPGATQNEVSQEEAEALVKAGTRIVAEGSNMGCTEEAIAIFENSRRASRAGVWYAPGKASNCGGVAVSGLEMAQNSQRLAWSTQEVDAKLKSIMAECYQICYTAGSRWSGEKVAEGVAEGEALPSLLSGANLAGFIKVADAMKEQGDWW

SEQ ID NO: 23516 - protein, 450 aa, Laccaria bicolor
MVLPVEPEYEQALSELPNSLKPFLAANPDYGKALEIVPIPERVLQFRVIWEDDQGKAQVNRGFRVQYNSALGPYKGGLRLHPSVNLSILKFLGFEQTFKNALTGLSMGGGKGGSDFDPKGKSDGEIRRFCTSFMSELFRHIGQDTDVPAGDIGTGAREIGYLFGAYKKLQNEFVGMLTGKGLAWGGSFIRPEATGYGLIYYVEHMIAKAAPEYSLSKPETLVAISGSGNVGQFTALKVIELGATVLSLSDSKGSLIAEKGYTKEFIKEIGQLKLKGGALESLAQREGYTYHAGKRPWSLLPVVHVALPGATQNEVSKTEAEDLIKAGVRIVAEGSNMGCTEDAIAVFEESRKAGAGGVWYAPGKASNCGGVAVSGLEMAQNSQRLAWTTDQVDQKLKKIMAECYEICLSAGTKWSGEEIKDGVLPSLLSGANVAGFIKVADAMREHGDWW

SEQ ID NO: 23517 - protein, 393 aa, Saccharomyces cerevisiae
MSLDRVDWPHATFSTPVKRIFDTQTTLDFQSSLAIHRIKYHLHKYTTLISHCSDPDPHATASSIAMVNGLMGVLDKLAHLIDETPPLPGPRRYGNLACREWHHKLDERLPQWLQEMLPSEYHEVVPELQYYLGNSFGSSTRLDYGTGHELSFMATVAALDMLGMFPHMRGADVFLLFNKYYTIMRRLILTYTLEPAGSHGVWGLDDHFHLVYILGSSQWQLLDAQAPLQPREILDKSLVREYKDTNFYCQGINFINEVKMGPFEEHSPILYDIAVTVPRWSKVCKGLLKMYSVEVLKKFPVVQHFWFGTGFFPWVNIQNGTDLPVFEEKEEESIEQANAGSPGREQTSTRFPTSTSMPPPGVPPSGNNINYLLSHQNQSHRNQTSFSRDRLRR

SEQ ID NO: 23518 - protein, 276 aa, Arabidopsis thaliana; identical to SEQ ID NO: 427

SEQ ID NO: 23519 - protein, 316 aa, Rickettsia prowazekii
MNKFKNIAVYGGGSFGTSLASLVARNCNNVTLFLRDEIILKEILYKKTNAQYLGDIELPTNLQATTNLSVIKDFELIIIAVPSYAFDDSIKLLKTYGISKEHTILVATKGLADNPTELFSDRLNTLLPDNPIGFLSGPNLAKELAKNLPASASIASLDIDIANKIAYNFSSKTFSTNTTIDIVTLQIAGALKNIFAIKSGIDLAREQGANSRATLIVGALKEITTLSKVLGGMQKNSDILLEAGVLGDLVLTCYSLGSRNTKFGYEFEISRDKKKFLCEYKELVEGREALKLVLDLIKKYNLHMPIVAEVASLILI

SEQ ID NO: 23520 - protein, 449 aa, Magnaporthe grisea
MTSSVASGLPLSTSTNPQAKPPTDATTTAASIPNLKDRLPKLEPRRRRPAPSNPVPVPETPNLPPPTGTSPETQFRVPTRRILSKKDHDLFVAAPAYKLILAFVFGLSDAVVDKPISAIKDSDLSPAVQTINALLDEASELVKQSPPDEQGGSRFGNKRFRDFLDNVKERAPSWHKKLGIKDEGDAIAEAVTYLGQSFGNRMRIDYGSGHELNFLMWLLCLYQLGVVTKSDFAALVLRVFVKYLQVMRLVQSTYYLEPAGSHGVWGLDDYQFLPFLFGASQLLHHPFITPLAIHQQLTIEEFGHDYLYLDQVNFVNSTKTVQGLRWHSPMLDDISAAKSWSKVEGGMRRMFVAEVLNKLPVMQHFLFGSLIPAAEGMTEQDLAGLQPEDEETEGGQVEVFNDEGGVRHMHQQNGWGECCGIKVPSSVAAAAEMRKRGIGGDSLRRIPFD

SEQ ID NO: 23521 - protein, 106 aa, Arabidopsis thaliana
MDVGRNNRKNMSFRSSPEKSKQELRRSFSAQKRMMIPANYFSLESLFLLVGLTASLLILPLVLPPLPPPPFMLLLVPIGIMVLLVVLAFMPSSHSNANTDVTCNFM

SEQ ID NO: 23522 - protein, 427 aa, Triticum aestivum
MAQAVVPAMQCQVGVRGRSAVPARQPAGRVWGVRRTARATSGFEVLALGPETTGVIQRMQQLLDMDTTPFTDKIIAEYIWVGGSGIDLRSKSRTISKPVEDPSELPKWNYDGSSTGQPPGEDSEVILYPQAIFKDPFRGGNNILVICDTYTPQGEPVPTNKRHMAAQIFSDPKVTAQVPWFGIEQEYTLMQRDVNWPLGWPVGGYPGPQGPYYCAVGSDKSFGRDISDAHYKACLYAGIEISGTNGEVMPGQWEYQVGPSVGIDAGDHIWASGYILERITEQAGVVLTLDPKPIQGDWNGAGCHTNYSTLSMREDGGFDVIKKAILNLSLRHDLHIAAYGEGNERRLTGLHETASISDFSWCVANRGCSIRVGRETEAKGKGYLEDRRPPSNMDPYTVTALLAETTILWEPTLEAEALAAKKLALKV

SEQ ID NO: 23523 - protein, 123 aa, Triticum aestivum
  misc_feature (87)..(87): Xaa can be any naturally occurring amino acid
MASPATPRPALIRPRASRSRSQLGAVSLASDHAAATASSGRRRDFVFVVNPSGANGRTGKQWKQLLPFLHTRLADQCNICQCITSGXPSHAIDVTTEAIKDGADAVIPVGGDGTLHEVVNGFF

SEQ ID NO: 23524 - protein, 144 aa, Triticum aestivum
MGPGVLVPRSAVPYASFARGRGRSASGRRSRNLVLSASFSNGAAVPSLTTDSEKKGPVIMEIPLDQIRRPLMRTRANDPVKVQELMDSIRVIGLQVPIDVLEVDGVYYGFSGCHRYEAHQRLGLPTIRCKVRRGTKETLRHHMR

SEQ ID NO: 23525 - protein, 247 aa, Pseudomonas syringae
MSQVNMRDMLKAGVHFGHQTRYWNPKMGKYIFGARNKIHIINLEKTLPMFNEALTFVERLASGKNKILFVGTKRSAGKIVAEEAARCGSPYVDHRWLGGMLTNFKTIRQSIKRLRELEVQAEDGTFAKLTKKEALMRTRDLEKLDRSLGGIKDMGGLPDALFVIDVDHERIAITEANKLGIPVIGVVDTNSSPEGVDYIIPGNDDAIRAIQLYMGSMADAVIRGRNNVAGGTDVFVEEAPAAAAVEG

SEQ ID NO: 23526 - protein, 97 aa, Brassica napus
MMVHTMHRESPDKGLDSGKYVRYTPEQVEALERVYTECPKPSSLRRHQLIRESPILSNIEPKQIKVWFQNRRCREKQRKEAARLQTVNRKPNALNKL

SEQ ID NO: 23527 - protein, 482 aa, Vibrio angustum
MKGDIGVIGLAVMGQNLILNMNDHGFNVVAYNRTVAKVEEFLEGPAKGTNIVGATSLEDLVAKLEAPRKVMLMVRAGDVVDAFIDQLIPLLDEGDIIIDGGNTNYPDTNRRVAHCREKGIYFIGTGVSGGEEGARFGPSIMPGGAPEAWEAVKPIFQGISAKTDAGEPCCDWVGNDGAGHFVKMVHNGIEYGDMQLITEAYQFMKDGLGMSADEMQAVFADWNKTELDSYLVEITADILGYKDEDGEALVEKILDTAGQKGTGKWTGINALDLGIPLTLISESVFSRCLSALKDQRVEAATLFGKTITPVEGDKQEWVDALRQALLASKIISYAQGFMLMREASNENGWDLNYGNVALMWRGGCIIRSAFLGNIRDAYEANPDIAFLGSDEYFKNILQGSLAAWRKVAAKSLESGIPMPCTISALSFLDGYTTARLPANLLQAQRDYFGAHTYERTDRPRGEFFHTNWTGTGGNTASTTYDV

SEQ ID NO: 23528 - protein, 415 aa, Arabidopsis thaliana
MEVFRLGELRHLLVTVFLSGLAEYLIRPVMTDVTVAAVCSGLDDSCSLAVYLTGVQQVTVGMGTMVMMPVIGNLSDRYGIKAMLTLPMCLSVLPPAILGYRRDTNFFYAFYVIKTLFDMAKNVHGTKRISMFGILAGVSSISGVCASLSARFLSIASTFQVAAISLFIGLVYMRVFLKERLQDADDDDEADSGGCRSHQEVHNGGDLKMLTEPILRDAPTKTHVFNSKYSSWKDMYFLKARFGFNKNDFAELFLLVTIIGSISQLFILPTLSSTIGERKVLSTGLLMEFFNATCLSVAWSPWVPYAMTMLVPGAMFVMPSVCGIASRQVGSSEQGKVQGCISGVRAFAQVVAPFVYSPLTALFLSENAPFYFPGFSILCIAISLMIGFLQSLLIKDHPSLPLVNITINNPSKAEA

SEQ ID NO: 23529 - protein, 348 aa, Zea mays
PPMAAGGGAPWAERARVVGTQIRNRFRVAPVDHRSLWLRADGRVATEAVRRWSDRVRALLQRGRSADRNSTSTETSPEAVAKPSSSVLRFYRKRVGKEVNGIEDSVIFRSLQALAVPLIGNACYVFMHGLNSVQVYGVEKLHQALHGRPKGKALLTVSNHVAAMDDPFVIASLLPPSVMLEAQKLRWTLCATDRCFTNPVLSTFFRSVKVLPVSRGDGIYQKGMDMALSKLNSGGWVHIFPEGSRSRDGGKTIAPAKRGVGRLVMDADSLPVVIPFVHTGMQDIMPVGKRIPRAGKRVIVVVGDPINFDDLLIDNCGDTQDIPRGILYDKVTQRIGQRLQELKVEVAD

SEQ ID NO: 23530 - protein, 606 aa, Zea mays
MDTHIGSVNGAASNQTVGCPASAPGCPMASTPAQPAATLSAGEASLGRHLARRLVQVGVNDVFAVPGDFNLTLLDHLIAEPGLRLVGCCNELNAGYAADGYARARGVGACAVTFTVGGLSVLNAIAGAYSENLPVICIAGGPNSNDYGTNRILHHTIGLPDFSQELRCFQTVTCHQAVVNNLDDAHEQIDTAIATALRESKPVYLSISCNLPGLPHPTFSRDPVPFFLTPRTSNKMGLEAAVEATVEFLNKAVKPVLVAGPKLRVAKAGKAFVDMVDASGYAYAVMPSAKGLVPETHPHFIGTYWGAVSTAFCAEIVESADAYLFTGPIFNDYSSVGYSFLLKKEKAIIVQPERVIVGNGPAFGCVMMKEFLSELAKRVNKNTTAYENYKRIFVPEGQPLESEPNEPLRVNVLFKHVQKMLTGDSAVIAETGDSWFNCQKLKLPEGCGYEFQMQYGSIGWSVGALLGYAQGANHKRVIAFIGDGSFQVTAQDVSTMLRCEQNSIIFLINNGGYTIEVEIHDGPYNVIKNWNYTGFVDAIHNGEGKCWTSKVKSEEELTAAIETALGEKKDCLCFIEVIAHKDDTSKELLEWGSRVSAANSRPPNPQ

SEQ ID NO: 23531 - protein, 561 aa, Pseudomonas fluorescens
MSESFAELFEESLKTLNLQAGSIITGVIVDIDYQARWVTVHAGLKSEALIPLEQFYNDAGELNINVGDEVHVALDSVEDGFGETKLSREKAKRAECWIVLEAAFAAEEVVKGVINGKVKGGFTVDVNGIRAFLPGSLVDVRPVRDTTHLEGKELEFKVIKLDQKRNNVVVSRRSVLEAENSAEREALLESLQEGQQVKGIVKNLTDYGAFVDLGGVDGLLHITDMAWKRIKHPSEIVNVGDEIDVKVLKYDRERNRVSLGLKQLGEDPWVAIKARYPEGTRVTARVTNLTDYGCFAELEEGVEGLVHVSEMDWTNKNIHPSKVVQVGDEVEVMVLDIDEERRRISLGIKQCKSNPWEDFSGQFNKGDKISGTIKSITDFGIFIGLDGGIDGLVHLSDISWNEVGEEAVRRFKKGDELDTVILSVDPERERISLGIKQLESDPFSEYVSVNDKGAIVKGTVKEVDAKGAIIVLADDIEATLKASEISRDRVEDARNALKEGQEVEAKIISVDRKSRQISLSIKSKDDAEEKEAIQSLKAAPEGEAADTTMAALLRQAMAKQN

SEQ ID NO: 23532 - protein, 638 aa, Aspergillus oryzae
MPASIALIEDEDIGDSSTLERNTHGIRIPSSNPPDLPPDLDVFSRGNSAGPTGYLIDAYSVNRLRPASFSARFRQAGGVNSIDSFARSWQRAAGFPEIIPRRPSFVTVEPDEDCIVNDTAESRDRRSLGGDTDITRPLLAADTEEEGCDLDGRSPPKGIASIFGSSLDRSTGTSYGTISSRVSEATRRHAVQLHREQQARLDAPAIEDTESLLVKQVHHEDGTRESIVVGQSTVPQTIFNSVNVLIGIGLLSLPLAMKQAGWLLGLTFLSFAAVVTSYTARILARCLDVDRSLVTYADLAYISFGNHARLVTSLLFCLELIGACVALVVLFADSLQALIPGLSSLQWKLICGFMLIPLNFVPLRLLSVTSILGIISCTSIVMLICLDGLLKPNGLGSLHEPATTSLFPNNWRTVPLSFGLIMSPWGGHGVFPNIYRDMRHPSKYGKSLIYLTYYAQQYSLDCAMAIVGWVMFGEEVRDEITANILLTNEYPRGISICIIIFIAIIPITKVPLNCRPLVATVEVLCGLGPHVGLAPENPKSTQATIRQSLQAIIRLLVVAVIVLMAILCPSFDRIMALMGSALCFTICIILPLAFYLKIFGQEISRKEWFLDWLLLLISTVLAIVGTAWAFLPENMISV

SEQ ID NO: 23533 - protein, 107 aa, Trichodesmium erythraeum
MAIKKKFNNFDELLAGSDLPVLVDFYATWCGPCKMMTPILEQVNQQIKDKLRIVKIDTDKYPQLASRYHIESLPTLVLFKNGQPVDRIEGVIQSPQLVERLNKMTSI

SEQ ID NO: 23534 - protein, 489 aa, Myxococcus xanthus
MLLAAPWPRRLVLEPRHRMRIAVIATYTHPTRLRLKEPSIMQSSVPELIAGLCPPHVEVEIFNEKERDIPMDRHWDLVFFSYLHSFYEHTKVLSTLFRQRGMTTVAGGRHASYFPDDAQQYFDAVITGEPEANVPALIEDFEKGQLQPRYQRPPLGPAAIRPYRYDLIDFTHNKLRLPGIEASRGCPFSCNFCVLTGNERYRYRPVAHVIDEIQQHMHWNPNFMGLMDDAFVFLDNNLGGSPKYLRELCEALIPLKKTWGCALTFNVLKDESLVKLMAKAGCRYVYTGLESLNPDSIKAMNKGQNKLSEVDAVIRRVFSAGILLSFGLIVGSDGDTNAYLEKLPEYLSDLQYFSVTFLGIVCPYPETPFFRELQAENRLLPGTLSRDYDGYTLCHRPKSLDTSEVVEHFHRLCAQLGSLPNIARHYWSKLTMSDMPRYKQTILFSGPEIVSIRNPVKNTARRYIAGQDALEYWDTQQMAQLGLQPQRLT

SEQ ID NO: 23535 - protein, 591 aa, Saccharomyces cerevisiae
MVRDLVTLPSSLPLITAGFATDQVHLLIGTGSTDSVSVCKNRIHSILNAGGNPIVVNPSSPSHTKQLQLEFGKFAKFEIVEREFRLSDLTTLGRVLVCKVVDRVFVDLPITQSRLCEEIFWQCQKLRIPINTFHKPEFSTFNMIPTWVDPKGSGLQISVTTNGNGYILANRIKRDIISHLPPNISEVVINMGYLKDRIINEDHKALLEEKYYQTDMSLPGFGYGLDEDGWESHKFNKLIREFEMTSREQRLKRTRWLSQIMEYYPMNKLSDIKLEDFETSSSPNKKTKQETVTEGAVPPTDENIENGTKQLQLSEVKKEEGPKKLGKISLVGSGPGSVSMLTIGALQEIKSADIILADKLVPQAILDLIPPKTETFIAKKFPGNAERAQQELLAKGLESLDNGLKVVRLKQGDPYIFGRGGEEFNFFKDHGYIPVVLPGISSSLACTVLAQIPATQRDIADQVLICTGTGRKGALPIIPEFVESRTTVFLMALHRANVLITELLKHGWDGDVPAAIVERGSCPDQRVTRTLLKWVPEVVEEIGSRPPGVLVVGKAVNALVEKDLINFDESRKFVIDEGFREFEVDVDSLFK

SEQ ID NO: 23536 - protein, 554 aa, Shewanella oneidensis
MCSIFSILDIQSDAKELRQVALEMSKLMRHRGPDWSGIYASDKAILAHERLAIVDIEHGAQPLLTEDGSLILAVNGEIYNHKELKAQLGDKYSYQTNSDCEVILALYQEYGTEFLDKLNGIFAFVLYDKAKDAYLIGRDHMGIIPLYTGRDAAGNLYVASEMKALMPVCKTVEEFQPGQYLYSSDAAAVKYYTRDWQQYDAVKDNGASQEELREALEAAVKRQLMSDVPYGVLLSGGLDSSVISAITQTFAKRRIEDDGETGAWWPQLHSFAVGLKGAPDLIAAKKVADAIGTIHHEINFTFQEGLDAIKEVIYHLETYDVTTIRAATPMYLMARKIKAMGIKMVLSGEGADELFGGYLYFHKAPNAQAFHEELVRKLDKLHLFDCLRANKAMAAWGLEARVPFLDKEFMDVAMRINPEAKMSKDGRIEKHILRQAFEHKLPKEVAWRQKEQFSDGVGYSWIDGLKAHAAEQVDDLQLANAKFRFPYNTPETKEAYFYRCFFEEHYPLPSAAETVPGGKSVACSTPEALAWDESLRGIIDPSGRAVRSVHAASY

SEQ ID NO: 23537 - protein, 173 aa, Brassica napus
MKRETMPSWLELLLATQFFTTCANHLLASRNECNLFCTQCETKPAAFCNYCRSSDHSTHRVIQIRRSSYHDVVRVSEIEDILDVSDVQTYVINSARIVFLNERPQLRASSVPICKAPTSSTHSCETCSRVLLDAFRFCSLGCNLRGLNMEAGMQAMVGNNPRSNGMDHVARID

SEQ ID NO: 23538 - protein, 417 aa, Vibrio cholerae
MMDLTVLGKAAKAASFQLATASTAQKNQALASMADQLEAQSASILAANAKDIALGREAGLSDAMLDRLLLNESRLQAIANDVRNVIKLNDPVGSEIDSRVLENGMSLARRRVPLGVVGVIYEARPNVTIDIAALCLKTGNAAILRGGKETFFSNMELVKVIQSALDKAGLPAASVQYIEKPDRELVTQLLKMDDYVDMIIPRGGAGLHKMCKENSTVPVIIGGFGISHIFVDESADLDKSVAVIENAKVQRPSACNALDTLLVHQAIAKPLLDKLIAKLNGKVAFVAEPKAKALMSSAAELRDAQAGDFDTEWLSYTLGVKVVQDVQEAIEHMREHNASHSDAIMTNDLYNAELFVNTAGSAAVYVNASTRFTDGAQFGLGAEVAVSTQKLHARGPMGLEELTSYKWVGKANYLSRS

SEQ ID NO: 23539 - protein, 206 aa, Arabidopsis thaliana; identical to SEQ ID NO: 429

SEQ ID NO: 23540 - protein, 107 aa, Bacteroides thetaiotaomicron
MKEKKIARDTRNREKLAGDDWVMAEFYATWCPHCQRMQPLIKEFKKEMEGIVEVVQVDVDEESDLANFYTIESTPTFILFRKGEQLWRQSGELTLERLGRAVKEFKS

SEQ ID NO: 23541 - protein, 359 aa, Zea mays
MEEITQHFGVGASSHGHGHGQHHHHHHHHHPWASSLSAVVAPLPPQPPSAGLPLTLNTVAATGNSGGSGNPVLQLANGGGLLDACVKAKEPSSSSPYAGDVEAIKAKIISHPHYYSLLTAYLECNKVGAPPEVSARLTEIAQEVEARQRTALGGLAAATEPELDQFMEAYHEMLVKFREELTRPLQEAMEFMRRVESQLNSLSISGRSLRNILSSGSSEEDQEGSGGETELPEVDAHGVDQELKHHLLKKYSGYLSSLKQELSKKKKKGKLPKEARQQLLSWWDQHYKWPYPSETQKVALAESTGLDLKQINNWFINQRKRHWKPSEEMHHLMMDGYHTTNAFYMDGHFINDGGLYRLG

SEQ ID NO: 23542 - protein, 411 aa, Zea mays
MNALAATSRNFKQAAKLVGLDSKLEKSLLIPFREIKVECTIPKDDGTLASYVGFRVQHDNARGPMKGGIRYHHEVDPDEVNALAQLMTWKTAVANIPYGGAKGGIGCSPGDLSISELERLTRVFTQKIHDLIGIHTDVPAPDMGTNSQTMAWILDEYSKFHGYSPAVVTGKPVDLGGSLGRDAATGRGVLFATEALLAEHGKGIAGQRFVIQGFGNVGSWAAQLISEAGGKVIAISDVTGAVKNVDGLDIAQLVKHSAENKGIKGFKGGDAIAPDSLLTEECDVLIPAALGGVINKDNANDIKAKYIIEAANHPTDPEADEILSKKGVLILPDILANSGGVTVSYFEWVQNIQGFMWDEEKVNAELRTYMTRAFGDVKQMCRSHSCDLRMGAFTLGVNRVARATVLRGWEA

SEQ ID NO: 23543 - protein, 444 aa, Vibrio parahaemolyticus
MSVYHTLCFLSAAAMLIAFVNSKIGKMQTTIAITAGSMVLSLLILIAGQNNWFHLTEIATETVTRINFEDFLLKGILGFLLFAGGLGIKLPNLKDQKWEITVLALGATLFSTFFIGFVLYGLCMLIGIQFDLVYCLLFGALISPTDPIAVLAIVKKLDAPKRISTQIEGESLFNDGFGLVIFVTLFTIAFGSEAPTVGSVTLLFIQEAIGGIVYGFLLGLVFHYLISATDDHSMELLLTIGVPTAGYAFAEYIHVSGPLAMVVSGIMIGNWTRFIGFSKESEDHLDHFWELVDEFLNGVLFLLIGMSMLLFKFHEEDWIMMAIAVPLVLASRYLSVFISYIGFKRYRKYNPWSVKILTWGGLRGGLALAMALSIPSGIWVVQDKLIDVKEIILVMTYSVVVFSILIQGSTITPMIEKAKAEEKKMEDEKLAQSSLAEQREQTEA

SEQ ID NO: 23544 - protein, 310 aa, Rickettsia prowazekii
MKITTKVLIIGSGPAGLSAAIYTARSALKPILINGMQPGGQLTMTTDVENYPGFAETIQGPWLMEQMSMQAKNVGTEIISDYVERVDLSKRPFKIFTGTGNEYEADSIIICTGAESKWLGIASEQEFRGFGVSSCAICDGFFFKNQEIVVVGGGNSALEEALYLTNHANKVTVVHRRNSFRAEKILQDRLFKNPKISVIWDHIIDEIVGSNKPKAVTGVKIQNVYTNEINLVNCSGVFIAIGHAPNTALFKGQIAIDDDNYIVTQSGSTRTNVEGVFAAGDVQDKIYRQAVTAAASGCMAALEVAKFLNK

SEQ ID NO: 23545 - protein, 1023 aa, Vibrio parahaemolyticus
MKRMLINATQKEELRVALVDGQRLFDLDIESPGHESKKANIYKGRITRIEPSLEAAFVDYGAERHGFLPLKEIAREYFPEGYTYQGRPSIKEVLTEGQEVIVQVEKEERGSKGAALTTFISLAGSYLVLMPNNPRAGGISRRIEGDERTQLKAALSTLELPQGMGLIVRTAGVGKSAEELEWDLNVLLNHWSAIKGAADSNPAPFLIHQESNVIVRAIRDYLRRDIGEILIDSNTIYERAKEHIQLVRPDFINRVKKYEGEVPLFSHYQIESQIESAFQREVRLPSGGSIVIDPTEALTSIDINSARATKGGDIEETALNTNLEAADEIARQLRLRDLGGLVVIDFIDMTPVRHQREVENRLREAVRLDRARVQIGRISRFGLLEMSRQRLSPSLAEASHHICPRCSGTGVVRDNESLALSVLRLIEEEALKDNTAQVLAVVPVPIASYLLNEKRRSVNHIERIQEVKITVVPNSDMETPHFEVIRVREGEEFDLISYLLPKKLEAMKEAEGKEPSETDIKPKRIEEPVLKGFAAPAQTAPAPVSKPAPVAKKKEVEQEAKPGLFSRLFKALGSFLFGGSEEVKEEPKQEEKKSNRDNKRNKRDRNDRRRSNQRDNREGRENRDNRRRRKPREEQANEQNEAQQPANKQQPNRSQKRKPKPQQAEKAQEPKANAKVAEKGLQLAAEARSEVKPEENKAKANAKTEKVKERRQRRKLNKSVRVKDQLADEQVEETAVKAIEPVESQVDQAVDTAADAQQDNKQGESKQRRNRRSPRHLRASGQRRRRGRDRRPNPFRLRKGGVASPEMAMGKVMPRYIPKPAPKKEERVQEETVVAIATVPAMQGGFACPEMAMGKVIIRREQPAVAEAPVVEPKVQETVEAKAESPIVEAVAPEKAEPVAVDQAPVEPIVEVAEAPVAEATTETVVEEAPVQEPVVAETVEEAATEVAVETPVAAPEMKAEVINVVAKPRASAPMTKAPGPQELREIEVAAAPFKAERYQAKGAGSQVATNRASAAMTKPNFN

SEQ ID NO: 23546 - protein, 609 aa, Acidobacteria bacterium
MPFDDPNVTSSTEQSEEHGAAASQQPVAVQAHNPPEAKPTAGRPRNEENMTEDFATALESFEQEQSEQALNEDRVLVGRVLSITPQYVVVDVGLKSEGVVPIEEVKDHDGNVSFQPGEEIAVMQEKGHTEEGYVHLSHQKAQRLKAWDEIEKAYNDKSSIKARAIDRIKGGLTVDIMGARAFLPGSQVDLRPVRNLDALKGHELEVRIIKLNKKRGNIVVSRKQILEEEQNDKKSKTLEHLNEDAVLTGTVKNLTDYGAFVDLGGIDGLLHITDMSWGRLTHPRDLVQVGDQIQVKVLKFDRDKQRVSLGFKQLTPDPWLDASERYPIGARVHGRVISVTDYGAFIELEQGIEGLVHVSEMTWSKRMKHPSKIVNVGDQVDAVVLNVNPQERRISLGLKQLETNPWESLHEKFPVGGVVEGKVRNLTDFGAFIEIEDGIDGLVHVSNLSWTKRVKHPSEVLKKGDKVKAVVLAIEPDNRRLSLGVKQLQPDVWETFFETHRVGDIIHGKVLRLASFGAFIEIADGVEGLCHNSEASDEHGAPLKLEPGQEFDFKIIKMNPDEKKVGLSLRAVGEEASRVEIENYKAPASSSPGAATIGELLSWKREQQD

SEQ ID NO: 23547 - protein, 227 aa, Oryza sativa
MAMAMSAVRGDFAADRAECADKLMALSTCLTFVQDGASGGAAAPTPDCCSGLKAVLAASRKCLCVLIKDRDDPNLDLKINVTKALSLPQLCNAPANISDCPRLLNLPPNSKDAQIFEQFAKQQAAMQGSPSASPGGSAANQISFGDLTPQAVDVNMSIKSKYNMGEQTFSHQGGSSAPAAGAQKSGAAVLRWLGVDGVGGGGARAVALLLFLLSSAVAVAAPLLLVF

SEQ ID NO: 23548 - protein, 141 aa, Saccharophagus degradans
MIVRLNEYGYGQGDASYKAAGEIEGITRLVDAFYHFMDTLPEAAKLRSMHAQSLAESRKKLAYFLSGWLGGPRLYAQHFGSINIPGAHRHLAATPEDADAWMLCMAKAVDLQPYEPSFKQYLLQQLRVPADRIVEAGRKPL

SEQ ID NO: 23549 - protein, 253 aa, Brassica napus
  misc_feature (8)..(8): Xaa can be any naturally occurring amino acid
WENPGDSXTLVQDRQRLRFVEKAAVITDPNELNEEGKAKNNWRLCSVEQVKNLKCVTGILPVWVTGIACFMLTDQQNIYGILQAIQMEKTFGHNFQVPAGWMNLVSMITLAVWISLYECVILPIARQITGRKQRLNMKQRIQIGIVMGIACMLVAGFLEKARREAALKKGSFVSPVSIVMLLPQFMLAGLTEAFSAVALMEFLTVKMPEHMRAVAGAIFFLSSSIASYICPLLINVIESVTPKEGRSWLGNKD

SEQ ID NO: 23550 - protein, 101 aa, Brassica napus
  misc_feature (27)..(27): Xaa can be any naturally occurring amino acid
  misc_feature (49)..(49): Xaa can be any naturally occurring amino acid
  misc_feature (51)..(51): Xaa can be any naturally occurring amino acid
  misc_feature (60)..(60): Xaa can be any naturally occurring amino acid
  misc_feature (63)..(64): Xaa can be any naturally occurring amino acid
  misc_feature (70)..(70): Xaa can be any naturally occurring amino acid
  misc_feature (72)..(72): Xaa can be any naturally occurring amino acid
  misc_feature (74)..(74): Xaa can be any naturally occurring amino acid
  misc_feature (77)..(77): Xaa can be any naturally occurring amino acid
MGTPESSREPCPDRILDDIGGAFGMGXVGGSAFHFLKGTYNSPKGSRLXGXPNKPLPMNXPRXXGSFAAXRXSXSPXLCLATMFPPSPTTRLHTLPTIHPH

SEQ ID NO: 23551 - protein, 255 aa, Methanosarcina barkeri
MSGNYGKVYLVGSGPGDPELLTLKARRLIDSAEVIVYDQLPGKAILDSMPASAEKINVGKYAGSHTMTQAEINEVLVQKAKEGKMVVRLKGGDPYVFGRGGEEAEVLVAEEIEFEVVPGITSAIAVPAYAGIPVTHRESTSMVTFITGHEDPTKEESGLDWETLAKFGGTIVILMGVKMLGRNAEELMKHGKAPDTPVAVIERGTRADQRVTVGTLANIASLAEERKVKAPAITVVGDVVHLHDILGEQRTGVDF

SEQ ID NO: 23552 - protein, 117 aa, Zea mays
  misc_feature (110)..(110): Xaa can be any naturally occurring amino acid
MATVDLEKLRMSGAGKAIGVLTSGGDAQGMNAAVRAVTRMGIYVGAKVFLIYEGYEGLVEGGENIKPANWLSGSDIMQLGGTIIGSARCKAFTTREGRLAAGYTLLRRGXTNLCVIG

SEQ ID NO: 23553 - protein, 93 aa, Medicago truncatula
MGFRIAKLIRMPSFSKTQESTKGLEVPKGYLAVYVGDRMRRFVIPVSYLNQPSFQELLNQAEEEFGYDHPMGGLTIPCSEDEFQNLTSRLSEL

SEQ ID NO: 23554 - protein, 91 aa, Medicago truncatula
MGFRFSGIIRRASFSANRAVSKAVDMPKGYIAVYVGEKRFVIPISYLNQPLFQDLLSQAEEEFGYDHPMGGLTIPCTEDVFQHITSRSNGL

SEQ ID NO: 23555 - protein, 566 aa, Triticum aestivum
MADDAASAPATAQLAAASISSPPSSDLEPPTSRTRIRAILDAGDAMAGERVVVGGWVKTGRQQGKGEFAFLEVNDGSCQGNLQVMVEKDVHPLAQLTHTGTSVLVEGVLKKPPAEAKQRIELKVERVIELGEVDAAAYPLPKTKITLETLRDFVHLRARTNTIGAVARIRHQLAYATHSFFDENGFLYIHTPIITTSDCEGAGEMFQVTALFSQAEKVEKELKENPAPSEADVEAAKLVVKEKGDAVAQLKAAKASKQEITAAVSVLTKAKENVLRVEERSKLKPGLPLKDDGKIAFENDFFKRQAFLTVSGQLQVETYACALSNVYTFGPTFRAENSHTSRHLAEFWMVEPEIAFANLQDDMNCAERYVQYLCKWLLKHCREDMEFMVKHVDKTAIERLELVSSTPFERISYTKAVEILEGVDKKFENKVEWGIDLASEHERYLTEVIFKKPVIVYNYPKGIKAFYMRLNDDQKTVAAMDVLVPKVGELIGGSQREERLDILKQRILDADLPLEPYEWYLDLRRFGSVKHSGFGLGFERMILFATGLENIRDVIPFPRYPGRADL

SEQ ID NO: 23556 - protein, 355 aa, Pseudomonas putida
MYPKNTWYVACTPDEIATKPLGRRICGEKIVFYRGHENRVAAVEDFCPHRGAPLSLGYVEDGNLVCGYHGLVMGCDGKTVSMPGQRVRGFPCNKTFAAVERYGFVWVWPGDQAQADPALIPHLEWAVNDEWAYGGGLFHIGCDYRLMIDNLMDLTHETYVHASSIGQKEIDEAPPVTTVTGDEVVTARHMENIMAPPFWRMALRGNGLADDVPVDRWQICRFTPPSHVLIEVGVAHAGKGGYHAEAQHKASSIVVDFITPETDTSIWYFWGMARNFAAHDQTLTDNIREGQGKIFSEDLEMLERQQQNLLAHPERNLLKLNIDAGGVQSRKVLERIIAKERAPQPQLIATSATPA

SEQ ID NO: 23557 - protein, 208 aa, Unknown
  Mycobacterium sp. MCS
MTDMLTGTRRARVERKTKESDIVVDLDLDGTGIVDIRTGVPFFDHMLTSLGSHASFDLTVHATGDIEIEGHHTVEDTAIVLGQALGQALGDKKGIRRFGDAFIPMDETLAHAAVDVSGRPYFVHTGEPDYMVEFTIAGSSAPYHTVINRHVFESLAFNARIALHVRTIYGRDPHHITEAQYKAVARALRQAVELDPRVTGVPSTKGSL

SEQ ID NO: 23558 - protein, 258 aa, Geobacillus kaustophilus
MGKVYLVGAGPGDPELITVKGLKCIQQADVILYDRLINEELLSYAKPDAELIFCGKLPGFHAMQQETINHALVWHAKKGKTVVRLKGGDPFVFGRGGEEAEALAKHGIEFEIVPGITSAIAAAAYAGIPVTHRAFSSSVAFVTGHRRDGSRDEIKWESLAKGIDTIAIYMGVHHLPYICGQLMKYGKAPETPAAVIEWGTTTAQRTVTGTLATIAGIAAKENIQNPSMIMIGDVVRLRANIQWFEPLLASSAAAGATS

SEQ ID NO: 23559 - protein, 103 aa, Ashbya gossypii
MSGRGKGGKGLGKGGAKRHRKILRDNIQGITKPAIRRLARRGGVKRISGLIYEDVRAVLKSFLESVIRDAVTYTEHAKRKTVTSLDVVYALKRQGRTLYGFGG

SEQ ID NO: 23560 - protein, 396 aa, Cryptococcus neoformans
MAGVNVGDDKLVFESSEAVTVAPTFEALNLKEDLLRGIYAYNFEKPSAIQQRAIIPIIRGRDVIAQAQSGTGKTATFSISMLQSIDTNLRETQALVLSPTRELAVQIQTVVLALGDYMNVSCHACIGGTSVGEDIRKLEAGQQVVSGTPGRVFDMIRRRNLRTKDIKMLILDESDELLNKGFKDQIYDIYRYLPPATQVVVVSATLPHDVLEMTTKFMTDPVRILVKRDELTLEGIKQFFVAVEKEDWKFDTLCDLYDTLTITQAVIFCNTRRKVDWLTEKMREANFTVSSMHGEMVQKERDAIMAEFRGGQSRVLITTDVWARGIDVQQVSLVINYDLPTSRENYLHRIGRSGRFGRKGVAINFVTVDDVRILRDIEQYYSTQIDEMPMNVAELT

SEQ ID NO: 23561 - protein, 526 aa, Chlamydophila pneumoniae
MERKRFIDCDSTKILQELALNPLDLTAPGVLSAERIKKFSWLGGGFTFSFATERLDDAILAALISLAEERGLHESMLAMQQGQVVNYIEGFPSEMRPALHTATRAWVTDSSFTGEAEDIAVRSRVEAQRLKDFLTKVRSQFTTIVQIGIGGSELGPKALYRALRAYCPTDKHVHFISNIDPDNGAEVLDTIDCAKALVVVVSKSGTTIETAVNEAFFADYFAKKGLSFKDHFIAVTCEGSPMDDTGKYLEVFHLWESIGGRFSSTSMVGGVVLGFAYGFEVFLQLLQGASAMDQIALQPNARENLPMLSALISIWNRNFLGYPTEAVIPYSSGLEFFPAHLQQCCMESNGKSIVQDGRRVGFSTSPVIWGEPGTNGQHSFFQCLHQGTDIIPVEFIGFEKSQKGEDISFQGTTSSQKLFANMIAQAIALACGSENTNPNKNFDGNRPSSVLVSSQLNPYSLGELLSYYENKIVFQGFCWGINSFDQEGVSLGKALANRVLELLEGADASNFPEAASLLTLFNIKFR

SEQ ID NO: 23562 - protein, 387 aa, Ostreococcus tauri
MLAVGSSAGATRASARAPTSSARSNTRRQAVVCAARRSTKTSAVTFGTTRDEGAIGRRRCVQRTTAAVWKPAARARVVAAAGKLSEMDVKTKTAVYFFLWYFFNIVFNVYNKSTLNVFPYPWLISTLQLAATSLWMLTVWATKIQPKPEVTKAFLLAVAPVAFFHTVGHVSACVSFSKMAVSFTHVIKAAEPVFSVILSGPLLGQTFAPAVWASLIPIVAGCSMAAMKEVSFNITGFQGAMISNVAMVLRNITSKKSLNDFKAIDGINLYGILGIIGLFYLAPAAYMIEGAQWSAGYAAAIAKVGEQKLWQMLFLSGIFYHLYNQVSYQALTNITPVTFSVGNALKRVAVIVASVIYFRNPVSPLNAAGSALALVGAYLYTKASEKK

SEQ ID NO: 23563 - protein, 591 aa, Saccharomyces cerevisiae
MVRDLVTLPSSLPLITAGFATDQVHLLIGTGSTDSVSVCKNRIHSILNAGGNPIVVNPSSPSHTKQLQLEFGKFAKFEIVEREFRLSDLTTLGRVLVCKVVDRVFVDLPITQSRLCEEIFWQCQKLRIPINTFHKPEFSTFNMIPTWVDPKGSGLQISVTTNGNGYILANRIKRDIISHLPPNISEVVINMGYLKDRIINEDHKALLEEKYYQTDISLPGFGYGLDEDGWESHKFNKLIREFEMTSREQRLKRTRWLSQIMEYYPMNKLSDIKLEDFETSSSPNKKTKQETVTEGAVPPTDENIENGTKQLQLSEVKKEEGPKKLGKISLVGSGPGSVSMLTIGALQEIKSADIILADKLVPQAILDLIPPKTETFIAKKFPGNAERAQQELLAKGLESLDNGLKVVRLKQGDPYIFGRGGEEFNFFKDHGYIPVVLPGISSSLACTVLAQIPATQRDIADQVLICTGTGRKGALPIIPEFVESRTTVFLMALHRANVLITELLKHGWDGDVPAAIVERGSCPDQRVTRTLLKWVPEVVEEIGSRPPGVLVVGKAVNALVEKDLINFDESRKFVIDEGFREFEVDVDSLFK

SEQ ID NO: 23564 - protein, 366 aa, Unknown
  Petunia x hybrida
MAPSTLTALAEEKTLQTSFIRDEDERPKVAYNQFSNEIPIISLEGIDDETGKRAEICDKIVKACEDWGVFQVVDHGVDAELISQMTTFAKEFFALPPEEKLRFDMSGGKKGGFIVSSHLQGEVVQDWREIVTYFSYPTRARDYSRWPDKPEGWIAVTQKYSEKLMELACKLLDVLSEAMGLEKEALTKACVDMDQKVVVNFYPKCPEPDLTLGLKRHTDPGTITLLLQDQVGGLQATKDNGKTWITVQPVEGAFVVNLGDHGHFLSNGRFKNADHQAVVNSNSSRLSIATFQNPAPEAIVYPLKIREGEKSIMDEPITFAEMYRRKMSKDLELARLKKQAKEQQLQAEVAAEKAKLESKPIEEILA

SEQ ID NO: 23565 - protein, 386 aa, Zea mays; identical to SEQ ID NO: 527

SEQ ID NO: 23566 - protein, 330 aa, Unknown
  marine gamma proteobacterium HTCC2207
MINYPERLNLAQTPTPFYPLERLSKQLGGPRIWIKRDDLTGAATSGNKVRKLEFLLAEALAKGCDTLITSGGVQSNHCRSVALLGAQLGLKVHLLLRADIEPKPVGNLLLDQLAGATISHYSLDEYRGLNKLFNQWQEHYAALGRKAYAIPTGGSNGTGMWGYIAAAEELSQDFQRHAISPAAIVHATGSAGTQAGLMLGCQLHQINTQVKAYAVCDNAEYFTRKVRGDLEQWQSHYSPQTDISGLVADTSDEYIGPAYGVAGEEVFECIKEVAALEGILLDPVYTGKAFFGMIEDIKKGKFSQWDGDDIVFVHTGGLFGLFAQQHRLGY

SEQ ID NO: 23567 - protein, 1043 aa, Arabidopsis thaliana
MMPVYMDPSQPCQMRPQEYYYQGFGNNSQHMAMDAPPPCHGSCVHGNFPAYWPPCYPPQVPYHQCCMNRSAFHPPHASYAPSCYVHPPFPVGYQPWFDVEKDVPGKHHCGKCSSQMCDLKKDRGVVIEEHEPEIEKGEAVLPVRSTNCPYPIIWIPHENARNQEYRSSLGLGKHNQPPAEVRAPDNMTIQKSFPESWRGCFPFDESSMKSLVQNQDSKKAQNGKTVEAPFDISKFKSLLQGQDMKEAQIQKNKEELGQLTYPTSWVPSRRKRDDVEASESSNEDRKKMQNGKTVEYPFDISMIKSLIQGQDVKEAQNQKNKEEPGQVPYPIFWIPSYGKRKDVEASESKESSNEGRNLESCPSDLHRNEGQITQAKGKEGNFECNVLSDAEEKSSVINIPVANHLQEPRNIPVKLSENHLPKPTEPTKRIAKNEPVKSTKKEQSSSSSEASKLPPVCLRVDPLPKERNGGSKSVSHPKRMEKSKETKIAAPLSSKKAESRTVPEACNVKCEDANAEMKMAEGSLNALRTEKGSVESNSNLQEESNGEIIKPCEAKENREQPAKKSFTEEEAARIIQSMYRGYDVRRWEPIKKLKEIATVREQMGDVKKRIEALEASTDQHIEEKEIVVNGELVMNLLLKLDAVEGLHPSIREFRKALATELSSIQDKLDSLKNSCASAEKEAVKEQVEIKSQPSDSPVNLEHSQLTEENKMVSDTNLEKVLRLSPEEHPMSVLNRTDEKQAESAAETEEGYGLFETLATDSKQATENAAAASSTTIPEKIGEVETVVPGNPPSADGNGMTVTNVEENKAMVVESLEEPINELPQMVEETETNSIRDPENASEVSEAETNSSENENRKGEDDIVLHSEKNVELSELPVGVIDEETQPLSQDPSSSYTREGNMTAMDPKTASQEETEVDHSPNNSKGIGQQTSEPQDEKEQSPETEVIVKEQPLETEVILNEQAPEPEITEPGISKETKKLMEENQRFKETMETLVKAGREQLEVISKLTSRVKSLEKKLSHKKKTQIRRRASKPMSVSPTDAVL

SEQ ID NO: 23568 - protein, 257 aa, Geobacillus kaustophilus
MFLPSFRLDGKTALVTGAGRGIGRAIAIGFAEAGADVALIARTEADLQETASHIEQFGRKAYIYPLDVIDRKAVHDAVANVKQQAGSLDIVVNNAGMNIRTPALDVTDHEWETIMNTNLKSAFLVSQEAGRVMKEQKQGGNIINIASVAGHVALRTGVVYAATKAALIQMTKVLAFEWGRYGIRVNAIGPWYFRTPLTKTLLEDEAYVNDILAVTPLKRIGELPELVGPAVFLASDASSYITGQTLFVDGGMTIHGF

SEQ ID NO: 23569 - protein, 143 aa, Glycine max
  misc_feature (85)..(85): Xaa can be any naturally occurring amino acid
  misc_feature (93)..(93): Xaa can be any naturally occurring amino acid
  misc_feature (122)..(122): Xaa can be any naturally occurring amino acid
MASSMISSPAVTTVNRAGAGMVAPFTGLKSMAGFPTRKTNNDITSIASNSGRVQCMHVWPPVDKKKFETLSYLPYLDNTQLAKEXEYLLKKEXIPYLEFECKHDFIYHKHNRSPGYYNKHYXTIVKLAIYNYTNTSQILRDLQ

SEQ ID NO: 23570 - protein, 395 aa, Oryza sativa
MSSSLLTDLVNLDLSESTDKVIAEYIWIHLILNHHQFLFMVVLLVSLSQNAGSLLSILHLKEVNHTLSGPVDDPSKLPKWNFDGSSTGQATGDDSEVILHPQAIFRDPFRKGKNILVMCDCYAPNGEPIPTNNRYNAARIFSHPDVKAEEPWYGIEQEYTLLQKHINWPLGWPLGGYPGPQGPYYCAAGADKSYGRDIVDAHYKACLFAGINISGINAEVMPGQWEFQIGPVVGVSAGDHVWVARYILERITEIAGVVVSFDPKPIPGDWNGAGAHTNYSTKSMRSNGGYEVIKKAIKKLGMRHREHIAAYGDGNERRLTGRHETADINNFVWGVANRGASVRVGRDTEKDGKGYFEDRRPASNMDPYLVTAMIAETTILWEPSHGHGHGQSNGK

SEQ ID NO: 23571 - protein, 497 aa, Eremothecium gossypii
MFIRRLHTSSRRLTCGEALRACQQTGARSANGQLMLSQHVQEFDPEMYDILTKERSRQKRSITLIPSENFTSVAVMNLLGSEMQNKYSERYPGQRYYGGNQYIDMAESLCQKRALELYGLDPAKWGVNVQSLSGAPANLYAYSAIMEVGDRMMGLDLPHGGHLSHGYQLQNGNKISYISKYFQTMAYRVDPATGLVDYDTLSETSKLFRPKVIVAGTSAYARVLDYKRFREIADACGAYLLSDMAHVSGLVAAGVHPSPFEYSDIVTTTTHKSLRGPRGAMIFYRKGIRKVTKKGTEIMYDLDKRINFSVFPAHQGGPHNHTISALAVALKQAATPEFKNYQTAVVENAKVFGEELSKRGFSLVSGGTDTHLLLIDLSPMGIDGSRLETILERLNIAANKNTIPGDKSALYPSGLRVGTPAMTTRGFGPAEFGRVAAYINEAVKLAIGLKSQEPVDAKDAKTRLAHFKSFCAESEQVTKLANEVADWVAQYPVPGEL

SEQ ID NO: 23572 - protein, 469 aa, Eremothecium gossypii
MPYHLSESHKKLISSHLSESDPEVDAIIKDEIDRQKHSIVLIASENLTSTAVFDALGTPMCNKYSEGYPGARYYGGNQHIDRMELLCQRRALEAFHVTPDRWGVNVQSLSGSPANLQVYQALMKPHERLMGLHLPDGGHLSHGYQTETRKISAVSTYFESFPYRVDPETGIIDYDTLEKNAVLYRPKILVAGTSAYCRLIDYKRMREIADKVGAYLMVDMAHISGLVAAGVIPSPFEYADIVTTTTHKSLRGPRGAMIFFRRGVRSVHPKTGEEVMYDLEGPINFSVFPGHQGGPHNHTISALATALKQATTPEFREYQELVLKNAKVLETEFKKLNYRLVSDGTDSHMVLVSLREKGVDGARVEHVCEKINIALNKNSIPGDKSALVPGGVRIGAPAMTTRGMGEEDFARIVGYINRAVEIARSIQQSLPKEANRLKDFKAKVEDGTDEIAQLAQEIYSWTEEYPLPV

SEQ ID NO: 23573 - protein, 91 aa, Medicago truncatula
MGFRIAKLIRKPSFSSTQASSKGFEVPKGYLAVYVGDKMRRFVIPVSYLNQPSFQELLNQSEEEFGYDHPMGGLTIPCSEDEFQNLTSRMN

SEQ ID NO: 23574 - protein, 92 aa, Medicago truncatula
MGFRVPSIIRKSSFSASRVISKVVDVPKGYLAVYVGKQKRFVIPISYLNQPSFQDLLSQAEEEFGYDHSMGGLTIPCTEDVFQHITSRLNGI

SEQ ID NO: 23575 - protein, 695 aa, Haloarcula marismortui
MHHPGPPRFATVGESVELAPRQPDPGMAAEWRLVERPAASTATLGDGPVCHLEPDVPGVYRAELIVPDGTHEQVIRAFPGVTETARFSVTADDFDGDELTVADRAIVIGTFNDFTMGTHWAERDGDEWVIEADLPPGTHHAIFSFDGSFESTATDEVTVEGPGRPRVELTSQAEDGDFVVSADARAAPSGSEPEVEFYLDGRDALEESAVTIDGDELRVPHEALPEMARVHAVAVAERHSVADTLVVERGGENGETGTGETVSVSRPADPPAWAGDATIYEIFVRSFAGETVDTTFEAIERRVPYIESLGVDVVWLTPVQASPTRHGYHITDFFDTAEDLGTREEFESLVDRLHDAGIRVVFDLVINHSSRDHPAFQLHRAGVPEYADYYERIPVSQDVSDVDWAGTDAPGYYFNWTRIPNLNYDSLAVRRWMLDVVDEWRDVVDGFRCDVAWGVPHGFWKEVRERVKADDPEFLLLDETVPRDAAFAENEFDVHYDTDLFDTLRDIGTGEEPASVLFEALDATAEHGYPDRAGHMRYVDNHDEDRYLDECGAASLQAAVGATFTLPGTPMVYAGQERGVEQQRGTMRWHDGDNALTDFHRRLVALRADHAALRVPGVCPVAHTVETGDADRVVAYERTDGDETLVVVLHFGDGTAKVSLDTIDEETDLLSGNPVGGDGTVEVGDIVVVPATRER

SEQ ID NO: 23576 - protein, 351 aa, Glycine max
MAAMATTTLSSNPKLSFFNGKPVTYSSRVAPTTKLSSSKQGTISMSLTPPPYDLQSFKFQPIKESIVSREMTRRYMTDMITYADTDVVIVGAGSAGLSCAYELSKNPAVSVAIVEQSVSPGGGAWLGGQLFSAMVVRKPAHLFLDELGVAYDEQEDYVVIKHAALFTSTIMSRLLARPNVKLFNAVAAEDLIVKEGRVAGVVTNWALVSMNHDTQSCMDPNVMEAKVVVSSCGHDGPFGATGVKRLKSIGMIDSVPGMKALDMNAAEDAIVRLTREIVPGMIVTGMEVAEIDGSPRMGPTFGAMMISGQKAAHLALKALGRNNAIDGTCGVGREEPQLILASADTEEIVDA

SEQ ID NO: 23577 - protein, 245 aa, Solanum lycopersicum
MASNTLMSCGIPAVCPSFLSSTKSKFAAAMPVSVGATNSMSRFSMSADWMPGQPRPSYLDGSAPGDFGFDPLGLGEVPANLERYKESELIHCRWAMLAVPGIIVPEALGLGNWVKAQEWAAIPGGQATYLGQPVPWGTLPTILAIEFLAIAFVEHQRSMEKDSEKKKYPGGAFDPLGYSKDPAKFEELKVKEIKNRLALLAFVGFCVQQSAYPGTGPLENLATHLADPWHNNIGDVIIPKGIFPN

SEQ ID NO: 23578 - protein, 783 aa, Aspergillus niger
MAPPQAPVQPPKRRRIGVLTSGGDAPGMNGVVRAVVRMAIHSDCEAFAVYEGYEGLVNGGDMIRQLHWEDVRGWLSRGGTLIGSARCMTFRERPGRLRAAKNMVLRGIDALVVCGGDGSLTGADVFRSEWPGLLKELVETGELTEEQVKPYQILNIVGLVGSIDNDMSGTDATIGCYSSLTRICDAVDDVFDTAFSHQRGFVIEVMGRHCGWLALMSAISTGADWLFVPEMPPKDGWEDDMCAIITKNRKERGKRRTIVIVAEGAQDRHLNKISSSKIKDILTERLNLDTRVTVLGHTQRGGAACAYDRWLSTLQGVEAVRAVLDMKPEAPSPVITIRENKILRMPLMDAVQHTKTVTKHIQNKEFAEAMALRDSEFKEYHFSYINTSTPDHPKLLLPENKRMRIGIIHVGAPAGGMNQATRAAVAYCLTRGHTPLAIHNGFPGLCRHYDDTPICSVREVAWQESDAWVNEGGSDIGTNRGLPGDDLATTAKSFKKFGFDALFVVGGFEAFTAVSQLRQAREKYPEFKIPMTVLPATISNNVPGTEYSLGSDTCLNTLIDFCDAIRQSASSSRRRVFVIETQGGKSGYIATTAGLSVGAVAVYIPEEGIDIKMLARDIDFLRDNFARDKGANRAGKIILRNECASSTYTTQVVADMIKEEAKGRFESRAAVPGHFQQGGKPSPMDRIRALRMATKCMLHLESYAGKSADEIAADELSASVIGIKGSQVLFSPMGGETGLEATETDWARRRPKTEFWLELQDTVNILSGRASVNNATWSCYENA

SEQ ID NO: 23579 - protein, 170 aa, Cenarchaeum symbiosum
MHGANYRRSNGQPYTRKEYIKGKPQSKISKFQNGSPGDYDYCVQLLINEKVQIRHMAIESARLAANKTIEKATGESGYFSRLRIYPHVLLRENKMIATAGADRLQEGMRRAWGKAVSLGARVRQGQVIYEAHVRKEHLEHTKKALKHACVKLPGTPTIRVIQLREIAPAH

SEQ ID NO: 23580 - protein, 93 aa, Medicago truncatula
MGFRIAKLIRMPSFSKTQETAKGLEVPKGYLAVYVGDRMRRFVIPVSYLSQPSFQELLNQSEEEFGYDHPMGGLTIPCGEDAFLQLTSRLSDL

SEQ ID NO: 23581 - protein, 93 aa, Medicago truncatula
MGFRFPGIIRKASFSANRSASKSVDVPKGYLAVYVGEKQTRYLIPVSYLSQPSFQGLLSQVEEEFGYDHPMGGLTIPCTEDVFQHITSCFNGL

SEQ ID NO: 23582 - protein, 91 aa, Medicago truncatula
MGFRIAKLIRMPSFSSTQASSKGFEVPKGYLAVYVGDQMRRFVIPVSYLNQPSFQELLNQSEEEYGYDHPMGGLTIPCSEDEFRNLTSRMN

SEQ ID NO: 23583 - protein, 371 aa, Sesbania rostrata
MSSFFTRTQRFSLAPLLFLLALLTMNLHMADAQIGVCYGMMGNNLPPANEVVGLYRSNNIRRMRLYDPNQAALQALRDSGIELILGVPNSDLQSLATNNDNARQWVQRNVLNFWPSVKIKYIAVGNEVSPVGGSSWLAQYVLPAVQNIYQAIRAQGLHDQIKVSTSIDMTLIGNSFPPSQGSFRGDVRSYLDPIIGYLVYAGAPLLVNVYPYFSYSGNPRDISLPYALFTSPNVVVWDGQYGYQNLFDAMLDAVHAAIDNTKIGFVNVVVSEDGWPSDGGFAATYDNARIYLDNLIRHVGKGTPRRPWPTETYLFAMFDENQKSPEIEKHFGLFNPSKQKKYPFGFGGERNYRQVVVDDEFNGTVPLKSDM

SEQ ID NO: 23584 - protein, 93 aa, Medicago truncatula
MGFRFAGIIRKASFSANRSASKAVDVPKGYLAVYVGEKQKRYVIPISYLNQPSFQDLLSQFEEEFGYDHPMGGLTIPCTEDVFQHMTSRLNGL

SEQ ID NO: 23585 - protein, 392 aa, Oryza sativa
  misc_feature (210)..(210): Xaa can be any naturally occurring amino acid
MSMSLADSWGSAPASPIGFEGYEKRLEITLSDAPVFVDPCGRGLRALSREQIDSFLDLAKCTIVSHLSNKHFDSYVLSESSLFVYPHKVVLKTCGTTKLLLSIPRILELAAELSLPVLSVKYSRGMFIFPGAQPSPHRSFLEEVSVLNSFFGGLKSGGNAYVIGDAFKPKKKWHVYYATEEPEQPMVTLEMCMTGLDAKKAEVFFKDSTXGSCSSAKEMTMFSGISEIIPEMEICDFEFDPCGYSMNGIYGPAVSTIHVTPEEGFSYASYEAMNFNPSSLVYDDLIKKVLACFCPSDFSVAVTIFGGHGFAKSWAKGAEVDSYMCDDLVEQELPGGGVLMYQSFTAVTPGAVSPRSTLDGWNSDGAEMVAKSKEMSVCWEGEKAAKKKDADA

SEQ ID NO: 23586 - protein, 343 aa, Sesbania rostrata
MVNIFLSRGNTAMFAMLLFIGILSFTQVEFTAAQSVGVCYGRNGDNLPTQQETVDLYKSNGIGRMRIYDPDERSLQALKGSNIELILGVPNDKLQSLNDAGAATDWINTNVKAYSSDVKFKYIAVGNEVEPNANEAQYVLPAMRNIQNAISSANLQDQIKVSTAIKSSLVTNSYPPNNGVFSDSASGYIKPIVDFLVSNRAPLLANLYPYFSHVENQQTVPLNYALFTQQGTNDAGYQNLFDALLDSLYAALEKAGASNVNVVVSESGWPSDGGVAANVDNAGTYYRNLINHVKGGTPKRPNGPIETYLFAMFDENRKDGEESEKHFGLFRPDKSPKYQLSYN

SEQ ID NO: 23587 - protein, 339 aa, Sesbania rostrata
MNMFFSRGNTAMSSILLLILLSSTAVFTGAQSVGVCYGGNGNNLPTKQAVVDLYKSNGIGKIRLYYPDEGALQALRGSNIEVILGVPNDKLQSLTNAGAASDWVNRYVKAYSNVKIKYIAVGNEVHPGDAVAGSVLPAMRNIQSAISSANLQGQIKVSTAIDTTLLGNSYPPKDGVFSNSASGYIRPIITFLVNNGAPLLANVYPYFAYVNNQQSIGLDYALFTKQGNNEVGYQNLFDALLDSLYAALEKVGAPNVKVVVSESGWPSEGGTGATVQNAGTYYRNLIRHAKGGTPKRPNGPIETYLFAMFDENQKQGPEIERHFGLFRPDKSPKYQLSFN

SEQ ID NO: 23588 - protein, 283 aa, Sesbania rostrata
MRIYGSDPEVFQALRGSNIELFLDVPNNELEKLSNQANANKWVQDNIKSYNNVKFRYISVGNEVKPDSPSAQFLVPAMQNIQRAISAAGLGNQIKVSTAIETGALQESYPPSKGSFKASYRGAYLDNVIKFLVSNGSPLLVNVYTYFAYDSNPGAINLEYALFTEPSVVVNDGNLGYQNLFDAMVDAAVYSALEKAGGGSLNIVVSESGWPSAGGRNTTLENARTYNTNLVKHVKGGTPKRPNKPIETYVFAMFDENNKEPEYEKFWGLFRPTKQPKYSINLN

SEQ ID NO: 23589 - protein, 223 aa, Zygosaccharomyces bailii
MIGEHKALVQRITNETKIQIAISLNGGHIELPESILDKNPTQENNIATQATTSQVIDIHTGVGFLDHMIHALAKHSGWSLIVECIGDLHIDDHHTTEDCGIALGEAFKQALGQVRGVKRFGCGFAPLDEALSRAVVDLSNRPYAVIDLGLKREKIGDLSCEMIPHFLESFIEAARLTVHIDCLRGFNDHHRSESAFKALAVAIREATAPNGTNDVPSTKGVLM

SEQ ID NO: 23590 - protein, 116 aa, Helicobacter pylori
DPLIAVLFIVALFYLSHYFFASITAHVSALFALFVGIGSHIQGVNLQELSLFLMFSLGIMGILTPYGTGPSTIYYGSGYIQSKDFWKWGFIFGFLYLIVFLSVCVPWVKFIAFRWL

SEQ ID NO: 23591 - protein, 336 aa, Nocardia farcinica
MTRAAVLGAGSWGTAFAKVLADAGTEVTIWARRPEIAEALATEHRNPAYLPDVQLPAVSATHDAEAALDGAQLVVLAVPSQSLRANLTGWRPALRAAIDEHDATLLSLAKGIETGTLLRMSQVIAEVTGAEERRIAVLSGPNLAREIAAGQPAATVIACSDAARAEAVQQASYTGYFRPYTNTDVIGCEIGGACKNVIALACGIAAGMGLGDNSIASLITRGLAEIMRLAVTLGAEPVTLAGLAGVGDLVATCTSPLSRNRSFGHVLGAGGSMEAAQQATHGQVAEGVKSCTSVRALAAAHEVEMPLTDAVHRVCHEGISVREAVGSLLGRRIKPE

SEQ ID NO: 23592 - protein, 1088 aa, Shewanella oneidensis
MKRMLINATQSEELRVALVDGQQLYDLDIESPGHEQKKSNIYKGKITRVEPSLEAAFVDYGAERHGFLPLKEIAREYFPKGYSFQGRPNIKEVVSEGQEVIVQIDKEERGNKGAALTTFISLAGSYLVLMPNNPRAGGISRRIEGDERTELKEAMADLEVPAGMGLIVRTAGVGKESTELKWDLKVLQHHWAAITEAAQTKGAPFLIHQESNVIVRAIRDYLRRDVGEILIDHPRIYEEAKQHIALVRPDFVERVKLYEAEVPLFTHYQIESQIESAFQREVRLPSGGSIVIDPTEALTSIDINSARATKGGDIEETALNTNLEAADEIARQLRLRDLGGLVVIDFIDMTPVRHQREVENRLRDAVHHDRARVQLGRISRFGLMEMSRQRLRPSLEESAAHICPRCHGQGTIRSTESLALSILRLMEEEAIKENTSQIEAIVPVDVAAFLLNEKRKAIRITEQRHDVEVYVIPDPHMMTPDYRVIRHRTDDEIDESSYKRIEQPEAKLYEPRKLERTAAPAPALKGFTAPQKVEQDVAPVAKVEAAKPGLFSKLFSAIGSFFSSSDNAATEKSAETKKSDSQATNANRRNRRNDTRRTRNNQDTEKAKEGSREPRARNAKKVADAPQAQERPIREKDESAKRAKPEAKNRSQAPKEVIADVQDEAPKQEVVRERRQRRNMRRKVRMDNTTDVVETSIQEEAILAEIVAINADAAVEAQPEAKAPRSRRQPRKEVAVANETTDTPATDAADEAKPIDAIADAPIVESQADIQVDPKSEAQLATTDEDNTDVDDKTKRESRDGQRRSRRSPRHLRAAGQRRRRDEDEQSTAAPAQFIPNDALGEDQDYPAPMAIVETVNFADQAVAETVAVEVEVKSVATQPTTVAHTADVTTSYEATFSESKAIDDATSAVAVEQLTDIKADVVDTEIASEPVVNDNATQTVKVSNVIAESSVVIEPTVQTTVVAQTDVRTFDAKAEEVTQATEKAELKEVVKSVASAPMAKPAAIVKPQVKPVVAQASAVQPSEAVVSKPKAASRFGAMVSSEMTKPTVEVRAQVEVPKGREYENTPASEAATKLKHSNSAESDMARP

SEQ ID NO: 23593 - protein, 427 aa, Aspergillus oryzae
MAIAAAVSSNDVLKGVPENVLRELQKMKSMFTINRETLRTVTDKFVTELENGLSSHENEIPMNITWATGRPTGQEQGTFITIDLGGTNLRVCKVELTKQLGGYKITQRKFKLPVQHRQRSVDDLWALVADKLKESLESQHITKGREALPLAITFSYPLTQHNIRRGSCSVGRRAPIFLALRDMPSLPSWSTSLHREDNLPVEIVALVNHTTGTLVATAYQYAQVKVSSIFITGCNPAYIEDCGLVTKIASYDLPAGKEMAIHKGYGAFNNSHSVLPRNVFDEAIESTSRPGQQTYEKMVAALYFGELVRLIILHLHHTTGLFTGCDLSRLDRIHSMESTFLSAMEGGPLGSLGEMQALFRERFNIEPKTKELKICRLVAEIACTRAARLYACGITAICKKKGIEPYHVAVDASTLFGERAAAALREI

SEQ ID NO: 23594 - protein, 382 aa, Vibrio cholerae
MSDMIRDFFKMESAGGILLVIAAAIAMVIANSAMGEGYQAFLHTYVFGMSVSHWINDGLMAVFFLLIGLEVKRELLEGALKSRETAIFPAIAAVGGMLAPALIYVAFNFNDPAAIQGWAIPAATDIAFALGIMALLGKRVPVSLKVFLLALAIIDDLGVVVIIALFYSSDLSTIALTIGFIMTGVLFMLNAKHVTKLSIYLVAGLILWIAVLKSGVHATLAGVVIGFAIPLKGNKGEHSPLKHLEHALHPYVAFAILPVFAFANAGISLQGVSLAGLTSMLPLGVALGLFLGKPLGIFSFSWAAVKLGVAKLPEGINFKHIFAVSVLCGIGFTMSIFISSLAFGQANEAYDTYARLGILMGSTTAALLGYSLLRLSLPLKKA

SEQ ID NO: 23595 - protein, 401 aa, Solanum tuberosum
MAFSAGKSYAFSTNFDPLQQNLWGSKPPISSLSIKDIDFKQCDKHNILSKKPLYISAVLSGFGHADESKEFKSRDPLVQCNAYEASQPQSIPIDIEFGQEAQAAATQKLKIGLYFATWWALNVVFNIYNKKVLNAFPFPWLTSTLSLAAGSLMMLVSWATKIAETPKTDFDFWKALFPVAVAHTIGHVAATVSMSKVAVSFTHIIKSGEPAFSVLVSRLLGETFPLPVYLSLLPIIGGCGLAAITELNFNLIGFMGAMISNLAFVFRNIFSKKGMKGKSVGGMNYYACLSMMSLLILIPFAIAVEGPQVWALGWQNAVSQIGPNFIWWVVAQSVFYHLYNQVSYMSLNEISPLTFSIGNTMKRISVIVSSIIIFQIPIQPINALGAAIAILGTFLYSQAKQ

SEQ ID NO: 23596 - protein, 112 aa, Tortula ruralis
MTAIAKSAAKVTCDGANTSFIISASTAALLALGRFVFLPFQRSMVSRHGLPEQNGVPTTRRVTAVRRRWWSMLKTNDPAGFTLVDVLAWGALGHAVGFFILATATNGYNGFQ

SEQ ID NO: 23597 - protein, 300 aa, Vibrio vulnificus
MSNGKVLAKIEARNPSFSVKCRIGANMIWEAEKEGKLKPGVELVEPTSGNTGIALAFVAAARGYKLTLTMLESMSLERRKLLKALGANLELTEAAKGMKGAIAKAEEIVASNPEKYLLLQQFNNPANPEIHEKTTGPEIWEATDGAIDVFVAGVGTGGTITGTSRYIKGEKGKQILSVAVEPTESPVISQALAGEEIKPAPHKIQGIGAGFIPGNLDLSLIDRVEKVTSEEAIEMARRLMEEEGILAGISSGAAVVAANRLAELPEFEGKTIVTVLPSSGERYLSTALFAGIFTEKENQQ

SEQ ID NO: 23598 - protein, 237 aa, Rhodopseudomonas palustris
MAKDTTGRMRVTVKSGGRMKLSSKLWLERQLNDPYVAQAKRDGYRSRAAYKLTEIDDKFRLLKSGMAVVDLGAAPGGWSQVAAKKVGAADGRGKVVAIDLLEMGEVPGVTFAQLDFLDPSAPERLREMLGGGADIVMSDMAANTTGHRKTDQLRIVGLVETAAMFASEVLKPGGTFLAKVFQSGADASLMTELKRDYASVKHVKPAASRKDSSERYLLATGFRGGAARDAEAAAETE

SEQ ID NO: 23599 - protein, 489 aa, Vibrio angustum
MSTELLINVTPSETRVAMIEHGVLQEIHIERESKRGIVGNIYKGRVSRVLPGMQAAFVDIGLDKAAFLHASDIVPHTECVAENEKKQFQVRDISELVRQGQDIVVQVVKDPLGTKGARLTTDITLPSRYLVFMPGASHVGVSQRIESEKERDRLKKAVLQHCDDLGGFIIRTAAEGANTDEVAQDAAFLKHLWRKVLERRAKYKPRSMLYGELGLAQRILRDFVGTEIDNIKVDSRQAFDKLKEFTDEFVPEVTDNIEYYSGQQPIFDLYDTESEIQRSLDRKVEMKSGGYLIIDQTEAMTTVDINTGAFVGRRNLDETIFNTNIEATKAIARQLRLRNLGGIIIIDFIDMISEEHQQRVLQALEQALSYDRVKTNINGFTQLGLVEMTRKRTRESIEHVLCGTCPSCDGRGTVKTVESVCYEVLREITRVNRAYDADRFIVYVSSAVGEALMGDESHALAELEVFIGKQVKIKPEPLYNQEQFDVVMM

SEQ ID NO: 23600 - protein, 904 aa, Hordeum vulgare
MAVGETGASVSAAEAEAEATQAFMPDARAYWVTSDLIAWNVGELEAQSVCLYASRAAAMSLSPSNGGIQGYDSKVELQPESAGLPETVTQKFPFISSYRAFKVPSSVDVASLVKCQLVVASFGADGKHVDVTGLQLPGVLDDMFAYTGPLGAVFSEDSVSLHLWAPTAQGVSVCFFDGPAGPALETVQLKESNGVWSVTGPREWENRYYLYEVDVYHPTKAQVLKCLAGDPYARSLSANGARTWLVDINNETLKPASWDELADEKPKLDSFSDITIYELHIRDFSAHDGTVDSDSRGGFRAFAYQASAGMEHLRKLSDAGLTHVHLLPSFHFAGVDDIKSNWKFVDECELATFPPGSDMQQAAVVAIQEEDPYNWGYNPVLWGVPKGSYASDPDGPSRIIEYRQMVQALNRIGLRVVMDVVYNHLDSSGPCGISSVLDKIVPGYYVRRDTNGQIENSAAMNNTASEHFMVDRLIVDDLLNWAVNYKVDGFRFDLMGHIMKRTMVTKSALQSLTTDAHGVDGSKIYLYGEGWDFAEVARNQRGINGSQLNMSGTGIGSFNDRIRDAINGGNPFGNPLQQGFNTGLFLEPNGFYQGNEADTRRSLATYADQIQIGLAGNLRDYVLISHTGEAKKGSEIHTFDGLPVGYTASPIETINYVSAHDNETLFDVISVKTPMILSVDERCRINHLASSMMALSQGIPFFHAGDEILRSKSIDRDSYNSGDWFNKLDFTYETNNWGVGLPPSEKNEDNWPLMKPRLENPSFKPAKGHILAALDSFVDILKIRYSSPLFRLSTANDIKQRVRFHNTGPSLVPGVIVMGIEDARGESPEMAQLDTNFSYVVTVFNVCPHEVSMDIPALASMGFELHPVQVNSSDTLVRKSAYEAATGRFTVPGRTVSVFVEPRC

SEQ ID NO: 23601 - protein, 266 aa, Xylella fastidiosa
MPQVTMRQMLEAGVHFGHQTRYRHPKMSPNIFGARGKIHIINLEKTVPLFNDAMNFLSAVAQKRGSVLFVGTKRSARDAIKEEAERCGMPYMIQRWLGGTLTNFRTVKQSVARLKELELAETDGTFSKLVKHEVLRLRRESGKLQASLGGIKDMNRIPDAIFVIDIGHEDIAIKEAKKLGIPVVAVVDTNYDPSLVDYPIPGNDDAIRAVQLYARAAADAVLEGKAAMPNAVAVREEEFASAPDAGKKGRQAQPKKGKRASDAAAE

SEQ ID NO: 23602 - protein, 177 aa, Haloarcula marismortui
MSDKPASMYRDIDKPAYTRREYITGIPGSKIAQHKMGRKQKDADDYPVQISLIVEETVQLRHGSLEASRLSANRHLIKELGEEGDYKMTLRKFPHQVLRENKQATGAGADRVSDGMRAAFGKIVGTAARVQAGEQLFTAYCNVEDAEHVKEAFRRAYNKITPSCRIKVERGEELLIA

SEQ ID NO: 23603 - protein, 1315 aa, Botryotinia fuckeliana
MEDSTIAHTTAILQTLALSSIDLPLTNVYGNKGIRLPGADTAEKLALERELAALVSRVQRLEARAITVNNQTLPDTPNELGAPSAFADVLTGAPSRASKSTTSRQQLVNSLLAAREAPTGGERPPKFTKLSDEELEALREHVDHQSKQLDSQKSELAGVHAQLFEQKQRQEQALNVLEVERVAALERELKKHQQANEAFQKALREIGEIVTAVARGDLSKKVQIHSVEMDPEITTFKRVINTMMDQLQIFSSEVSRVAREVGTEGILGGQAKISGVDGTWKELTDNVNVMAQNLTDQVREIASVTTAVAHGDLTQKIERPAQGEILQLQQTINTMVDQLRTFAAEVTRVARDVGTEGILGGQAEIEGVQGMWNTLIVNVNAMANNLTTQVRDIAIVTTAVAKGDLTQKVQAECKGEIKQLKETINSMVDQLQQFAREVTKIAREVGTEGRLGGQATVHDVEGTWRDLTENVNGMAMNLTTQVREIAKVTTAVARGDLTKKIEVEVQGEIASLKDTINTMVDRLSTFAFEVSKVAREVGTDGTLGGQAQVDNVEGKWKDLTENVNTMARNLTTQVRGISTVTQAIANGDMSQKIEVAAAGEILILKETINNMVDRLSIFSNEVQRVAKDVGVDGKMGGQADVAGIGGRWKEITTDVNTMANNLTTQVRAFGDITNAATDGDFTKLITVEASGEMDELKRKINQMVYNLRDSIQRNTLAREAAEFANRTKSEFLANMSHEIRTPMNGIIGMTQLTLDTDLTQYQREMLNIVHNLANSLLTIIDDILDLSKIEANRMIMEEIPYTLRGTVFNALKTLAVKANEKFLDLTYRVDSSVPDHVVGDSFRLRQVILNLVGNAIKFTEHGEVSLTIQKAEQDHCAPNEYAVEFCVSDTGIGIQADKLNLIFDTFQQADGSMTRKFGGTGLGLSISKRLVNLMRGDVWVKSQYGKGSSFYFTCTVRLATSDISFIQKQLKPYQGHNVLFIDKGQTGHGKEIITMLTQLGLVPVVVDSEQHTILLGNGRTKEKIASTYDVIVVDSIESARKLRSIDEFKYIPIVLLAPVIHVSLKSALDLGITSYMTTPCLTIDLGNGMIPALENRAAPSLADNTKSFDILLAEDNIVNQRLAVKILEKYHHVVTVVGNGQEALDAIKEKRYDVILMDVQMPIMGGFEATAKIREYERSLGTQRTPIIALTAHAMLGDREKCIQAQMDEYLSKPLKQNHLIQTILKCATLGGALLEKGREVRQSANEESPNSQNGPRGAQHPASSPTPAHMRPAIEPRAYTTTGPINHGSAESPSLVTADAEDPLARLLMRAHSS

SEQ ID NO: 23604 - protein, 551 aa, Prochlorococcus marinus
MSRHFDRGSFRAVSDVHQLMSFPDFSASDAHVQWQRFNNLLWHHNDLGIWLDISRMHINAEDFERLGPRFDQAFKAMQALEQGAIANTDEQRMVGHYWLRQPQLAPDQEVCDHIAKEIDLIETFGSNVINGLIKAPNGKKFTDVLWIGIGGSGLGPLLMIRALQNAEQGLRFHFFDNVDPDGMSRVLGNLGDALSTTLVVTVSKSGATPEPHLGMEQARQRLEAMGGHWAGQAVAVTMLNSQLDQLAQKESWLKRFDMFDWVGGRTSITSAVGLLPAALIGCDIRAFLAGAAQMDEATRVSDLHSNPASLMAAAWFVAGDGLGRRDMVVLPYRDRLEVFSRYLQQLVMESLGKRLDRDGNVVHQGLAVYGNKGSTDQHAYVQQLRDGVDNFFATFIEVLEDVENIPAINNEHPGDFLDGFLQGTRAALSQGGRQSLTISMRRFDPRRLGALVALFERAVGLYGELVNINAYHQPGVESGKKAAAAILNLQSRVEDLLADGVERSAGEIHQVIGDGSEEAIFWIMRHLTANKRGYVAEGDWGIPTSLRFSKG

SEQ ID NO: 23605 - protein, 617 aa, Medicago truncatula
MASKPGILTNWPWEPLGSFKFVIVIPWIAHSIYTFIWGERDPVYYIIFPFALVRMLHNQIWTSVSRYQTAKGKNRIVDKGLEFEQVDRETHWDDQMLFTVLVYCIAYFIFPMASNLPWWRIDGVILTAILHAGPVEFLYYWLHRALHHHYLYSRYHSHHHSSIVTEPITSVAHPFAEHLSYFTLFAIPMLTTLFINKSSVAALYGYIFYIDFMNNMGHCNFEFFPKKLLSYFPILKYLSYTPSFHSLHHTKFRSNYSLFMPIYDYIYGTVDKSTDATYEASLMRPKESPDVVHLTHLTTLSSIYQLRLGFTSLASNPQTSKWYLYLMWPFTMCYMLMTWISRRAFVLESNTFNDLKLQCWLLPRFKTQYFSKGQKLTWNNLIEETIIEAELNGAKVISLGLLNQKHQLNAHCELYIRRFPQLKIKVVDGSSLAAATVLNNIPKGTNQVLLRGKFNKVAFAIANALCKKNVQVVVLYKDELKELEQRVVTKGNLALSQVNIPKIWLVGDEWDEDEQLKAPEGSLFIPFSHFPPKKMRKCCFYHFTPAMITPATFMNSHSCENWLPRRVMSAWRIAGIIHALEGWNVHECGDTILSTEKVWEASIRHGFQPLKILTSQG

SEQ ID NO: 23606 - protein, 222 aa, Pichia stipitis
MARTATIKRDTNETKIQIALSLDGGFLAVEESIFKKRKIDDDDEHAKQATSSQVINVQSGIGFLDHMLHALAKHAGWSLIVECIGDLHIDDHHTAEDVGITLGIAFKQALGQVKGVKRFGSGFAPLDEALSRAVVDLSNRPFAVVELGLKREKIGDLSCEMIPHVLESFAQGAHITTHVDCLRGFNDHHRAESAFKALAVAIREAISSNGTNDVPSTKGVLF

SEQ ID NO: 23607 - protein, 376 aa, Solanum dulcamara
MAIDCMITNGKSPMLDEKKTLIFDASHMKRESNIPTQFIWPDHEKPCAVAQQLAVPLIDLRGFLSGDSDAAQQASKLVGEACRSHGFFLVVNHGVEANLISNAHRYMDTFFDLPLSEKQKAQRKIGEHCGYASSFTGRFSSKLPWKETLSFRYSAEENSSHIVEEYFQRTLGESFNHLGNVYQEYCNSMNTLSLGIMELLGMSLGVEKSHFKEFFEENDSIMRLNYYPPCQKPELTLGTGPHCDPTSLTILHQDCVGGLQVFVDDEWRSITPTFNAFVVNIGDTFMALSNGRYKSCLHRAVVNNKTPRKSLAFFLCPNKDKVVSPPNELVDSNNPRIYPDFTWPTLLEFTQKHYRADMNTLQTFSNWLQHNTTAQL

SEQ ID NO: 23608 - protein, 294 aa, Oryza sativa
  misc_feature (238)..(238): Xaa can be any naturally occurring amino acid
  misc_feature (265)..(265): Xaa can be any naturally occurring amino acid
GRSPHTPQSSLHTRAAVVVVLSSSDACRTHGFFQVVNHGIDAALIASVMEVGREFFRLPAEEKAKLYSDDPAKKIRLSTSFNVRKETVHNWRDYLRLHCYPLHQFVPDWPSNPPSFKEIIGTYCTEVRELGFRLYEAISESLGLEGGYMRETLGEQEQHMAVNYYPQCPEPELTYGLPAHTDPNALTILLMDDQVAGLQVLNDGKWIAVNPQPGALVINIGDQLHALSHGKYRSVWHXRAGVNSDRERMSVASFLCPCNSVELGXYRNYTYDEYYKKFWSRNLDQEHCLELFRT

SEQ ID NO: 23609 - protein, 225 aa, Solanum dulcamara
LSFQYSDEEGSSHIVEDYFQRTMGEKFSHLGKVYQDYCNAMSTLSLRIMELLGLSLGVSRNHFKEFFQENESIMRLNYYPTCQKPELTLGTGPHCDPTSLTILHQDSVGGLQVFVDNEWHSITPNFNAFVVNIGDTFMALSNGRYKSCLHRAVVNNKIPRKSLAFFLCPKKDKVVTPPIELVDSNNPRIYPDFTWPDLLEFTQKQYRADMNTLQTFSIWLQKTQV

SEQ ID NO: 23610 - protein, 226 aa, Zygosaccharomyces rouxii
MIPEQGEHKAFVQRNTNETKIQIAISLNGGHIEIPESIIGKKRVESDGVRTQATSSQTIDIHTGVGFLDHMIHALAKHSGWSLIVECIGDLHIDDHHTTEDCGIALGDAFKQALGQVRGVKRFGFGFAPLDEALSRAVVDLSNRPYSVIELGLKREKIGDLSCEMIPHFLESFTEAARLTVHVDCLRGFNDHHRSESAFKALAVALREATSPNGTNDVPSTKGVLM

SEQ ID NO: 23611 - protein, 338 aa, Hordeum vulgare
MAKVMNLTPVHASSIPDSFLLPADRLHPATTDVSLPIIDMSRGRDEVRQAILDSGKEYGFIQVVNHGISEPMLHEMYAVCHEFFDMPAEDKAEFFSEDRSERNKLFCGSAFETLGEKYWIDVLELLYPLPSGDTKDWPHKPQMLREVVGNYTSLARGVAMEILRLLCEGLGLRPDFFVGDISGGRVVVDINYYPPSPNPSRTLGLPPHCDRDLMTVLLPGAVPGLEIAYKGGWIKVQPVPNSLVINFGLQLEVVTNGYLKAVEHRAATNFAEPRLSVASFIVPADDCVVGPAEEFVSEDNPPRYRTLTVGEFKRKHNVVNLDSSINQIININNNQKGI

SEQ ID NO: 23612 - protein, 116 aa, Helicobacter pylori
DPLIAVLFIVALFYLSHYFFASITAHVSALFALFVGIGSHIQGVNLQELSLFLMFSLGIMGILTPYGTGPSTIYYGSGYIPSKDFWKLGFIFGFVYLIVFLSVCVPWVKFIAYRWL

SEQ ID NO: 23613 - protein, 402 aa, Unknown
  Sulfitobacter sp. EE-36
MRPAVIFIILTVMIDAMGIGLIIPVMPDLIAQVQSADLSRAALWGGVLATTFAVMQFLFSPLVGSLSDRFGRRPVLLTSLSVMALDYVLMALAGSIWLLLLGRVIGGISAATGATASAYMADITRPEKRAAAFGMIGAGFGAGFVLGPVAGGFLAEFGTRAPFWAAAVLAAGNVIFGWIVLRETVNTRSAAPLSWRRANPLGALRALGDLPGVSRLLLVYFLYHLAFAVYPSVWSYFGKAQFGWSPAMIGGSLALFGAAMAVVQGGLIRPVLHRFAERGTVLIGFACSITTFGLIATVTWGSAILILTPLAALAGVIPPALQAPMSARVTPERQGALQGLLTSASALAMVVAPLVMTSVFAAFTSTSTPVYFAGAPFVLSMILSVVALVVFRRVRINPAHVD

SEQ ID NO: 23614 - protein, 722 aa, Unknown
  Mycobacterium sp. MCS
MTVVTPGSGPTSPTLHTVWPGEAYPLGATYDGAGTNFSLFSEVAERVELCLIAKDGSEERINLDEVDGYVWHAYLPTVTPGQRYGFRVHGPWDPSAGHRCDPSKLLLDPYGKSFYGDFRFGQALYSYDLDAEDLASGGDPPRIDSRGHTMTSVVINPFFQWGSDRAPRTPYHDTVIYEAHVKGMTRRHPAVPAELRGTYAGLCHPAIIDHLKSLNVTAIELMPVHQFMHDHRLLDLGLRNYWGYNTFGFFAPHNEYAANQHAGGAVAEFKAMVRSFHAAGIEVILDVVYNHTAEGNHLGPTVNFRGIDNAAYYRLLDGDLRLYKDFTGTGNSLNARHPHTLQLIMDSLRYWVLEMHVDGFRFDLASTLAREFYDVDRLSAFFDLVQQDPVVSQVKLIAEPWDIGEGGYQVGNFPGLWTEWNGQYRDTVRDYWRGEPATLGEFASRLTGSSDLYEATGRRPSASINFVTCHDGFTMHDLVSYNEKHNEANGEDNRDGESHNRSWNCGVEGPTDDPDVIALRGKQMRNMLATLMCSQGTPMIAHGDEIGRTQQGNNNVYCQDSELSWMDWSLCETNADLLEFTRKVVAFRKNHPVFRRRRFFEGKPIRSADQVRDIAWLTPAGTEMTPEDWGTGLGKCVAVFLNGEAIPAPNARGERVVDDSFLLCFNAHDHVQDFVTPDGDYAEMWTADLDTADPTGHTDVVVPAGEKISLQPRSLLVLRKTA

SEQ ID NO: 23615 - protein, 591 aa, Oryza sativa
MRGNLREQKVYHMEGADEERPLIHHLPPQEQCSQYTCDGTVDIDRRPALKHSTGNWRACFFILGAEFTQCLCFSAVVKNLVRYLTSVLQESNVNAARSVSTWIGTCFFTPLIGAFLADTFWGRYRTIVICLSVYSIGMLILTTSASLPFLLHDSYNNGDDIRRVVAYLGLYLIALGAGGIKPCMSALGADQFDGADPVERVTKGSFFNYYYFSNNMGTLLSTTVLVWVQDNIGWGIGFATPMLLMGFGLSMFVAGRRVYRYRKLGRSPLTRVSQVVVAAARNHRLKLPDDSSLLHELPSLTEGGYRIQHTTRFRFLDKAAIPSDSDDNSPVQPDPWRLCTVSQVEELKMLLRVFPVWASLLVFFVVTAQMSSTLIEQSAAMDGRVGPFTVPPASLATFNVVAVLIWVPVYDAVLVPLARRATGNDRGLSHLQRIGVGLALSAVAMAYSAQVERRRRRPAAEEEAMSIMWQAPCYLVLGMAEVFTSIGMLEFFYERSPGSMKSLGTSLAHLAVATANYLNSGVLGVVVAATTRGGGAGWIPDNLDEGHLDYFFWMMALVRSDWASAAGQTGGDLMPQESIAGDGSGVNLEIR

SEQ ID NO: 23616 - protein, 116 aa, Helicobacter pylori
DPLIAVLFIVALFYLSHYFFASITAHVSALFALFVGIGSHIQGVNLQELSLFLMLSLGIMGILTPYGTGPSTIYYGSGYIPSKDFWKLGFIFGFVYLIVFLSVCVPWVKFIAYRWL

SEQ ID NO: 23617 - protein, 116 aa, Helicobacter pylori
DPLIAVLFIVALFYLSHYFFASITAHVSALFALFVGIGSHIQGVNLQELSLFLMFSLGIMGILTPYGTGPSTIYYGSGYISSKDFWKWGFIFGMVYLIVFLSVCVPWVKFIAYRWL

SEQ ID NO: 23618 - protein, 218 aa, Actinidia deliciosa
ETGRHVRMLTHEIRSTLDRHTILKTTLVELGRTLALEECALWMPTRTGLELQLSYTLRHQKPVGFTVPIQLPVINQVFSTNRAAKISPNCPVARLRPLAGKYMPGEVVAVRVPLLHLSNFQINDWPELSTKRYALMVLMLPSDSARQWHVHELELVEVVADQVAVALSHAAILEESMRARDLLMEQNVALDLARREAETAIRARNDFLAVMNHEMRTP

SEQ ID NO: 23619 - protein, 303 aa, Sinorhizobium fredii
MLCRHFLQKRISAAVLPGWEKRAVTDTFFAGLPELDPGSVWLVGAGPGDPGLLTLHAANALRQADVIVHDALVNADCLKLAKPGVTLEFAGKRGGKPSPKQRDISLRLVELARAGLRVLRLKGGDPFVFGRGGEEALTLVEHGIPFRIVPGITAGIGGLAYAGIPVTHREVNHAVTFLTGHDSSGVVPDRINWEGIAKGSPVIVMYMAMKHIGQISANLIAAGRSADEPVAFVCNAATPEQVVLETTLSRAEADISASGLEPPAIVVVGEVVRLRPSLDWLGALNGRALVADPFLSRIRRNPA

SEQ ID NO: 23620 - protein, 557 aa, Bdellovibrio bacteriovorus
MSEVQKNWWKEAVVYQVYPRSFKDSNGDGMGDLQGLISKLDYLKELGINVIWICPMYKSPQDDNGYDISDYQDIHHEFGTMKDFDQLLQQVHARGMKLIIDLVVNHTSDEHPWFIESRSSRNNPKRDWYIWRDGKNGKEPNNWESIFSGSAWKYDELTQQYFMHIFSSKQPDLNWENLDMRKAVYDMINWWLDKGIDGFRVDAISHARKEPGLADMPNPNNLEYVPSYDKHMNVNGIQEYLKDLCTNTFNKYDIMTVAEANGVSAENAEEWVGREQKKFNMIIQFEHVGLWDANPERRVDLAKLKSVLGRWQKGLEGRGWNALFVENHDVPRITSKWGDIQNFWRESTTSIATMYFMMQGTPFIYQGQEIGMTNTVFNGPEDFNDVSAKNIFTIRRKQGATDAEITADLASASRDNARTPMQWDSSEQGGFTTGRPWLKVNPNYKNINVAAQDKDPTSVLNFYRNLIRLRKAHSVFIYGVYDEVLSKHDQIYAYTRTDGNEKMLVMANMTGKPAKFDLPGFSLSSANLLMANYAVADHSSITGGELRPFESRIYKIN

SEQ ID NO: 23621 - protein, 357 aa, Unknown
  Nostoc sp. PCC 7120
MRKRIGILTSGGDCPGLNCVIRAVVSHATLTYDWEVLGIPYATQGLRERQAIALNMHGWDLRGIDPLLNMGGTILGTINKGDTLAHVDEMLASYQALALDALIVIGGDGSLGILHELASRGNWNLVAIPKTIDNDVALTERAVGFDTAVNTIVDALNRLTFTAASHDRVMIVEVMGRSAGHLALHAGIAGGADVILIPEISYTISGLCQHIAELRDRWQRKFAIVVVAEGAKLCLEDVQENIASSCAPSKCGRGQYIADQIAQCSKNLIDTRVSVLGHIQRGGIPSALDRLTATVFGKTAVDLIAQGKFGQMVAWQNGEAIPVPIQDVVAQSPLHVNPQGSLVQSARCLGIYVGEKT

SEQ ID NO: 23622 - protein, 189 aa, Zea mays
MATLARHLILCSSSPSQRRRRPLPPDATAGTQQQQQQQAPPPQPSTTRRLAVAASAALAATATAALSARRPAPPPPAMAAEAAVPPAPPTPASPGTVPRWGTRSYVRERFFEPELTAEEAAARIRQTAEGMRTLRPMLETMSWKYVLFYVRLKSKYLGLDLTTAMAGVPAGRRADYVRVANELVDNMTE

SEQ ID NO: 23623 - protein, 697 aa, Geobacter metallireducens
MNEQKVNVDFGGRTITIATGKMAKQASGAVMVSCGETMVLVTAVALKSAKEGQDFFPLTVNYQEKAYAGGKIPGGFFKREGRPTENETLTCRFIDRPIRPLFPENFLNDTQIMATVVSADQDNDPGILAMIGASAALEVSDIPFFGPIAGVKVGRVDGKFICNPTAEQLAASDLEVVVAASRDAVIMVEGGAAEISEADLLEAIFFGHASVQPIIDAQIELRKQAGVPKREIAPPAVDEALGAKVKELAYAQMKDAVRIRSKQERHNRISAIADETVAALEADFSGRGAEIKDFLDGFEYELVREHILKDGERIDGRDTKTIRPITSEVGILPRVHGSALFTRGETQALVAATLGTSSDEQRIDSLYGESRKRFMLHYNFPPFSVGETSFRLAPGRREIGHGYLAERALERVLPKHDDFPYTIRIVSDILESNGSSSMASVCGGALSMMDAGVPISAPVAGIAMGLIKEGDDIAILSDILGDEDHLGDMDFKVAGTSTGVTAIQMDIKITGVTREIMGKALEQAKEGRLHILGKMAEALAAPRTDLSPYAPRITTIWVKTDKIRDVIGAGGKNVRGITEATGVSIDIEDTGKINIASTNKEACDKAIKMIRDLTAEAEEGKLYMGTVRKVMDFGAFVEIFPGTDGLVHISELDTERVKDVTDILKEGDKVLVKCIGIDKQGKIKLSRKEALGAVLPE

SEQ ID NO: 23624 - protein, 403 aa, Oceanicola granulosus
MAHFVVIGAGQAGASLVAKLRAEGFEGDVTLIGAEPVPPYQRPPLSKAYLLGEMEESRLYLRPRGWYDAHDVTLRTATRAVGIDPEAKVVTLQGEEPLPYDELALTTGSNPRVLPADIGGDLERVYCMRDLQDADALAPELVAGRRVLVIGGGYIGLEAAAVAARKGLHVTLVEMAPRILQRVAADVTSDFFRALHAGHGVDVREGVGLDRLLGTDAVTGARLTDGTELDVDFVVVGVGIAPASILAESAGIACDNGIRTDEFGRTSAPHVWAAGDCASFPYRGGRIRLESVGNAIDMAETVARNMLGQQVPYDARPWFWSDQYDCKLQIGGLNMGFDNVHVKQGEGGAVSHWYYRGAELIAVDAMNDARNYMIGKKLIEMGKSPPPEVVVDPATDMKALLKA

SEQ ID NO: 23625 - protein, 267 aa, Parvularcula bermudensis
MQRHEASRQGRGQVTLVGAGPGAADLLTLRAVRAMQAADVILFDALVSTEVLDLARREAKRMLVGKRGHRVSCRQEDINALMIKLAKQGKRVVRLKSGDPMIFGRAGEEIAALAVENIPVDIVPGVTAALAAASDLGVSLTHRDCAQGVKFITAHSRKGELPDLDWCACADVATTLVVYMGGRTAPALANRLMEEGLSPTTPVVVLHDVSLPGANCQPMSLSDLLHAVIEREGPVLIGIGDVFRDVAARTGIATPPPTNCLPLAVAN

SEQ ID NO: 23626 - protein, 242 aa, Burkholderia vietnamiensis
MTVYFIGAGPGDPELITVKGQRLVRTCPVILYAGSLVPPAVLDGHRAEQVVNTADLDLDAIVALLADAHAKGQDVARVHSGDPSLYGAIGEQIRRLDALGIPYQIVPGVTATAACAATLGVELTLPGVAQTVILTRFAGKTTMPEGEALGALAAHRATLAIHLGVRHLARIVDEVLPHYGPDCPVAVIYRASWPDEERVTGTLADIVAKVDRTAIERTALILIGRVLDAHGFADSTLYASTR

SEQ ID NO: 23627 - protein, 815 aa, Parvularcula bermudensis
MVDGQRTGWSAAMDRIARGFRDAIERHGPDSVAFYLSGQLLTEDYYVANKLMKGFIGSANVDTNSRLCMASAVAGHKRAFGSDTVPGTYEDLEACDLLVLVGSNLAWCHPVLYQRVLAAKEARPDLKIVVIDPRRTATCDLAEQHLAIAPGSDVALFSGLLRFLANSPARNDGYIAQYTSGMRDALEAAAAYDINRVARETRLPKDDLIRFYESVSRNERTVTLFSMGVNQAADGTDRVNAIINTHLVTGRIGKLGGGPFSITGQPNAMGGREVGGLSNQLACHMDFDDASVDRVRRFWRAPRMATRPGLKAVEMMDAVAAGRIKAIWIMATNPVVSMPNADAVKAALKACPLVVVSDIVPDTDTAQCADILLPATGWGEKDGTVTNSERRISRQRAFLPAPGLARHDWWAMSDLARRLGYEEAFGYENTASIFREYAALTAFENEGGRDLDLGGLAGLTDDEYDELSPVRWPVRRDGSRTERFFRRGGYFTPDRRARFVAPRTDEPKEEAPGLCLNTGRIRDHWHTMTRTGRAARLNKHIAEPFAEIHPDDAAAHGILDASLVRVKNDDGEAVVRALLTDRQQRGSVFVPMHWTGQAASQARVDTLVPPLVDPVSGQPALKSGRVTIEPYPAVWYGFAAGHVTPPTGETYWARAMTETGRRLELAGTSHPHDWSVFARELLSADEEDSETVEHMDAAGAHYRCAVFRGGRLRSVLLVGPTPVAAARDWLGDQIGKVASLNTRTSILAGVPGAGAPDPGPIVCSCLGVGANVIRRAMRDGASSLTQIGDRTGAGTNCGSCRPEIRKLMEIAHATT

SEQ ID NO: 23628 - protein, 484 aa, Glycine max
IRLEAGIRNCGQDGINEIKFLIKEAHKRGIEVIMDVVFNHTAEGNENGPIISFRGVDNSMYYMLAPKGEFYNYSGCGNTFNCNHPVVRQFIVDCLRYWVTEMHVDGFRFDLASIMTRSSSLWDGANVFGAPIEGDLLTTGTPLSSPPLIDLISNDPILCGVKLIAEAWDAGGLYQVGTFPHWGIWSEWNGKYRDTVRLFIKGTDGFAGAFAECLCGSPNLYQGGGRKPWHSINFVCAHDGFTLADLVTYNNKNNLSNGEDNNDGENHNNSWNCGQEGEFVSTSVKKLRKRQMRNFFLSLMVSQGVPMIYMGDEYGHTKGGNNNTYCHDNYHNYFQWDKKEESSSDFFRFCRLMTKFRQECESLGLADFPTSERLQWHGHFPGKPDWSETSRFVACTMVDSVKGEIYIAFNMSHLPFTVTLPERPGYKWEPLVDTSKPTPYDFLTPDLPGRDIAIQQYAQFLDANMYPMLSYSSIILLRIPDENL

SEQ ID NO: 23629 - protein, 815 aa, Parvularcula bermudensis
MARNRLVIIGNGMAPGRVLDHLFERAPGAYDVTIFNAEPRVNYDRIMLSPVLSGEKAFEDIIIHDDAWYEQNGVTLHRGKRVTEIDRQRKTVTAADGTQAEYDKLLIATGSTPFIIPVPGHDLDGVLGYRDLDDVEKMLAAAEQGGRAVVIGGGLLGLEAAVGLKKRGMDVTVLHLAPTLMERQLDEPAGHLLQAAIERRGIEVLTKANTKEILGTERVEGVRLDNGRVIEADLVCMAAGIRPSTELAKDAGLEIGRGIVVGDDLRTSDPDIFAVGECVEHRGICYGLVAPLYEMAKVIAAQLCEDCEAEYLGSEVSTKLKVTGVDLFSAGDFQTGEGREEVVFRDAAKGIYKRLVLEGDRIVGAVFYGDTKDSAWFFQHIKDRTDVSEYRDTLIFGPAFAGSGAPDPMAAVAALPGDAEICGCNGVCKSKIEGAITGEGLTTIDEVRAHTKASASCGSCTGLVEQLLALTLGDEFDPDAVKPVCGCTDLSHDEVRRLIVAGELKSIPSVMQQLEWKTSCGCAKCRPAINYYLVCAWPGEYVDDGQSRFINERVHANIQKDGTYSVVPRMWGGMTSPSELRAIADVADKFAIPTVKVTGGQRIDLLGVQKEDLPAVWADLNAAGLVSGHAYAKGLRTVKTCVGTDWCRFGTQDSTGLGVKLERFLWGSWAPHKVKLAVSGCPRNCAEATCKDIGVVCVDSGYEIHYAGAAGMHVKGTELLCTVPTEKDAIQYIGALMQMYREQGWYLDRIYKWAAKVGTDYVRDTLDDPAERQAYYDRFVYSQQFMQDDPWAARVAGKDAHEFEPITISRELEAV

SEQ ID NO: 23630 - protein, 567 aa, Magnetospirillum gryphiswaldense
MKKGSNYMTMEDFAALLDETMGVANPFEGSVIKGIIVRVENDFAVIDVGLKSEGRVLLKEFATAGRAPEIKAGDAIDVFVERYEDKNGEVVLSREKAKREEAWTLLEKSFQDNQRVTGVIFGRVKGGFTVDLSGAVAFLPGSQVDIRPVRDITPLLGSPQPFQILKMDRSRGNIVVSRRAVLEETRAEQRSELIENLKEGQILEGVVKNITDYGAFVDLGGVDGLLHVTDIAWKRINHPSEALHIGQTVKVQVIRFNPETQRISLGIKQLDADPWEGVEAKYPVQAKFVGRVTNITDYGAFVELEPGVEGLVHVSEMSWTKKNVHPGKIVSTSQEVEVMVLDVDPQKRRISLGLKQCLSNPWESFVEKFPVGTLVEGEVKNITEFGLFIGLSGDIDGMVHMSDLSWDKSGDAAIAEYKKGDVVNAKVLDVDVEKERISLGIKQLGADPFQDAVANVKKGDIVTCAVTQVTENGLEVQVDGMTGFIRKSELSRERSEQRPERFAVGEKIDAKVTMIEKGARKVTLSVKAREIDEEKAAMAEYGSSDSGASLGDILGAAMRRAQSQDDK

SEQ ID NO: 23631 - protein, 271 aa, Methanosarcina mazei
MVRMGNDNWPEVGEFVVCTVKNVTDFGAYVELEEFGGREGFIHISEIKAGWVKYVRDYVREGQKIVCKVLNVDPSRGHIDLSLKDVNEHQRRAKIQEWKNEQKAAKWLQFVAEETKTDENGLQALHERLVEDFGSAYSAFEEAAIEGERAFKGLKVNKKYLKSIVKIAGENIKLPFVDIAGYVDLTCNLPNGIEVIKQSLNAANSISDVDGKDIRLEITYTGAPRYRIKVIAPDYKKAESVLKKSAQTAVDTISKLGGHGIFKRHIESAKA

SEQ ID NO: 23632 - protein, 477 aa, Unknown
  Candidatus Kuenenia stuttgartiensis
MMKKTLLLNPPCFDQFDGGAGSRYQARREVRSFWYPTWLCYTAGLIPGSKVVDAPAQGLQIDEVVSLAGDYELVVMYTNTPTLSIDRETAKKIKAANPESVICFVGPHVTIQPEDALREDRIVDIVARGEFDITVKELAEGKALQEVKGISYLNGSGVVHNADRGFTTDLDSLPFVTEIYERDLNYKDYEIPYLRYPYLSIYSGRGCPSQCIYCLWPQTMMGHQYRVRSVDNVIRELMYCKERFPEVKEIFFDDDTFTANRKRVQEFSRKVKDLGITWSATSRANLDRETLQQMKEGGLRLLVVGYESGNDEILKNVKKGITIDQAKRFTGECKSLGIQIHGTFMLGLPGENRSSMEDTIRFAIEMDPDTMQVSIASPYPGTEFYDYCEKNGYLKTGTMLSSSGHQLCNIEYPDLPAEEIILWTEKFYKKFYFRPRIILRIVKKMLQDPVERKRRLREGRQFFKTMRSRRKYTKKSC

SEQ ID NO: 23633 - protein, 642 aa, Oryza sativa
MAAPPLSSWPWASLGSWVQYVLYGAVVWKVAEEWRQQGAAPVGSWWLHLLLLFAARGLTYQFWFSYGNMLFFTRRRRVVPDSVDFRQVDAEWDWDNFLLLQTLIGATLVGSPAVARQQLLLPSLKQAWDPRGWAIALLLHVLVAEPLFYWAHRALHRAPLFSRYHAAHHHASVTTPLTAGFGTPLESLLLTVVIGVPLAGAFLMGVGSVGLVYGHVLLFDFLRSMGYSNVEVISPRVFQAVPLLRYLIYTPTYLSLHHREKDSNFCLFMPIFDLLGGTLNHKSWELQKEVYLGKNDQAPDFVFLAHVVDIMASMHVPFVLRSCSSTPFANHFVLLPFWPVAFGFMLLMWCCSKTFLVSSYRLRGNLHQMWTVPRYGFQYFIPAAKKGINEQIELAILRADRMGVKVLSLAALNKNEALNGGGTLFVNKHPELRVRVVHGNTLTAAVILNEIPSNVKDVFLTGATSKLGRAIALYLCRKKIRVLMLTLSSERFLKIQREAPAEFQQYLVQVTKYQPAQNCKTWLVGKWLSPREQRWAPHYSEIFYDVLLYNKCAHLNIYEISELMPPSSCKQLPLQIDDVQHAAYGVLQLQALWSMHPCDVIYCDEVLHIAVDTTSLQQLWYEMRFLNCCEMRFACKWQVVQA

SEQ ID NO: 23634 - protein, 468 aa, Parvularcula bermudensis
MTWVAFFISFVIWFNFAPLTEAVRVTFDLDKSQISTLLILNVALTIPARILIGALTDRFGPQKVYSGLLAFSAVPCLAFAFADNFTQLAIARFALGFVGAGFVVGIRMVSEWFPPNEVGTAEGIYGGWGNFGSAAAAFTLPSIALIFGGDEGWRYAIALTGLVALAYSFVYYRNVSDAPEGSRYFKAKQTRAMEVTSKGDFFLLLIMKAPLQIALGILAWRLERVGLISEPVQYAIWLLLAAYYAFNAWQAYEVNKSVFTEEVPLIHRYKFKQVAALNFLYAATFGSELAVVSMLPLFFAETFGLSPVLAGMVASGYAFMNLVSRPSGGVFSDRFGRRLTMIVLMAGVVVGYLLMAMVGSSWPVFLAVAVAMLCSFFVQAGEGAVFAMVPLIKRRLTGQIAGLTGAYGNVGAVVFLVIYSMVPAAAFFLVLAATALVGLACSFLLEEPRGEIAEINEDGTVTMIAVSA

SEQ ID NO: 23635 - protein, 348 aa, Bordetella bronchiseptica
MSFQVTIEPSKHQFQAEAGQTVLDAALAAGIVLPYSCRTGACSTCKGKVVAGEVDAGPYPAQILSPEDLAQGYTLFCQAKPQSDLVVESTEVRLASDIQIRKLPSRVQTIERVAPDVAVLKLQLPASEQFRYYAGQYIEVILKDGKRRSYSMAGAPHTGSPLELHIRHMPGGLFTDHVFGAGDTQMKEREILRLEGPFGSFFLREDSDKPIVLLASGTGFAPVKAIVEHMIHNQIQRPAVLYWGGRRPRDLYHDALAQSWAGSLPGFRYVPVVSDALDEDGWSGRTGYVHEAVMQDLSDLSGYEVYACGTPLMVDAARREFSAQCGLPAEAFYADAFTSEADLAKATP

SEQ ID NO: 23636 - protein, 205 aa, Magnetospirillum magnetotacticum
YAVALGADIEPSTSAGTRLFGHELVVWRDAGGAVHVWEDRCPHRGMRLSFGFVRGDHIACLYHGWRYDTAGQCRFIPAHPDLEVSPMIRTRTYPCRERAGLIWVRWGAPAEEAEPAPVAASPLRSLYLEAPAARLAAALGEAGPDGLVRFDLAGSPVLVAVQPLAGEASAAHIVVPDTPEAPEADLGRLAAACVTLRRSIEGAAP

SEQ ID NO: 23637 - protein, 168 aa, Oryza sativa
MASRRRDLGRPLLVALCVVALFAVGSESHGLEDFREGNTEATPAMASFFGSKPEAAELPEALDASNAAAATAKPEAACKQAGIIKQWLLVSAVISVITQQLVAVVTVIPQKKNWIRATLSRIGEVKRVTKETNVHVKINLDGTGVADCSTGIPFLDHMLDVPVFTHAA

SEQ ID NO: 23638 - protein, 400 aa, Medicago truncatula
MEMEWTRGNIIGHGSSATVYLATSRRSTDVSAVKSAETSLPNSNQLQSEQRILSSLSSPYIVTYKGCNFSKENNKHLFNLFMEYMPFGNLSQVTCRNGGRLNEAMIAYYTRQIVEGLEYLHSKDVVHCDIKGSNILVCEKGVKIGDFGCAKMIDEIAPAAGTPMYMAPEVARGEEQGFPCDVWSLGCTIVEMATGFSPWSNVEDSVHVLYRVAYSDEVPMIPCFLSEQAKDFLEKCLRRDSKERWSCSQLLKHQFLDCGVEKIEEFDSCSPTSILEQGFWNCDEGSESFFFDDLGKINFVNCPVGRIKKLALCSRDPCWKWGDENWITTRENDADAGSSISDELDFDELEKSDFSGRISGDYFGYDYSNCKIRDVSYVANSLNFGRGIGRLMPQSTLDFL

SEQ ID NO: 23639 - protein, 361 aa, Colwellia psychrerythraea [sequence omitted]

SEQ ID NO: 23640 - protein, 364 aa, Hordeum vulgare
MEEIGHHFGLGATAHGQHHSQLPWGSSPLSAVISPPPQQQQQHQQQSAGYLAHSPLSLNTAPPGVSHGGGSGCSNPVLQLANGSLLEACAKAAKEPSSSSYAADVEAIKAKIISHPHYSSLLAAYLDCQKVGAPPEVSARLTAVAQDLELRQRTALGGLGTATEPELDQFMEAYHEMLVKYREELTRPLQEAMEFLRRVETQLNSLSISGRSLRNILSTGSSEEDQEGSGGETELPEIDAHGVDQELKHHLLKKYSGYLSSLKQELSKKKKKGKLPKEARQQLLSWWEMHYKWPYPSESQKVALAESTGLDLKQINNWFINQRKRHWKPTDEMQFVMMDAYHPPNAAFYMDGHFVNDSGLYRFG

SEQ ID NO: 23641 - protein, 556 aa, Cicer arietinum
MGCQGSKEKNKPTPDFTARHHGSSATAASASGVATNNHQYHSVQPSSTHVQTPPPKPDSNPKPTVTTQNVKTVHKTDTTILGKPFDDIKKHYTLGQELGRGQFGITYFCTENSTGNTYACKSILKRKLVSKSDREDIKREIQILQHLSGQPNIVEFKGAYEDRFSVHLVMELCAGGELFDRIIAQGHYSERAAASICRAVVNVVHICHFMGVLHRDLKPENFLLSSKDEGATLKATDFGLSVFIEEGKVYRDMVGSAYYVAPEVLRRSYGKEIDIWSAGIILYILLSGVPPFWAETEKGIFNAILEGELDFASEPWPSISDSAKDLVRKMLNHDPKKRITSAQVLEHPWMREGGEASDKPIDSAVLSRMKQFRAMNKLKKLALKIIAENLSEEEIKGLKAMFANMDTDNSGTITYEELKTGLARIGSRLSETEVKQLMELADVDGNGSIDYLEFISATMHRHRLERDEHLYKAFQYFDKDNSGHITREELETAMTQHGMGDEATIKDIISEVDTDHDGRINYEEFCAMMRSGMPPPGTTIINLQSEFDFICSCNSL

SEQ ID NO: 23642 - protein, 464 aa, Glycine max
MVTCAVKGGCPSDYIAIALSILSITVLLLWSIFPFLVHKVPRTKGSGFWLPVIQVVASFNLLLSIVMSNNFLKMGKRHWLRSCYLWGVWVEGPLGFGLLLSCRITQASQLYFIFVKRRLPLIRSYIFLPLILLPWIAAGGVIHSMKPLSSRCHMKAQWTIPVVCLHSLYIAILVGVTAAVHHIEFRFDELKDLWRGILVSVVSIAVWVTAYILNEIYEQLQAMRYCHKFLLLVVASILVVAFFSISSSQPLLSQISLRRRESREFRTMSQALGIPDSGVLAQSEPISRIDPNEPLDKLLLNKRFRLSFMAFADSCLAGESVHFFDEVYELSKIPEDDCVKRIYMARHIIEKYIVAGAAMEVNISHRSRQEILSTSNLTRPDLFHNALNEIIQLMRTNLARDYWSSMFFLKFQEDSNVRSNEYELEQITGWNFSPRLSSVHGTDDPFHQDHLLKSSGCSNDTTNL

SEQ ID NO: 23643 - protein, 469 aa, Brucella suis
MEKADIGMVGLGVMGSNLALNIAEKGYTVAVYDRDEPVLKAFIEKAGRLRDKIIPCPTFEELAANIRKPRPIIFLIKAGAPVDTETTRLKAFLEKGDIMIDAGNSDYRDTVRRLKALGPNDPTFVGMGVSGGAEGARHGPSMMVGGTEQAYERIAPILLAVAAKYQGEPCCALVGPDGAGHFVKTIHNGIEYADMQMIAEIYGILRDGLGLSAPAIGDVFEKWNEGPLNSYLIEITAKVLKSTDPETGKAMVDMILDEAGQKGTGRWAAIEAQILGVPATGIEAAVAARSLSSMKGEREEAAKAYKSGARTLDIANQTRFLSDLEQGLLAGKIAAYAQGFAVMEAASREHGWNIPLATTARIWRAGCIIRSQLLDDIAQAFEGNESRNLLMAPAFVPRMETSVKSLRQIVAQAALASLPLPALGSALSYFDSYTQALGTANLIQGQRDFFGSHGFKRIDKEGDFHGPWG

SEQ ID NO: 23644 - protein, 94 aa, Neurospora crassa
ARKETYSSYIYKVLKQVHPDTGISNKSMSILNSFVNDIFERVATEASKLAAYNKKSTISSREIQTSVRLILPGELAKHAVSEGTKAVTKYTSSK

SEQ ID NO: 23645 - protein, 116 aa, Helicobacter pylori
DPLIAVLFIVALFYLSHYFFASITAHVSALFALFVGIGSHIQGVNLQELSLFLMLSLGIMGILTPYGTGPSTIYYGSGYIQSKDFWKWGFIFGFVYLIVFLSVCAPWVKFIAFRWL

SEQ ID NO: 23646 - protein, 225 aa, Arabidopsis thaliana
MSNAFSIMPTLYKKAGCQFQLTTMAENNNNNGDNMNNDNHQQPPSYSQLPPMASSNPQLRNYWIEQMETVSDFKNRQLPLARIKKIMKADPDVHMVSAEAPIIFAKACEMFIVDLTMRSWLKAEENKRHTLQKSDISNAVASSFTYDFLLDVVPKDESIATADPGFVAMPHPDGGGVPQYYYPPGVVMGTPMVGSGMYAPSQAWPAAAGDGEDDAEDNGGNGGGN

SEQ ID NO: 23647 - protein, 729 aa, Legionella pneumophila
MAKITKEIVFGNHKLILETGEVARQADGAVMASMNGTQVLVTVVWKKDSGESNDFFPLTVNYQEKFYAIGKIPGGFNKREGRPSDNETLISRLIDRPIRPLFPDNFFNEVQIIATVLSLNPEVSPDIIAMIGASAALSISGVPFNGPIGAARVGYKDGVYLLNPSRKEQEESKLDLVIAGTKDAILMVESEAQELSEDIMRGAMLYGHEMMKSVIKSIEELAREVGKSKPEWKAPEIDTVLKARINDVARNEVEAAYLIKDKQQRYQRLDELREQTISALLAENDELNADVIANMFGELERSIVRNRILDGEPRIDGRDHRTVRPISIRTKFLERTHGSCLFTRGETQAIVVATLGNERDAQILDGISGETRDRFMLHYNFPPYSVGETGQVGSPKRREIGHGRLAKRALMAVLPDTNEFPYVLRIVSEITESNGSSSMATVCGTSLALMDAGVPLKAPVAGVAMGLIKEGDRYAVLTDILGDEDHLGDMDFKVAGTEKGITALQMDIKISGITNEIMERALEQALEGRTHILGVMNNALAEHRTELSQHAPRITTMKVAEDKIRTIIGKGGATIKGLIESTGVSIDIDDSGVIQLFSPDKMALEEAQKQIKALIAEIEVGQTYQGKVSKIVDFGAFINLLPGKDGLLHISQICAERTQKVEEVLQEGQEIEVFVAGIDKQGRVKLEWKDKPQAEAKEVEGASVSATFLTMEEQSEEINSGNKISEEEE

SEQ ID NO: 23648 - protein, 378 aa, Arabidopsis thaliana
MAILCTTTSPAEKEHEPKQDLEKDQTSPLIFNPSLLNLQSQIPNQFIWPDEEKPSIDIPELNVPFIDLSSQDSTLEAPRVIAEACTKHGFFLVVNHGVSESLIADAHRLMESFFDMPLAGKQKAQRKPGESCGYASSFTGRFSTKLPWKETLSFQFSNDNSGSRTVQDYFSDTLGQEFEQFGKVYQDYCEAMSSLSLKIMELLGLSLGVNRDYFRGFFEENDSIMRLNHYPPCQTPDLTLGTGPHCDPSSLTILHQDHVNGLQVFVDNQWQSIRPNPKAFVVNIGDTFMALSNGIFKSCLHRAVVNRESARKSMAFFLCPKKDKVVKPPSDILEKMKTRKYPDFTWSMFLEFTQKHYRADVNTLDSFSNWVITNNNPI

SEQ ID NO: 23649 - protein, 559 aa, Myxococcus xanthus
MAESTRRDCIVIGYNETPFDEYEAGIRRFGEDSEAYRDLKFSFIELEGKRLNYVDLLNHVYCRALPSGTPHAAFRSGGIPSLAAVYLCSFLGRRGHDVTYLNLFQHEKERLAELLAQNPRTVAITTTFYVLNDPVIEMVQFIRQHNPDVRIIVGGPLVSNHHRRYEGNELAVVLDDLGADIYVVESQGELTLSRVLDRLKAGQELSDVPNLIYPAEGGPVRAGRYRINPPQAESNSLDENIIDWRGMAESPLGPTLQTRTARSCAYSCSFCAYPMRAGSLTLAGMDAVARELDAMAELGTQNVVFIDDTFNVPLKRFKELCRLLIERRYGFNWFSYFRCSNSDDEAVDLAAQSGCRGVFLGIESGSPRILANMNKAATVEKYVSGMKRLHAHGILTFASFILGFPGETEETVEETLAFIQETRPDYYRTQLWYCEPGTAVDAKRQQYGITGQGFIWRHDTMESLEAMDHIDRMFLTVKDSVWLPQWSFDFWIIPYLLGRGLQTEQFKALMRLAHQLLALEIASVSSETKRAQQRNYVGQMEALVRQWNGASSQAVLAGR

SEQ ID NO: 23650 - protein, 222 aa, Brassica napus
KDFKVLVLTSCEGFSTDGLAAIAVACRNLRELELRECIVELGTGSFSDKLDQEAVAKLSQAFSELKELKSLSGLWDVLPEYIPLLYSVCPGLTSLNLSYATVQMSDLVELITRCSNLQKLWVMDLIEDKGLEVVASSCKELRELRVFPSGAGLDETNVAMTEQGLVYVSEACPNLESVLYFCVQFTNAAMVTIARNRPNLTCFRLCVMEPFAPDHKTQQPLD

SEQ ID NO: 23651 - protein, 451 aa, Novosphingobium aromaticivorans
MAVSDHVDLPTFMEGVKKRNPYQPEFVQAVQEVAEDIFDFIEDKEEYHAQQILRRIAEPDRVVSFRVCWEDDNGNVRVQRGWRVQNNNAIGPYKGGIRFHPSVNESVLKFLAFEQTFKNALTGLPMGGGKGGSNFNPKGKSVREIMRFCQSFMTELYRHIGADVDVPAGDIGVGGREIGYMFGQYKRITNHFTGVLTGKGLEWGGSLIRTEATGYGAVYFLANMLATKGEDLRGKTAVISGSGNVATHAAEKIVQLGGKVLTLSDSGGFIHDPDGIDQEKIDWVKTHKTHRRGRIEEYVDAFPGASFHAGKTPWGVPCDVALPCATQNELLGEDARTLIANGCKGVAEGANMPTDLEGVHVFKAARILYAPGKASNAGGVAVSGLEMSQNSERRSWKEHELQQMLKDIMAGIHKSCLTYGDQGGGYIDYVKGANIAGFKKVADAMLAFGVV

SEQ ID NO: 23652 - protein, 636 aa, Neisseria polysaccharea
MLTPTQQVGLILQYLKTRILDIYTPEQRAGIEKSEDWRQFSRRMDTHFPKLMNELDSVYGNNEALLPMLEMLLAQAWQSYSQRNSSLKDIDIARENNPDWILSNKQVGGVCYVDLFAGDLKGLKDKIPYFQELGLTYLHLMPLFKCPEGKSDGGYAVSSYRDVNPALGTIGDLREVIAALHEAGISAVVDFIFNHTSNEHEWAQRCAAGDPLFDNFYYIFPDRRMPDQYDRTLREIFPDQHPGGFSQLEDGRWVWTTFNSFQWDLNYSNPWVFRAMAGEMLFLANLGVDILRMDAVAFIWKQMGTSCENLPQAHALIRAFNAVMRIAAPAVFFKSEAIVHPDQVVQYIGQDECQIGYNPLQMALLWNTLATREVNLLHQALTYRHNLPEHTAWVNYVRSHDDIGWTFADEDAAYLGISGYDHRQFLNRFFVNRFDGSFARGVPFQYNPSTGDCRVSGTAAALVGLAQDDPHAVDRIKLLYSIALSTGGLPLIYLGDEVGTLNDDDWSQDSNKSDDSRWAHRPRYNEALYAQRNDPSTAAGQIYQGLRHMIAVRQSNPRFDGGRLVTFNTNNKHIIGYIRNNALLAFGNFSEYPQTVTAHTLQAMPFKAHDLIGGKTVSLNQDLTLQPYQVMWLEIA

SEQ ID NO: 23653 - protein, 826 aa, Geobacter sulfurreducens
MVTLTIDDKQVTVPKDATIFDAAKQAGIRIPILCHDKKLHPFGGCRMCLVEVEQMKGRQIPACTTPVTEGMIVRTMTDEIVKARKMVLELLLLKHPIDCPVCDAAGDCDLQNLTYEYGVDTNRFTDEKFNWKIDYVNPLIERDMNRCVHCGKCARICDEIVSFGAYSFINRGIEAKIGTEFDGPLNCEFCGSCVSVCPVGALISRPFKFKARWWALNKVKTVCSYCGTGCQLTLGVKDNKVLTTIYDENQGFHNGQLCTRGRWGYQFVNSSKRLTTPLIRKGDTLQPASWDEALGMVADRLKTSKDAAATLVTPRLTNEELYLLKRVVKDAVGSDNLDHSGGYAHEALTAGARESLGFPGSPSVIADIQKSELLLVIKTDAYETHPVIGFEVNLAVKRQGVALRILSDKKGKLSRLPGAQTYVHTPGAELVLVNALAKTIVDEGLHDASSVGAIKGFDAWLKSIESCTPDQAAGQCGIAADTIKAVAREYAAAGKALIMLPLGMGYPGHGKALAQALINLALLTGRVGKEGCGVLIMGEKNNSQGAADLGIHPTANGLNAQAILAGCSAGSIKTLYVVGENPVVSYPNRKQVEAALDAVEFLVVQDLFLTETASKADVVLPACSFAEKDGTFTSLGGAVQRVNRAITPLGDCRSDFDILNMLHAKLTGQAAYTSQKEAFADLAAATPGYAGLTLEGLGDAGAVRVNNCTASFVPVATSTVTTEAGKFALLTGSALNHSGTLSLYGEGPMLVCPEGYLELNKDDAAKLSITEGDAVTMKSATGELRLKAKVGTRLPQGVAFAPYHFAEASINSLTGATAITWITISK

SEQ ID NO: 23654 - protein, 115 aa, Glycine max
  misc_feature (38)..(38): Xaa can be any naturally occurring amino acid
  misc_feature (57)..(57): Xaa can be any naturally occurring amino acid
  misc_feature (59)..(59): Xaa can be any naturally occurring amino acid
AESAIGYEGVEKRMEICLLQPGLFADPQGRGIRAITKXQVGENITPTACTIGGILKXNXVDSYALSECRLFVYAYKNIIKTCGTTKLLLAMPPILKMAEQLSNDVKSANDTRGGL

SEQ ID NO: 23655 - protein, 415 aa, Pseudoalteromonas tunicata
MNLIKNLSQQASQAARTLLTLKEESKNTILRTMAASLREHCAPILAANHLDLNQARADNLPDAMLDRLMLNEERIEAMATGIETIATLPDPVGKLRDLGTQPNGLKISKMRMPLGVICMIFEARPNVTADAAALCFKSGNAVILRGGKEALNSSKAIAEVLQAVLRSFELPEALITVVPTAERALLMDLMQQRDHIDVIIPRGGEGLINFVTDNSKIPVIQHFKGVCHLYIDKEADLEKALNLLLNGKTQRTGVCNALEGLIVHRDIMAQFLPLVSYALKIHKVKVNACKTAFAFFEDATLLADDQFGEEYLSLEIAIKVVDNMSQALDHIHQFGSHHTEVICTEDRMRAALFQRLVDASVVMINASSRFSDGGELGLGAEIGIATTKLHAYGPMGLESLTTEKYLVSGDGQIRA

SEQ ID NO: 23656 - protein, 304 aa, Hyphomonas neptunium
MEKWTLENIPSQSGRSAVVTGTGGLGFEDALALARAGAEVVIAGRNSEKGAAAVTAIRKLVPSARVRFGLVDLANLSSVSAFAAEIAWERTSLDLLINNAAVMNPPARRTTRDGFELQLGTNFLGHFALTAHLLPLLKRGAAPRIVTVSSVAARQGAINFDDLQATRTYHPMTVYSQSKLACLMFALELSRRSRAGGWGVASLAAHPGVTRTDLIVNGAGPSSLNGRIRRFLPFLFQPAWQGALPTLYAATDPEARDGAYYGPGGPGGIRGYPAEERPPKHALDEAVAARLWNVSVGLTDAKFL

SEQ ID NO: 23657 - protein, 415 aa, Geobacter metallireducens
MSILETFDPAVAEAIRHETERQEYNLELIASENFVSEAVMEAQGSVLTNKYAEGYPGKRYYGGCHHVDVVENLAIERAKELFGADHANVQPHSGSQANMAVYFSVLKPGDTILGMNLSHGGHLTHGSPVNFSGRFFNVVPYGVSQETETIDFNEVERLALEHKPKLIVVGASAYPRVLDFAAFRAIADKVGALVMVDMAHIAGLVAAGLHPSPVPYAEFVTTTTHKTLRGPRGGMILCREEFAKTLNSNIFPGIQGGPLMHVIAAKAVAFKEALAPEFKLYQEQIVKNARTLADELMKRGFRLVSGGTDNHLMLVNLTGTELTGKVAEEALDKAGITVNKNTVPFETRSPFVTSGFRIGTPAATSHGLKEAEMVEVAAFIAEALANVGNEAKLAEVKGKVNALMGRFPLYASRLK

SEQ ID NO: 23658 - protein, 166 aa, Brassica napus
MASHAISLQSISTTTLNDLSCSHQSHRSSLLSFYKPFQNLGISSNVQDFSSRSTSTPKNLSLSQALSKNSGDTEHSRPSKVQELNVYEINELDRHSPKILKNVMSLKFRLGDLVPFTNKLYTADLKKRVGITAGLCVVIQHVPEKKGDRFEATYSFYFGDYGHLSV

SEQ ID NO: 23659 - protein, 1132 aa, Xylella fastidiosa
MKRMLINATQAEELRVAIVDGQSLYDIDIEQPSKEQKKSNIYKGRITRLEPSLEAAFVDYGTDRHGFLPLKEISKDYFQASLDHHKAGIRELLREGQEIVVQVDKEERGNKGAALTTFISLAGRYMVLMPNSPSAGGVSRRIEGEDRAALKEALEKLNIPNDMGVIIRTAGVGRDTQELQWDLDFLLHAWRAIAEAALSKPAPLLIYQESRLIIRALRDYFRADIGEILVDTEEMYQDAHEFMRHVMPQSLRKLKYYKDDIPLFNRFQIESQIEGAYERNVRLPSGGSIVVDQTEALTAIDVNSSRATKGNDIEETAFQTNLEAADEIARQLRLRDVGGLVVIDFIDMSSSKHQREIETRLQNCLKYDRARVQLSRISRFGLLEMSRQRLRPSLGESSQIVCPYCDGHGRMRSIESLSLSIIRIVEEHAMKENTGQVLVQTPVEIANYLLNEKRRAINEIEKRHDAPIIIIADEQLHAPHYEVTRLRENELSEETGKPSYQRNTPRKLPVHALTKSQLNIPPAPAVKSITPPQLAPTQEKIPTIREQSAENRAHPIPELVSSLASWLKRIFGNTDKRQTASNSSHPAPLQQNRNGNVQRNERNRRDGRIATSNTQPQQQSSSHRDNYRHNESNNYPQIQNQCTADTNGKLRNESQTPKSSAYVSKLPQMPRQPQPQLPKTPRTQSQPTQNSTKTILDKQPGPVLYGEDNTLQKAKPIPLTAEAVLTNIPAPSMTDKPSGKDQNALPTTSNVTQDTSNALIEAKSTTKTNIDTNTDIEPQQNNHEGTANNDGSNRRRRGRRGGRRRRRNTSLSNETNAVSESNSIKLSNDTETDNADNIESPQALRPAMQENKRQPEFEFDDLAPAAPITAPLRKAIAAEREGISADLTTTAPQSIMETASRTHIASQMAPQSETSAASTTSHTSVQATATHTHKDVVSDSPSRTPYKAHSNTTRHSSGRRLETLSTAHPPAKAPPSEHITPTSRSNANAKTTKTEIPNKQTNANSDTATRPTATDVLVVTNQPVIATKPSTTIEKAQTKVIPSTTYNNEHIETKRKIIATESETTQPPVRKPRLPMQNPLPKVVAPLEDKKQAPFVENTTQRNINNATTTSQNDKSLDFTKNNEENSDNNTL

SEQ ID NO: 23660 - protein, 925 aa, Methylococcus capsulatus
MNPSDEIVFKLDGRPVGARPGEAILQAARRHGVEIPHLCYRDGLRPDGNCRACVVEIEGERVLAASCCRTPGEGMEVRSDSPRARSAQRMVVELLLADQPETSRSRDDELRQWAERLGVSGSRFPGREAPPPDRSNPAIAVQLDACIQCTRCVRACRETQVNDVIGYAYRGSHARIVFDQGDPMGLSSCVSCGECVQVCPTGALAPGNGAALLEADRRVDSGCPYCGVGCQLTYHVKDGKIVKVTGRDGPANHGRLCVKGRYGFDYPAHRQRLTQPLIRKPGIAKDPQGELDPADPLAAFRPASWEEALDFAADGLKRIIAEHGKHALAGFGSAKGSNEEAYLFQKLVRTGFGTNNVDHCTRLCHASSVVALLEGVGSGAVSNPVADVQHAEVVVVIGSNPIVNHPVAATFIKNAVKKGTTQLILMDPRRTELARHAAYHLPFRPDSDVALLNALLHVIVTEGLVDEEFVRLRTENYEALKQNVLAYSPEAMAPICGIDARTLREVARLYARSRASMILWGMGVSQHVHGTDNVRCLIALAMVTGQIGRPGTGLHPLRGQNNVQGASDVGLIPMCFPDYLRVDDEAARAKFERLWGVPLDGQPGLTVVEIIDAACAGRIKGMYIEGENPAMSDPNSNHAREGLASLEHLIVQDLFMTETAYFADVILPASAYAEKTGTFTNTDRIVQIGRQAVTPPGEARQDLWIIQEIARRLGLDWNYQGPREVFEEMRSAMPSIAGISWERLEREGHVTYPCASETDPGQPVIFTERFPTPSGRARIVPADIIPADERPDADYPLVLITGRQLEHWHTGSMTRRASVLDAIEPAPTVSVHPLDLEGIGAEAGDVLTVESRRGRIALFARADDGIPRGSVFIPFCYYEAAANRLTNQALDPYAKIAELKYCAVRVRKGGTVGREFGYQLRGRVA

SEQ ID NO: 23661 - protein, 321 aa, Oryza sativa
MTTARFGVPLPLARVPLAGRPSLRVVVVVQGWGRPPRSAARSLAPPEAACYGLRRRRRERLSFRAGGLHRWILRRRLGFCSVALHVICYHAMLDISTSTLSRIGEVKRVTKETNVHVKINLDGTGVADCSTGIPFLDHMLDQLASHGLFDVCVKAKGDTHIDDHHSNEDIALAIGTALLEALGDRKGINRFGHFTAPLDEAAVEVILDLSGRPHLSCGLSIPTERVGTYDTQLVEHFFQSLVNTSGMTLHIRQLAGKNSHHIIEATFKAFARALRQATEYDLRRRGTVPRLQYSKETNGMASTAPRFLLTLGISVGCDNRT

SEQ ID NO: 23662 - protein, 350 aa, Triticum aestivum
TKSWKKLVNIAVSGAAGMISNHLLFKLASGEVFGQDQPIALKLLGSERSFQALEGVAMELEDSLYPLLREVSIGIDPYEVFEDVDWALLIGAKPRGPGMERAALLDINGQIFADQGKALNAVASKNVKVLVVGNPCNTNALICLKNAPDIPAKNFHALTRLDENRAKCQLALKAGVFYDKVSNVTIWGNHSTTQVPDFLNAKIDGRPVKEVIKDTKWLEEEFTITVQKRGGALIQKWGRSSAASTAVSIADAIKSLVTPTPEGDWFSTGVYTTGNPYGIAEDIVFSMPCRSKGDGDYELATDVSMDDFLWERIKKSEAELLAEKKCVAHLTGEGNAYCDVPEDTMLPGEV

SEQ ID NO: 23663 - protein, 229 aa, Medicago truncatula
MLRCLDGLKNLCVGVVNWCYSKVSGSKPPPSGLENPEEISRITVFSVSEVEALYELFKKISSGVVDDGLITKEEFQLALFKTSNKRSLFAERVFDMFDTNSHGVLDFKEFASALSIFHPIAPIDDKIDFLFRLYDLKQQGYIDRERLKQMVVATLSEFGMRLTEEMLNSIMDKTFEEVDTNHDGKIDREEWKNLAMQQTSLLKNMTLPYLTEITTTFPSFIFHTQVDDD

SEQ ID NO: 23664 - protein, 103 aa, Fusobacterium nucleatum
MAIVKGTKENFDAEVLKASGVVVVDFGANWCGPCKSLVPILDEIVEEDPSKKIVKVDIDEQEELAAQYKIMSVPTLLVFRNGEIIDKSIGLIQKHEVKALFAK

SEQ ID NO: 23665 - protein, 549 aa, Enterococcus faecalis
MKIVIIGGVAGGMSAATRLRRLMEDAEIVVMEKGPFVSFANCGLPYYVSGEIAEREQLLVQTPEALKARFNLDVRPHHEVVAIDPIEKVITVKHETEILTEHYDKLILSPGAKPFVPPITGLAEAKNVFSLRNVPDLDQIMTALTPETKRAVVIGAGFIGLEMAENLQKRGLEVTLVEKAPHVLPPLDEEMAAFVKAELSKNNVQVITGQSAVAFEEEGQVIRLEDGQTLASDLTILSVGVQPENTLAVEAGVATGLRGGIVVDEHYQTNQPDIYAVGDAIVVKQQITQEDALISLASPANRQGRQVADVIAGLERKNQGSIGTAIVRVFDLTAASTGLSERAAKAAGLTTAVVHISGKDHAGYYPGATDLQLKLVFHPTTGEIYGAQGIGAKGVDKRIDILATAIKGQLTIFDLPELEFTYAPPFGSAKDPVNMLGYAAMNLVEGLSENVQWYELSNELANGAVLLDVRNPAERANGQFKNAVSIPLNELRERLEELDKSTEYIVSCHSGLRSYIAERMLKQAGISAKNLDGAFALYRMVKPEELENV

SEQ ID NO: 23666 - protein, 396 aa, Coprinopsis cinerea
MSGINPGDDKLVFESSEAISTVSTFDDLGLKEDLLRGIYAYNFEKPSAIQQRAILPIIQGRDVIAQAQSGTGKTATFSISILQSIDVTVRETQALVLSPTRELATQIQSVILALGDYMNVQCHACIGGTSIGEDIRKLEYGQHVVSGTPGRVFDMIRRRSLRTRNIKMLVLDEADELLNKGFKDQIYDVYRYLPPATQVVLLSATLPYDVLEMTTKFMTDPIRILVKRDELTLEGIKQFFVAVEKEDWKFDTLCDLYDTLTITQAVIFCNTRRKVDWLTEKMRASNFTVSSMHGEMVQKERDAIMAEFRSGTSRVLITTDVWARGIDVQQVSLVINYDLPANRENYIHRIGRSGRFGRKGVAINFVTVEDVRILRDIEQFYGTQIDEMPVNAAELI

SEQ ID NO: 23667 - protein, 496 aa, Unknown
  Mycobacterium sp. MCS
MRVERLQTFASTLPADDDHPYRTGPWRPQVTEWRADDLEVVAGEVPADLDGMYLRNTENPLHPAATAYHPFDGDGMIHIVEFGGGKAAYRNRFVRTDGFLAENEAGGPLWAGFIEMPSAAKRADGWGARTRMKDASSTDVVVHRGTALTSFYMCGDLYQVDPYTADTLGKETWHGDFPDWGVSAHPKIDPVTGELLFFSYSKEAPHLRYGVVDKDANLVHHTDVALPGPRMPHDMAFTENYVILNDFPLFWEPSLLKQDIHAPVFHRDMPSRFAVLPRRGDQSQVRWFETDPTYALHFVNAYEDGDEIVLDGFFQDNPSPSTKGAKSLEDAAFRYLALDGFESHLHRWRFNLATGAATEERLSDSLTEFGMMNGDYQTRRHRYVYAATGKPGWFLFDGLVKHDLRDGTEERITFGDGVFGSETAMAPRQDGTAEDDGYLVTLTTDMNDDASYCLVFDAARIADGPVCKLRLPERICSGTHSTWVSGAELRRWHSPR

SEQ ID NO: 23668 - protein, 411 aa, Sorghum bicolor
MFLADRRGPCRRRDGDAIGHREQEAASLPLVLLLVVLQALPRRPAPAVPAQAACRAASATPRREVEEEEGARPAVDEDGSVGQVRAREKAMVINLEFIRAIVTADEVLLLEPLAQEVIPFIDKLRRHFPLKSVEVDVGATQVGNVDGKHAKTGAECGLPFEFQVLELALEAVCLSFHSSLSDLNKHAIFVLDELTENVSTRNLERVRSLKRNLTSLLAGVHKVRDEVEHLLDHNENRAQLHLSRKQIKSPQDEALLVSSALNCNFPSKTNLDIRNSVINQGTGIAVVAPLDDTVGDLEMLLESYFMQLDGIRNRITMVRGYIVDTEDYINIQLDNLRNGLIQLHLILIIVSFGISTNTLIAASFAINMPNNGDYKKFVGDFWQFVGGTSSFCLLVIVVLLGYAWRNRLLGS

SEQ ID NO: 23669 - protein, 485 aa, Corynebacterium efficiens
MPTNNAPQVAINDIGSAEDFLAAIDATIKYFNDGDIVEGTVVKVDHDEVLLDIGYKTEGVIPSRELSIKHDVDPDEVVQVGDQIDALVLTKEDKEGRLILSKKRAQYERAWGAIEELKEKDEPVTGTVIEVVKGGLILDIGLRGFLPASLVEMRRVRDLDPYIGQELEAKIIELDKNRNNVVLSRRAFLEQTQSEVRSEFLHQLQKGQVRKGVVSSIVNFGAFVDLGGVDGLVHVSELSWKHIDHPSEVVTVGDEVTVEVLDVDLDRERVSLSLKATQEDPWRVFARTHAVGQIVPGKVTKLVPFGAFVRVEEGIEGLVHISELAQRHVEVPDQVVTVGEEVMVKVIDIDLERRRISLSLKQADEDYTEEFDPSKYGMADSYDEQGNYIFPEGFDPETNEWLEGFDEQRQAWEARYAESERRFQAHTAQIERRRQQAEEAAAEAPAGNYSSESEDAAPSAAVEETGGSLASDEQLAALREKLAGN

SEQ ID NO: 23670 - protein, 140 aa, Zea mays
  misc_feature (39)..(39): Xaa can be any naturally occurring amino acid
  misc_feature (46)..(46): Xaa can be any naturally occurring amino acid
  misc_feature (56)..(56): Xaa can be any naturally occurring amino acid
  misc_feature (64)..(64): Xaa can be any naturally occurring amino acid
  misc_feature (85)..(85): Xaa can be any naturally occurring amino acid
  misc_feature (111)..(111): Xaa can be any naturally occurring amino acid
DCNKYMTQSAAKGCTSTFGPGVHSYRCPLRINKTPYCDXAEMLRSXMRGAFGKPEXTRAKVDIXQVLLSVPCMDHLVAHDVEALXRAYFNFPGRQMIIDTIRWGFTNFIRXPQHEVQLLTVDLFNVHTIAARITMARLEK

SEQ ID NO: 23671 - protein, 146 aa, Legionella pneumophila
MKYLHTMVRVSNLEQSLDFYCNKLGLIEVKRTENAKGRFTLVFLAAPADIEQVQTSYGPMLELTYNWDPEDYTEGRNFGHLAYHVDDIYKICQHLQECGVVINRPPRDGHMAFIRSPDNISIELLQKGEPLPKQEPWLSAPNIGHW

SEQ ID NO: 23672 - protein, 305 aa, Linum usitatissimum
IPPDQQRLIFAGKQLEDGRTLADYNIQKESTLHLVLRLRGGMQIFLKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGI

SEQ ID NO: 23673 - protein, 139 aa, Glycine max
MEGGGRRITVSPRPCCGRRVVAKKRPRLVDGFVNSVKKLQRREISSNRDRAFSMTDAQERFRNIRLQEEYDTHDPKGPSSAVLQFLRKRSKIIEIVAARDIGFALAQSGVCAAFSRETNERICFLNGKSLMKVITSLFY

SEQ ID NO: 23674 - protein, 142 aa, Trichodesmium erythraeum
MRLLHTMLRVNNLEKSIEFYCDVLGMKLLRKKDFPGGKFTLAFVGYGDELNHTVLELTYNWDTDKYDLGNAYGHIALGVDDIYSTCEKIKEQGGKVTREPGPMKHGSTVIAFIEDPNGYKVELIELKSDNSSLEKKVAANTN

SEQ ID NO: 23675 - protein, 340 aa, Oryza sativa
MGANGNDVVAAAAAGESPMGAARVVAEGGATVFRGADYSLPRTTVALALWLGGIHFNVFLVLASLFLFPLRVAAMVVAFQLLFMLIPLNDKDKLGRKIARFICRYAMGYFPISLHVEDYKCFDPNRAYVFGFEPHSVLPIGVAALADLVGFMPLPKIKVLASSAVFYTPFLRQIWTWLGLIPATRKNFQSYLGAGYSCIIVPGGVQEILHMDHDSEIAFLKSRKGFVKIAMQSGCPLVPVFCFGQSYAYKWWRPKGKLFVKIARAIKFTPIVFWGRYGTPIPFPTPMHVVVGRPIEVEKNSQPTIDEINEVHEQFTVALQDLFDKYKTETGYPGLHLRVL

SEQ ID NO: 23676 - protein, 501 aa, Matricaria chamomilla
MKPLFSLFLSLLILAQSSSSLPLPQTILPSTQASSLIRGLNLFPKHAVNLVEEDDYVRNNNSLDKKIVEKLFRFPNFVESDGVTVEDLGHHAGYYQIQHSHAAKMFYFFFESRNNKKDPVVIWLTGGPGCSSELALFYENGPFKIADNMTLVWNEYGWDQASNLIYVDQPTGTGFSYSSDKRDIRHDEQGVSDDLYDFLQAFFTEHPEFVDNDFYITGESYAGHYIPAIAARVHQGNKAKEGIHINLKGFGIGNGLTDPAIQYQAYTDYALDMGLIKESQYKRINLIVPLCEAAIKLCGTDGTVSCMAAYVVCNTIFSSILSIAGNINYYDIRKECVTSMCYDFSDMETLLNKKSVRQALGVGDIEFVSCSTTVYTAMLVDLMRNLEAGIPELLEDGIKMLVYAGEYDVICNWLGNSRWVHAMEWNGKEQFNALSEAPFEVDGSEAGLLKSYGPLSFLKVHDAGHMVPMDQPKAALEMLKRWMDGSLSETPRGPKSLVSSI

SEQ ID NO: 23677 - protein, 170 aa, Unknown
  Populus trichocarpa x Populus deltoides
MATQTSKNPESVHDFTVKDAKENDVDLSIFKGKVLLIVNVASKCGMTNSNYAEMNQLYEKYKDQGLEILAFPCNQFGEEEPGTNDQITDFVCTRFKSEFPIFDKIDVNGENASPLYRFLKLGKWGIFGDDIQWNFAKFLVNKDGQVVDRYYPTTSPLSLERDIKQLLEIS

SEQ ID NO: 23678 - protein, 533 aa, Geobacter sulfurreducens
MWKKRLAVLAVAAGAAVALSIPALSTAAKGKPAATGAKGDGRETCYGCHEEVKALKEGSKHARLACDSCHDKLKEHLANYETKPGTNLDPAKCGSCHKNEYSSFFTVNYDAQPRKEKGIPTGRSPMQDKLLAGHGFTFEHNEPRGHAFMVVDQFIVDRFQGGRFQYKKGAWGMDATGKAWDILTDTGKKLPETAMAGNPTCIQCKTSDHILKWKFMGDKDPKATWDRSSDIVAVAKDTQNPVGCIHCHDPHGTQPRVVRDGLIQAIEKDPTANIFAKNGKTDLKVISFRDGFRKIGVMEKTDSRLMCAQCHVEYNCNAGSQWSDGQKVGYDDQRTNHFPLKNAKDLLAHYKKLDFYDFKHAITGARLVKLQHPEAETYAGSVHDRAGVGCADCHMPRMKGKDGKMFKSHGVIRPAHHVKEACLGCHPKSTVEQKSYQIEGTRNYIRGKMRKAEYWLGQLIDTYAAAKRMGIGEDVLAKAREKHEEAHVLWEYWTAENSDGFHNPELARDSLTSSIAASKAGVKLLNDAMEPKK

SEQ ID NO: 23679 - protein, 268 aa, Euphorbia esula
MAASSSMALSSPSFAGQAVKLSPSSASELMGNGRVSMRKAATKKVAPSGSPWYGPDRVKYLGPFSGEPPSYLTGEFPGDYGWDTAGLSADPETFAKNRELEVIHSRWAMLGALGCVFPELLARNGVKFGEAVWFKAGSQIFSEGGLDYLGNPSLIHAQSILAIWACQVVLMGAVEGYRIAGGPLGEVVDPIYPGGSFDPLGLADDPEAFAELKVKELKNGRLAMFSMFGFFVQAIVTGKGPLENLADHLFDPVNNNAWAFATNFVPGK

SEQ ID NO: 23680 - protein, 302 aa, Cytophaga hutchinsonii
MHQSPLQPIILPQTEKAGVQLYLKRDDLIHPLYGGNKIRKLKYNVQQCLREGKIGLLTCGGAYSNHIIATAAYGKEHGLKTKAIIRGEELLIDNPTLKDAAALGMEFVFVSRETYRSIREQNALAFDLSKSNYNEWYFIPEGGTNAFAVEGIAELVAEIEIPFDYIATPCGTGGTFAGLMKGIKVYSPWRTKLLVFSALKNGNYIIDEVAELLKADFDRTTLELFTSEYVFGGYGKVKPELIAFVKSFEHQTGILLDPIYNGKMMFGLLGKIESGYFKKGSVIVAIHTGGIQAWRGFNNNFT

SEQ ID NO: 23681 - protein, 463 aa, Burkholderia vietnamiensis
MSGSNTGLGTGLKQRHVTMMSIAGVIGAGLFVGSGHAIAEAGPASILAYAIAGVLVVLVMRMLGEMAVAHPDSGSFSTYADRAIGHWAGFSIGWLYWWFWVLVIPIEATAAATILNAWFPGVATWIFALGITLLLTITNLFSVKNYGEFEFWFALIKVVAIVVFLCIGGAAILGIVPAPAVSGVSNLFAHQGFMPNGAGAVLAAMLTTMFSFLGTEIVTIAAAESDNPQRQIVRATNSVIWRITLFYLGSILVVAAIVPWNDPLLPKHGSYQRAMELIGVPNAKAIIDVIVLVSVASCLNSALYTASRMLFSLSKRKDAPAFLHRTDSTGTPRAAVLASTAFGFLTVIANYLMPEQVFGFLLATSGAIALLVYLVIAISQLRMRKTLESTGADLALRMWLFPWLTWAVILFICGTLTVMFVSEAHRMEVGATAVLALLVLFASWLNKRARDARAVAGGRVSAT

SEQ ID NO: 23682 - protein, 138 aa, Vibrio parahaemolyticus
MSNGRILHTMLRVGDLDKSIKFYTEVMGMQLLRTNENKEYEYTLAFVGYGDESQGAVIELTYNWGKTEYDLGTAFGHIAIGVDDIYATCDAIKAAGGNVTREAGPVKGGTTHIAFVKDPDGYMIELIQNKQASAGLEG

SEQ ID NO: 23683 - protein, 492 aa, Corynebacterium glutamicum
MPSSTINNMTNGDNLAQIGVVGLAVMGSNLARNFARNGNTVAVYNRSTDKTDKLIADHGSEGNFIPSATVEEFVASLEKPRRAIIMVQAGNATDAVINQLADAMDEGDIIIDGGNALYTDTIRREKEISARGLHFVGAGISGGEEGALNGPSIMPGGPAKSYESLGPLLESIAANVDGTPCVTHIGPDGAGHFVKMVHNGIEYADMQVIGEAYHLLRYAAGMQPAEIAEVFKEWNAGDLDSYLIEITAEVLSQVDAETGKPLIDVIVDAAGQKGTGRWTVKAALDLGIATTGIGEAVFARALSGATSQRAAAQGNLPAGVLTDLEALGVDKAQFVEDVRRALYASKLVAYAQGFDEIKAGSDENNWDVDPRDLATIWRGGCIIRAKFLNRIVEAYDANAELESLLLDPYFKSELGDLIDSWRRVIVTATQLGLPIPVFASSLSYYDSLRAERLPAALIQGQRDFFGAHTYKRIDKDGSFHTEWSGDRSEVEA

SEQ ID NO: 23684 - protein, 350 aa, Dunaliella salina
MPPLRPSPKETALVAKPRTSILIKPFKITRLHAHEGASADSSPGPAPPKEQQEQPPKEQVAPPPAAAQAAAEPTQPQAASQAPPAPEPKKGSAFKGYVQQNFVQPGRTLQQQAGRKIYPGSDERALSYLTGSLPGDFGWDPLHLADTNDQDRLNNAMSMEWLSYAEVIHGRWAMLGAAGALSPEVLGKAGVIPKETGLTWFQAGGLDSSSNLIAVPFTGPIPFQYWTDQYTLLFTMLVAMGFAETRRWQEYKEPGSVQKQFFLGLEKLTPPSQQPAYPGGGFFNFAGLGAKDEKQMFELKVKEIRNGRLAMLAFLGFMVQAEVTHVGPFQNLLDHINSPGAQNLLSRLTN

SEQ ID NO: 23685 - protein, 229 aa, Medicago truncatula
MLRCLDGLKNLCVGVVNWCNSEVSGSKPPPSGLENPEEISRITVFSVSEVEALYELFKKISSGVVDDGLITKEEFQLALFKTSNKRSLFAERVFDMFDTNSHGVLDFKEFASALSIFHPIAPIDDKIDFLFRLYDLKQQGYIDREQLKQMVVATLSESGMRLTEEMLNSIMDKTFEEVDTNHDGKIDREEWKNLAMQQTSLLKNMTLPYLTEITTTFPSFIFHTQVDDD

SEQ ID NO: 23686 - protein, 270 aa, Glycine max
MSQDLKRDYVVSEEIGRGRFGTVFRCSSADSGHSYAVKSIDKVAITAAGDSLDAQCLLTEPKIVQLLSPHPHIVNLHDLYEDETNLHMVLDLCYESQFHHRVMSEPEAASVMWQLMQAVAHCHRLGVAHRDVKPDNILFDEENRLKLADFGSADTFKEGEPMSGVVGTPHYVAPEVLAGRDYNEKVDVWSAGVVLYQMLAGFLPFRGDSPVEIFEAVLRANLRFPTRVFCSVSPAAKDLLRRMLCKEVSRRFSAEQVLRHPWFSVAEQSE

SEQ ID NO: 23687 - protein, 417 aa, Unknown
  Marinobacter sp. ELB17
MFNRDMKIAGFDDELWNAMQAESHRQEAHIELIASENYTSPRVMEAQGSDLTNKYAEGYPGKRYYGGCEFVDIAEQLAIDRAKELFGAAYANVQPHSGSQANSAVFLALLNAGDTVLGMSLAHGGHLTHGASVNFSGKIYNAVQYGIDTDTGLINYDDVEALAVEHKPKMIIAGFSAYSQYLDFARFREIADKVGAYLFVDMAHVAGLVAAGVYPDPVPHAHVLTTTTHKTLRGPRGGLILACDDEALHKKLNSAVFPGGQGGPLMHVIAAKAICFKEAMSPEFKTYQQQVVKNAAAMAEVFVDRGFDVVSGGTKNHLFLLSLIKQDITGKDADAALGRAHITVNKNAVPNDPRSPFVTSGLRIGTPAITTRGFAEAECRELSGWICDILADLNDEAVIDRVRGQVEAMCARFPVYA

SEQ ID NO: 23688 - protein, 329 aa, Unknown
  Azoarcus sp. BH72
MKRLKIAVLGAGAWGTALAQAFADTHEAVLWGRDAAHIDATRHAAENTRYLPGVALHPQLALTADLPAAALGADLHLVVTPLAGLRDTLRLLNDIQPDTPVIWACKGLEAGSGKLPHEIVADELGATPCGVLTGPSFAAEVARGLPAAITLAASDVEFARHWVHALHRPRLRLYANADVVGCEIGGALKNVMAIAAGVSDGMGFGLNARAALITRGLAEIARLATAMGGHAETLMGLAGMGDLILTCTGDLSRNRRVGLALAAGNTLSDILRDLGHVAEGVSTAHEAVRLARRHGVEMPICEAVDALLHGGLAARDAVERLLARDPKRE

SEQ ID NO: 23689 - protein, 745 aa, Rickettsia prowazekii
MFNEITKSVMWNGQVLEISTGKIARQANAAVTVKMGNSILLCTCVVANKVKDGIGFFPLTINYREMAYSAGKIPGGFFKREGKASDREILVSRLIDRPIRPLFHQAFMHETHVTCSVLSYDPATPVDILAIIGASAALSISPAPYLEIVAASKVGLINGEFVLNPTLELLKTSQLDLVVAGTEDSVMMVESEAHLLSEDKMLEAVKFGFESFQTVIKLIKELAKEAKKPKFEMQDLYPSSLKKEIEKLFTKEVEQAFEIKSKQERSTDLALIYEKVLTHFVRDIENKKYNNYQIESALKAISADILRNKILEKNIRIDGRSTTDIRQIACEVGLLPSAHGSALFTRGETQSLVSTTFGTSLDEQIVDSLEGEYKERFMLNYIFPPYSVNEAMPMKAPSRREVGHGKLAWRAINPILPNKVQFPYSIRVVAETTESNGSSSMATVCGSSLALMHAGVPIKAPVAGIAMGLVKESNKFAVLSDIIGDEDYFGDMDFKVAGTSSGITALQMDIKISGIDFKIIQIALEQARLGRLHILEQMNKVISKPNSELSKNAPSSTTVKIDKDKIKDIIGPGGKIIKEICETSNAKIDISDDGTVSIYASDRDKIKIALDKIKAIAVEPEIGEIFNGTVMKVLDSGAFINYLGNKDGFVHISEISDARIDKVSSVLKQGDIVKVKLIGFDNKGKAKLTIKNAYKDHSSNNTKQKNNVKDDSESEQRRDTSKKRTWNEDNNTEMSEVITERKYFT

SEQ ID NO: 23690 - protein, 393 aa, Arabidopsis thaliana
SSESNNTLKKSVSSPFMNTASKMYSISEVRKHNTADSAWIIVHGHIYDCTRFLKDHPGGTDSILINAGTDCTEEFEAIHSDKAKKLLEDYRIGELITTGYDSSPNVSVHGASNFGPLLAPIKELTPQKNIALVNPREKIPVRLIEKTSISHDVRKFRFALPSEDQQLGLPVGKHVFVCANINDKLCLRAYTPTSAIDAVGHIDLVVKVYFKDVHPRFPNGGLMSQHLDSLPIGSMIDIKGPLGHIEYKGKGNFLVSGKPKFAKKLAMLAGGTGITPIYQIIQSILSDPEDETEMYVVYANRTEDDILVREELEGWASKHKERLKIWYVVEIAKEGWSYSTGFITEAVLREHIPEGLEGESLALACGPPPMIQFALQPNLEKMGYNVKEDLLIF

SEQ ID NO: 23691 - protein, 396 aa, Arabidopsis thaliana
SADAPPSLKKSVSTPFMNTTAKMYSMSEVKKHNSADSCWIIVHGHIYDCTRFLMDHPGGSDSILINAGTDCTEEFEAIHSDKAKKMLEDYRIGELITTGYSSDSSSPNNSVHGSSAVFSLLAPIGEATPVRNLALVNPRAKVPVQLVEKTSISHDVRKFRFALPVEDMVLGLPVGKHIFLCATINDKLCLRAYTPSSTVDVVGYFELVVKIYFGGVHPRFPNGGLMSQYLDSLPIGSTLEIKGPLGHVEYLGKGSFTVHGKPKFADKLAMLAGGTGITPVYQIIQAILKDPEDETEMYVIYANRTEEDILLREELDGWAEQYPDRLKVWYVVESAKEGWAYSTGFISEAIMREHIPDGLDGSALAMACGPPPMIQFAVQPNLEKMQYNIKEDFLIF

SEQ ID NO: 23692 - protein, 679 aa, Medicago truncatula
MSSSGGGCSIVWFRRDLRVEDNPALAAGVRAGAVVGVFIWAPEEEGQYYPGRVSRWWLKNSLAHLDSSLRNLGTPLVTKRSTDSVSSLLEVVKSTGATQIFFNHLYDPLSLVRDHRAKEILTAQGITVRSFNSDLLYEPWDVNDENGQPFTTFDSFWERCLSMPYDPQAPLLPPKRIIPGDVSKCPSDTLVFEDDLEKASNALLARAWSPGWSNANKALTTFINGPLIEYSKNRRKADSATTSFLSPHLHFGEVSVKKVFHLVRIKQVFWANEGNEAGEESVNLFLKSIGLREYSRYISFNHPYSHERPLLGHLKFFPWVVNEGYFKAWRQGRTGYPLVDAGMRELWATGWLHDRIRVVVSSFFVKVLQLPWRWGMKYFWDTLLDADLESDALGWQYISGTLPDGREFDRIDNPQFEGYKCDPNGEYVRRWLPELARLPTEWIHHPWNAPESVLQAAGIELGSNYPLPIVEIDAATVRLEEALIQMWQLEAASRAAAENGTEEGLGDSAESTPIAFPQDIQMEERHEPIRNNAPHGTRRYQDQMVPSMTSSRVRVEEEETSSVRNSAGDSRAEVPTNANAREAMNQGALQNGNRNTRQRHNPTTTFWLRNAAEDSTAESSSSTRRERDGGVVPEWSPQASNFSDQYVDDENGIGATSPYLQRHPQSHQLMSWTRLPQTG

SEQ ID NO: 23693 - protein, 833 aa, Mycobacterium avium
MVGHRFVEALRARDTEGRWRITVFAEEADAAYDRVGLTSYTESWDRALLALPGNDYQGDPQVRLVLNQRVTEIDRATKSVVTADGQRHHYDTLVLATGSYAFVPPVPGHELPTCHVYRTLDDLDAIRADAQRAAQTDHARAGVVIGGGLLGLEAANALRQFGLATHVVEMMPRLMAQQIDEAGGALLARMIGDLGISVHVGTGTEAIEPVEGPDGSTTVRVRLSDGQVIDAGLVIFAAGIRPRDELAVAAGLARAERGGVLTDLSCRTSDPDIYAIGEVAAIDGRCYGLVGPGYTSAEVVADRLLDGSAEFGEADLSTKLKLLGVDVASFGDAMGTTENCLEVAINDAVNRTYAKLVLSDDAKTLLGGVLVGDASSYGVLRPMVGSELPGDPLALIAPASSGGGTALGVGALPDSAQICSCNNVTKGDLKCAIADGCADVAALKSCTSAGTSCGSCVPLLKQLLEAEGVEQSKALCEHFSQSRAELFEIISATEIRTFSGLLERFGRGKGCDICKPVVASILASTGSEHILEGEQASLQDSNDHFLANIQKNGSYSVVPRVPGGDIKPEHLILIGQIAQDFGLYTKITGGQRIDMFGARVDQLPAIWKRLVDGGMESGHAYGKALRTVKSCVGTDWCRYGQQDSVQLAIDLELRYRGLRAPHKIKMGVSGCARECAEARSKDVGVIATEKGWNLYVGGNGGMTPKHAQLLASDLDTETLVRYIDRFVMYYIRTADRLQRTAPWVESLDGGLDHVREVVCEDSLGLAEEFEAAMERHVRNYKCEWKGVLDDPDKLSRFVSFVNAPDAVDSTVAFTEHAGRKIPVSIGMPKIRQG

SEQ ID NO: 23694 - protein, 400 aa, Physcomitrella patens
MKRRNECEEHHVEMNGWNGYTNSDLSPAPTPTGPRGRGSRAKTVKQTKNGPQTPGPSGIGSPTSSAPTPTSTCRYDSSLGLLTKKFIDLIKQADDGVLDLNKAADTLHVQKRRIYDITNVLEGIGLIEKKLKNRIRWKGLGMVRNAEAKDDAAGLLAEVEDLRIKEKKLDESISEMRERLRSLSEDEHNKQWLYVTEDDIKNLHCFQNETLIAIKAPLGTTLEVPDPDEAVEYPHRRFQILLRSTLGPIDVYLVSRFEGRTEVPMETLPDSQEAGPSSSVDGMSHQENMVMVPEVGYGLSDLVPPVSHESASQAPEPTGSHPDFAGGIMRIAPAEVNTDTDYWLLSDAGVGISDMWRSDPSNAMWDEVVRLNPEFGSENIGSPRPHTPPSNNALEVDPVS

SEQ ID NO: 23695 - protein, 987 aa, Geobacillus kaustophilus
MEAQMVTVTINGRAYRAKPGMTILEVVNEHGLPHPQVCYTPELGAIQTCDTCIAEVNGTLLRACATPVEDGMVVELGSPRAKAAQKEAMDRLLENHLLYCTVCDNNNGNCKLHNTAEMMQIEHQTYPYRPKVDPSEVDMSHPFYRYDPNQCIACGQCVEACQNLQVNETLSIDWEAERPRVVWDGGVPINESSCVSCGQCVTVCPCNALMEKSMLGEAGFLTGLDKDVLNPMIDFVKEVEPNYTSIFAISEIEAAMREQRIKKTKTVCTFCGVGCSFEVWTKGRKILKIQPVSEAPVNAISTCVKGKFGWDFVNSEERLTKPLIRKGDVFVESTWDEALDLVAEKLGAIKRQYGGNAIGFISSSKISNEENYLMQKLARQVFETNNVDNCSRYCQSPATDGLFRTVGMGGDSGTIHDIATAGLVIIIGANPAEGHPVLATRVKRAHKLFGQKLIVADLRRNEMAERADLFIRPKQGTDQVWLMAVTKYIIDQGWHDEAFIRERVHFFEEFKQLLEKYTLDYAEQVTGIAKADLIRIAEMIHEADGTCVLWGMGVTQNTGGSDTSAAISNLLLATGNYGRPGAGAFPLRGHNNVQGACDMGSLPAWLPGYQHVTDDEARAKFEQAYGVRIDAKPGLDNIQMLEAAERGELKAMYIVGEDMALVDCNANHVQETLAKLDFVVVQDIFLSKTAQFADVILPAAPSLEKEGTFTNTERRIQRFYQALEPLGDSKPDWWIIQEIAKRLGADWNYAGPKEIMDEIASLAPLYSQAHYDRLEGWNSLCWGSHDGADTPLLYKERFNFPDGKARFALADWVEPVQYPEEYDLLVNNGRLLEHFHEGNLTYKSKGIEHKFPEVFVEVSPELAKERGIEDGALVRLISPYGRVKVRVLVTDRVRGNELFLPMHSTANESAINILTGPATDRRTNTPAYKQARVRMEVIERSGKTPLPRTNPRFKKRHPQNGVEVERKWRRSDYVPLTEENKGVTIGG

SEQ ID NO: 23696 - protein, 389 aa, Arabidopsis thaliana
MVIAAAVIVPLGLLFFISGLAVNLFQAVCYVLIRPLSKNTYRKINRVVAETLWLELVWIVDWWAGVKIQVFADNETFNRMGKEHALVVCNHRSDIDWLVGWILAQRSGCLGSALAVMKKSSKFLPVIGWSMWFSEYLFLERNWAKDESTLKSGLQRLSDFPRPFWLALFVEGTRFTEAKLKAAQEYAASSELPIPRNVLIPRTKGFVSAVSNMRSFVPAIYDMTVTIPKTSPPPTMLRLFKGQPSVVHVHIKCHSMKDLPESDDAIAQWCRDQFVAKDALLDKHIAADTFPGQQEQNIGRPIKSLAVVLSWACVLTLGAIKFLHWAQLFSSWKGITISALGLGIITLCMQILIRSSQSERSTPAKVVPAKPKDNHHPESSSQTETEKEK

SEQ ID NO: 23697 - protein, 256 aa, Pseudomonas fluorescens
MHPYFSLQGRTALVTGGTRGIGKMIAKAFVEAGARVYICARDPDACQQVAEELAAFGECRGLAANLANEEGVQQLAATLGQQLDSLDLLVNNAGTTWGAPLESYPAKGWEKVMQLNVTSVFSCIQQLLPLLRRAGSAAHPARIINIGSVAGISSFGEQAYAYGPSKAALHQMSRILARELVSQHINVNVIAPGRFPSKMTQHIGNDEQALAEDVALIPMKRWGREEEMAALAISLASTAGAYMTGNIIPLDGGFSL

SEQ ID NO: 23698 - protein, 533 aa, Pseudomonas aeruginosa
MTTCGEFLVKQLEAWGVETVFGIPGVHTVELYRGLPGSRIRHVTPRHEQGAGFMADGYARVTGKPGVCFIITGPGMTNILTAMAQAYADSIPMLVISSVNERARLAHGNGYLHELPNQRNLVGNVCAFSHTLMSAEELPAVLARAFAVFDSERPRPVHIELPLDVITAPAEHLALRPRTVASRPAPALAPLREAAARLRNAKKPLLLLGGGCVEAAAEARALAAALDAPTALTINAKGLLPADHPLLLGSNQSCVPVRELAAEADVVLAIGTELGETDYDVVFDGGFALDGELIRIDIDPQQLMRNYTPSLAIHSDARLAMRVLLAELPGGEASPDSPGARRAAAVRQRLAEDFAGWSHYRQLFAAILAEWPDARFVGDSTQTVYSGNHLVDLDEPRRWFNASTGYGTLGYGLPAAIGAKLGEPGRPVVSLMGDGGLQFTLPELASAVEAKVGIVVLLWNNHGYGEIKRYMERREITPLGVDIYTPDFLAIARGFGCAAERARDLEHLRELLRGAPADRPLIVEVLQAAPFHP

SEQ ID NO: 23699 - protein, 206 aa, Legionella pneumophila
MNRTKSSKRWLQEHFDDVYVKKAQAEGYRSRAVYKLKEIDDKESLIKPGMTVVDLGAAPGGWTQYASEKMRGSGRLVALDILPMDALPNVEFILGDFREDNVLQELINLIPQRTLDLLLSDMAPNMSGSSAIDIPRAMYLVELAFDFAEKMLKPGGNMLVKIFHGSGFDELVKQARASFEKVVIRKPSASRSRSKETYLLAKGYNL

SEQ ID NO: 23700 - protein, 444 aa, Bacteroides thetaiotaomicron
MNAAKVLDDLKRRFPNEPEYHQAVEEVLSTIEEEYNKHPEFDKANLIERLCIPDRVFQFRVTWMDDKGNIQTNMGYRVQHNNAIGPYKGGIRFHASVNLSILKFLAFEQTFKNSLTTLPMGGGKGGSDFSPRGKSNAEVMRFVQAFMLELWRHIGPETDVPAGDIGVGGREVGFMFGMYKKLAHEFTGTFTGKGREFGGSLIRPEATGYGNIYFLMEMLKTKGTDLKGKVCLVSGSGNVAQYTIEKVIELGGKVVTCSDSDGYIYDPDGIDREKLDYIMELKNLYRGRIREYAEKYGCKYVEGAKPWGEKCDIALPSATQNELNGDHARQLVANGCIAVSEGANMPSTPEAVRVFQDAKILYAPGKAANAGGVSVSGLEMTQNSIKLSWSAEEVDEKLKSIMKNIHEACVQYGTEADGYVNYVKGANVAGFMKVAKAMMAQGIV

SEQ ID NO: 23701 - protein, 288 aa, Ostreococcus tauri
MDSASLLSAFDVCFPEGEGPAEFGLALPSFSDIVFPQDDDDQMSKMAMEIFDFDCDCDWGTELAGDEETVPEQLRHRHSKDRAVMMKKKAQIAPKGSSRSSKWKGVTKHKITSRWEAHLWDATFERRKSSKSGRQRGRQVYLGGWQSELDAARAYDLASLRYFGTRSPLNFPRENYADELKIMQEYTCADWVAEIRRKSSGFSRGRSRFRGVTSHKGKNSKGKWEARIGRVMGNKYLYLGTFPSERAAAEAYDLAALRFRDSKAVTNFDRSNYSEEDIKNAANDAKIV

SEQ ID NO: 23702 - protein, 303 aa, Burkholderia thailandensis
MTFMAYKTIEDTIGNTPLVQIVRLPDDEIRARNNVILAKLEGNNPAGSVKDRPALSMIRKAEERGRIKPGDTLIEATSGNTGIALAMVAAIRGYKMVLIMPEDLSVERRQSMAAYGAEIVLTPVKGGMEFARDLADQMQREGKGVILDQFANPDNPLAHYEGTGPEIWRETEGRITHFVSAMGTTGTIMGTSQYLKERNPAVEIVGAQPEEGSRIPGIRKWPEAYLPKIFDRSRIDRVENVSQAASEAMARKLAAVEGIFCGISSGGACEVALRVARQVENATIVFVVCDRGDRYLSTGVFPA

SEQ ID NO: 23703 - protein, 445 aa, Bacteroides thetaiotaomicron
MNIQKIMSSLEAKHPGELEYLQAVKEVLLSIEDIYNQHPEFEKVKIIERLVEPDRIFTFRVTWVDDKGEVQTNLGYRVQFNNAIGPYKGGIRFHASVNLSILKFLGFEQTFKNALTTLPMGGGKGGSDFSPRGKSDAEIMRFCQAFMLELWRHLGPDMDVPAGDIGVGGREVGYMFGMYKKLTREFTGTFTGKGLEFGGSLIRPEATGFGGLYFVYQMLQAKNIDIKGKTVAISGFGNVAWGAATKATELGAKVITISGPDGYIYDPDGISGEKIDYMLELRASGNDIVAPYAEKYPGATFVEGKRPWEVKADIALPCATQNELNGEDAQNLIKNNVLCIGEISNMGCTPEAIDLFIEKKIMYAPGKAVNAGGVATSGLEMSQNAMHLSWSAAEVDEKLHAIMHGIHAQCVKYGTEPDGYINYVKGANIAGFMKVAHAMMGQGVI

SEQ ID NO: 23704 - protein, 920 aa, Unknown
  Magnetococcus sp. MC-1
MYDLENTLMRQALELNGLGTIILDPQQTIVFWNAWMERGSQMFAAHVLGSKLLDVFPELQGSRLDRAVVSALRTGLPTMLSHRLNPTPFPLETASKNEELGQRMSQMVQIKAIRNEAGERYCVILIHDITNTVSREQMLRNQARELHSAKDEAQQANRAKSDFLANMSHEIRTPMNAIIGMSHLALKTDLNAKQRDYVGKIHDSALLLLGIINDILDFSKIEAGKLSMESVAFYLDDVLSNVANLVSMKVEEKGLEISFQVDRGVPLHLVGDPLRLGQILINLVNNAVKFTEQGNIVVAITAELDCESHVVVQFQVRDSGIGMTKQQIDRLFQAFSQADSSTTRRYGGSGLGLSICKRLVGMMDGDIWVESQPGRGSQFTFTAQLVSQRQDRRRFRLPSMHLVGLRVLVVDDNPVVRQILVESLAIFSFCVEALATVEEVIEALGQAIARGEPYGLVVLAGRFGGKGGVALAGEINRCYPQLTLPKMVLVGASERDDVVAMAGAQLVELFVTKPITQTILFEGVLEVLGYVVQAQQHAGGRDRTREKRVLSGCQILLVEDNEINQQVACELLQGEGVTVVVANSGQQAVDRVLSGERFDAVLMDIQMPGMDGYEATQVIRKQPQFSDLPIIAMTANAMAGDRERCLAAGMNDHIGKPIQPKLLFETLGRYVIKGDGVVEAGNKGILLPPIELTPLDGSVTTPLPPPVLPAAVGRAAMISPRAGAVPERLDGVDMEKGLVHVGGNEALYVKILKEIGERYKDVVVEIQGLFAARHFAQAIQLVHTYKGLTGTIGAMALSQSAAQLEEALKAGAYERLPQLLGDFSQLAERLNVALLPMVGVANVQALPSGAEQAGLEEGLLALGALIRDGDAEALDRVKQLRGMAAGQVYQPLMAQLESELDEYEFERAKVTYHHLLAQLK

SEQ ID NO: 23705 - protein, 586 aa, Triphysaria versicolor
MCGILAVLGCSDDSQAKRVRVLELSRRLKHRGPDWSGIHHHGDCYLAHQRLAIVDPASGDQPLFNEDKRIAVTVNGEIYNHEELRALLPNHKFRTGSDCDVIAHLYEEYGENFVEMLDGMFSFVLLDSRDNTFIAARDAFGITSLYIGWGLDGSVWISSELKGLHDECENFEVFPPGHVYSSKTEGFRRWYNPPWFSEAIPSTPYDPLVLRGAFEQAVIKRLMTDVPFGVLLSGGLDSSLVAAVTARHLAGTKAAKRWGSQLHSFCVGLEGSPDLKAGKEVADYLGTVHHEFLFTVQDGIDAIEDVIYHIETYDVTTIRASTPMFLMSRKIKSLGVKMVISGEGSDEIFGGYLYFHKAPNKEEFHRETCRKIKALHQYDCLRANKATSAWGLEARVPFLDKEFVNLAMSIDPEAKMIKPDQGRIEKWILRKAFDDEERPYLPKHILYRQKEQFSDGVGYSWIDGLKAHAEQHVTDKMMLNAGHIFPHNTPTTKEGYYYRMIFERFFPQNSAKLTVPGGPSVACSTATAVAWDASWSKNLDPSGRAATGVHDLAYENHVPIGNLKSKKMDSVSLGNAVGPQELTIRS

SEQ ID NO: 23706 - protein, 429 aa, Saccharophagus degradans
MSFPLSSSSFSDKKNAFYAQSGGAAAVLNASAAGVVAGVMAHKDKIENLYIGRNGILGALHEDMVVVNTHDDNLIDDLLHAPAGAFGSCRYKLKSIEESEREYARILEVFKAHNIGYFFYNGGGNSQDTSCKLAKYAAKKNYPLQCIGIPKTIDNDLSGTDCSPGYGSVAKYVAVSILEASMDLASMHQTSTKVFVMEVMGRDSGWIAAAAGLAADERNLGPDLIIFPEVPYEEYKFYAELNRIVARKGFCVVVVAEGVRGPDGNHLTSTANKDAFGHTQLGGAASIIAGRIREVTGHKTHFAVCDYLQRAARHIASKTDVDQSFLVGKKAVEFAANGYSNVMMAIVRESEQPYRWSVGTVPLVEAANSRNALPAGFISKCGFHITDACRRYLAPLIAGESYPSYQNGLPAYRVFNSVAVPKKLEEFTL

SEQ ID NO: 23707 - protein, 581 aa, Penicillium chrysogenum
MEEKKFEAVQTGAEAPPAYGDSSPTRGGIGQRIFDSFKRDPNHTVTGHVGADGSGFDAETAAHNTAHSPLQRRLKGRHLQMIAIGGSIGTGLFVGSGSVLATGGPASVLIAYILIGCMLYCTVHALGEMAVLFPVAGSFAHYSTRFVDPAWGFAMGWNYALQWLIVLPLEIVAASITVDYWNPGVSNAAWVTIFWVMIVSINLFGVRGYGEAEFVFSLIKVIAVIGFIILGIILNCGGGPQGGYIGARYWYDPGAFRNGFKGLCSVFVNAAFAFAGTELVGLAAAETTNPRKSLPTAVKQVFWRIALFYIVSLTLVGLLVRYDDERLISGSSSADAKASPFVIAIENAGIKALPSIMNVVIMIAVLSVGNSSVYGSSRTLAALAEQGQAPKFLAYIDRKGRPLPAIIIASILGLLSYLAASDVQTTAFEWMMAISGLSSIFTGVPCVRAHILFRRAWKKQGHSLDELAFRSQPGVIGSWVGFIFNCLVLVAQFWVGFAPIGYADMTSQEIAYKFFSVYLAAPVVLICYIGYKIMYKTKFVRTSEVDLVTGRRDLDIQHLIEQEMAEQREWPKWKKVYKFFC

SEQ ID NO: 23708 - protein, 243 aa, Oryza sativa
MVVGAGGGDELKLLGVWDSPYVNRVQIVLNLKGLSYEYVEEDLMNKSDLLLGSNPVHKKVPVLIHNGKPIAESRVIVEYLDEAFAAGAGGSTGASVLPSDPYERAVARFWAAYVDDKVGSPWYTILFARERGEKVEAAARAISALETVEAGAFRDRSSEGKTTNAAAAPFFGGDSIGFVDVVLGSYLGWFRVIEKMIGVRIMDAARTPRLAAWAERFEAADAVRGVLPDDVDKVIDFLQAFLH

SEQ ID NO: 23709 - protein, 678 aa, Arabidopsis thaliana
MSSLFPFIFLFLFSFLTSFRASAQDPRFLAYYCPNATTYSSNSTYLTNLKTLLSSLSSRNASYSTGFQNATVGQALDRVTGLFLCRGDVSPEREAVFYYEECILRYSHKNILSTAITNEGEFILRNPNHISPIQNQINQFTNLVLSNMNQIAIEAADNPRKFSTIKTELTALQTFYGLVQCTPDLSRQNCMNCLTSSINRMPFSRIGARQFWPSCNSRYELYDFYNETAIGTPPPPLPPLASPSLSGEQFLLPLPCLLDLCSITNMERRMICLNADKSGNSNVVVVAVVVPIIVAVLIFIAGYCFFAKRAKKTYGTTPALDEDDKTTIESLQLDYRAIQAATNDFSENNKIGRGGFGDVYKGTFSNGTEVAVKRLSKTSEQGDTEFKNEVVVVANLRHKNLVRILGFSIEREERILVYEYVENKSLDNFLFDPAKKGQLYWTQRYHIIGGIARGILYLHQDSRLTIIHRDLKASNILLDADMNPKIADFGMARIFGMDQTQQNTSRIVGTYGYMSPEYAMRGQFSMKSDVYSFGVLVLEIISGRKNNSFIETDDAQDLVTHVSLKERSYIYAWRLWRNGTALDLVDPFIADSCRKSEVVRCTHIGLLCVQEDPVKRPAMSTISVMLTSNTMALPAPQQPGFFVRSRPGTNRLDSDQSTTNKSVTVSIDDKSMSDLDPR

SEQ ID NO: 23710 - protein, 164 aa, Vitis vinifera
RSHLMVGFGAIVEHCKELHRLSLSGLLTDRVFEYIGTHAKKLEMLSVAFAGDGDLGLHHVLSGCKSLRKLEIRDCPFGDKALLANAAKLETMRSLWMSSCSVSFGACKLLGQKMPRLNVEVMDERGRPDSRPESCSVEKLYIYRSVAGPRSDMPRFVWTMKTPS

SEQ ID NO: 23711 - protein, 375 aa, Unknown
  Populus tremula x Populus alba
MGRAPCCEKNGLKRGPWTPDEDQKLIGYIQKHGYGNWRTLPKNAELQRCGKSCRLRWTNYLRPDIKRGRFSFEEEETIIQLHGILGNKWSAIAARLPGRTDNEIKNYWNTHIRKRLLRMGIDPVTHSPRLDLLDLSSILNSPLYDSSRMNMSRILGVQPLGDPELLRLATSLLSSQRDQTQDFAIPNGHQENHLSSPQVHQNQNQSIIHQANQFQPAGQEMPACTALTTTPCVTFSNEAQQMDPNGDQYHLSTITTFSSPNSQVSTHDQWQSNRMGSNLSEDYYVPAVSSYNSADNCRGTDLVDPSSEASTFISNNSNQTFGFASVLSTPSSSPAPLNSNSTYINCSSTEDERDSYCSNFLKFEIPDILDVSNFM

SEQ ID NO: 23712 - protein, 466 aa, Unknown
  uncultured archaeon GZfos1D1
MSDVLFIYPNALEIPVHPEFDKYERLMRDFAEERDLVGLAWGTMVPPTAMLSLSAFLKENGISTSFLDFTVECFLGGKTDKVLVSALRKENPKVVAVNGMEDCFLSELYNIAHIVKEYDENIYVVTGGVSATTRDSEILRKPVVDFVIMGESETPLLTLSNALIQNEDFEKIRGISFMKDDRIVRTDNQSFIDLETLPFPDRDSYPLSRLYALNGGIDLVYASRGCPFNCSFCNAPAFWKRQWRAREPKDIVEELSILGDLGAKIVHIYDLNFGINKKWVKNICKEIRREKLDIIWDCELALIDFNRSFLKTLYDGNCRGAFCGIEAVSQSVLDSVNKSYKSQDLVKYLNNAKDAGIHVDGGYVFGLPEDNLSGMMTMTRLACRLLEEDLVETPAPFLFVPFKGTEIGENLKRHGIEIVNNNTDEWHFFPPNPIASTKYASAEEVHREWVNCIINISNILESKLSG

SEQ ID NO: 23713 - protein, 392 aa, Fusobacterium nucleatum
MAKRDYYEVLGIDKSASENDIKKAYRKAAMKYHPDKFANASDAEKKDAEEKFKEINEAYQILSDSQKKQQYDQFGHAAFEQGGAGFGGGFNAGGFDFGDIFGDIFGGGGFGGFEGFSGFGGSSRRSYVEPGNDLRYNLEITLEEAAKGVEKTIKYKRTGKCENCHGTGGEDDKMKTCPTCNGQGTIRTQQRTILGVMQSQSVCPDCHGTGKVPEKKCKHCHGTGTAKETVEKKVNVPAGIDDGQKLKYAGLGEASQNGGPNGDLYVVIRIKSHDIFVRDGENLYCEVPISYSTAVLGGEVEIPTLNGKKMIKVPEGTESGKLLKVKGEGIKSLRGYGQGDIIVKITIETPKKLTDKQKELLQKFEESLNEKNYEQKSSFMKKVKKFFKDIID

SEQ ID NO: 23714 - protein, 562 aa, Brassica rapa
MTNRSQRKLNVSSALHTHPALHFPKQSSTSPAIIVNPKTKESDTKQMSLFQRAAAAALDAAEGFLVSHERQHPLPKTADPSVQIAGNFAPVNEQPLRRNLPVVGKIPDSIKGVYVRNGANPLHEPVTGHHFFDGDGMVHAVTFEDGSASYACRFTLTNRFIQERQLGRPVFPKAIGELHGHTGIARLMLFYARAAAGLVDPAHGTGVANAGLVYFNNRLLAMSEDDLPYQVRITPGGDLKTVGRYDFDGQLESTMIAHPKVDPESGELFALSYDVVSKPYLKYFRFSPDGEKSPDVEIQLDQPTIMHDLPITENFVVLPDQQVVFKLQEMIRGGSPVIYDKEKVARFGILDKYAADSSGIRWIEAPDCFCFHLWNAWEEPETEEVVVIGSCMTPPDSIFNESDENLKSVLSEIRLNLRTGESTRRPIISDGDQQVNLEAGMVNRNMLGRKTKFAYLALAEPWPKVSGFAKVDLATGEVKKHLYGDDRYGGEPLFLPGEGAEDDGHILCFVHDEKTWKSCVNVIDAKTMSAEPVAVVELPHRVPYGFHAFFVTEEQLQEQTLT

SEQ ID NO: 23715 - protein, 137 aa, Oryza sativa
MPSAASDDATLGRHLACRLVQVGISDVFAVPGDLNLTLLDHLIAEPGLRVVDCCNELNTGYAANGYAWARGMGTCTVTFTVCGLLLHGRRHRSHWFWNQETGDEAGAAFRNQERASASPSLPSAVARRSGSVVVGGG

SEQ ID NO: 23716 - protein, 625 aa, Lactobacillus sakei
MQPNIQWLDTPAVFRVGQLPAHSDHRYYATLAEMAQQQSSFEQSLNGTWQFHYSVNAASRPKSFYELAFDAQDFEPITVPQHIELAGYEQLHYINTMYPWEGHYYRRPAFSTSDDKQHLGMFSEADYNPVGSYLHHFDLTPALRNQRVIIRFEGVEQAMYVWLNGQFIGYAEDSFTPSEFDLTPYLKETDNCLAVEVHKRSSAAFIEDQDFFRFFGIFRDVKLLAKPRTHLEDLWVIPEYDVVQQTGQVKLRLQFSGDENRVHLRIRDQHQIILTADLTSAAQVNGLYKMPELVQAWSNQTPNLYTFELEVVDQAGETIEISQQPFGFRKIEIKDKVMLLNGKRLVINGVNRHEWHPETGRTITAEDEAWDIACMQRNHINAVRTSHYPDRLSFYNGCDQAGIYMMAETNLESHGSWQKMGAVEPSWNVPGSYDEWEAATLDRARTNFETFKNHVSILFWSLGNESYAGSVLEKMNAYYKQQDPTRLVHYEGVFRAPEYKATISDVESRMYATPAEIKAYLDNAPQKPFILCEYMHDMGNSLGGMQSYIDLLSQYDMYQGGFIWDFIDQALLVTDPVTGQRELRYGGDFDDRPSDYEFSGDGLVFATRDEKPAMQEVRYYYGEHK

SEQ ID NO: 23717 - protein, 850 aa, Arabidopsis thaliana
METSSIEINELPLATKTQTPPASVEPIPMETSSIDELPSSDSNATDNIEAVGEKRKRADEDEKTNLESSDTKITTPSPWWKTSLCSYFRREASCSHGNECKYAHGEAELRMKPDNTWDPTSERGKKAKAMKMSEHEEKEEDEVLFTEQMMESIDGDEGGGGSVSVVDLSLSKCLVHLPNKWQSDELKKFLGEQGVLYKSAKKRRGMIVGFVTFENAEQLQSGVERMLYRNVFNVLQILDGKTVNSSNLKIADVLPRTFDKNDARKSVKSARDAVTPLAYLSYADQLEQKKTSIGQMLKKLVRSFVFLFELVRGMRVKLVQMGIHFHNGSLHRETEGIIESPITNGYRNKCEFSVGLSLQGKPTVGFSLGSFCAGVTAVEEPVDCPNVSKIASQYASIFQKFIENSKFQVWNRFQHSGFWRQLTVREGRKPGVFSNDEDAITRIAEVMLMVQVCVLNGKVATEFEELAKAFAEGARASSPTLPLTVLVVQNHSGISNVAPPDAPLQVLAIPISDNGTDQEQTTNVLTEARIHDHINNLRFSISPTAFFQVNTVTAEKLYSIAGDWADLGPDTLLFDVCCGTGTIGLTLAHRVGMVIGIEMNASAVADAERNATINGISNCKFICSKACILTVTYFVVGSIVLICLHGSSVGFVVQAEDVMSSLLKQYLDVTQMEEAKPLSNANDDLNKQIPSTEEMTNSEHVADQNLPPSNTQVEELQDNEQKDSSSLEPEKTTKPQFKNVVAIVDPPRSGLHPAVIKALRTHPRLKRLVYISCNPETLVANAIELCTPSFDEPDRGNKNYRGRKKIGIAALARHRAKSMPTSEAFRPVKAMAVDLFPHTDHCEMVMLLER

SEQ ID NO: 23718 - protein, 62 aa, Arabidopsis thaliana
LLRVRVYSLAAPPGPLFKPNVANSAPVLGLPPMGKKKGGVRCSMGTKQGNVSIMGAGVSAAA

SEQ ID NO: 23719 - protein, 568 aa, Rickettsia prowazekii
MSIKLKQRFVPQLAAINCQFEEDFAQMLKTVDTSHIKEKTVVKGQVIEIKNDMIIVDVGLKNEGRIPKSEFLSLPEVGDVVEVFIEKIEGRNGRTILSREKAVKEELWGQLEIMCSKGEFVDGTIFGRVKGGFTVDLSGVVAFLPGSQVDVRPIKDPTSIMNIKQPFKILSMDKKLGNIVVSRRVILEESRSEARDEMLSKIKEGIVLEGVVKNITDYGAFIDLGSVDGLLHLTDISWGRVNHPSEVLEFNQKVKVMVIKFDEKTKRISLGIKQLDSNPWDAIKEEFPVGKKMTGKVTNFADYGVFLELKDGLEGLVHSSEISWLKSNQNPRKMLTIGQEVEFIVLEVDTEKHRVSLSIKQCQENPLIKFAENNPIGTIIKAPIRNITDFGIFVVLGNNMDGMIHEGDISWEDNGTDLLKSYKKGDEIECKVLAINFEKEQVSLGIKQLLPNPYQKISDEYKKSTIVKAVVTEIKDDGLVVLLNNKVTGFIKRVELSDEKDEQKPEMFKVHEEIDAKVVSIEKSTGRVLLSIKAHKIAERQKTLKEYGSSDNTTNMGDILANVLEEKK

SEQ ID NO: 23720 - protein, 330 aa, Unknown
  Bradyrhizobium sp. BTAi1
MALPEFTMRQLLEAGVHFGHQSHRWNPKMADYIFGARNNIHIIDLAQTVPLLHTALQAVSDTVAKGGRILFVGTKRQAQDNVADAAKRCAQYFVNSRWLGGTLTNWKTISASIKRLRHLDEVLSSGEANSYTKKERLTLQRERDKLDRSLGGIKDMGGLPDMIFVIDTNKEDIAIQEAQRLNIPVAAIVDTNCDPKGITYVVPGNDDAGRAISLYCDLIARAAIDGISRAQGELGIDIGASAAPLEEELPAATAASTFQGLPGPRGTADDLKKLTGVSGAIEKKLNDLGIFHFWQLAELDHDTAHQIGEEVGLPSRADAWVAQAKSLADA

SEQ ID NO: 23721 - protein, 365 aa, Petroselinum crispum
MAPTTITALAKEKTLNLDFVRDEDERPKVAYNQFSNEIPIISLAGLDDDSDGRRPEICRKIVKACEDWGIFQVVDHGIDSGLISEMTRLSREFFALPAEEKLEYDTTGGKRGGFTISTVLQGDDAMDWREFVTYFSYPINARDYSRWPKKPEGWRSTTEVYSEKLMVLGAKLLEVLSEAMGLEKGDLTKACVDMEQKVLINYYPTCPQPDLTLGVRRHTDPGTITILLQDMVGGLQATRDGGKTWITVQPVEGAFVVNLGDHGHYLSNGRFRNADHQAVVNSTSSRLSIATFQNPAQNAIVYPLKIREGEKAILDEAITYAEMYKKCMTKHIEVATRKKLAKEKRLQDEKAKLEMKSKSADENLA

SEQ ID NO: 23722 - protein, 514 aa, Broussonetia papyrifera
MDTKSITLLQEALKPLPMAIFLVIPLLFLLGHILRSRGRLPYPPGPKGLPIIGSMSMMDQLTHRGLAALAKQYGGIFHLKMGYLHMVAISSPETARQVLQLQDNIFSNRPANIAIRYLTYDRADMAFAHYGPFWRQMRKLCVMKLFSRKRAASWESVRGEVEKTVLSVAGSTGTAVNVGELVFKTTMDIIYRAAFGASNKEGQDEFISILQEFSKLFGAFNMADFIPWLTWVDPQGLNGRLKRARKALDAFIDKIIDEHVVKKNEAAETDMVDDLLAFYSNEEAKVNDAEDLHNAIRLTRDNIKAIIMDVMFGGTETVASAIEWAMTEMMRCPEDLKKVQQELADVVGLDRRLEESDFEKLTYLRCAIKETLRLHPPIPLLLHETAEDAAVAGYHIPKGSRVMINAWAIGRDKNSWADPDSFKPARFLRDGVPDFKGSNFEFIPFGSGRRSCPGMQLGLYALELTVGHLLHCFTWNLPDGMKPSELDMNDVFGLTAPRATRLVAIPTKRVVCTI

SEQ ID NO: 23723 - protein, 486 aa, Oryza sativa
MGSRRKYGSKTTNHTVTTVHRSTVPATCRHPPPCPRASVSTTSSSPSSPLSQPALSITPGPTSAAAAAAATASHHHVVTRLPGYDGELPFRLETGYVAVDEEEHGAELFYYFVESESGDPRRDPLLLWLTGGARCSVLSGVFFEVGPVRLALEHHRPYDAGELPRLRYHPHGWTKAASVLFVDSPVGAGWSFSRHPDGYLVGDVSASLQLKHFLAKWISDHPEYLANPFYIGGDSYAGKIVPFLAQKISEDIEAGVRPIVDLKGYLVGNPVTGESIDFDSRVPYAHGVGIISDQLYETIMEHCQGEDYSNPKNAICRQALDRFNELLGESSGGHILYNYCIYDSDIDGSIQEKRKIPPFPPRECIGSVDEWLRCHNGDLPYSMDIKSNIKFHHNVTTKGYRALVYSGDHDAMIPFLGTQAWVRSLNFSVVDDWRAWHVDGQSAGFTITYMNNMTFATVKGGSHTVPEFEPERSLAMFKRWISNEPL

SEQ ID NO: 23724 - protein, 1755 aa, Candida glabrata
MSNSDYFSHKPADSTGTPGTGTGTGTGTGGGTGTGTGTGSRRLAKEYLPARSRSSSSDARNPYMYHYNPRDAAGAGAVTGSGSGSNVGTPPGFHTTSPQSGYMSSRIGGPESLMQHHTGLTFDSMMQNPVLSMGPLSPGISPLTNLNAFGKNSTGVPKQPSSGNNTISFAPVPSPTSTSARSSRRASVVSNSSQGIHSLPKIATQIHQGQGQQVQQQSPNKKPYKIYNSQDGNPSITNTASKIRTSSIAMDSSTSTITTPTLVISPDMAAGSLPSNLGSTPSESTLKHSSGKHSAMATPGGTASNAVNMGSVGSLQDMATPGASTRSATIQNGSTASLRTFKKQYVLNEQLYLEKMRRNVPDDYYTRGIGPTSVTDEDEEFDIEMDEVFDQSGSNNKLSELDGNVDIQDDVDFGTKFINPDADRNENLVALSSRFLSRKLDWAFPSKKVREDQSSSTPTESRRSPADINDGNNNNINNNINNNTNDNNNTNSNRNNSNNNNNNNNNKDSNGTSDTAITTTSTTNNSADVTPRKSTPNNSVSDTPAPQENLSANEHFISQLLQDPAVVKRFEWQTMLANVLKGDIVKSEKTKIAKEVKGPGFTTQYSDDIWLELKAWMNGRNVDDQKKSLKLLRESADEVFQRVLDFRLPDGLTSDEGEVEIAKLMNKYYRVIKLWSNMKRLYQDKPIAKTEAFRNRIDTLDSWLNFKRNFEEKIHYIRNWVVGTKDPETQVVVDINDDDAIFRHYAHEFADQMIKEKDIEAIFQKRIFFPLAPWILKAKLFFLKNRDTLNELNLMYLNDQLEMLLMFPMRLVKDIIQLRLSYAKKLQKPTMMMIDQMIDDFNSYIRVAVQMKFTVISYCQGWQFTVNIDPQFDDTVVEAIRHLFILLELKLLDGGGKSTNAFKEPDILLKYWDGLKNCGHYIDGAGKVIAIEFTKLTLRLVHRLHSYLLQQQNSPPKLTNEAEAEKWLVQLFETLGSMKRKLNRFTNVLMKAFQNSVTYRIDDHAQLMNGLKDTGHFLVYTGGKLEKQGIYLIASPELLGCPENEILKVLYNSDSGCDLIPKLEIENSLTLYNAVAEKWDLSTSIVQGVGKDGLPRYYLQNGNVDAQFRPPNLNSGKSHVAEMYNDDRDPDADILELEMKLNSLGYILVLCPQEPMLWSGEVFNLSEFTTEEINDLDFKTRPDTIKLMCQSSSYALEYQCDRFLQSASDCVTFLEKRCSFEVVENNLQKLNKAYFRCTYSVLKNYHKIVKTFKKVCPNNDLLNGIFLFARDFGLNFLRINVASNEKKSLIILLLVRLSVGWLQFLSVDCDPTDPRTFRWCVTAMEFAMHMTSGWNILALDENQFSSLKHKISACMSLLISHFDVMGARAVELEKNSQQPRPNINIEDVFDDDSMLQKNSELRMQSIKALEENVTRGTHRIGKVLDDTDKGNKYISSLASSISNVSIRWQKRNFIGGGTFGSVYSAVDLDNGEILAVKEIRIQDSKAMEKVFPSIKEEMNVLEMLNHPNIVQYYGVEVHRDKVNIFMEYCEGGSMASLLEHGRIEDEMVTQVYTLELLEGLAYLHESGIVHRDIKPENILLDFNGIVKYVDFGAARKISKKGTKRTKMPGADNDMKEDKIVPDSTGLNDLIGTPMYMAPESITGSTNKGHLGSDDIWSLGCVVLEMITGRRPWANLDNEWAIMYHVAAGHIPQLPAQDEVSSAGRRFLKRCLVQDPKRRATAVELLMDPWIVEIREQLFSSDDVDTNSVSSSQERK

SEQ ID NO: 23725 - protein, 853 aa, Mycobacterium tuberculosis
MPTAGSSRAPAAAREIVVVGHGMVGHRLVEAVRARDADGSLRITVLAEEGDAAYDRVGLTSYTESWDRALLALPGNDYAGDQRVRLLLNTRVTQIDRATKSVVTAAGQRHRYDTLVLATGSYAFVPPVPGHDLPACHVYRTFDDLDAIRAGAQRTLDGGHTDGGVVIGGGLLGLEAANALRQFGLQTHVVEMMPRLMAQQIDEAGGALLARMIADLGIAVHVGTGTESIESVKHSDGSVWARVRLSDGEVIDAGVVIFAAGIRPRDELARAAGLAIGDRGGVLTDLSCRTSDPDIYAVGEVAAIDGRCYGLVGPGYTSAEVVADRLLDGSAEFPEADLSTKLKLLGVDVASFGDAMGATENCLEVVINDAVKRTYAKLVLSDDATTLLGGVLVGDASSYGVLRPMVGAELPGDPLALIAPAGSGAGAGALGVGALPDSAQICSCNNVTKGELKCAIADGCGDVPALKSCTAAGTSCGSCVPLLKQLLEAEGVEQSKALCEHFSQSRAELFEIITATEVRTFSGLLDRFGRGKGCDICKPVVASILASTGSDHILDGEQASLQDSNDHFLANIQKNGSYSVVPRVPGGDIKPEHLILIGQIAQDFVLYTKITGGQRIDLFGARVDQLPLIWQRLVDGGMESGHAYGKAVRTVKSCVGSDWCRYGQQDSVQLAIDLELRYRGLRAPHKIKLGVSGCARECAEARGKDVGVIATEKGWNLYVAGNGGMTPKHAQLLASDLDKETLIRYIDRFLIYYIRTADRLQRTAPWVESLGLDHVREVVCEDSLGLAEEFEAAMQRHVANYKCEWKGVLEDPDKLSRFVSFVNAPDAVDSTVTFTERAGRKVPVSIGIPRVRS

SEQ ID NO: 23726 - protein, 187 aa, Triticum aestivum
  misc_feature (7)..(7): Xaa can be any naturally occurring amino acid
  misc_feature (121)..(121): Xaa can be any naturally occurring amino acid
  misc_feature (140)..(140): Xaa can be any naturally occurring amino acid
  misc_feature (162)..(162): Xaa can be any naturally occurring amino acid
  misc_feature (175)..(175): Xaa can be any naturally occurring amino acid
  misc_feature (177)..(177): Xaa can be any naturally occurring amino acid
  misc_feature (186)..(186): Xaa can be any naturally occurring amino acid
SAHAVRXRPSEGGAGGDIYYATEQPEQPMGTLEMCMTGLDKKKGSVFFKTSADGHVSCAKEMTGGSGISDIIPGMGGCDFDFEPCGYSMNAINGSAFSTIHVTPEDGFSYASYEGMGMGAXGLGYGDIVKRGLRCFGPSXVSGGGTIVRWPGPCRHLGQEAXRRGIRLRQRVGAXAXWGRRPHLPXL

SEQ ID NO: 23727 - protein, 587 aa, Cryptococcus neoformans
MLSADQRQRAPFAHKSSCANLTATQPSALRSPFPPQSHWPTPPSAEGHQLQLTSDRSKWAQYPSPRKISNETCQAGFSDHPYAFGGIGATYSLDTPTSRRHSLPSLFNPNTHRRAFTFPSMSLPNPATVRFISLCFLWYACSAISNNTGKVILNHFKYPVTLTIVQFFFVAFYCAISSQKMLGWTGRLRQPTKNILKGTLPLAAFQVGGHIFGSMAISRVPVSTVHTIKALSPLFTVMAYALLFGVSYSPATYLSLLPLTLGVMLACSFDISFSNIFGLVCALGSTIVFVSQNIFFKKIMPTTSTNEVNSSSKLDKINLLYFSSSMAFILMIPLWIYSDARRLIDLWINPAASESGTSVLFYFFLNGTVHFAQSIIAFALLASTSPVTYSIASLVKRIAVICLAIIWFKQPVHTVQALGIVLTGAGLWMYNNAKRDVDRGEIKMRHVEALREGVLPSTKMDQCILEGSGIELSYKSAHNSPKPTYPNNYIDLPSSTTTAVNKTTFQVPPILDHTSHIEAPYPSPPASISSSPPADITYLGISKGRQHWLSGEGERFRPPVLNSIRSSVMEEARETGVNEGMAAVVTT

SEQ ID NO: 23728 - protein, 297 aa, Triticum aestivum
  misc_feature (96)..(96): Xaa can be any naturally occurring amino acid
  misc_feature (143)..(143): Xaa can be any naturally occurring amino acid
  misc_feature (194)..(194): Xaa can be any naturally occurring amino acid
  misc_feature (209)..(209): Xaa can be any naturally occurring amino acid
MGAEAKCDRIKGPWSPEEDEALRRLVERHGARNWTAIGRGIPGRSGKSCRLRWCNQLSPQVERRPFTAEEDAAILRAHARLGNRWAAIARLLPGRXTDNAVKNHWNSSLKRKLAHRHRRRRGVGRRPTTPGTPRGPCKSPKPXGPGNPPGYRTGGELSHGSGQVFRPVPRPGGFDAISADVRPPPPRQDEDPIXSLSLSLPGLEHGFHXDSARSHFQELSPSPRSPSPPTGPAPQPSSSYPVSGDLVGGIQEMIAPEVCKYMSAVGLPAGWGPGPRARRSSATSQGRNSPPPERFGF

SEQ ID NO: 23729 - protein, 94 aa, Lupinus luteus
ASAHAGKVFKLVYEAAIQLQVTGVVVTDATLKNLGSVHVSKGVADAHFPVVKEAILKTIKEVVGAKWSEELNSAWTIAYDELAIVIKKEMNDAA

SEQ ID NO: 23730 - protein, 448 aa, Geobacter sulfurreducens
MSGADYCPNSPEEVRRMLDAVGVADIDDLFRPISPALRAKSFDLPPGMSEFEMLHRLQTLAGRNAQGLVHFVGGGFHDHLIPAVVDHLASRPEFYTAYTPYQPECSQGTLQALFEYQTAICRLTGMEVANASLYDGGTALAEAALMALRITGRSRLVVDGAVNPFHREILATYLANLDVELVEIAPKAGMEDDARLRAAIDDATAAVIVQNPDFFGTLSDLSGLAAEAHGVGALLVASVYPISLGLVRSPGSMGADIVVGDGQSLGNPLSFGGPSFGFIAGRREHIRNLPGRIIGETVDRNGARGFVLTLQAREQHIKRHKATSNICSNQSLCALRGLIFLSALGSEGMAELARLNRDKAEYAKAVLGAVPGVEVLNSGFTFNEFTVCLPKVAEEAVVALLRKGVAAGVPLGPYYPDMEKCMVVTVTERRTRAEIDAFARQLEGALWN

SEQ ID NO: 23731 - protein, 224 aa, Methanosarcina mazei
MTKEYVKGDLPEKAAILQRDGETYAIAPHIPGGIVYPETLRKLADIAEKYGAAALKVTSAQRIAVVGLKEEDLDSAWGELGMKPGAAIGLCVRSVKICPGTTFCKRGKQDSVGLGLKLDEKYHGMQLPSKFKMGVSGCQNSCSETIIKDVGIVGTAKGFNVSVGGNAGPRPRLGEVVAKDLSEEQVLDLVERIINFYKGYGKSKRIGAMIDEIGIEKFKEGVGL

SEQ ID NO: 23732 - protein, 493 aa, Ostreococcus tauri
  misc_feature (1)..(1): Xaa can be any naturally occurring amino acid
XRRAQRGHRPRASAEEEIGQDVENVVIIGSGPAGYTAAIYAGRANLRPLVFEGFQAGGVPGGQLMTTTEVENFPGFPEGVTGPDLMDKMRQQAERWGAVMHTEDVVEVNFTARPFTISSSERTVRANSVIVATGATAKRLGIPAEQTLWSKGISACAICDGASPIFKDEEVAVVGGGDTATEEAVYLTKYAKHVHLLAMQDRVLEHKAITVHYNTECIDGSPNSKGNLGSLALRDTKTGDERKLNVKGLFYGIGHTPNSKVFGEQLELDQAGYVVVKEGAKTSIEGVFSAGDIHDKEYRQAVTAAGSGCMAAITVERYLTENNLLVEYHQTKKSQMNEQTDSIDEEEKAILGENSDTFDINIQKHYGQYALRKLYHESDRVLLVMYSAPTCGPCRRLKPMLDKVTAEYGDKVHYVEIDIAADPEIAEAAGVTGTPTTHIFYEKERLEILSGVKMKSEYRRVIDSVLGKAVTSEKKVTMQSPQGDDAKSEVRAR

SEQ ID NO: 23733 - protein, 194 aa, Arabidopsis thaliana
  misc_feature (172)..(172): Xaa can be any naturally occurring amino acid
MASSMLSSATMVASPAQATMVAPFNGLKSSAAFPATRKANNDITSITSNGGRVNCMQVWPPIGKKKFETLSYLPDLTDSELAKEVDYLIRNKWIPCVEFELEHGFVYREHGNSPGYYDGRNWTMWKLPLFGCTESAQVLKEVEKCQKEYPNAFLKITGFQNTRQVQCIKFIXAYKPPSFTGLIFPLLLGKTQKF

SEQ ID NO: 23734 - protein, 481 aa, Geobacter sulfurreducens
MELIFEKSVTGRRGVRLPASDVPPAPPLSAVLARDGAPDLPQVSELDVVRHFTTLSRRNFSVDTHFYPLGSCTMKYNAKALEEAAKLFAPYHPMVPLLPHGASFSQGSLGLVHGLGEALAEITGMDEVTCQPLAGAHGEMTGIMLIAAYHEAKGNRKKYVVVPDSSHGTNPASAAMVGYEIITVPTAPYGDMDLEKYRAVMTDEVAAVMMTCPNTLGLFNPHIREICDIAHDHDALMYYDGANLNAILGKVRPGDVGFDVIHVNLHKTFGTPHGGGGPGSGPVGVKKLLASYLPGPRVVKNSDGDYSVIPHSHESIGRTAGFFGNFGVMAKAFAYITMLGREGLIQVSEQAVLNANYIMARLKDVYDLPYDQTCMHECVFSAARQARNGVHAIDIAKFLIDRGFHPPTVYFPLIVKEAIMIEPTETESKETMDAFIEAMRDAADLAERNPAAFAELPRTMPITRPDETKAAREQNVCYFGC

SEQ ID NO: 23735 - protein, 291 aa, Saccharomyces cerevisiae
  misc_feature (1)..(1): Xaa can be any naturally occurring amino acid
XVHVASVEKGRSYEDFQKVYNAIALKLREDDEYDNYIGYGPVLVRLAWHISGTWDKHDNTGGSYGGTYRFKKEFNDPSNAGLQNGFKFLEPIHKEFPWISSGDLFSLGGVTAVQEMQGPKIPWRCGRVDTPEDTTPDNGRLPDADKDAGYVRTFFQRLNMNDREVVALMGAHALGKTHLKNSGYEGPWGAANNVFTNEYYLNLLNEDWKLEKNDANNEQWDSKSGYMMLPTDYSLIQDPKYLSIVKEYANDQDKFFKDFSKAFEKLLENGITFPKDAPSPFIFKTLEEQGL

SEQ ID NO: 23736 - protein, 959 aa, Unknown
  Synechococcus sp. WH 8102
MTSPFLQRHVGPSDSEQQQMLSALGYADMAAFLADVVPEDILDEFPPQGLLPPGCGEAEALVHLREIAAANNSRRSLIGLGYYGTSTPALIQRHVFENPAWYTAYTPYQAEIAQGRLEALLNFQTLISELTGLPIANASLLDEATAAAEAMSLSYGICRRTEANRFLVDANVLPQTWAVLQTRAEPLGIDLERVTPEQASFDASVFGVLLQLPGADGQIWDPTAVIARAHEAGALVTVAIDPLAQALIAPVASFGADIAVGSAQRFGVPMGFGGPHAAFFATKDTYKRQIPGRLVGQSRDSAGNPALRLALQTREQHIRRDKATSNICTAQVLLAVMASFYAVHHGPEGLMSIARRIVGQRRQLERALQSLGFVVPDGERFDTVTVTSALAPAVHQAVGEAGFNLRVLPDGANPAESTGFGIALDECTTADELSRLVAALATAAGQTSPSLPLAPVEELCGVPERVDPWLSQSVFHDHLSETELMRYIQRLVSRDLSLVHGMIPLGSCTMKLNAAAELLPVSWPAFAGLHPFAPMAQAAGYQRLAEQLEAWLAALTGFAAVSLQPNAGSQGEYAGLLVIRAWHRSRGDDHRDVCLIPTSAHGTNPASAVMAGLKVVAVACDADGNIDQQDLAARAAEHADRLAALMVTYPSTHGVFETGIRGICELVHRHGGQVYLDGANLNAQVGLCRPGAFGADVCHLNLHKTFCIPHGGGGPGVGPIGVADHLAPFLPGHPMQASPDQAIGPVSAAALGSASILPISWMYLRMMGAEALRQATAVALLSANYLALRLDPHYPVLFRGATGRVAHECILDLRPLKRDAGIDVDDIAKRLMDYGFHAPTVSWPVAGTVMVEPTESESLAELDRFADAMIAIRNEIRDIESGAMDASNNPLKQAPHTMAAVIAEDWDRPYSRQQAAFPLPDQQQNKVWPAVARIDNAYGDRNLICTCPSVEEIAVAVAA

SEQ ID NO: 23737 - protein, 291 aa, Saccharomyces cerevisiae
  misc_feature (1)..(1): Xaa can be any naturally occurring amino acid
XVHVASVEKGRSYEDFQKVYNAIALKLREDDEYDNYIGYGPVLVRLAWHISGTWDKHDNTGGSYGGTYRFKKEFNDPSNAGLQNGFKFLEPIHKEFPWISSGDLFSLGGVTAVQEMQGPKIPWRCGRVDTPEDTTPDNGRLPDADKDAGYVRTFFQRLNMNDREVVALMGAHALGKTHLKNSGYEGPWGAANNVFTNEKYLNLLNEDWKLEKNDANNEQWDSKSGYMMLPTDYSLIQDPKYLSIVKEYANDQDKFFKDFSKAFEKLLENGITFPKDAPSPFIFKTLEEQGL

SEQ ID NO: 23738 - protein, 363 aa, Geobacter metallireducens
MKRKIGILTGGGDCPGLNAVIRGVVKSAIIGRGWEVVGIEDGFDGLLYDRTPRPLGLEDVRGILPRGGTILGTSNRGNPFSYPIEVNGKTVLTDVSDRVVERVKDLGIDAIVAVGGDGSLKIALELMKRGVPVVGVPKTIDNDLMETDVTFGYNTALETATDALDKLHSTAESHHRIMIMEVMGRYAGWIALESGISGGADVILIPEIPFELKAVCNAIEGRRRRGSKFSIVVAAEGAFPRGGTRVVQKKADETMAIERLGGIGNFVAHELTSCLDMDIRVTVLGHLQRGGSPSTFDRCLGSRFGIGAVELIEREQYGEMICLKGRAIRSVPIEKAVRKLKLVDPRGQMVTAAKELGINVGRE

SEQ ID NO: 23739 - protein, 372 aa, Burkholderia thailandensis
MRSIIADSKRLVVKVGSSLVTNDGRGLDHDAIGRWAAQIAALRNEGKEVVLVSSGAIAEGMQRLGWSRRPREIDELQAAAAVGQMGLAQVYESRFAEHGIRTAQILLTHADLADRERYLNARSTLLTLLRLGVVPIINENDTVVTDEIKFGDNDTLGALVANLIEGDALIILTDQQGLFTADPRKDPGATLVAEASAGAPELEAMAGGAGSSIGRGGMLTKILAAKRAAHSGANTVIASGRERDVLLRLASGEAIGTQLIARTARMAARKQWMADHLQVRGHVVIDAGAVDKLTAGGKSLLPIGVVAVQGVFARGEVIACVNDAGREVARGITNYSSAEAKLIQRKPSGEIEAVLGYMLEPELIHRDNLVLV

SEQ ID NO: 23740 - protein, 574 aa, Anabaena variabilis
MVALTEKTEKRLTIQTAEIAQDTTAIRSLDWERDRFDIEFGLQNGTTYNSFLIRGEQIALVDTSHEKFRKLYFDTLTGLINPTDINYLIVSHTEPDHSGLVKDLLQMAPDITVVASKVAIQFLEDLVHQPFKRKIVKNGDRLDLGNGHEFEFVIAPNLHWPDTIFSFDHKTQTLYTCDAFGMHYCSDIVFDEDLKTIEPDFHYYYECLMGPNARSVLSALKRMGELPSVKMIATGHGPLLYHNVEELTGRYRTWSQNQSKAETSIGVFYVSEYGYSDRLAQGIINGISKTGVGVEVVDLGSAVDLQELRELVGRCAGLVIGMSPAASAASIQGALSTILGSANEKQAVGIFETGGGDDEPIDPLLSKFRNLGLTTAFPAIRIKQTPTENTYKLCEEAGTDLGQWVTRDRSIKAMKSLGADLDKALGRLSGGLYIITAKKGDVSSAMLASWVNQASFKPLGFSIAVAKDRAIESLMQVGDRFVLNVLEEGNYQPLMRHFLKRFAPGADRFEGVKTQPAENGAPILGDALAYMECEVVSRMDCGDHWAVYSTVYAGRVSKPESLTAVHHRKVGNHY

SEQ ID NO: 23741 - protein, 570 aa, Anabaena variabilis
MSETKPRDVQVLPIGTDTTVMRSRSWTRLRFEIEYALAKGTTANSYLIQGNKLALIDPPGETFTQIYLDALQKRLDVTEIDYVILGHVNPNRAATLKALLEIAPQITFVCSNPGAINLRGVLENPDLPILIMRGEETLDLGKGHDLQFIPTPNPRYADELCTYDPQTEIIYTDKLFGAHICGDQVFDEGWEAINEDRRYYYDCLMAPHARQVETALDKLADFPARVYATGHGPLVRYGLIELTHAYREWSQQQTSADLTVALIYASAYGNTATLAQAIARGITKAGVAVESINCEFADPEEISAAVEKSAGFVMGSPTLGGHAPTPVQTALGIVLSTATNNKLAGVFGSFGWSGEAVDLIEGKLKDAGYRFGFDSIRVKFKPNEVTLQMCEEAGTDFAQALKKARKVRTQSVPATNVEQAVGRIVGSLCVVTAKQGEVSSAMLASWVAQASFNPPGLTIAVAKDRAVETLTHTGNKFVLNVLKEGNHLGLMKHFLKPFSPAQDRFADVATAEAENGSPILKDALAYLECSVQNRMESGDHWLVYATVENGKVLNQDGVTAVHHRKSGNHY

SEQ ID NO: 23742 - protein, 412 aa, Methanosarcina acetivorans
MSYIEKIDPDMFEAIQKEADRQEHKLNLIASENYASRAVMEAQGSIMTNKYAEGYSGKRYYGGCDFVDIAENLAIARAKEIFGAKYVNVQPHSGSGANMAVYFSVLQPGDTIMSMDLSHGGHLSHGSPVSFSGKLYNIVPYGVSKETEALDYDELMKMAKECKPKMIVCGASAYPRVIDFKKFREIADEVGAYLLADIAHIAGLVVSGVHPSPVPYADFVTTTTHKTLRGPRGGMIISKTEELAMGVNKAVFPGIQGGPLMHVIAAKAVAFKEAMDEKFRQDQAQTVKNAKVLCACLKEKGFDIVSGGTDNHLMLVNLNNMNITGKDAEAAMSKAGIIANKNTVPFETRSPFITSGVRLGTPACTTRGMKEKEMELIADYIETAIKNAGNDALLSEVSAKVRDLCSRFPVYS

SEQ ID NO: 23743 - protein, 457 aa, Escherichia coli
  misc_feature (90)..(91): Xaa can be any naturally occurring amino acid
MDHLPIFCQLRDRDCLIVGGGDVAERKARLLLDAGARLTVNALAFIPQFTAWADAGMLTLVEGPFDESLLDTCWLAIAATDDDALNQRVXXAAEARRIFCNVVDAPKAASFIMPSIIDRSPLMVAVSSGGTSPVLARLLREKLESLLPLHLGQVAKYAGQLRGRVKQQFATMGERRRFWEKLFVNDRLAQSLANNDQKAITETTEQLINEPLDHRGEVVLVGAGPGDAGLLTLKGLQQIQQADVVVYDRLVSDDIMNLVRRDADRVFVGKRAGYHCVPQEEINQILLREAQKGKRVVRLKGGDPFIFGRGGEELETLCNAGIPFSVVPGITAASGCSAYSGIPLTHRDYAQSVRLITGHLKTGGELDWENLAAEKQTLVFYMGLNQAATIQQKLIEHGMPGEMPVAIVENGTAVTQRVIDGTLTQLGELAQQMNSPSLIIIGRVVGLRDKLNWFSNH

SEQ ID NO: 23744 - protein, 322 aa, Debaryomyces hansenii
MIYRILGGIYLSSIEPLNNNVDFKHQYNVTHIISAIPGTIPNNYVHDYVHKQIDITDEETSNIIQHFPETNDFIDSCLFPPGTTTDKHHGAILIHCAQGVSRSVTLIVAYLMYRYKLTKDQALHAVKRKFAPACPNDGFQKQLQLYADLKFKVDTTSPLYRQLFIDLNIQADPSGRSLQELNMFSSTTASQSEIDKQAELRCKKCRQVLALESQIENHLSPDASSRQAQFIKRAPNSRRIISAQEASDSCSHYFVREPLIWMRSELEDKGEIEGKFNCPKCDSKVGGYSWKGSRCSCGKWMIPALHLQCAKIDNIKSIPTHR

SEQ ID NO: 23745 - protein, 587 aa, Aspergillus nidulans
MTSLCLSLTKKKPLAAASAKRKLDITKDPNELYKAAKLEANGDVKSKGKAPMVEDEEENDDYAGPELPPDFDAEDVADDEEGRFFGGGMERETAQAMDYIEEQDKGELTNEKYDVAWLRRFALNFEKKISKNAELRGKFENDPQKFMASEADLDAEIKSLSILSEHTDLYPEFAKLGCVGSLVSLLSHENADIAIDAIQIISELTDEDVEAEQEHWDSLVNAMLDCDLIELLAQNLSRLNEEEEADRAGVYYVLGVFENLSSQVHIAEKIGEDSNIMPWLLARIQKKERPVSQNEQYSAEILAILLQSSTKTRERFISLDGVDVLLQLLSQYRKRDPEKDSDEEEYAENLFDCLVCLVDDDAGKEKFLEGEGIELVQIMLKEGKFSKLRAIRTLDHALGGLEGVAACERLVEVAGLRTIFGMFMRKQEHQIIEHLLGIFCSLLRLLPGGSAPRIRTLAKFMEKDYEKTEKLVKLRRDYASRVSPVEQIIEKERKQFTEEEQKAMEAEWLSRRFDAGLFSLQLIDVILAWLVAEDDGAKMKIVSILSDRDEDLSLIRSTLQEQIEGLSEDEPGQKDHKEMLQTLLQFL

SEQ ID NO: 23746 - protein, 368 aa, Petroselinum crispum
MAPSTLTALAQEKTLNSKFVRDEDERPKIAYNKFSDEIPVISLAGIDDDSVDKRSQICRKIVEACEDWGIFQVVDHGIDIDLISEMTRLARQFFALPAEEKLRFDMTGGKKGGFIVSSHLQGEAVQDWREIVTYFSYPIQARDYSRWPDKPEGWRSITEMYSDELMALACKLLEVLSEAMGLEKEGLTKACVDMDQKVIVNYYPKCPQPNLTLGLKRHTDPGTITLLLQDQVGGLQATRDGGKTWITVQPVEGAFVVNLGDHGHYLSNGRFKNADHQAVVNSNSSRMSIATFQNPAPNATVYPLKIREGEKAVMEEPITFAEMYKRKMSRDIEMATLKKLAKEKVLQDQEVEKAKLQMTPKSADEIFA

SEQ ID NO: 23747 - protein, 672 aa, Xanthomonas oryzae
MASSARVRLPAAPPASACVTTFKDPAPGPARRFLMSTSPINSTILRAAFAAPLDPQRAAIVMARYDQHAPRLLDALQTLYGQRAHYAPWLTQWLGELGDLARQRPQALQTLDSTRHAGWFGEQHMLGYSAYADRFAGTLQGVAERVPYLQELGVRYLHLLPFLRARAGDNDGGFAVSDYGQVEPSLGSNDDLIALTTRLREADISLCADFVLNHTADDHAWAQAARAGDTRYLDYYHHFADRSLPDQYESALGQVFPHTAPGNFTWVDDTAQWMWTTFYPYQWDLNWSNPAVFGDMALAMLRLANLGVEAFRLDSTAYLWKRTGTDCMNQPEAHTLLVALRAVTDIVAPSVVMKAEAIVPMTQLPPYFGSGAGQGHECHLAYHSTLMAAGWSALALQRGDILHNVIAHSPPLPRNCAWLSYVRCHDDIGWNVLQHEAAGNAAQPPFSLRDVARFYANAVPGSYARGESFQSSGDGVHGTNGMAAALAGIQAAQEAGDAAGLAVAVNRLMLLYAIALAMPGVPLIYMGDELAMLNDTSYRDDPHRQHEGRWLHRPAMDWRLAAQRHDAESLSGTVYRRLRGLIQQRAALGALAADHALGSIALDDPRLFALSRGESFLAVHNFSDQPLEVELAAIGDGWELLAIGDDVDAAAPSDNVSLVLPAYGVRWLQRGA

SEQ ID NO: 23748 - protein, 337 aa, Petroselinum crispum
MEVERVQAISKMSRCMDTIPSEYIRSESEQPAVTTMQGVVLQVPVIDLGSSNNTEENLVELIAEASREWGIFQVVNHGIPDDAIAKLQKVGKEFFELPQQEKEVIAKPEGYQGVEGYGTKLQKELGGKKGWVDHLFHIIWPKSAVNYNFWPNNPPLYREANEEYAVALRGVVDKLFEALSLGIGLEKHELKKASGGDDLIYMLKINYYPPCPRPDLALGVVAHTDMSAITILVPNEVQGLQVHKDDHWYDVKYIPNALIIHIGDQIEIMSNGKYKSVYHRTTVNKDKTRMSWPVFLEPPPELLTGPISKLITDENPAKFKTKKYKDYVYCKLNKLPQ

SEQ ID NO: 23749 - protein, 238 aa, Zea mays
MTVPDAESRFHVLAVDDSLVDRKLIEMLLKTSSYQVTTVDSGSKALELLGLRDASSPSPSSPDHQEIDVNLIITDYCMPGMTGYDLLKRVKGSSSLKDIPVVIMSSENVPARISRCLQDGAEEFFLKPVKLADMKKLKSHLLKRKQPKEAQAQAQQGQAVELEPEQQLDPRAQPAHDAEETAAEPPPAASNGTADGGNKRKAAAMEEEGMLAVMTVAAPESSTKPRLSTTSNSLAVET

SEQ ID NO: 23750 - protein, 344 aa, Arabidopsis lyrata
LNSKFVRDEDERPKVAYNEFSDEIPVISLAGIDDVDGKRGEICRQIVEACENWGIFQVVDHGVDTNLVADMTRLARDFFALPPEEKLRFDMSGGKKGGFIVSSHLQGEAVQDWREIVTYFSYPVRNRDYSRWPDKPEGWVKLTEEYSERLMSLACKLLEVLSEAMGLEKESLTNACVDMDQKIVVNYYPKCPQPDLTLGLKRHTDPGTITLLLQDQVGGLQATRDNGKTWITVQPVEGAFVVNLGDHGHFLSNGRFKNADHQAVVNSNSSRLSIATFQNPAPDATVYPLKVREGEKPILEEPITFAEMYKRKMGRDLELARLKKLAKEESDHKEVAKPVDQIFA

SEQ ID NO: 23751 - protein, 492 aa, Xanthomonas oryzae
MHCSMRMAPIGRRFGDRKSAAAQRYNRLQRWQGTVRCGHWEPHRCPGLCMSSTVPPLSFARILALNAGFFGVQYSFGLQQSNMSPIYNYLGADHANLPYLWLAGPMTGLVLQPFVGAWSDRSVTRWGRRMPYMVLGALVCSLCLLAMPFSTVLWMAVCLLWMLDAANNVAMEPYRALVSDVLAPPQRPLGYLMQSAFTGLAQTLAYLTPPLLVWMGMNQDAANAHHIPYVTIAAFAIGAGFSAASILLTARSVREPAIPPAQIARLRQTGAGLGATVREIGSAVREMPPTMRQLAPVMLFQWYAIFCYWQYIVLSLSTTLFGTTDATSHGFREAGLVNGQIGGFYNFVAFLAAFAMVPVVRRFGPKFTHAACLVAAGIGMWLLPGIESRWLMLLPMIGIGLAWASMMGNPYLMLADSIPPERTGVYMGLFNLFIVLPMLIQIVTLPLYYDRLLHGDPRNVIRLAGALMLAAAVAMVCVRLRKPKAVLVESRS

SEQ ID NO: 23752 - protein, 608 aa, Nocardia farcinica
MTRTLEPSAAPEEALDPQTRVETWLREFETALAARDIEAAAGMFAVDSFWRDLIAFTWNIKTVEGRDGVTDMLRARLDDTDPRGFHTTEPVTEADGVITAWIGFETAVGRAAGHLRLTDGGAWTLLTSLRELKGHEENKGPRRPKGVEHGATRERVTWSEQREQEERELGVTRQPYVVVVGGGQGGIALGARLRQLGVPALVVDKHDRPGDQWRKRYKSLCLHDPVWYDHLPYLPFPDNWPVFTPKDKIGDWLEMYTKIMEVPYWSKTVCRSATYDEQTGEWTVHVERDGEPLVLRPKHLVLATGMSGKPNIPNFPGMDRFQGDQHHSSQHPGPDAYAGKRAVIIGSNNSAHDICGALWEAGADVTMVQRSSTHIVKSDSLMELGLGDLYSERALAAGMTTDKADLTFASMPYRIMHQFQIPIYDAIRERDADFYARLERAGFQLDWGDDGSGLFMKYLRRGSGYYIDVGASELVANGDIKLAHGQVRELTEHSVILEDGTELPADLVVYATGYGSMNGWAADLIGQDVADKVGKCWGYGSGTTKDPGPFEGELRNMWKPTQQDGLWFHGGNLHQSRHYSLYLALQLKARYENIPTPVYGLQEVYHLS

SEQ ID NO: 23753 - protein, 739 aa, Nocardia farcinica
MSVEHPPIGEANTEPAAGGCPVTGRLRHPLQGGGNHEWWPNQLNLKVLAKNPAEGNPLGDFDYKAAFNSLDLAAVKADIAEVLTTSQDWWPADFGNYGPLMIRMAWHSAGTYRSSDGRGGANTGQQRFAPLNSWPDNGNLDKARRLLWPVKKKYGQNISWADLMILAGNVALETMGFKTFGFAGGRVDVWEPEEDVYWGPEAEWLGDKRYSGERDLENPLAAVQMGLIYVNPEGPNGNPDPLAAAVDIKDTFGRMGMTVEETVALIAGGHTFGKTHGAGDAALVGAEPEAAPLEQMGLGWKSSHGTGKGADAITSGLEVVWTTKPTQWSNDFFEILFGYEWELTKSPAGANQWVAKDAQPIIPDPFDPAKKRLPTMLTTDLSLRVDPEMEVISRRFKDNPDEFADAFARAWFKLTHRDLGPVTRYLGPEVPSEVQLWQDPIPAVDHELVDAADIAALKEQILASELSISQLVKTAWAAASSFRGSDYRGGANGGRIRLQPQLGWEVNEPDELARVIAVLEGIQEQFNAAQTGNKKVSFADLVVLGGVAAVEQAARNAGVAVEVPFTPGRADTTQELTDPEGFAVLEPKADGFRNYLGKANPLPAEYLLVDKANLLTLTAPEMTVLVGGLRVLNANYQRSPLGVLTETPESLTNDFFVNLLDMGVVWEPSPADDGTYVGKDAATGAQKWTGSRVDLLFGSNSVLRSLAEVYATDDAKPKFVQDFVAAWNKVMNLDRFDLA

SEQ ID NO: 23754 - protein, 333 aa, Triticum aestivum
  misc_feature (57)..(57): Xaa can be any naturally occurring amino acid
  misc_feature (207)..(207): Xaa can be any naturally occurring amino acid
  misc_feature (219)..(219): Xaa can be any naturally occurring amino acid
  misc_feature (226)..(226): Xaa can be any naturally occurring amino acid
  misc_feature (237)..(237): Xaa can be any naturally occurring amino acid
NGLNLYLYGLVLNEQERTVEARRVFIESLNYFPYNWSCWLELCKIIESEDLTPITKXLNDHWLKNFYFGHLCLQKYKNDICIDLYYGVHCFFKHSNFIMNQIAHSFYNNQEFDSSSDWYQKLLSVDPYRYENMDTYSNILYIRENQGELANLALKSFYNNKYYPETCCVVGNYYSLMGEHLKAIVYFRKALKLDRTCLAAWTLMGHXYLEMKNIPGAIXAYRSAVXIDPKDFRAWYXGLGQTYELQNMNNYALYYYSRAVLSRPKDSRMWNAMGCCYEKMGKQNEAQRCYVRAENSKDREGIAIHQMGKLYHSMGPEYEKKAVDAFELNLRRK

SEQ ID NO: 23755 - protein, 244 aa, Zea mays
MISPDAARNVVGIIGNVISFGLFLSPVLTFWRIYKAKDVEEFKPDPYLATLLNCMLWVFYGIPVVHPNSILVVTINGIGLVIEAVYLTIFFLYSDSQKRKKAFAILAVEILFMLAVVLGVILGAHTHEKRSMIVGILCVIFGSMMYASPLTIMSRVIKTKSVEYMPFLLSLVSFLNGCCWTAYALIRFDLYVTIPNALGAFFGLIQLILYFCYYKSTPKNEKNVELPTVSSNVGGGNVTVSVER

SEQ ID NO: 23756 - protein, 316 aa, Arabidopsis thaliana
IKKKIRAMSGSTRKEMDRIKGPWSPEEDDLLQSLVQKHGPRNWSLISKSIPGRSGKSCRLRWCNQLSPEVEHRGFTAEEDDTIILAHARFGNKWATIARLLNGRTDNAIKNHWNSTLKRKCSGGGGGGEEGQSCDFGGNGGYDGNLTDEKPLKRTASGGGGVVVVTALSPTGSDVSEQSQSSGSVLPVSSSCHVFKPTARAGGVVIESSSSEEEEKDPMTCLSLSLPWVNESTTPVELFPVKREEEEEKEREISGLGGDFMTVVQEMIKTEVRSYMADLQLGNGGGAGGGASSCMVQGTNGRNVGFREFIGLGRIE

SEQ ID NO: 23757 - protein, 201 aa, Brassica napus
HACGAEVRPDVLSGLSVAISGCKKLKWLSGFWDALPAYLPAVYSVCSGLTTLNLSYATVQSYDLVKLLSQCPKLQRLWVLDYIEDDGLEMLALTCKDLRELRVFPSEPFVMEPNVALTEQGLVSVSAGCPKLESDLYFCRQMTNAALVTIARNRPNMTRFRLCIIEPKAPDHLTLEPLDVGFRAIGEHCKDLQGLSLSRLL

SEQ ID NO: 23758 - protein, 97 aa, Datura innoxia
ATYKVKLVTPDGPVEFDCPDDVYILDRAEEEGHDLPYSCRAGSCSSCAGKVTAGTVDQSDGNYLDDDQMAEGFVLTCVAYPQSDVTIETHKEEELTG

SEQ ID NO: 23759 - protein, 428 aa, Zymomonas mobilis
MTGNKIDQATPTEMMAGMAKKARLASQILAQAPTAQKAEALVLTADAIRRHSADILAANAQDVATAENNQSSSAMVDRLRLTEARLENMASALEVIAHLEDPVGQIIDKRTRPNGLELTRIRVPIGVIGIIYESRPNVTIDAAALTLMSGNAAILRGGSEAIHSNKALYQTMREGLAKAGLPEEAIQLVPTTDRALVGAMLTASGLIDLVIPRGGKSLVARVQQDARVPVLAHLDGINHSYVHKEADPEKVEKVVVNAKMRRTGICGATESLLIDRGYPVEKVKSLLQALHNAGCEIRGTAEIQKIDPEAKAVSEEDWGTEYLDAVLSVRFVDDMDDALSHIARYSSGHTDAILTENREVAEKFLASVDSAIVMWNASTQFADGGEFGLGAEIGIATGRIHARGPVALEGLTSYKWQVRGTGQIRPVA

SEQ ID NO: 23760 - protein, 431 aa, Triticum aestivum
  misc_feature (23)..(23): Xaa can be any naturally occurring amino acid
VSSGDGAGGGAGDAVPGGRAGQXAVPARQPAGRVWGVRRTARATSGFKVLALGPETTGVIQRMQQLLDMDTTPFTDKIIAEYIWVGGSGIDLRSKSRTISKPVEDPSELPKWNYDGSSTGQPPEEDSEVILYPQAIFKDPFRGGNNILVICDTYTPQGEPIPTNKRHMAAQIFSDPKVTAQVPWFGIEQEYTLMQRDVNWPLGWPVGGYPGPQGPYYCAVGSDKSFGRDISDAHYKACLYAGIEISGTNGEVMPGQWEYQVGPSVGIDAGDHIWASGYILERITEQAGVVLTLDPKPIQGDWNGAGCHTNYSTLSMREDGGFDVIKKAILNLSLRHDLHIAAYGEGNERRLTGLHETASISDFSWCVANRGCSIRVGRETEAKGKGYLEDRRPPSNMDPYTVTALLAETTILWEPTLEAEALAAKKLALKV

SEQ ID NO: 23761 - protein, 97 aa, Datura stramonium
ATYKVKLVTPDGPVEFNCPDDVYILDQAEEEGHDLPYSCRAGSCSSCAGKVTAGTVDQSDGNYLDDDQMADGFVLTCVAYPQSDVTIETHKEEELTG

SEQ ID NO: 23762 - protein, 143 aa, Triticum aestivum
MATSTAAVLSPPTVAGLRLAPSHRAAVSFRGASSPARRSVAARAALEPSVVISLSTGLSLVMGRFVFFNFQRENVAKQVPEQNGKTHFEAGDERAKEFAGILKSNDPVGFNLVDVLAWGSIGHIVAYYILATTSNGYDPPFFG

SEQ ID NO: 23763 - protein, 205 aa, Shigella flexneri
STIPVITGGIGVCHIYVDESAEIAEALKVIVNAKTQRPSTCNTVETLLVNKNIADSFLPALSKQMAESGVTLHADAAALTQLQAGPAKVVAVKAEEYDDEFLSLDLNVKIVSDLDDAIAHIREHGTQHSDAILTRDMRNAQRFVNEVDSSAVYVNASTRFTDGGQFGLGAEVAVSTQKLHARGPMGLEALTTYKWIGIGDYTIRA

SEQ ID NO: 23764 - protein, 377 aa, Bordetella parapertussis
MAKRDYYEVLGVAKNASDEDLKKAYRKLAMKYHPDRNPDSKEAEEKFKEAKEAYEVLGDEQKRAAYDRYGHAGVDPNAAGMGGGMGGGMGGGFADAFGDIFGEIFGAGRRGGGGPQVYRGADLKYALEITLEQAASGFDTEIRVPSWENCDTCHGSGAKAGTSPKTCRTCGGSGAVRMQQGFFSVQQTCPTCHGTGKEITDPCPSCDGVGRTRRNKTLQVKIPAGIDDGMRIRSSGNGEPGINGGPPGDLYVEIHIKQHKIFQRDGDDLHCELTIPFTTAALGGELQVPTLGGKAEISIPEGTQSGKTFRLRAKGIRGVRGSYPGDLYCHVVVETPVRLSDEQKAILRQFEASLNDGGDRHSPQSKSWTDRVKEFFS

SEQ ID NO: 23765 - protein, 786 aa, Methanosarcina acetivorans
MEEIQLKVEKAYPIDLGRGIIRLDPAALLKLQLSPGDIVEIRGKKKTTAKVWRADRQDWEQGIVRIDNFIRQNAGVSIGEKVTIKKVEAPEAKKLILALPESMTQGGPELQFGEHANEIIKRHILKRPVFKGDIIPIINSMSQPMTESLTTSQVIPLVAVETDPANTIVLITEATIIELRKKPVQGYEKATRGVTTYEDIGGLGQEIMRVREIIEMPMKHPELFAHLNIEPPKGVILYGPPGTGKTLIAKAVANESGASFHYIAGPEIVGKFYGESEERLRKIFEEATQDAPSVIFIDEIDSIAPKRENVTGEVERRVVAQLLTLLDGMEERGQVVVIGATNRVDAIDPALRRPGRFDREIHIGVPDTKDRYEILQIHTRGMPIEKDDEITPAESEVELEEATEIEAEIEVDEAALEREKKEKTNRYLMYLAEKTQGFVGADLLALVQEAAMRCLRENLPDLDLEKETIPPERLEKIVVTKKNFEDALMEAEPSALREIFVEMPSVGWDGVGGLDEAKNAIIEAVEWPIKNPEKFVKLGIKAPKGILLYGPPGTGKTLIAQAVAKESNANFISVKGPEMFSKWLGESEKAIRETFKKARQVAPCVVFFDEIDSIAAMQGMESTDSRTSERVLNQLLTEMDGLETLKDVVIIAATNRPNLLDPAIMRPGRFDRLVYVGAPDRKGRMKIFKIHTRNTPLAEDVDLENLANITEGYVGADIEAVCREAVMFALRENFDVEAIEMRHFREALKKVKPTINENIAQFYEKIEEQFKGGQRPAETAGYVGYR

SEQ ID NO: 23766 - protein, 491 aa, Unknown
  Oceanobacter sp. RED65
MSDTGINPLKLSQPKIRMLHISWFAFFLTFMVWFNHAPLMGFIKEAFDLTSQEVKALLILNVALTIPARIIIGMLVDRFGPRYVYSGLLFVSSLLCTAFALSQTYEQLALFRFLMGFVGAGFVIGIRLVGEWFPAKEVGIAEGIYGGWGNFGSAASAMLLPTVALIFGGDDGWRYALLSTACLAFVYSFIFFKVARNTPKGSTYFKPKKSGGLQVSNKRDLYFYLAMNVPMYLALAVLTWKLSPANLGLLSEIASWALYIGLALLFVVQTWQILKVNKEHLSQPVPKMQRYKYKQVAVLQWAYFVTFGSELAVVSMLPLFFMETFEGLTAVTAGLLASGFAFMNLVARPGGGWLSDKFGRRKTLSILICGLAVGYLTLSQIDSTWWIPVAVIATMMCSFFVQAGEGAVFAMVPLVKRSLTGQIAGMTGAYGNVGAVIYLTILSFVDYSTFFMVIAASAAFIFIAVQFLEEPEGHVAEINDAGEVELVQIGK

SEQ ID NO: 23767 - protein, 532 aa, Sulfolobus tokodaii
MKALFIRPNNPSGSGYFKYFGFLPTPLGLIQLASDVLSVGNWEAKIIDMEADNMTIDDVVSTAISYDPDMIGITLHATAAHNIATKIAQQIKSQLNDTVIIAGGHHATFVPYQMLNEGFDIVVLGEGDDTIMKLASALKEGNRDFSQIRGIVYKKEGKIFKTPPAPLISDLDSLPEPALELVKKENYPVKIFGDDQYVACLETARGCPYACDFCSVTPTWGNKWRNKSNNRILKEISKAKELGYNWIFFVDDIFIVWPNRSQRAALFRKMIETKNTINFIAQMRADVTARNPELIKLASDAGLRIAFLGIESGSQEVLKKMHKGLAVSDSINAVKTLHENGVIVLVGLMIGAPYETIKDIRATVKLSRKLADVGADAVQFSIYTPLPGTRIFVESLKNNLLFTLNWDRYDVITPVVKTKVNPALVQLIAAYASYTFYIYKYLKSKLRLSKIKIPEKKLTLLRKAEKYLWKKIPYLVKESLIDLPISAVKTLKMYLKRDNIPADVIQSLIAQSSNIIYLETGDKNRYYNIKNE

SEQ ID NO: 23768 - protein, 382 aa, Guillardia theta
MSKNDFQITRMNDLVCIEFNSNGISRLRKISRKKIITESRTFPKNYFQKLFDLYFEYSYAKEFKKFPINLINEKDKRQIKKFLDDSIQLRDIRQVDPYFESKPTFWIRNNAILLSLEQIRAIVLFNKLFLFDPDNPKVQRAGKIISEKLEKFQEDSVEDRKTPFEFKALEGIFVNICMNLEKDFSYLEPTILENLDDLPTKLTSRMLEELRSFKQRLSQFSIRSQEVQRILQETLENENNLPNHYLSINNNNKKIKLKTTSDYYAIEIISEGFLQVVEHLTHRAELLDNAIDDTEDLVNIRLDTIRNKILFVELSLNIVSLTLSAGGLVAGLMGMNLGIPIFKEENSSTTFFILVSFLIIFSSLTLYLWLLNWCRIKGLYSI

SEQ ID NO: 23769 - protein, 135 aa, Encephalartos sp.
ARTKQTARKSTGGKAPRKQLATKAARKSAPATGGVKKPHRFRPGTVALREIRRYQKSTELLIRKLPFQRLVREIAQDFKTDLRFQSSAVAALQEAAEAYLVGLFEDTNLCAIHAKRVTIMPKDIQLARRIRGERA

SEQ ID NO: 23770 - protein, 348 aa, Ipomoea alba
ETLAGSGIERIPKEYIRPEEERRSIGDIFEEEKMGGGPQVPTVDLKGINSDDLEVREKCREELRKAAVDWGVMHLVNHGIPEELTGRVKAAGEGFFAQPIEEKEKYANDQAAGNVQGYGSKLANNASGQLEWEDYFFHCIFPQDKTDLSIWPKTPSDYIAATREYAKQLRALATKVLAVLSLGLGLDEGRLEKEVGGMEELLLQMKINYYPKCPQPELALGVEAHTDVSALTFILHNMVPGLQLFYGGKWVTAKCVPNSIIMHVGDTVEILSNGKYKSILHRGVVNKEKVRVSWAVFCEPPKDKILLQPLPETVSEAEPPRFPPRTFAQHIKHKLFRQSDQGADTPKT

SEQ ID NO: 23771 - protein, 463 aa, Bacillus anthracis
MQHSNKSGTLNRGLKERHITLMSLGSAIGVGLFLGSASAIKLAGPSILLGYMIAGLVIFFIMRALGEMAIEQPVAGSFSKYAYDYLGPLAGYITGWNYWFLWVVTCMAEITAAGIYMQYWFPDIPRWTWALLALLLMSAFNFLSVKVFGELEFWFALIKIVTIICMIVVGAGIILFGFGNGGIATGISNLWSHGGWFPNGFSGLLLSMQMVLFAYLGVELIGVTAGEAQNPKKTLAKAIDNVFWRILLFYVGALFVMMAIYPWNELGEKGSPFVLTFQQIGIAKAAGIINFVVLTAALSSCNGGLFSTGRMLYTLAQQKKAPERFGRLNKNGIPSQGIVATAIVLLIGVILNYLVPAKVFTWLTSISTFGAIWTWGIILVAQIKFRKSLPTQNRQKLSYKMPLYPLSSYFSLAFLVLVLGIMAYSEDTRIALIVGPIWLIGLAIVYYMKGFHKIDETPNSKIS

SEQ ID NO: 23772 - protein, 585 aa, Unknown
  Nostoc sp. PCC 7120
MTITANSQLPNRFPQNLESMNHKADGLLANLGAELVYVQDGVGRYLSFYWQKSELLGFNPEQIVCDGNGQEIFVPLDKVSYMKRLHCIMANLAPEKFPCWFSCHQNLFELELAITPIIPPLGTGATTVLVMGRLLQVKVNNQEVNVAITTPTQTDLASRSQQHQRLVNKITRNIRRTLDLDLIWQQTVDSLGKALRLERCIICPYQPSSSKVRVIAEYHQPDRPSMLGLEIDVTSEPAFAQALTTLEPIIMEVPGYELCPQQKILVVATCYQDQANGLIAINLRHECYPLTNAELELAKEVADQLGTAIAHATLYKELEAARQKAEEASRLKSEFLANVSHEIRTPLNGMIGFLKLILEGMADDVEEKNQFLSEAHQLSLHLLNIINDILDIAKIEAGKMELVCAPIKLEELFSDVDNFMRPQAEVKNLSFRMQLPPTSDEIVVQGNYQRLLQVMLNIVGNAIKFTHEGGITVTADVVLKKGKLQEQNFPGMVRVRIADTGIGVSLDQQDKLFQLFSQVDGSRTRQYGGTGLGLAISQKLVETMGGEVHFYSLGEGLGSTVTFTVPLYQQPVMLSSNDTDAECIG

SEQ ID NO: 23773 - protein, 887 aa, Alkalilimnicola ehrlichei
MTAATVPELLSARPPDGVAAVAITRDGAEECSRGELLERAGRLAAGLVSAGLDKGDRIALVAHNSVDWVAAALGVMQAGGVVVPLDTQMPLKEFHFVLRDAQPRWVFTTGALVDRVIGAEVDPEPTLYRLDGDERAPEHWRSLWADEPIVPDVAPEDLATMFYTSGTTGAPKGVPLTHKNLASNVSSLVQENVAGSDDRVLVPLPFHHVYPFTVGILVPLRLGAPLILPFSLVGPQIVRALQLGQPTIMLGVPRLYDAVWTALEDRVAGRGAVAEKLFHGMLALSMQARKRWGLRLGRRLFRSLHQRLAPSLRMVVSGGAALDPTLTEKLRALGWEVATGYGLSETAPILTYNPPERLRVESAGMALPGVELAIDPPGEIGEVLARGDNVFHGYWRRPDKTREVLQEDGWFRTGDLGELDGDGYLYLQGRRSAMIVLPGGENIDPERVEGVLSQAEGVREVGVLESGGRLVGVAVPEPALLRAHQGEALRERLISAVQAAGRALPSHHRPGRLQVAVDPLPRTRLGKLRRHELQHLYDRLAEQGGVSAAKAEPIPRESMAPEDQQLLTDPSAEATWEYLVEKYPDFRLTPDTSLSLDLGLDSLAWVNLSLTLRDRVGVEFDDDAIGRIETVRDLLREAAGAGQSEGTAEGAGDLVAELRRPESNVPEDLQRWLEPRSALSAVSARLLWALASLFTRVWVRVEVRGRLPDDGPVLIAPRHLSVLDPVVLSHAVGLRRMLHLRWAGWTGLLFQGPVSRWFSRAAGVLPVDPASAPRRSLALAAMTLQRQDSLVWFPEGARSPDGRLQPFQPGVGLLLRAWPVPVVPVWVEGTRELMPKGRRLPRFGRATVVVGEPISAERLKALGDDEHAIARLIHDEVAALEPGSPRS

SEQ ID NO: 23774 - protein, 874 aa, Medicago truncatula
VDYEEKQFSHGLIPSTYMRREGAPKERELLCARIIDRPIRPLFPPGFYHEVQVTASVLSSDGTQDPIVYAANATSAALMLSDIPWGGPIGMIRIGRICGQFVVNPTMDELSLSDLNLIYACTKDKTLMIDVQAREISEEDLQAGLRFAHPEAVKYIEPQIRLAAKAGKSKKEYKLSMLSDKTLEKVSNLAEAPIKAVFTDPSYGKFERGKALDNITQDVKKVLEEEGDEESIKVLSKTIDTVRKKVVRKRIIAEGSRVDGRQLDEVRPLYCEAGCISKLRGSADFFRGETQVLCTVTLGAPKDAQHLDSLVGPSSKRFMLHYSFPPYCIGEVGKRGGLNRREVGHGALAEKALLAVLPPEVVFPYTVRVNSEVMASDGSTSMASVCGASMALMNAGIPIREHVAGISVGLVSELDPCTGEIVDYRILTDILGLEDHLGDIDFKIAGTRKGVTAAQLDMKPAGIPLDIICECLEPAHKAHLHIIDHMEREIKEPCTKQGSSSQQIVTLKYSNDALRRLIGPMGVLLKKLEMETGARLSVGDGTLTIVTKNQSLMDKTLEKVVSIVGREIEVGGIYKGVVTSIKEYGAFVEFNGGKQGLLHISELSHEPVSKISDIVSIGQQLSLMCIGQDVHGNIKLSLKAALRGPGGSETNYIAEVSATSAKVTTNSWAPVWDASSITQEQNSASKLPIEKNEVGETKPSASQTPVIVIRSAAECDEEEKSISLDHNQTSNSPLIDDGVKLDSSKSKSPSKSKPRKSQDAVDSPSQSGSLPKKPKLSMQKKLKSDTQRAEGNEKKDKDNEPLTAKDLPLGTKFKAKVFQIRAHGLVLDLGGGVRGMYRFEGDGKTDLKVGDEMPVVLSSFSSKGIPVVFPVDDK

SEQ ID NO: 23775 - protein, 462 aa, Unknown
  Synechocystis sp. PCC 6803
MNKRRIIEVLRHGQADDQVMVQGWLRTKRTLKDFSFVEVNDGSSLANLQVVLDGSLADYDRLLSQLQTGAALVVEGKLAPSPGKGQRVELKATKLELLGGADPGSYPLQKKRHSFEFLRTIGHLRPRTNTIGAVMRVRNACATAIHQFFQERGFLWVHTPIITASDCEGAGDLFKVTTLDLQRVPKNGEGIDYSQDFFGKQAYLTVSGQLEAEVMALAFQNVYTFGPTFRAENSNTSRHLAEFWMVEPEMAFCDLEGDRQWAEEFLKYIFKFVLEKCPEDMEFFDQRIDNTVLATADNIINNEFAWLTYSEAIKLLEKADQKFEYPVAWGVDLQSEHERYLAETVFKRPTIVTDYPKDIKAFYMRLNDDGKTVAAMDILAPKIGEIIGGSQREERLDILTQRMQEQGVPEEDLWWYLDLRRYGSVPHAGFGLGFERIVQFMTGMANIRDVIPFPRTPMNAEF

SEQ ID NO: 23776 - protein, 446 aa, Zea mays
MAAAAGDGAGEARARALLQQHRPFATPPGEYHHFGAPSAATDEMVEAVVLRTPLKRKHNDRTENEAAESNDWMSPGYANAGSSPVPTPPSGKGLKASTKPKATKGQKSGPQTPLGFGSPGNPSTPVGGCRYDSSLGLLTKKFLNLLKGAPGGIVDLNNAAETLEVQKRRIYDITNVLEGIGLIEKKLKNNIRWKGVDDSRPGEVSDDMSILQADIDALTLQERNLDERISEMRDRLRGLTEDENNQKWLYVTEEDIKSLPCFQNQTLIAIKAPHGTTLEVPDPDEVNDYPQRRYRIVLRSTMGPIDVYLVSQFEEMSGMETPPRPTQTISMDSLENPRTPLAADCNKVTGMESNIHGGLILPSDAPSSSQDISGMMKIVPSELDADTDYWLLSDNTGVSMTNMWETGPDEWDGIEKFNAEDFLEVGTPQQQDKPADVVDDDPSCII

SEQ ID NO: 23777 - protein, 400 aa, Geobacillus stearothermophilus
MNYLPQQDPQVFAAIEQERKRQHAKIELIASENFVSRAVMEAQGSVLTNKYAEGYPGRRYYGGCEYVDIVEELARERAKQLFGAEHANVQPHSGAQANMAVYFTVLEHGDTVLGMNLSHGGHLTHGSPVNFSGVQYNFVAGVPETHVIDYDDVRIKARFHRPKLIVAGASAYPRIIDFAKFREIADEVGAYLMVDMAHIAGLVAAGLHPNPVPYAHFVTTTTHKTLRGPRGGLILCQEQFAKQIDKAIFQGIQGGPLMHVIAAKAVAFGEALQDDFKAYAKRVVDNAKRLASALQNEGFTLVSGGTDNHLLLVDLRPQQLTGKTAEKVLDEVGITVNKNTIPYDPESPFVTSGIRIGTAAVTTRGFGLEEMDEIAAIIGLVLKNVGSEQALEEARQPSPL

SEQ ID NO: 23778 - protein, 1071 aa, Magnaporthe grisea
MSIPHRPVTKVMGPHEETTNRPDQWKIAQGMAGALLPALDMTGPETKEIPPQKFGPLTKDEEAIKSVGDRSKLFARERKGWKGFVEWENYPEKKAAAHKILSSQTWPPNPEYQLAEIPGTNPVLPGTRFKLWHHALGGELEDVVDDSWNCVLEEKHVDMLHLLQFPYNGEPPKRLTAAKDITPNPLHFVRNHGGIPSIEKDDFSFDVDGLVKNPKTFTLDDLMDESRFPRMEKHVTIQCSGTRRIEQIVKYPGQGDEVPQAPWAEGAIGTAKWTGVSLKAVIKECGGMVDGAKHVEFYGADTYVKSEKAMNYVVSVPWSKVKANEVMLAWAMNDEPLPKIHGFPLRTVVFGYIGARSVKWLYRIKAIKQPSRAPVQTQEYLYFPQQVGKHNFNLTDGIQIQEMPVSSAIMSPWMKQVVIHNGKIRCNGWAYSGGGRWPERVELSADGGFNWYTVPLENLSKKRKWTWRTWHMELPCDVEGWIEIVVRCWDNSLNTQPPEVRTAWNWGLHVTSSCHRVSVYSINKTRPKTQARMAELEGKNIPIVPITVPLEVPAQGSDEYEEFWRTHEPRDAEERPLSSQLMQAHPESRYACGRPPFWTLELKICSGKTMEDRIPSLLTLIITTSPTPSAPETELLTQVIASYRRHCPSLLTCRVIVVLDTYDHIKPRARLKRGQVTAQGAQVYDVYKENVKELFLAEYCPDRALPIPMTQSSVEAEFGFDGRNNPLGSAVSVAVSRTDDGRVTFVEPADRLGFGLAVRTALRLTETSYVFSTWRPQDRDLVYIPSPAQDIPIAGMLDVMEANKASPAGLPSTLSLSSLSLSSASTSEAPASALDTATVGSLPGSPAAADTPGGTGDDAFTTDLESPPVKYICLPSCRLLSYAVQAHVTYHTALLRLTRQLKRTFIPSSSSLPPIPLTPLFFWHDKPHIAEVSHYLARVFPTRLSMARGAFIEDTVGHRARDQMKLGNWAKWACWMYYPDEGKRLCLRHLHGRTWRGSVLELEKKEHHITMNIKGKRNQKKLDKKKEKREANPADSDDGHHQATTAPAPIEESLGSVEGVRGGHVPATPGS

SEQ ID NO: 23779 - protein, 522 aa, Ostreococcus tauri
MGRFRSLTARGLALLSHLTTSSIDAKSVAIEDALLERLTRREIDFSNLKHITEDARDDALIYGASSGTFKLNSTRDAHLFYTFFDRRGSGDGRASMNDSDDESPLIIWLTGGPGCASELASLYENGPYAMERDPKSGEARLGRRAHAWNDAGRLLYVDSPVGTGFSYTSKRADAARDETTVANDLLEFLSAFMLSRPELADVEVYVTGESYAGHYVPAFAHRIFEANKKGDNPVRFNLRGVAIGNGLTEPAIQYGAYADYSLGNDIVDAKAAAEAMKAYPACRKAIKACYRGDAGEKSNRATCIRALNACQIIPETLLENAASRFDGKAINVYDIRKSCDAELCYDFSAAEEWLNRADVQKALGVNKKWEMCDNRVHSDMMGDWMHEYEDMIPPLLEAGIRFMIYAGDQDFICNALGNERWVKAMKWSGRAAFTAEHPRPFVVSTSGDDEIIGGTVTESGKLSFVKVSQAGHMVPMDQPLNALTMIQRFVRGEPIARGDETTPVRGAAPRRAVRDSLRVASQ

SEQ ID NO: 23780 - protein, 710 aa, Oceanicola granulosus
MFNETKKSIQWGEETLTLETGKIARQADGTVIATLGETSVMAAVTFAKTQKEGQDFFPLTVHYQEKYYAAGKVPGGFFKREARPTEKETLTARLIDRPIRPLFVPGFKNEVLVMCTVLSHDLVNDPDIVAMIAASAALTISGAPFMGPIAGCRVGYEDGEYVLNPTVDDMQGLRNNPDQRLDLVVAGTKDAVMMVESEAYELTEEEMLGAVTFAHEQIQPVVDLIIDLAEDSAKEPFDFSPPDYSALYEAVKAAGEEKVRAAYAISDKQERVAAISAAKDEIKASLTEEQLEDPNLGTALKKLESAVLRGDVVKNGRRIDGRALDEVRPIVSETQILPRTHGSALFTRGETQALVVTTLGTGDDEQIIDALHGNFRSNFLLHYNFPPYSVGEAGRVGPPGRREIGHGKLAWRALQAVLPPATDFPYTIRLVSEITESNGSSSMASVCGGSLSMMDAGVPLKAPVAGVAMGLVLEDDGSYGILTDILGDEDHLGDMDFKVAGTENGITSLQMDIKVAGITPEIMKKALEQAKAGRMHILGEMAKAITEAADFSVHAPRIETMQIPTDKIREVIGSGGKVIREIVEVSGAKVDINDDGIIKIASPNGEAIQKAYDMIYSIVAEPEEGKVYKGTVVKIVDFGAFVNFFGKRDGLVHVSQIENKRLNHPSDALKEGQEVWVKLLGFDDRGKVRLSMKVVDQETGEEMKKEETAE

SEQ ID NO: 23781 - protein, 848 aa, Unknown
  Oceanobacter sp. RED65
MSNKQDLIVIGNGMVGQKFLQTLADKGKHESFNITVLCEEPRPAYDRVYLSSYFSGKTADDLSLVEKDFFNDNQIEIKLNCKAESIDRENQLVKTSHGENLHYDKLILATGSYPFVPPVEGHDREHCLVYRTIEDLENIEASAKESKVGVVVGGGLLGLEAAKALKDLGLKTHVVEFAPRLMAVQVDDAGGALLKRKIEELGVQVHTSKNTQLITDGDTLRHKMEFADGESLETDLILFSAGIRPQDAIAKQAELELGPRGGIIINNHCQTSDENIYAIGECALWGGMIYGLVAPGYAMASVAVDHITQTGDSEFAGADMSTKLKLMGVDVASIGDCHGRTEGSLSYAYNDEVNQVYKKLVVSADKKQLLGAIMVGEAEDYGNLLQMMLNNIELPEKPELLILPSTDGMEKPALGPDALPETAQICSCYDVSKGQICCSVQDGAQTIGDVKASTSAATGCGGCTALVTQVMNSELEKLGVEVNTDICEHFAYTRQDLYNIIRVEGIESFQELLEKHGKGHGCEICKPAVGSILASVYNDYVLDEKHISLQDTNDIYLGNMQKDGTYSVVPRMPGGEVTPEGLLVIGQIAKDFGLYTKITGGQRIDLFGAQLHELPQIWKRLVDAGFETGHAYGKALRTVKSCVGSTWCRYGVDDSMSLSIEVENRYKGLRAPHKIKFAVSGCTRECAEAQSKDVGIIATENGWNLYVCGNGGMKPRHAELLAQDLDKETLIKYIDRFLMFYIKTADRLQRTSVWRDNLEGGLDYLKSVVVDDSLGLAEELEQQMQHVVGTYQCEWKSTIENPERLKRFKHFINADDTDKNLQFVKERGQIRPANEDERLKKDNLITVG

SEQ ID NO: 23782 - protein, 542 aa, Rhodopseudomonas palustris
MPAKKSKQPSAAVTTVKSATLDLLRAFKIDKVFGNPGSTELPFLSDWPDDIDYVLALQEASAVAMADGYAQATRNAGFVNLHSAAGVGNALGNIYSAFKNQTPLVITAGQQARSLLPLQAFLGAERASEFPRPYVKYSVEPARAEDVPAAIARAYYVAMQPPCGPTFVSVPIDDWARPAAPVPPRTITREIGPDRSAMQVLADTLANAKKPALVVGPAIDRAAAVGLMARLAERAKAPVWVSPFSARCSFPERHPLFAGFLPASPGQLSETLGAYDVIVLIGAPVFTFHVEGHAAIFDGASQLFQITDDAEAASVTPLGASIIATMTPALTLLLELLPETKRAAPPARAVPPAPRPAEPMPVEYLLHTLRAAMPESAMLVEEAPSHRPAMQTYMPMPGQDSFATMASGGLGWSLPASVGFALAHPNRRTVCLIGDGSAMYSIQALWTAAQRKLPLTVVVLNNGGYGAMRSFSQVMQVRNVPGLELPGIDFTALAQSLGCDAVRVTRSEELAPALTRALAWDGVSLVEVMLDTSVPMLYARNG

SEQ ID NO: 23783 - protein, 112 aa, Oceanicola granulosus
MKLIIATIKPFKLEEVREALTGIGVRGMMVTEIKGFGSQSGHTEIYRGAEYAVNFVPKVKLEIVVPANMADQVVATIATTAKTDKIGDGKIFVLDVESALRVRTGETNSDAL

SEQ ID NO: 23784 - protein, 255 aa, Rhizobium leguminosarum
MSGFNILERFSLSGRRALVTGAGRGLGRSIAEGLASAGAEVTLCARTESEVEEGARCIRDHGFKAEALVADVSDIAGFRATVDAMHAHDIFVNNAGTNRPKPLSDVTIEDFDAVIGLNLRAAVFAAQAVTARMANLGIQGSVINMSSQMGHVGAANRTIYCASKWALEGFTKALAVELGPVGIRVNTVAPTFIETPMTTPFLEDPAARNAIVSKIKLGRLGTPEDVVGAVLFLASDASALVTGSALLVDGGWTAD

SEQ ID NO: 23785 - protein, 423 aa, Unknown
  Oceanobacter sp. RED65
MLTSSNGRQKLAVIGNGMAAAKLLQELVLSSLDQYDITVFGNEPYAAYNRIMLSPLLAGEKQLNDIITLPRDWYTENNIDLYTGSEYHISKIERGRKRLTCSNGEIFQYDKLVIATGSHPFILPIQGIELDGVLSFRDIADVNKMLKATESYKRAVVIGAGLLGLEAAMGLMQRGMDVTVVHNSDIPLNRQLDEQAGRLLKDSLIDRGLHFKMDANSHHIEGCGNRVQRIVFDDDSFIETDLVVMAIGIRPNIELAQQSGLQCGRGILVSDTLQTYDPSIYALGECIEHRGETFGLIAPLYEQAKVLANHLSEHGVAHFQTLPTATKLKVTGISLFSMGQFIEQQHHEVQTYFDPQSQVYKKLVIENEQLIGAVLYGDVTDGSFYSELIEQERDISEFRDYIMFGQALCHQSLQENAPEEAVA

SEQ ID NO: 23786 - protein, 493 aa, Unknown
  Shewanella sp. ANA-3
MSDNQTPAAKHALMWFRQDLRLTDNQALTAACDWVRQAPGAKLRAIYIATPNQWLSHDMAPIQIDFIQRHVNLLAQGLASLGIEFELIQLDSFKEVPAFLASYCEKLGVERVFAGREPEINEQKRDQACLDTGIPLVLSDEHCLLPPGTVLNLSGDMYKVFTPFSRKWREIAAKRAIFPLAVPAPLGPMLPEPKPISFKERFQSTSKLTSSEQWAAGEGQAKRILTAFIKQKVQDYKQDRDFPALDGTSVISPYLALGVLSPRQCIAALLGRFPDVIVDDTSPGRTWLNELIWREFYRHLLVAFPDLSKGHNFNRQADHVQWRNNQAEFLAWCEGKTGYPIVDAAMRQLNQTGWMHNRLRMVVASFLTKHLLIDWRWGERYFRQHLIDGDLAANNGGWQWSAGCGCDAQPYFRIFNPISQSEKFDPDGSFIRKYLPELASWGIKRLHQPNMQKTPSLFEAPMLESDSAYPCAIVEHNAARARALAVLGVLKKA

SEQ ID NO: 23787 - protein, 892 aa, Unknown
  Oceanobacter sp. RED65
MNQAINTTCAYCGVGCGIKADVNKTTREISIIGSDQHPANYGRLCSKGTALGNTLEEKGRLLSPLVKGQKTSWSSAIDHVANGFQSIIEQHGPDAVAFYVSGQLLTEDYYVANKLMKGFMGSGNIDTNSRLCMSSSVVGHKRAFGTDTVPGCYEDFEKAKLITLVGSNTAWCHPVLFQRIKRYKANNPDVKVVVIDPRKTATCDIADLHIPLALGTDSWLFNGLLHYLADNDYLNQEFIYQHCNGFDAALESAASSSADLKHLSKILSVELTTLKTFFKWFANTEQAVTLYSQGVNQSSSGSDKVNTIINCHLATGRIGRPGMGPFSMTGQPNAMGGREVGGLANTLAAHLEFNDSDIEIVKTFWDAPNMAHKPGRMAVDMFEAIERGEIKAVWIMATNPVVSLPNADQIKRALNQAELVIVSDCIEKTDTTAYADVCLPALGWSEKDGTVTNSERRISRQRALLEPLGEAKPDWWIICQVAQAMGFKESFDYPDAASIFREHAQLSGYKNTPEERLRDFDISRLSSISSDDYDNLNPFQWPINDSYPQGRERFFAQGDFFTPDRKANFLAIEPNLPKEKTSKQYPLKLNTGRIRDQWHTMTRTALAAQLNQHINEPFLQMHPTDAQQQNVHTGQIVQVTSQWGQMLAKLEVTDNVKQGDVFAPMHWTEQLSSRGRINTVVNPHVDPFSKQPESKHTPVNVHAFDLSMYGLLLTRQDLSVVDCAYQVSIRGAHSQQYQLAHHQWPSDPEQQLLDWLNIRSQQDLEKRGWQWIHFADARRRNHRLAILNEHGRLEALAMIQSSAIDCSTTWLQQQFAKESLSGRDRQALLSGHAPAGEDVGNIVCACFSVGSKTIEGAIKQGCRSVSAVGERLKAGTNCGSCIPEIKQLIAKA

SEQ ID NO: 23788 - protein, 1031 aa, Psychromonas marina
MRTFPEIINARDWENQHVTHQHVLEAHAPLHAFHSQQAALLNQASEFQHTLNGQWRFQLFTKPEVVPCDSIEVDFDDSEWPNITVPSNWQLQGYDKPIYTNVKYPFEDNPPFVPADNPTGIYRLNFDLPDTWQGRKQTITFDGVNSAFHLWCNGVWIGYSQDSRLPAEFDLSEQLQAGNNQLTVMVLRWSDGSYLEDQDMWWLSGIFRDVTLRSKPIISLRDIAISTDLDACFNHAQLNMVTYLSEISSDFRAQVQLFDAQGLPVTEPICAAFGERIFDEKGGAQDRAEHKIAIISPHKWSAESPYLYRAVISLLNSDQEVVDREAYDVGFRVVEISDGQLKVNGCPLLIRGVNRHEHHPEKGHAVNDDDMLMDIKLLKQNNFNAVRTAHYPNHPRWYELCDQYGLYVVDEANLETHGQFPMSRLSNDNSWLSAYMRRMTRMVERDKNHASIIIWSLGNESGIGHNHHAMYQWTKLKDPTRPVQYEGGGADTAATDIIVPMYARVDEDQLLPNAPDVVPKIAIKKWLSMPNEQRPLILCEYAHAMGNSLGSFDKYWQAFRDYPRLQGGFIWDWVDQGLTKTDKNGVDYWGYGGDFGDQINDRQFCINGLVFPDRSLHPGIYEVKKAQQFYQFSLIEADAVTIKVDSEQLFIDSSDENLRWTITENGEVMVSGEVELDIAPQCSQLLTLLENHPDQKVGCDYFLNIEVVLNKDKPWAEKGFVVATEQFVLPSIPQLARLTPVVSDAPCVSESENTLTISGDNFTVKMDKQQGVITDWLVAGEKRLLAGPKDNFFRAPLDNDIGTSEANCVDPKAWVSRWQSAGINDLVCRCLSIEAVTLKHQVLINVEFGHYSADKLIIATHWQYKIDHHGKVSIAVNVDVAKSLPPLPRIGMELILPKTDKPVSWFGRGPHENYPDRTLSAHIGRYSCPVEALHTDYIFPSENGLRCDVKEAQVGPLMVTGDFHLAVSRYQQANIAQAKHTNELIDEQQLYLRLDGFHMGVGGDDSWSPSVHQEFLLTKQHYHYHVVLSFT

SEQ ID NO: 23789 - protein, 315 aa, Colwellia psychrerythraea
MSDVRHCPLLILGSGPAGYTAAVYAARANLKPVMITGMQQGGQLTTTTDVENWPGDADDLTGPALMERMQKHAEKFDTEIIFDHIESVDFSSKPYKLTGSSEYTCDALIICTGASAQYLGLPSEEAFMGRGVSACATCDGFFYKNQKVAVVGGGNTAVEEALYLSNIASEVHLIHRRDTFRSEKILTDRLYEKVANGNIVLHTDRTLDEVLGDNMGVTGLRLKEMGSDATEELEVSGVFIAIGHKPNTDIFKDQLDMKDGYLTIQSGTQGNATQTSVEGVFAAGDVADHIYRQAITSAGAGCMAALDSERYLDAL

SEQ ID NO: 23790 - protein, 757 aa, Burkholderia pseudomallei
MREFDYLLVGGGIASVTAARTLRGEDASASIAILCGEPVLPYQRPPLSQEWLMGAVQPASITLHDAAFYVAQRIDIALGVRAEQLDRAKRIVRTSSGATFRYGKLLIATGASAKAPALPGFGLDGVHVLHTFAQAQALKDAAAHARRATVLGGGFLGVEIAATLQALGLQVTLVERAPGVMPSLRAPALGGHFEALCRARGIDVLTRCEVRRVLGAQCVEAVETSDGGTRPCDLFVAAVGVTPNCGWLDGSGLALGDGVEVDAFLQTADPDVFAAGDVAHFDDPIFGVRRRIEHWDNAVRQGRIAARNMLGHRLPYRDVSIFYGSVFGLSYNLLGYPVGATETIERGAFDEASYMQLYLADDVLRAAFTIDRPAVEIAALNDAIRLHVNVAAHKTKLSDPNYPLDKLPVQTILILQGGGALGAFECGAVKALEQHGVRPDVISAVSIGAFNGAIVASHPKGATKALEAFWRELSIALPLPYESQWREAWLSSYVLSFGVPNFLKPQWSQLGFDADRLRAKWTSFFDATAIEQLIARYVDFDSLGMSPTRLLIGAVDVETGEPRIFDSYVDRLSPAHVLASGSLPPGMPWTVVDGRPYWDGGVVSNSPLDLVIARCGQIGGRVFIVDLFSGSKALPTNLVEVMLRREEIAYMDRVRNDLRFEEYASDFRDLVDGILAHVDAPSANEIRQQPLYIRLMGNRAAIDIARITLNREGRLSFIEDYDFSSDAIAQLQQQGYDAALVALANGRSRRRRGRRRA

SEQ ID NO: 23791 - protein, 421 aa, Mesorhizobium loti
MADLKRTQPLARDAMAYVLAGGRGSRLKELTDRRAKPAVYFGGKTRIIDFALSNALNSGIRRLGVATQYKAHSLIRHLQRGWNFLRPERNESFDILPASQRVSETQWYEGTADAVYQNIDIIEAYGPEYMVILAGDHIYKMDYEMMLRQHVDANADVTVGCLEVPRMEATGFGVMHVDAKDNIIAFVEKPADPPGIPGNPDFALASMGIYVFKTKFLMEQLRRDAAEPGSSRDFGKDIIPYIVQHGKAIAHRFTKSCVRSTAENEAYWRDVGTVDAYWEANIDLTDITPELDLYDRDWPIWTYAELKPPAKFVHDEDGRRGSAVSSLVSGDCIVSGATLKKSLIFTGARINSYSTLEEVVMLPDVHVGRNAKLKRVVIDHGVRIPEGLVVGEDPALDAKRFRVSEKGICLITQDMINKLGL

SEQ ID NO: 23792 - protein, 196 aa, Oryza sativa
NILFKHIKELLSGDTALIAETGDSWFNCQKLRLPEGCGYEFQMQYGSIGWSVGATLGYAQAAKDKRVMSCIGDGSFQMTAQEVYTMLRCGQKSIIFLINNGGYTIEVEIHDGPYNVIKNWDYTGLIDAIHNSDGNCWTKKVRTEEELIEAIATATGAKKDCLCFIEIIVHKDDTSKELLEWGSRVSAANSRPPNPQ

SEQ ID NO: 23793 - protein, 176 aa, Sulfolobus tokodaii
MPLRPGRCYRHFSGPAYTRKEYIPGVPMPKITKFTMGNVNGNYDYELRLVALEKGQIRHNALEAARVLALKQLTNKTGSDQNFALIVLKYPHHVIRENKMMAFAGADRLQDGMRLSFGKPIGTAARIERLGDIIMIAKVKKEHLEIAKKAFEAAASKIPLKTKIDIVPIPKEAVVQ

SEQ ID NO: 23794 - protein, 672 aa, Mesorhizobium loti
MTPLGATVTPEGIRFAVWSSSARRLWVSLFDGQGNRELDRLELQSEGEGMHALFVPRLAAGTRYGFRADGDYAPDRGLWFDPDKLLTDPYAVEIDRPYAYHWRLAARRNEGADTAPLMPKTVAKTLPKTVPALPPLFRPGGLIYEVPVRAFTKLHPDIPEAQRGTIAALAHPVIIEHLQRLGVSAVELMPVTASIDERHLPPLGLSNAWCYNPVTFMALDPRLAPGGLEELRDTVAALRKASIGTILDLVFNHTGESDRLGPTLSLRGLDNQAYYRHQPDGRLVNDTGTGNTVACDHPVVRDMVLDTLRHFVRHTGVDGFRFDLAPVLGRVDGAFDPTAPLLEAITGDPVLADRVLIAEPWDIGPDGYQLGNFPPRFLEWNDRYRDDARRFWRGDAGAVGALATRLAGSSDIFGKAGQAASRTVNFIAAHDGMTLADIVAYERKHNEANGEQNRDGHNDNLSWNNGAEGETDSAAIANARFDDQCALLATLFASRGTIMLTAGDEFGRSQKGNNNAYAQDNAITWLDWAGRDHALERYASVLGMLRRAVPALSATDFLTGQSADATGTPDVAWLTETGMPLAETDWNDPARHRLVMLLGDAGGDRLAVMINGDRRQCVFTLPEREGFRWQPAIETQAIELARPLPGRSVHFMAEHRTEKWQSVFGQSDASKK

SEQ ID NO: 23795 - protein, 1240 aa, Oryza sativa
MAPTAAAAGPSDDGLRKLEYLSLVSKVCSELETHIGVGDKVLAEFITELGRDSASVADFDTKLKANGADLPDYFVRTLLTIIHAILPPPSDSRNPSSASQPAAGGSKFPGLSRPDDPDRARNLRLELERDAEEAAATAAPAPARDDRGRRRDERGRDRGRDDRGRDDGGRDRDYERGGRDHDRSHGRDRDHGRDRDRDRACDGDRQRGRDYGRDRDQDRDHDRDREGERRRDRDKDRGRDIDRDMDRDHRRGRRYDDEEEPEQFGGRKEGALVNSSGEPELYQVYRGRVTRVMDTGCFVRLEDVRGGREGLVHISQMATRRVANAKEMVKRDQEVYVKVVSVKGQKLSLSMRDVDQDTGRDLLPIQRGGDDAPRANPSGGSASGVGVGSGKRLGLSGIMIAEEDEVAPPSRRPLKRMSSPERWEAKQLIASGVLDVRDYPMFDEDGDGMLYQEEGAEEEQEIELNEDEPAFLQGQSRFSIDMSPVKIFKNPEGSLSRAAALQTALIKERREVREQEQRAMLDSIPKDLNRPWEDPMPDTGERHLAQELRGVGLSAYDMPEWKKEAYGKALTFGQRSKLSIQDQRQSLPIYKLKKELIQAVHDNQVLVVIGETGSGKTTQVTQYLAEAGYTTRGKIGCTQPRRVAAMSVAKRVAEEFGCRLGEEVGYAIRFEDCTGPDTVIKYMTDGMLLREILVDENLSQYSVIMLDEAHERTIHTDVLFGLLKQLIKRRSDMRLIVTSATLDAEKFSGYFFNCNIFTIPGRTFPVEILYTKQPESDYLDAALITVLQIHLTEPEGDILLFLTGQEEIDHACQCLYERMKGLGKDVPELIILPVYSALPSEMQSKIFDPAPPGKRKVVVATNIAEASLTIDGIYYVVDPGFAKINVYNSKQGLDSLVITPISQASAKQRAGRAGRTGPGKCYRLYTESAYRNEMSPTTIPEIQRINLGSTVLNMKAMGINDLLSFDFMDPPAPQALISAMEQLYSLGALDEEGLLTKLGRKMAEFPLDPPLSKMLLASVDLGCSDEILTIIAMIQTGNIFYRPREKQAQADQKRAKFFQPEGDHLTLLAVYEAWKAKNFSGPWCFENFVQSRSLRRAQDVRKQLLTIMDRYKLDVVSAGRNFTKIRKAITAGFFFHAARKDPQEGYRTLVENQPVYIHPSSALFQRQPDWVIYHELVMTTKEYMREVTVIDPKWLTELAPRFYKSADPTKMSKRKRQERIEPLYDRYHEPNSWRLSKRRA

SEQ ID NO: 23796 - protein, 410 aa, Pinus taeda
MASNIMQRCNVFMSERVKLHAAMLALQFGYAGFHIVSRAALNMGVSKVVFPVYRNILALMLIGPCAYFLEKKERPALTLSFLIQFFLLALCGITGQSRILSLRIVLHIPTFASAIQNSVPAITFIMAAALRLEKVHISRRDGLAKIIGTVACVSGATIITLYKGPPITHIWRPNLEVTASYFKAFQGNDLSAKSENWTLGCIYLLGNCLAWSGWIVLQAPVLKRYPARLSVTSFTCFFGVIQFLIIAAFFETDLEHWKIHSGGELFTILYAGFVASGIAFSVQIWCIDRGGPVFVAVYQPVQTIAVAIMASIILGEQFYLGGIFGAILIIIGLYLVLWGKSEEKRLGLLQAKSSMVPENQPDNMDQSATLIINSSNGIKPNTSSSLTQPLLLDTSYKTVNIPSPSDEPQP

SEQ ID NO: 23797 - protein, 288 aa, Thermococcus kodakarensis
MGYNEQERAFIEWYPRGYGVGFKVKRRLFETQTEYQRLEIYETEGFGKLLVLDGTVQLVEVGEESYHEVLVHPVMLAHPNPRKVLVIGGGDGGTLREVLRHDTVEKAIMVEIDEGVVEASYLYLDVAKDLLDRLIKKEEPRAELIIGDGVKYLRETDERFDVIIVDSTDPVGPAKLLFSEEFYRDAYEKLNEKGLYVTQAGSVYLFTNELLDAYKAMKKVFDRVYYFSFPVIGYASPWSFLVGVKGDVDFTRIDLERAKKLDLYYYDPERHETLFQMPRYVRKLLEGQ

SEQ ID NO: 23798 - protein, 213 aa, Oryza sativa
MEVKLWNDKRERELLESLADLYAIIKATEKLERAYVRDLVSAADYEAECLKLISQFNSLSSSLAGVVTIPRFVEAYRLDCPAALNRLVQSGVPATVELRAAASSSAPASSAASAAAIAQCVQSFITAMDAVKLNMLANDQVRPLLHDLSTSMGKLGPVLPPDFEGKVKVSEWLAKLNKMGAGDELTEQQARQLNFDLDSAYSAFMASLPSTGL

SEQ ID NO: 23799 - protein, 171 aa, Glycine max
IITRMLGIQMAVMMGANLAGEVADGNFCETTIGCNDKAMAPILKELCQADFFRVVVVDDRNTVEICGALKNIVACAAGFTDGLGLGDNTKAAVIRLGLMEMIKFVDTFFPGSKLSTFFESCGVADLITTCYVGRNRRVSEAFVKTGKSIPDLEAEMLNGQKLQGPITAEEL

SEQ ID NO: 23800 - protein, 72 aa, Lactobacillus sakei
MAKDDVIEIEGKVTDTLPNAMFKVELENGAVILAHVSGKIRKNYIKILPGDRVTVELSPYDLTKGRITYRFK

SEQ ID NO: 23801 - protein, 420 aa, Triticum aestivum
VQKSRLVPARNFRDIVDPRVRGRVGRGRGPHLASPSASLNHAPSPRFRHRRGSRFIVRAESDFYSVLGVSRNASKSEIKSAYRKLARSYHPDVNKEPGAEQKFKDISNAYEVLSDDEKRAIYDKYGEAGLKGSGMGTGDYSNPFDLFESLFEGFGGMGGMGGGRAARNRPMQGDDESYNLVLNFKEAVFGVEKEIEITRLEGCNTCDGSGAKPGTKPTTCKTCGGQGQVVSSTRTPLGIFQQVSTCNTCGGTGEFSTPCKTCGGDGRVRKTKRISLKVPAGVDSGSRLRVRSEGNAGRRGGPPGDLYVFIDVLSDSVLKRDGTNILYTCKVSYIDAILGTTVKVPTVDGVVDLKIPSGTQPGTTLVMSKKGVPLLGKSNARGDQLVRVQVEIPKRLSSDERKLIEELANLNKAEPANSRR

SEQ ID NO: 23802 - protein, 87 aa, Zymomonas mobilis
MAEFHSARQKLKRLHLAKEELLEMRGRVVELLPNAMFRVQLENDHEILGHTAGKMRKNRIRVLVGDEVLVELTPYDLTKGRITYRFK

SEQ ID NO: 23803 - protein, 180 aa, Rhizobium etli
EFDAFPTLEQLPLWGFDGSSTMQAEGRSSDCVLKPVAIYPDPARTNGVLVMCEVMMPDGVTPHPSNARATILDDEDAWFGFEQEYFFYQNGRPLGFPEQGYPAPQGPYYTGVGYSNVGDVAREIVEEHLDLCLAAGFNHEGINAEVAKGQWEFQIFGKGSKKAADQIWMARYLLQRLTEK

SEQ ID NO: 23804 - protein, 401 aa, Unknown
  Rhodococcus sp. RHA1
MQGTAQAQERTGRIVTTQQSETVEVREIDAGAAPTRFARGWHCIGLSEAFRDGKPHSVQAFGTKLVVFADSAGDLTVLDGYCRHMGGDLSQGTVKGDEVACPFHDWRWGSNGRCKKIPYARRVPPLARTRSWHALDQDGMLFVWNDPEGNPPPVDVTIPRIDGALDDEWTDWVWYRTTVDTNCREVVDNIVDMAHFFYVHYSFPTYFKNVFEGHVASQFMRGQARDDMRPHASGQPRMLGSRSDATYFGPSFMVDDLTYRYETHDVDSVLINCHYPVSADKFVLQYGIIVKKSKELDGEAATEMAKSFGTFIAKGFEQDIEIWKNKTRIENPLLCEEDGPVYQLRRWYEQFYVDVDAVTPQMTERFEFELDTTRPVESWKREVEENLARKAREADATAAVH

SEQ ID NO: 23805 - protein, 861 aa, Oryza sativa
MAKIQPLPAASPSAEWHHGDGGGGGVQGKQAVYTVWMKSLVFNGHGCTVYGSDGRVAFRVDNYGCRGSRDVFFMDTAGTTLIGIQTKSFGMMKRWEASRHHGGEKETTTATVTTPWFRVQRGRGPGGAMATVTLHGGVGMAYRIDGCPSKSEYRISRGGGGGGGGDGEVVAEVARKQTASGVVLGEDVLTLTVGPGADHLLVLGLVVMVDEDTSLKLGLSLFVGNSLDKVGQVSPANYAGDGRVCVGWSMYTSLPRFGVGWLTDDDVVCGVSWWVARAARLRVCADGGANRVFDGMPELLPAEDPDQVRMRYKPDVIKGDMDSIRPEVKEYYSNLGAEIVDESHDQDTTDLHKCVSFITRNPPGSEESNLYILVLGALGGRFDHEMGNINVLYRFSNIRIVLLSDDCSIFLLPKTHSHEIHIERSIEGPHCGLIPMGSPSASTTTTGLRWNLVGKEVDGIEDSVIFRSLQALAVPLIGNACHIFMHGLNSVQIYGAEKLQQALQERPKGKPLLTVSNHVAAMDDPFVIASILPPSVMLEAQKLRWTLCASDRCFTNPILSTFFRSVKVLPVSRGDGIYQKGMDMALSKLNNGGWVHIFPEGSRSKDGGKTVAPAKRGVGRLVMDADSLPVVIPFVHTGMQDIMPVGKRIPRAGKRVIVVVGDPINFNDLIIDNSDETQHISRGILYDKATERIGQRLQELKAEVDRLAAEQKSELQHHHARDTVNYGTRLWQQVDWEAFGMESSMLSPEPSDVQEPLKKAKPVLHLESEHAKPELHLEPEQAKHELHTEQCVPAAPSAEICSNFGVPLFFRQHTDPSELMGFAARGLLKNGRFMEEEGYRELQRQGAMNMFWGSQANNTVL

SEQ ID NO: 23806 - protein, 395 aa, Pseudomonas fluorescens
MPLRSTFTRFFAMEAASGLLLIAAAILALIINNSPLSWLYNGLLETPVVAQVGALKIAKPLLLWINDGLMALFFLLIGLEVKREVLEGQLAKPSQIVLPGAAAIGGMLVPALIYWFLNRDNPPALNGWAIPTATDIAFALGVLALLGKRVPTSLKLFLMTLAIIDDLGAIVIIAIFYSGTLSTLSLMLAGACIAALVAMNRMGVVKLGPYMIIGLILWVCVLKSGVHATLAGVTLAFCIPLRTRNAEPSPLKALEHALHPWVSFGILPLFAFANAGLSLSGVTLESFTHHVPMGIAVGLLLGKTIGVFGLTWMAVKTGIAALPSGANWGQVLGVAILCGIGFTMSLFVGSLAFEPGSSEYAGMDRMGILTGSLFAALIGYAVTAAASRRNNTLAS

SEQ ID NO: 23807 - protein, 598 aa, Mycobacterium tuberculosis
MPPLLPPAPPVPPAPNSPPCPPAPPSAPSVPAPPVPPAPKSNPFPPVPPFAPNPPAPPAPPLANSPPVPPAPAVPPAPIKFWERAAWPPVPAAPRNKPASPPRPPAPPVSRPNPPLPPVPPEPISKAAPPVPPVPPWPVVPMPPDPPVPPIPDRIPPAPPDPPSPPSAPVAPWPPLPPLPNNHPPAPPSAPVPGVPLAPLPISGRPVRAWVGSLIALRICCCRVCSGVLAGALNPSRPSSCPPKPPAPAVPAGAPVPPLPPLPPLPISTPLPPAPPLPPLPALPTSPGAPPAPPVPPAPAKDPPPAPPAPPAPLSRPAFPPAPPAPPASKPSPPTPPAPPEPNNVPPSPPIPPAPPPPSGLDPPLPPAPPAAPRLSMPASPPAPPFPPTLIMLVPPLPPVPPAPNSPPEPPSPPAPPPKMPNPPGPPVPPAPNSPPFPPDPPAPPVPASVAPPAPPTPPSANSPPFPPAPPAPPVAPKAAANPPGPPTPAAPNSMPAAPPAPPAPPVPVLALPPAPPAPPLPMSPPAPPLPPAPPLTPAAPDPPAPPLPINQPPSPPLAPVPGAPLVPLPISGRPVFARKNSLIGASSGDTAAASAAA

SEQ ID NO: 23808 - protein, 305 aa, Unknown
  Synechococcus sp. WH 8102
MVWTVDDIPSQEERVALVTGANSGLGLATARAMSARGATVIMACRCRRKAETARTQLLEAGLTGLDLLDLDLADLNSVRRAAAEVSDRYGHLDLLFNNAGVMAPPRQLTVQGHELQLGVNHLGHMALTLQLLPLMQGRNDARVVTVTSGAQYFGRIRWDDPSWAQGYDRYGAYSQSKLANVMFALELEARQQEQGGGIRSLAAHPGLARTDLQPTAIASGGNRLEAVAYRLMDPLFQSAAMGALPQLHAATAATAQGGEHYGPDQLGGMRGHPTRCRIAPAALDREQRQRLWQLSEELAGGLLMP

SEQ ID NO: 23809 - protein, 307 aa, Unknown
  Iris x hollandica
MAKDPVRVLVTGAAGQIGYALVPMIARGVMLGPDQPVILHMLDIPPAAEALNGVKMELVDAAFPLLKGVIATTDVVEACTGVSIAVMVGGFPRKEGMERKDVMSKNVSIYKSQASALEKYAAANCKVLVVANPANTNALILKEYAPSIPEKNITCLTRLDHNRALGQISERLNVQVSDVKNVIIWGNHSSTQYPDVSHAIVKTESGEKPVPELVSDDAWLRGEFITTVQQRGAAIIKARKLSSALSAASSACDHIRDWVLGTPEGTFVSMGVYSDGSYNVPAGLIYSFPVTCRDGQWTIVQGLSVDE

SEQ ID NO: 23810 - protein, 486 aa, Unknown
  Candidatus Kuenenia stuttgartiensis
MNTPEPLIFEKSVPNRRCFSLPACDVPESPITQLIPQKMQRSRNPNFPEVSEIDIVRHFTKLSQMNYCVDTHFYPLGSCTMKYNPKINEDAANLEGFTRLHPYQPQEQCQGILKILYDLEQMLADISGMPCFTLQPAAGAHGELTGMLIIQAYMKKQREIRNTIIVPDSAHGTNPASAALCGYRIASVQSDANGLIDVKKLKQMLSNDTAALMVTNPNTLGLFEKDILEISKISHDAGALVYCDGANMNALLGIARPGDMGVDILHLNLHKTFSTPHGGGGPGAGPIGVSRALEVFLPIPRTVKNEDDSYALTYDFPDSIGRVRAFYGHVGIMIRAYTYLLSLGKEGIIKTGENAVLNANYLRNILSEYYEIPYGKTCMHEFVISAKKQKAQGVSALDIAKKLLDYGFHAPTIYFPLIVEEALMVEPTETESRETLDAFAGAMIEIAGAIAQAPETVRNAPQKTRIGRPDEVIAARNPKLRWKGTG

SEQ ID NO: 23811 - protein, 145 aa, Yersinia pseudotuberculosis
MNTVCTACMATNRLPEERIDDGAKCGRCSHSLFDGEVINATAETLDKLLQDDLPMVIDFWAPWCGPCRSFAPIFAEAAAERAGKVRFVKVNTEAEPALSTRFRIRSIPTIMLYRNGKMIDMLNGAVPKAPFDNWLDEQLSREPNS

SEQ ID NO: 23812 - protein, 185 aa, Bacillus cereus
MKKRRRKLPFFSLKLHQQKEKNFVMIRKGEERRVYILGYIEELRKVVGTRPLILVGSAIIILNDNQEVLLQYRSDTYDWGVPGGAMELGETTEETARRELFEETGLNAKIMQFIGVLSGKEVYFQYPNGDEIFNVIHLYQGHHVSGELRLDHEGLQLQYFPVDKLPNLNKTTEKILQKFLYALTE

SEQ ID NO: 23813 - protein, 412 aa, Methanosarcina mazei
MSYIEKIDPELFEAIKNEADRQEHKLNLIASENYASRAVMEAQGSIMTNKYAEGYSGKRYYGGCDFVDVAENLAIARAKELFGAKYVNVQPHSGSGANMAVYFSVLQPGDTILSMDLSHGGHLSHGSPVSFSGKLYNIVPYGVSKETEALDYDELLKLAKECKPRMIVCGASAYPRVIDFKRFREIADEVGAYLLADIAHIAGLVVAGVHPSPVPYADFVTTTTHKTLRGPRGGMIISKTEELAIGVNKAVFPGIQGGPLMHIIAAKAVAFKEAMSEEFRQDQDQTVKNAKVLCSCLKQKGFDIVSGGTDNHLMLVNLNNMNITGKDAEAALSKAGIIANKNTVPFETRSPFVTSGVRLGTPSCTTRGMKEKEMELVADYIEAAIKNSENDALLSEINIKVRDLCLKFPVYE

SEQ ID NO: 23814 - protein, 319 aa, Unknown
  Nostoc sp. PCC 7120
MRIANDVTELIGGTPLVKLNKIPQAEGVVARIVVKLEGMNPASSVKDRIGVSMINAAEAEGLIIPGKTILVEPTSGNTGIALAMVAAARGYRLILTMPETMSQERRAMLRAYGATLELTPGTEGMRGAIRKAEEIVASTPDTHMLQQFRNPANPKIHRETTAEEIWNDTDGEVDIVIAGVGTGGTITGIAEVLKQRKPSFQAIAVEPSNSPILSGGQAGPHKIQGIGAGFVPDVLRLELVDEVIRVSDDQAMSYGRRLAREEGLLSGISSGAALCAALQVGKRPENAGKLIVMIQPSFGERYLSTPLFQDLTNETAGVS

SEQ ID NO: 23815 - protein, 253 aa, Pseudomonas syringae
MSAKVWLVGAGPGDPELLTLKAVRALHEADVVLIDDLVNTAVLEHCPNARVIAVGKRGGCRSTPQAFIHRLMLRYVRQGKCVVRLKGGDPCIFGRGGEEAQWLQERGVAVELVNGITAGLAGATQCGISLTLRGISRGVTLVTAHTQDDSSLNWQALAQGGTTLVVYMGVAKLAEIRESLLAGGMSGEMPVAMIENASLPWQRECRSTLNAMQRDASAFELKSPAILVIGAVAACSNELLNETLIDHAQLSAG

SEQ ID NO: 23816 - protein, 414 aa, Glycine max
AGDNVKFGFPMAFTTTMLSWSVIEFGGLMKGELQNAREAIRWGTDYLLKATAHPNTIYVQVGDAKKDHACWERPGDMDTPRSVFKIDANTPGSEVAAETAAALAAASLVFRRSDPTYSKILVRRAIRVFQFADKYRGSYSNALKPYVCPFYCSYSGYQDELLWGAAWPHKATKNPMYLNYIKVNGQILGAAEFDNTFGWDNKHAGARILLSKEFLVQRVQSLHDYKGHADNFVCSLISGTSLSSTQYTPGGLLFKMSDSNMQYVTSTSFLLLTYAKYLTQSHMLVNCGGITVTPRRLRTIAKKQVDYLLGDNPLKMSYMVGYGPRYPRRIHHRGSPLPSIAVHPGKIQCSAGFSVMNSQSPNPNILVGAIVGGPDRHDRFPDQRSDYEQSEPATYINSPLVGALAYLAHSFGQL

SEQ ID NO: 23817 - protein, 100 aa, Neisseria meningitidis
LDDVREALTEIGITGMTVSEVKGFGRQKGHTEIYRGAEYAVDFLPKVKIELVLADDAVERAIDVIVEVARSGKIGDGKIFVLPVEEAIRIRTGERSDAAV

SEQ ID NO: 23818 - protein, 100 aa, Neisseria meningitidis
LDDVREALTEIGITGMTVSEVKGFGRQKGHTEIYRGAEYAVDFLPKIKIELVLADDAVERAIDVIVEVARSGKIGDGKIFVLPVEEAIRIRTGERSDAAV

SEQ ID NO: 23819 - protein, 321 aa, Lactobacillus sakei
MADTPHFYIILNQVAGTGQAQKIWPQIETALKQRGISYELQISSYPGHTTRIAYQFARFKRTNQVLLIVGGDGTLNQAINGVQSAGKHDIPIAYLPCGSGNDFARGIGLNSDPLQALEQILAATAPVNIDLGVYHDALKNETGYFVNNVGIGFDASVVSITNNSKSKRFLNKCHLGSLSYVFSLIQAFTSQDAFQVTVKANGSVKNFSRGFLVTTTNHPYFGSGVPIMPSARVDDQKLDLVVIEKLNVFFFCYLFIMMLMGKHTRYKTVHHFRTDDLVIRTQTLEFGQVDGEEMGSRAFDMHFKVTSQPFWLTTTKTEQFK

SEQ ID NO: 23820 - protein, 523 aa, Colwellia psychrerythraea
MLDTNLQTQLKSYLDNLKTPVELITFTDESPKAKELAQLVTQIAELSPLITEINGNNSEQAANERVPSMLVRSVASNSEMRFAGLPMGHEFTSLVMALLHSGSHPLKIEAEQIEQVRNLEGDFVFETYISLSCQNCPDVVQALNMMAAINPNIKHTMIDGSLFQTEVFDRDVMAVPSVYLNGESFSQGRVSLTDILNKVDTNAGARQAKALENKDTYDFLVVGGGPAGAAAAIYAARKGINTGLVADRFGGQVSDTMAIENFISVKATQGPKLVASLEEHVREYDVDIMNSNKASKVKRNEATGLVEVSLENGAVLKSKSVVLATGARWREMNVPGENQYRGKGVAYCPHCDGPLFKGKPVAVIGGGNSGIEAAIDLAGIVEHVTVLEFADTLRADDILVRKANSLTNVTIITNAQTTEVHGDGTRVTSLSYTDRGTGEHHSLALAGIFVQIGLMPNTEFLQGEIELTNRGEIIAGSRGETSITGVFAAGDVTNNPYKQIIIAMGSGANAALGAFDYLIRQDV

SEQ ID NO: 23821 - protein, 1028 aa, Kluyveromyces lactis
MLKYRSSVTVVRQFARTRVPLGLTPALGYRFVSTKCNVSSNQYGKIYEAKKNGPDAYEPLDTFQRRHLGPSPSNVDQMLKQLGYTDLDQFINGVVPENILVKRPLELNSPENGFTEQQMLKHLEELANKNNHKVRNFIGKGYYGTVLPPVIQRNLLECPEWYTSYTPYQPEISQGRLESLLNYQTVVSDLTGLPVANASLLDEGTAAGEAMLLSFNVAKKKKLTYVIDKRLHKQTKSVLKTRTEPFGIKLVEVDPLDESTWSVLSSDKDVSGCLVQYPDTEGNIIPGETLAKLADIVHQSKGLFAVASDLLALTLLKPPAQFGADIVLGSSQRFGVPFGYGGPHAAFFSVIEKLNRKIPGRIVGVSKDRLGKPALRLALQTREQHIKRDKATSNICTAQALLANIAANYCVYHGPQGLKEIAGRVYGFTTVLANGLSSSNHTLLNKSWFDTLTVELNGISAQDFIKTAVDKYQINLYQVNNETVSLSLDETVTKDDLIALLELFGCNANELPVALPEFPQELTRQDEILSNEVFNTHHSETAMLRYLHRLQSRDLSLANSMIPLGSCTMKLNATVEMIPITWPQFANIHPFQPRDQVEGYEVLIKNLEKDLASITGFDEVSLQPNSGAQGEYAGLRVIRRYFEDRGETHRNICLIPVSAHGTNPASAAMCGLKVIPVNCLKNGSLDLVDLKAKAEKHKDNLAAIMITYPSTYGLFEPGVRTAIDLVHENGGQVYLDGANMNAQVGLTSPGDLNADVCHLNLHKTFSIPHGGGGPGMGPICVQSHLAPYLPAHDVVPMITGVGSDKSIASVSSAPYGSASILPISYAYIKMMGSKGLPFSSVIAMLNANYMMSRLRPHYNILFVGEKGSTTETEDLTHCGHEFIIDLRAYKDQGVEAIDVAKRLQDYGFHAPTLAFPVPGTLMVEPTESENLEELERFIDAMISIKKEIDLFIKGDPQGQVLKNSPHSLEDVVSSDDWSSRGYTREQAVYPLPYLKYNKFWPPVARLDDTYGDTHLMCTCPSVEEVASE

SEQ ID NO: 23822 - protein, 105 aa, Neisseria meningitidis
VKPFKLDDVREALTEIGITGMTVSEVKGFGRQKGHTEIYRGAEYAVDFLPKIKIELVLADDAVERAIDVIVEVARSGKIGDGKIFVLPVEEAIRIRTGERSDAAV

SEQ ID NO: 23823 - protein, 538 aa, Mycobacterium avium
MMSAHEVMSAHETERGAMQSKPWWSSAVFYQVYPRSFADSDGDGVGDIDGVTAHLDHLEQLGVDAIWLNPVTVSPMADHGYDVADPRDIDPLFGGMAAIERLIAAAHRRGIKITMDVVPNHTSSAHPWFQAALAAGPGSDARQRYFFRDGRGTDGELPPNNWTSVFGGSAWTRVLEPDGNPGQWYLHLFDTEQPDLNWEHPDVFDDFEKTLRFWLERGVDGFRIDVAHGMAKPAGLPDSPDLESKVLHHSDDDPRFNHPSVHDIHRDIRKVVNDYPGAVTVGEVWVTDNARWAEYLRPDELHLGFNFRLTKIDFDAAQIHDAIQNSLAATALQDATPTWTLSNHDVGREVTRYGGGEVGLRRARAMAMVMLALPGAVFIYNGEELGLPDVELPDEVLQDPTWERSGHTERGRDKCRVPMPWSGQAPPFGFSSRTDTWLPMPKEWAALTVQKQRDDPDSTLSFFRRALELRRRRVEFDGDGVEWLEATADAVTFRRPGGLVCALNSGEQPVPLPPGELVLASAPLLDGKLPPDAAAWLA

SEQ ID NO: 23824 - protein, 369 aa, Oryza sativa
MSRLAAVYRLFTTDEEIHELTGERSVVKTKDAELELVIPAVFVRCNKKSKPEFFFPLFYINKNSLLTGSLELFENYGSLKNKKHLVVYEIKKCRTTSNPTGIIYQITNFLNGTKHEIVNIAVTMDNQQLPYAGQPAAAGAGAPVPGVPGAGGPPAVPHHHLLQQQQAQLQAFWAYQRQEAERASASDFKNHQLPLARIKKIMKADEDVRMISAEAPVLFAKACELFILELTIRSWLHAEENKRRTLQRNDVAAAIARTDVFDFLVDIVPREEAKEEPGSALGFAAGGPAGAVGAAGPAAGLPYYYPPMGQPAPMMPAWHVPAWDPAWQQGAAPDVDQGAAGSFSEEGQQGFAGHGGAAAGFPPAPPSSE

SEQ ID NO: 23825 - protein, 307 aa, Solibacter usitatus
MRNVVIIGSGCAGNTAAIYTARANLKPLVIAGHEAGGQLSLTTLVENFPGFPEGINGPDLVENMRVQAQNFGAEFMHGSVIDTDFSQRPFRLNIEGDWMETRTVIIASGASARWLGLESEHKLIGHGVSSCATCDGFFYRGRKIMVVGGGDSAMEEANFLSRFGSEVTLVHRREEFRASKIMLDRAQHNPKIKFLLNTEVEEVHDVSKKLVTHVRLRNNKSGEVWDQEVDGFFLAIGHIPNTKVFKGQIETDPDGYILSKGGARTNIAGVFHAGDVQDRTYRQAITAAGAGCMAAIEVERFLEAEGH

SEQ ID NO: 23826 - protein, 479 aa, Mycobacterium smegmatis
MPSPSVTSPQVAVNDIGSAEDFLAAIDKTIKYFNDGDIVEGTIVKVDRDEVLLDIGYKTEGVIPSRELSIKHDVDPNEVVSVGDEVEALVLTKEDKEGRLILSKKRAQYERAWGTIEELKEKDEAVKGTVIEVVKGGLILDIGLRGFLPASLVEMRRVRDLQPYIGKEIEAKIIELDKNRNNVVLSRRAWLEQTQSEVRSEFLNQLQKGAIRKGVVSSIVNFGAFVDLGGVDGLVHVSELSWKHIDHPSEVVQVGDEVTVEVLDVDMDRERVSLSLKATQEDPWRHFARTHAIGQIVPGKVTKLVPFGAFVRVEEGIEGLVHISELSERHVEVPDQVVQVGDDAMVKVIDIDLERRRISLSLKQANEDYTEEFDPSKYGMADSYDEQGNYIFPEGFDPETNEWLEGFDKQREEWEARYAEAERRHKMHTAQMEKFAAAEAEAANAPVSNGSSRSEESSGGTLASDAQLAALREKLAGNA

SEQ ID NO: 23827 - protein, 689 aa, Medicago truncatula
MSKEKVDHKEMNNSCAPDQSSVPRNDLFELVWQNDQILVHGQSSNSNRAKMTPTLPSHTLKGHDKYSGQHANETNTRIGKFEDLDNGLNEIITRSVSSSQDEDLMTMMPWLNCAMDDEHSLHYSSCFVHEPGARTNDFAATNKFSLLDRKSNCIQVFSDSHKQGILSKGSSLAVEDFDTSELKTSTNQLNMSSLLQQCQPSFESIRFRESGLSENNTKGNANQHAPCEEISHVPSSSTVMNFTHFAKPAAIVKANLQNIGFSSSRSERVGAKNKDAAAIGRNPCESSKVDLSVECPKSSAIHCHQSVEPSRVGLKPLEPKSLEKNTTVSTSACKEDVSKVDQTSNQVLSESSRKGQEVFKKCTELTVASSSVCSDNGVHRSSDDANQNLKRKNLDSEDSEWHSEDFEDESIGVKRTDHGRGVTGSKKNRSTEVHNLSERRRRDRINERMRALQELIPNCNKVDLFFLQADKASMLDEAIEYLKSLQLQLQIMSMGGGGLYMPMTLPAGMQHMHAAHMFPFSPMSVAMQMGLGVPQFQGTHLPVAHTSGLAALHGMVRPNPQMFGLQAGQGLHMPMPSASMFSYPGEPVMNSSAVELNASGTAGLMETVESASASKLKDQMPKLKDPMPNVNSQVMLNNKGCSSTNQMSIQCEATTGGLEQSNVVLDSAHALLENDKRDNIEIEIDKSHE

SEQ ID NO: 23828 - protein, 666 aa, Cryptococcus neoformans
MSGNVACARVRSQSSTFSPLETRDGDEQESSSSDSQHGSSKRGPQRRATDLPSAADLYVPSLPGLPEMATHPTHPLNIYAGMLPSYPGEGKVGGEGQTGKDAKLYFLMAKARRNAGKERVIFWFNGGPGCSSFDGSLMEVGPFRTVPATETTSGMVEAKLVEGGWEEFATVVFVDQPPGTGYSYAATDGYLHDFDELSAHFIEFLQNFYTVFPELKGVDTYLAGESFAGQYIPFFADALIKSIELPNFPLKGIAIGNGWIDPKEQYPGYVEFAYEKGLIVSGTPEAEEMESALKRCQEEMDKYSDPFTTPVNINNCGQVMDSVTRPFTQELNGKKVCMNVYDVRLVDDFPACGMNWPPDLPDVYTFLRQDDVISALHATSKETAWVECNNKVSYELNLKKSHMSAALLPSILEAGVPILMFAGAEDLICNYKGIERIVNGLEWDGEKGFGNATSQEWYFNGTQVGTWQTSRGLSYAKIFDSSHMVGFDVPHVSNDMIMRFMDVDVSLLPGMTAQWPSRIGDDERTMIHVGDGESGGVPLIEGGNTDWEAWYNAIFAFLVLGILVSIAGLYFYFRRKPVSYRSRISLKQRSRRRRGHDMDEDEAAERMPLGSERLELDDIERAEGYEFHDGDGERYSREGKGKGKERAKDGEEVVFALGDDDEDDHH

SEQ ID NO: 23829 - protein, 318 aa, Unknown
  uncultured Acidobacteria bacterium
SWSKRVKHPSKLVNPGDTVEVEVLSVDPKARRISLGMKQIQDNPWQTLHERYQVGTRVHGRVRNLTDFGAFIEIEDGVDGLVHVSDISWSRRIKHPSEVLKKGQEIDAVITSIDAENRRLSLSIKDLEPNAWDRFLTEHKPGDVVRGKIARFANFGAFVELDDNLEGLCHISELSDERVEKPEDVVQLGQEMEFKILRIDVESKKIGLSARSVGKDDEPIVDTKVYSSQAGSGMASLGELADFGLGRIDAKAGPEIGTNVPSEPEPVTEPESEEQPVTEPASEEKPVSEPEPAAEPVKEPEAEDSTESASAVASEDQQ

SEQ ID NO: 23830 - protein, 677 aa, Prochlorococcus marinus
MIHLNKGKPFPLGSSLTSQGVNFSLIATNAEYVEILLFEREDSIFPKSIFKLDQTHNKGPYWHAEIKNLNEGCIYAFRVKQKNNGINNNYEKKVLLDPCSRGITGWGSYKRENSLKTHENTNSCLKSVVCDRKLFNFKDYPRPKHSWEETIIYELHIKAFTESTDRDESCFKKFLKKIPYLKELGITTIELLPIFCFDPTDAPNGLKNFWGYSPINWFTPHFEYLSNESAEENREEFRRFVEECHKADIEVILDVVYNHTSEGDSKGPAISWKGIDENLYYFIGKDKNYQDVSGCGNTIAANRGLVRKLIIESLKCWASELGVDGFRFDLGIALSRGENLSPLDNPPIFEDIECEPELIDIKFISEPWDCGGLYKLGDFPSKNTFTWNGHFRDDLRRFWKGDKDTAWNMSDKIKGSPSIYKEDNIFPKSINFITSHDGFTLKDLVTFNRKHNFANREQNRDGDNHNNSWNHGEEGPTTNLLINDLRKRQQKNLILSLLISRGVPMILMGDEIGRSQGGNNNSWCQNNLLGWMNWEHGHQDLELLEYFKYVIKIRKELINIFNPPFFPKNKTNENIPTYHWHGTKLDNPDWSSWSHTVAFSINKGITNPLVWIGLNAYSKSINFPLPKCKYNWLKVIDTSMSKIFEPLTIDEKFVSIKSRSSLLIISEEVFGAKNNLF

SEQ ID NO: 23831 - protein, 301 aa, Schizosaccharomyces pombe
MAKQTLLSTPLHGVYIPVFLIIFGTYIVKREWVGYAIVVAFSLGFHKFWRGRVRKVLSDKIQQFELSDKAVLNHNTAIYRFRLPRANDVLGLPIGQHLKVFVDVDGKEYSRSYTPLSSDADKGYFDLLVKSYPNGKVSKKFSELKIGDTIGVRGPKGNWKHRTGLARHFGMIAGGTGITPMLQIIRAVLSNFEDPTEITLLYANVSEGDIVLRDEIDALAKKDPRFTVHYVLNNPPENWKGSVGFVTQELIKAHFPAPSPETKVLICGPTPMVNSLREATVALGYEKSRAISKLEDQVFVF

SEQ ID NO: 23832 - protein, 415 aa, Bacillus licheniformis
MSEVIEKAKKAKVAKEELVHQPTERKNEALSFIAEAIRFKQDEILAENEKDIVRGKEKGFSPALLDRLALTPERLNDIADAVMLLTKLEDPVGETLETIRKDNGLFIENVRVPLGVVGMIYEARPNVTVDAATLCLKTGNAVILRGSSSAINSNKALVRVIREALERSALPEDAVQLIEDTSKETAKQLFTLNDGLDVLIPRGGKNLIDMVVRESTVPVLETGAGNCHIFIDESAQPDMAEQVVINAKTQRPSVCNAIETVLIHKGWAEEHTKALLQKLEEAGVEIRGDEAVCTMLPSAVPARETDWGTEFLAPVVSIKTVAGIDEAIRHIRQYGTRHSEAILTENQENARYFLTSVDAAAVYHNASTRFTDGFEFGYGAEIGISTQKLHARGPMGLKALTSSKYIIKGNGQIRI

SEQ ID NO: 23833 - protein, 316 aa, Unknown
  Halobacterium sp. NRC-1
MSSDDAWTAAALPDQSGRRVVVTGANSGLGFEATRAFARAGAHVVMACRSTERGEDARDDIVAELPGASLTVHELDLAALDSVAAFADWFTAEFDSLHVLANNAGVMAIPRSETADGFETQFGVNHLGHVALTAGLLGVLRRTSGETRVVTQSSGAHRRGRIDFEDLQHEAEYGKWEAYSQSKLANLLFAYELDRRLRAASASVTSVACHPGYAATNLQLRGPQAAGSRLRLLAMRAANALVGQSAEQGAWPLLYAATNPSIDGGEYIGPGGVLNMRGHPERQQPSARSRDEDTARRLWTVSADRTGVDFDLPDPA

SEQ ID NO: 23834 - protein, 222 aa, Anabaena variabilis
MALFGFGKKLALPTPEKALPGRAQIMPVPANHYVNKNPLKPPFPEGFEKALFGLGCFWGAERKFWQQSGVYTTAVGYAAGFTPNPTYDEVCTGLTGHNEVVLVVFDPKVISYTQLLKVFWESHNPTQGMRQGNDVGTQYRSGIYVYSEAQKQLAEASRDAYQQALSSAGYEKITTEILDAPEFYYAEAYHQQYLAKNPNGYCGLGGTNVACPVGVFESSANG

SEQ ID NO: 23835 - protein, 225 aa, Brassica napus
  misc_feature (175)..(175): Xaa can be any naturally occurring amino acid
  misc_feature (196)..(196): Xaa can be any naturally occurring amino acid
MDELSIIPLWKVIGAEKEEIQGLLKAVVQSVGWTYSVFWQLCPQRRKLMWSSGYYNGAIKTRKTTQPAEVTAEEAASERSQQLMELYETLFAGESSMEARACTALSPEDLTDPEWFYVLCFTYSFEPPSGMPGKAYARRKHIWLSGANEVDNKIFSRAISAKSAKIQTVVCIPVXDGVLELGTTNKVKESEELVEXHKSFFHNPPEVNTKPTLSEHFINEEHEED

SEQ ID NO: 23836 - protein, 973 aa, Sulfolobus tokodaii
MIVKLNGNEISLKESNITILDLLRENNIYISHICYNEGLVPIQSCDTCLVEVNGKLVRACSTKVTDGMSIVTHSERAVNARKKAVERILKYHKLYCTVCENNNGDCPLHEAVIKLGINSQQYIEKPYPIDDSGPFYVYNPSQCILCGRCVEACQDFAVNEVIWINWDLNPPRVVWDNGNPIGNSSCVNCGTCVTVCPVNALMEKSMLGEAGYFTWLNPEVKKKIIDSIGKVEDNFNLLMQISEIEAKARSSQIKKTKTVCIYCGVGCSFEVWTKGRKILKVEPKPESPANGILTCVKGKFGWDFVNSPERLTKPLIREGDHFREASWEEAINYIARRLKEIREKYGPDSIGFIASDKMTNEEAYLLQKLARAVIGTNNVDNSARYCQAPATIGLWRTVGIGGDSGTFKDIENADLIVIVGHNTTESHPVAGSKIKRAKKIRGAKLVVIDVRKHEIADWADLFIKPKPGTDAAVLAAVAKYIIDQGWEDKEFISKRVKGFEEFKESIKGFTLDYVESVTGVPRDQIIKLAEMIHSAKSVAILWGMGVTQHLGGGDTSTIISDLLLITGNYGKPGSGAFPMRGHNNVQGVSDFGCLPNYFPGYQKFDDVTFEKFEEAWRVKLNRKPGLQIPQMIEGVLEGKIHALYIVGEDTVMVDCGTPLTKKALEEVDFLVVQDMFLTETAKLADVVLPAAASLEKEGTFVNTERRIQRIYKAFDPLGESKPDWEIIQMIANALGANWNYSSPAEIMEEIRRLCPIFAGVTYDRLEGFKSLVWPVNEDGTDTPLLYVNAFATPDGKAMLYPLEWKPPQLQDDVHKITVNTGRVLEHFHVGNMTRRVEGLRRKVPETFIEISKELAQKYSIKTGDLILVKSKFGGEIKGRALVSERVQGDEIFIPLYASDPSKGVNNLTGNVIDKVTGTPAYKDTPVVIEKISEGNETPLPKDNWRFHINERKRQFGIEVEKKWKREEFKPLTD

SEQ ID NO: 23837 - protein, 386 aa, Pasteurella multocida
MINGKLASILCDKNKKIEKMKIDKTLVVKFGTSTLTQGSAKLNLPHMMDIVRQLAQLHQAGFRLVIVTSGAIAAGRHYLNHPQLPPTIASKQLLAAVGQSQLIQTWEKLFAIYDIHIGQILLTRADIEDRERFLNARDTLRALLDNQIIPVINENDAVATSEIKVGDNDNLSALVAILVQAEQLYLLTDQQGLFDRDPRKHPDAKLIADVDKITDHIRAIAGGSGTSLGTGGMSTKISAADVATRSGIETIIAPGNRPNVIVDLAYGQAIGTKFSVQADRLESRKQWLYAAPSAGIITIDAGAENAMLMQHKSLLPAGIVNVEGRFSRGEVVKIRTQQGKDVALGMPRYNSDALHLIQGKHSQDIEQVLGYEYGAVAVHRDDMIVL

SEQ ID NO: 23838 - protein, 100 aa, Neisseria meningitidis
LDDVREALTEIGITGMTVSEVKGFGRQKGHTEIYRGAEYAVDFLPKVKIELVLADDAVERAIDVIVEVARSGKIGDGKIFVLPVEEAIRIRTGERADAAV

SEQ ID NO: 23839 - protein, 203 aa, Triticum aestivum
MDPTKSSTPPPAPVLGAPVGYPPGAYPPPPGAPAAAYPPQLYAPPGAAAAQQAAAQQQQQLQVFWAEQYREIEATTDFKNHNLPLARIKKIMKADEDVRMIAAEAPVVFARACEMFILELTHRGWAHAEENKRRTLQKSDIAAAIARTEVFDFLVDIVPRDDAKDAEAAAAAAMATAAAGIPRPAAGVPATDPSMAYYYVPQQ

SEQ ID NO: 23840 - protein, 483 aa, Idiomarina baltica
MAINVVWFKRDLRLSDHEPLKAAISTGRPTLLWFNFEPWLVNDPHYDERHWRFIVESIRDINRKLKAYNTQIYVTYGDTVEQLQIWHQQFSIESLYSHQEVGLLNTFDRDKQVASWCRQHHVNWFESPTGAVQRGLNSRQQWQKHWYETMKAPLATPDLARIQPVKAVSVDYRTLPKSWFERRPSFQYGGPAAAWATLNSFLEQRGRAYHYSISQPIRAQHHCSRLSPYLAWGNLSLRECYQATVDKRRETGWKRPLNAFLSRLHWHCHFIQKFESETAMQHAPLNRAYENYPYRSDTQVEQHLKAWQQGKTGYPMVDAAMRCLLQTGYINFRMRALLVSFLCHYLHIHWQYATTHLAALFLDFEPGIHYPQIQMQAGIIGTNTIRMYNPEKQAIEKDPTGAYIDQWVPELAELPLEIKHAPYRITPMEAQMYGFKLGEDYPSPIVDVDDYRPIARDTLYRIKKSVAGTKEAQRILKRHVVSR

SEQ ID NO: 23841 - protein, 372 aa, Zea mays
RGALRRTFSCLGDPDPPPRDRSSRMHGPYPTAAAAAASSSDDMAANGMKVALHRQVSGGSMKQNAELRRQASLESPRTGRATSRFLFGRQSSMDPNRRRGRSQSPVRAPEDLGVPDNLDATMQLLFFACQGDALGIEGLLRSGVDVNSINLDGRTALHIAACEGHRDVVRVLISWKANIDARDRWGSTAVADAKFYGHSRVYDLLKFHGAKVPRTKRTPMMVSAPAEIPEYELNPGEVQFRRGCDVTPGVYHIAKWNGTKVSVKILDRDGCSDQEAANSFRHELTVLEKVRHPNVVQFVGAVTQSIPMMIVSELHEEKDLSVCIQKKGKLKPQKVLRYGLDIARGMTYLHQCKPDPIIHCDLKPKCQTYLPG

SEQ ID NO: 23842 - protein, 421 aa, Pseudomonas syringae
MTESVLDYMTRLGRAAREASRVIGRASTAQKNRALQATAAALDEARAELSAANALDLANGQANGLEPAMLERLALTPARIDSMIVGLRQVAGLADPVGAIRDMSYRPSGIQVGKMRVPLGVVGIIYESRPNVTIDAASLCLKSGNATILRGGSEAIHSNRAIAACIERGLAEARLPAAVVQVVETTDRAAVGALITMPEYVDVIVPRGGKGLIERVSRDARVPVIKHLDGICHVYVSAHADLAKAQKIAFNAKTYRYGICGAMETLLVDQTIAADFLPAMAAQFREKGVELRGCERTRDLIDVIPATEDDWHTEYLAAILSIRVVSGLDEAIEHINHYGSHHSDAIVSDHQSQIRRFMAEVDSSSVMVNAPTSFADGFEYGLGAEIGISTDKLHARGPVGLEGLTCEKYIVIGDGQLRGQA

SEQ ID NO: 23843 - protein, 101 aa, Neisseria meningitidis
KLDDVREALTEIGITGMTVSEVKGFGRQKGHTEIYRGAEYAVDFLPKVKIELVLADDAVERAIDVIVEVARSGKIGDGKIFVLPVEEAIRIRTGERSDAAV

SEQ ID NO: 23844 - protein, 98 aa, Neisseria meningitidis
DVREALTEIGITGMTVSEVKGFGRQKGHTEIYRGAEYAVDFLPKVKIELVLADDAVERAIDVIVEVARSGKIGDGKIFVLPVEEAIRIRTGERADAAV

SEQ ID NO: 23845 - protein, 599 aa, Clostridium perfringens
MLYPIITESRQLIDLSGIWKFKLNEGNGLTEELSKAPLEDTIEMAVPSSYNDLVESQEVRDHVGWVWYERNFTIPKTLLNERIVLRFGSATHEAKVYLNGELLVEHKGGFTPFEAEINDLLVSGDNRLTVAVNNIIDETTLPVGLVKEVEVDGKKVIKNSVNFDFFNYAGIHRPVKIYTTPKSYIEDITIVTDFKENNGYVNYEVQAVGKCNIKVTIIDEENNIVAEGEGKEGKLTINNVHLWEPMNAYLYKLKVELLDDEEIIDTYFEEFGVRTVEVKDGKFLINNKPFYFKGFGKHEDSYVNGRGINEAINIKDFNLMKWIGANSFRTSHYPYSEEIMRLADREGIVVIDETPAVGLHLNFMATGFGGDAPKRDTWKEIGTKEAHERILRELVSRDKNHPCVVMWSVANEPDSDSEGAKEYFEPLIKLTKELDPQKRPVTVVTYLMSTPDRCKVGDIVDVLCLNRYYGWYVAGGDLEEAKRMLEDELKGWEERCPKTPIMFTEYGADTVAGLHDTVPVMFTEEYQVEYYKANHEVMDKCKNFVGEQVWNFADFATSQGIIRVQGNKKGIFTRERKPKMIAHSLRERWTNIPEFGYKK

SEQ ID NO: 23846 - protein, 99 aa, Neisseria meningitidis
DDVREALTEIGITGMTVSEVKGFGRQKGHTEIYRGAEYAVDFLPKVKIELVLADDAVERAIDVIVEVARSGKIGDGKIFVLPVEEAIRIRTGERSDAAV

SEQ ID NO: 23847 - protein, 159 aa, Castanea sativa
DQIKVSTAVDTNLLDVFDPPSAGAFSDNARPFIEPIISFLVSNGAPLLANIYPYFRVRYNNQPVPYALFTATEVVVHDGQLEYRNLFDALMDALYSALEKRNGGSLKIVVSESGWPSAGGDVETIENAGTYYRNLINHVKGGAPKRPAKAIEAYLFAMF

SEQ ID NO: 23848 - protein, 498 aa, Oryza sativa
MDVLDHAPPSPLSSDILPHFPPSLADAGAGALDLSFTSTASASTSSFTTATTFSARSSLSLPSFSSSTSLSPRPHSSSSSPHWALLAAERAATPDGVLRLAHLHLIRELGHGHLARVFLCRLKSSPPASPLFALKVVDLRDDDPSRVTHVLAESRVLSSLDHPFVPTLYARLDAGRYACFLMDYCSGGDLHAVLRRRPGGLLPVAAARFYAAEVLLALEYLHALGFVYRDLKPENVLLRGDGHVVLSDFDLALPASVEPAVRRRQVRKLSRRKNRIVPSCFSANGGSGDDGDEVNAKEQFEFVAEPTTANSKDCVGTHEYLAPELVSGSGHGNGVDWWAFGVFLYELVYGRTPFKGHAKDATLKNILAKQVTYPQLDGEADAAQLRDLIGRLLERDPRRRMGSARGAAEIKRHPFFAGVDWALIRCVAPPVVPDKDSAAAGAGDKKAKLGSWNSMGGKKRSSFGRKSNYEERQGVFRKLMSWSQESRSKKAKTNKVKL

SEQ ID NO: 23849 - protein, 450 aa, Enterococcus faecalis
MNGETNVEQIQIIDSNKHVGETVKIGAWIANKRSSGKIAFLQLRDGTAFFQGVVFKPNFIEAFGEEAGTEKFQEIKHLSQETAVMVTGVIKEDSRSKFGYEMDITDLEVVGASEDYPITPKEHGTDFLMDHRHLWLRSSKQHAIMLVRNEIIRATYEFFNEQGFIKIDSPILTGSAPEGTTELFETDYFGQPAFLSQTGQLYAEAGAMAFGKVFTFGPTFRAEKSKTRRHLTEFWMIEPEMAYTTHEESLDIQEAYVKHLIKSVLKNQQYPLDVLERDTALLEKYVSEPFKRITYDDAIELLQKEEANNDYDHIEWGEDFGSPHETFISNYYGVPTFILNYPKAIKAFYMKPHPTREDVVICADLIAPEGYGEIIGGSERATDYDYLKEKVAEFGLSEEEYSWYLDLRKYGSVPHSGFGLGLERAVTFITGNEHIREAIPFPRMLNRIYP

SEQ ID NO: 23850 - protein, 296 aa, Exiguobacterium sibiricum
MSKVMLIINPSSGKELGKKHAELAEGTLAQRFTEVDVRFTEKELDATEFATQASLGHYDAVVAMGGDGTVNEVITGIAEQAHRPTLGIVPLGTVNDLARALHIPTDPEEAISILEDAPSRPLDIGKYDDHYFMNVIAVGLIAEAVEEVSVEQKTSLGSVAYFIEGLKAFKDHSPYPIRLTAEEESFDGETPLLIISLTNSVGGFESFAKDARVDDGLLHVFIVKQLGFFDALQALPKLLTGKISDADQVEYFTTKEVHVDSKERLPINADGDTAGHLPVTVQVLSQHLTVFAPVSK

SEQ ID NO: 23851 - protein, 232 aa, Brassica oleracea
MASSSYAPFSAVFSGFAATKPNPPPTCSAFLVPKRRSNSRNLKNGVSLKSWNKHGFQFKSRNLSVYARATEEKTVHDFTVKDISGKDVSLDKFKGKPLLIVNVASKCGLTSSNYTELSQLYDKYRNQGFEILAFPCNQFGGQEPESNPDIKRFVCTRFKAEFPIFDKVDVNGPSTAPIYQFLKSKSGRFLGDLIKWNFEKFLVDKKGNVVQRYPPTTPPLQIEKDIQKLLVA

SEQ ID NO: 23852 - protein, 213 aa, Xylella fastidiosa
MSHSKSSQRWLKEHFSDPFVKKAQAEGMRSRAAYKLEEILKRDRILRPNMVVVDLGAAPGGWSQQIRKQMGDSGRVIALDIVKMAPLVGIEFLQGDFRDKAVLSQLEIMLKGQPVDLVLSDMAPNKSGIDVMDQPRMMYLAELAMDFADIHVKPGGSFLIKLFHGVGSDGYIRQLRHRYKKVAIRKPLASRKRSPEVYILGDGKLTQNEVSCS

SEQ ID NO: 23853 - protein, 400 aa, Xanthomonas campestris
MTPAFPLLADLRGRAVLVVGGGADAERATAQLLQAGALPLVGAPELTAQLRHWAQAGQLRWLAGRFDPAWLAQPDQPLWLTIAASESEALNDALRHAASARRLLTHIATPAASATAPARSPAPRSPIGTLAPGNVSLVGAGPGDPGLLTRHALRALRQAEVVLHDRLVSPQILRLARHGAHLIEVGKSAQGHSTRQEQIHALMLDHARAGRRVVRLKGGDPFVFGRGGEELEFLRAHGIGFQVIPGITAAIACAAYAGIPLTHRDHAQSLRLITAHCKDSLDTLDWQALGQERQTLAFYMGVAGLDIIQQRLLQAGRAASTPFALVENGSRPQQRVITGTLASLAASARQHAVTAPALLILGEVATLAQTLHWFGSAPLSALPPYSPGATPHTPTLAHAA

SEQ ID NO: 23854 - protein, 160 aa, Pseudomonas aeruginosa
MSAFHDLTLLGLDGQDLPLSPFKGKVLLVVNVASKCGLTPQYAGLENLYQTYRERGFAVLGVPCNQFAGQEPGSEADIQSFCSLNYGVSFPMSAKVEVNGSARHPLYRLLAGEGAEFPGDITWNFEKFLLGPDGRVLARFSPRTAPDDPALVQAIEKALG

SEQ ID NO: 23855 - protein, 915 aa, Unknown
  Petunia x hybrida
MAASVENRQFSHLEPGLSGVVRSFKPRSDSPVRGCNFPLNNELTNFQKKPNTTIYLDCSSSEDDDDDDDKNEYLQMIRKGKLEVEPSVHDIRDEGTADNWIERNNSMIRLTGKHPFNSEPPLARLMHHGFITPVPLHYVRNHGPVPKGMWDDWTVEVTGLVKRPMKFTMEQLVNEFPSRELPVTLVCAGNRRKEQNMVKQTIGFNWGAAAVSTTVWRGVPLRAILKRCGIYSRTKGALNICFEGADVLPGGGGSKYGTSIKKEFAMDPSRDIIIAYMQNGEKLTPDHGFPLRMIIPGFIGGRMVKWLKRIIVTTQESESYYHYKDNRVLPPHVDAELANAEAWWYKPEYIINELNINSVITTPCHEEILPINSWTTQRPYTLRGYSYSGGGKKVTRVEVTMDGGETWNVCTVDHPEKPNKYGKYWCWCFWSLEVEVLDLLSAKEIAVRAWDETLNTQPEKLIWNVMLCCNVQGMMNNCWFRVKTNVCKPHKGEIGIVFEHPTQPGNLSGGWMAKERHLEISAEAPPTLKKSISTPFMNTASKMYSMSEVKKHNSADSAWIIVHGHVYDATRFLKDHPGGIDSILINAGTDCTEEFDAIHSDKAKKLLEDFRIGELITTGYTSDSSPNNSVHGSSSFSGFLAPIKELAPAVRSVALIPREKIPCKLVDKKSISHDVRKFRFALPSEDQVLGLPVGKHIFLCAIIDDKLCMRAYTPTSTVDEVGYFELVVKIYFKGIVPKFPNGGQMSQYLDSLPLGAFVDVKGPLGHIEYQGRGNFLVHGKRKFAKKLAMLAGGTGITPVYQVMQAILKDPEDETEMHVVYANRTEDDILLKDELDSWAVKLPERVKVWYVVQDSIKEGWKYSTGFITEAVLREHIPLPSQTTLALACGPPPMIQFAVNPNLEKMGYDIKDSLLVF

SEQ ID NO: 23856 - protein, 402 aa, Mycobacterium smegmatis
MTEDAYLVGLRLSGKKVVVVGGGTVAQRRLPLLLANGADVHVITRAATPVVEALQKDDPGITLELRDFRPGDLEGAWYVIAATDDPVVNAAIAAEADERRIFCVRADIAREGSAVTPATFEHDGLSVGVLAGGEHRRSAAIRSAIHEALQQGLVTEDMPGELTSGVALVGGGPGDPELITVRGRRLLARADVVVADRLAPQELLAELGPHVEVIDAAKIPYGRAMAQEAINAVLIERARAGKFVVRLKGGDPFVFARGYEEVLACSEAGIPVTVVPGVTSAIAVPALAGVPVTHRGMTHEFVVVSGHVAPGHPESLVNWDALAAMRGTIVLLMAVERIEQFAKVLLEGGRPADTPVLVVQHGTTMAQRTLHATLADAPERIRSEGIRPPAIIVIGPVAGFAG

SEQ ID NO: 23857 - protein, 319 aa, Xanthomonas campestris
MALYDNILDTIGRTPVVKLQRLAPDNVTLYVKVESFNPGGSVKDRLALAIILDAEQRGLLKPGDTIVEATSGNTGVALAMVAAARGYKFVATMVETFSIERRKLMRAYGAKVILTPAAERGSGMVRKAKELAEQHGWFLASQFANPANPAYHRNTTAAEILRDFAGHRLDHFVTGWGTGGTLTGVGEVLRVARPEVRITASEPAGAALLQGQDWKPHKIQGWTPDFVPEVLNREAAHQVLSVEDTDAITVARRLAAEEGIFTGISGGATVATALRVAEGAASGAVILAMLPDTGERYFSTPLFADINEGSDDDWLAGLP

SEQ ID NO: 23858 - protein, 724 aa, Bacillus anthracis
MYMEMVDNRQALMKMLVKELGFTEKQVRHVIQLTEEGNTVPFIARYRKEWTGSLDEVQIRTILERWQYIMQLEDRKEEVLRLIDEKGKLTGELRQQILKATKLQEVEDLYRPYKEKRRTKATIAKEKGLEPLAEWLLLYTKEDPNQKAMEFINAEKEVQSAEEALQGAQDIIAEIVSDEAAYRSWIRNVTFRKGVMSSVVKDEEKDEKNIYEMYYDYEEPLQKVVPHRVLAMNRGEKEDILRVSVVPPVDEIVTFLYKKVIRDNDSKSAQYVKLAIEDGYKRLIQSSIEREIRKELTETAEEQAIHIFSENLRNLLLQPPMKGKVVLAVDPAYRTGCKLAIVDDTGKVLYIDVIYPHPPVRKYEDAKAKVLSIIDKYQVEMIAIGNGTASRESEEFIVDVLQNVKREVFYIIVNEAGASVYSASDLAREEFPDLQVEERSAVSIGRRLQDPLAELVKIDPKSVGVGQYQHDVSQKRLNESLTFVVETAVNQVGVNVNTASVALLQYVSGLSKTVAKNIVAKREEEGKFTKRTDLKKIPRLGAKTYEQCIGFLRILEGANPLDRTGIHPEQYKNVELLLKSLGLSKDDVGQPQLQKSLEEVEISKLSEETGIGEPTLVDIIDALISPERDMRDELPKPLLKKGILKLEDLKRGMELEGTVRNVVDFGAFVDVGVKQDGLVHISKLSKQYVKHPLDVVSVGQIVKVWVDDIDTKKGRVALSMLPIE

SEQ ID NO: 23859 - protein, 339 aa, Corynebacterium efficiens
MMDEMTGDGMRSEHEAIIIGGGQSGLATAYYLLRAGVDTLVLDDQPAPGGAWLHVWPSMTLFSTAEFSNLPGWPMPLYDGFPPAQHVVDYLTAYEQRYKIPVERPVRVDRIEHEEGIFRVRAGNKVWSAQNVVAATGTWSAPFVPNYPGTFRGTHWHSANYPGIEPFRGTRVAVVGGANSGAQIAAELTRVAEVTWYTRRPPRWMPDEVDGRVLFRRNRLRALAIQRGEPDPGADSDLGDIVALPEVRDARDTGRLQATPMFTSLDEVDADHLIWCTGFRPALGPVRRLLDGTTPRYSALHLVGYGDWTGPGAATITGVGPYAKQAAREIAESVGKVVK

SEQ ID NO: 23860 - protein, 350 aa, Unknown
  Rhodococcus sp. RHA1
MTTVETPRSSRSVVVTVAAVVEETSDARSLVFDVPDERRHEFAYKPGQFLTLRIPSDRTGSVARCYSLASSPFTDDLPKVTIKRVAGGYGSHWLCDNVGVGDRIEVLPPAGVFTPASLDEDLILFAAGSGITPVMSILKSALSVGNGKVVLVYANRDEKSVIFADELRELAARHEHRLTVVHWLESVQGLPTPRQLANLSDRFRDHRAYLCGPRPFMDAIHESLALAGVPRDRVHAEVFTSLSGDPFADVVVEELPDTEAGTSTVEVQLDGEAHNLSWPRRATLVDVMLSKGLDVPYSCREGECGSCACTVVQGEVDMDNASILDPEDIASGYILACQARPVSEHVRIEF

SEQ ID NO: 23861 - protein, 271 aa, Unknown
  Nostoc sp. PCC 7120
MKSYLAAAIQMTSVPDLHKNLAQAEELIDLAVRRGAELVGLPENFSFMGEEQDKLAQAEAIARESEIFIKTMAQRYQVTLLGGSFPVPVSDTGRVYNTTILISPSGEELARYNKVHLFDVNVPDGNTYRESSTVVAGQQLPPVHFSEYLGNIGVSICYDVRFPELYRHLSDKGTDIIFIPAAFTAFTGKDHWQVLLQARAIENTAYVIAPAQTGNNYGRRLTHGHAVVIDPWGTILADAGDKPGIAIAEINPSRLEQVRRQMPSLQHRVFS

SEQ ID NO: 23862 - protein, 540 aa, Shewanella oneidensis
MSELTWWRGAVIYQIYPRSLLDTNGDGVGDLRGIITKLDYIASLNVDAIWISPFFKSPMADFGYDISDYREIDPLFGSMQDFDELIEKAHQRGIKVIIDQVLSHTSDQHAWFIESRESRTNPKADWYVWADPREDGTPPNNWLAIFGGCAWEWEPRRQQYYLHNFLRSQPDINFHNPDVRQAVLDNVEFWLKKGVDGFRLDAITFCFHDELLRDNPAKPKEKRQGRGFSEDNPYAYQYHYYNNDRPQTIQFIEALRQLINRYPGTVTLGEVSAEDSLAVMAAYTKGDDRLHMAYSFELLTDDYSAAYIRQTVEALENSIGDGWPCWAIGNHDVQRVASRWGRGKQTSDMAKMLNAMLCSLRGSVCSYQGEELGLTEVPIEFHELQDPFGKTFWPMFKGRDGCRTPMPWEQYADFSGFSQVSPWLPIAAAHRALAVDLQEADCHSVLHGYRQFLAWRKCYPALITSEIEFLDAPEPLLVFVRKLGEQKLLVCFNLLDAETQLSLTGLKLQQELAGHGLKTAHRQGDSLIFSAYASFYALLA

SEQ ID NO: 23863 - protein, 469 aa, Thermoanaerobacter tengcongensis
MNEIGLIGLAVMGQNLALNIARKGYSVSVFNRTSEKTKEFLEERVKNEKIEGYHDIKSFVESLKKPRKIILMVKAGKPVDDVIQELLPYLEKGDLIIDGGNSYFKDTSRRIKELKEKGILYLGMGVSGGEAGALHGPSLMPGGSIEAYEMVKDVLLKIAAQTESGPCCTYVGNDSAGHFVKMVHNGIEYAIMQAISEVYDIMRKILKFSPEEIGDVFERWNNGELNSFLMEISFKIMRYKDEETGKHLVDLILDEAEQKGTGKWTSQTALDLGIPTPSLSLAVEARSLSFFKEDRVKLSGKVKKTYPDVKLDKEKVIKDLENALLFSVFTSFSQGLWLIHEASKTFEYNIDLPEVLRIWKGGCIIRAKILDFLREILNENKENVNLLDSDKSISFLMDKLDSIRYVTNLAKEFYIPTLVLSSSLDYFLSMVEGNLPANLIQAQRDFFGAHTYRRIDKEGIFHTEWEPID

SEQ ID NO: 23864 - protein, 399 aa, Arabidopsis thaliana
MSSTSRSSAANNRKDPPRKKNKQTPSPVTREPTSIDSLPNDLLLNCFARVSRMYYPALSRVSKRFRSIVTSPEIYNTRSLLNRTEKCLYLCLRFPFDNNTHWFTLYQNPNQTVSDKVFLQIPSPQHPLTLSSNLVAVGSNIYRIGGTVGDDSCPLGFDREPSSKVSILDCRSHTWRDGPRMRLNRRSSTTSVVDGKIYVTGGTEDTDNPSHWIEVFDPKIQSWGTVTNPHIVKVWEEVCYRRAVKSIGHDGKLYLSGDKYVVYDPDEGKWNSVEEHWLIGYAIGSSNCVVDNILFYWDQGVFKWYDSKVSSWKQLKGLEGLPDDFSQREYCKLVDLGGKMAVLWDKWEYSGVCMIFCAEISLEKRDGDEIWGKVEWFDTVLEVGASCSLKSADALSASV

SEQ ID NO: 23865 - protein, 280 aa, Unknown
  Synechococcus sp. WH 8102
MGGWIDEEHRGVRYGLAGDVLVEETSPFQRISVIRSERYGKGLLLDGCWMTAEQQERHYHEALVHPALCSAEAIERVLVIGGGDGGTARECLRYPEVIHLDLVEIDGRVVELSQEHLPGIGGAVWSDSRCQLTVGDGIAWAANAPDQSYDVVLVDGSDPAGPAEGLFNRAFFEHCRRILKPGGVFATQSESPEAFREVHVAMVRLLREVFGHADPLYGWVPMYPSGWWSWTFAAVDGPRYRTVQPARAALVAEGCEIWSPRWQQGALDAVPAFIARELAP

SEQ ID NO: 23866 - protein, 81 aa, Gibberella zeae
MRDNIQGITKPAIRRLARRGGVKRISAMIYEETRGVLKTFLEGVIRDAVTYTEHAKRKTVTSLDVVYALKRQGRTLYGFGG

SEQ ID NO: 23867 - protein, 391 aa, Unknown
  Halobacterium sp. NRC-1
MSEDFYDVLGVSRDATEDEIMQAYRDQVSEYHPDVSDDPDAEEKFKKIQKAKDVLTDEETRQQYDQLGHERFEEAEKRGATGNGGGGAGGMGGAGGPFGGGMGGGAGGGMGDIFEQFFGGAGGGGGRGRSGPEQGRDLRTDLTVTLSEAYRGVSKQVTVRRPESCADCGGSGYPEDADVRTCPQCDGQGVVTQVRQTPLGRVQQRQECSRCGGEGELHSETCSTCGGQGQTRERATLTVDIPEGIRTGQTLRMDGEGAPGEPGAPNGDLLVDVTVEEHPDFERDGDDLHHRHAVSFPQAVFGAEIEVPTLDGAATFDLDAGTQSGETFRLKGKGMPRLRRRGNGDLYVTVQVVTPESLSDEQRDALEQFAEAGGEEIDVEQGFFEKLKNSF

SEQ ID NO: 23868 - protein, 177 aa, Picrophilus torridus
MEDVCYLAGGCFWCMEAVFKDIYGINDVQPGYAGGTTVNPTYEEVCSQRTGHAETVRIRYDPEKISFDDILEIYFSVIDPTTLNRQGEDVGTNYRTAIFYINEYQKERAVNYIKNLEASGKYSKIVVSVEPYKNFYPAEDYHKNYFERHPEQGYCRVVIKPKVEKVRQKFFYKINNQ

SEQ ID NO: 23869 - protein, 144 aa, Gibberella zeae
MARTKQTARKSTGGKAPRKQLASKAASSLTSSSARKSAPSTGGVKKPHRYKPGTVALREIRRYQKSTELLIRKLPFQRLVREIAQDFKSDLRFQSSAIGALQESVESYLVSLFEDTNLCAIHAKRVTIQSKDIQLARRLRGERN

SEQ ID NO: 23870 - protein, 230 aa, Brassica napus
  misc_feature (152)..(152): Xaa can be any naturally occurring amino acid
  misc_feature (207)..(207): Xaa can be any naturally occurring amino acid
MDQQEHGQSGAMNYGTNPYQTNPMTTTAAGSVGPAAPQGQLAFHQIHQQQQQQQLTQQLQVFWENQFKEIEKTTDFKNHSLPLARIKKIMKADEDVRMISAEAPVVFARACEMFILELTLRSWNHTEENKRRTLQKNDIAAAVTRTDIFDFXLVDIVPREDLRDEVLGRGTAPEAAAAGYPYGYLPPGTGPIGNPGMVMGNPGGAYXPNPYMGQPMWQQQQGPDQTDPEN

SEQ ID NO: 23871 - protein, 297 aa, Magnetospirillum magnetotacticum
CAIRQDATPKLRTSRTRIREGSPHPRGATWDGRGVNFALFSAHATKVELCLFDDAGEKEIERIALPEYTDEVWHGYLPDARPGTIYGYRVHGPYEPEAGHRFNPNKLLIDPYAKGLVGTIEWNPALFGYKMETGDDLTFDERDSAPYTRRSRVIDPAFTWGRDAKPRVPWERTIVYETHVKGFTKLHPAVPEKLRGTYAGMGHPAVLDYIKSLGVTSVELLPVHSFVQDDYLQQKGLINYWGYNTISFFTPARRYAAVPDFAFSEFKEMVARMHGAGLEVILDVVYNHTAEGNEGDP

SEQ ID NO: 23872 - protein, 423 aa, Burkholderia thailandensis
MDIDQYMTDVGRRARRASRSIARASTAAKNAALEAVARAIERDAGALKAANARDVARAKDKGLDAAFVDRLTLSDKALKTMVEGLRQVATLPDPIGEMSNLKYRPSGIQVGQMRVPLGVIGIIYESRPNVTIDAAALCLKSGNATILRGGSEALESNTALAKLIGEGLAEAGLPQDTVQVVETADRAAVGRLITMTEYVDVIVPRGGKSLIERLINEARVPMIKHLDGICHVYVDDRASVTKALTVCDNAKTHRYGTCNTMETLLVARGIAPAVLSPLGRLYREKGVELRVDADARAVLEAAGVGPLVDATDEDWRTEYLAPVLAIKIVDGIDAAIEHINEYGSHHTDAIVTEDHDRAMRFLREVDSASVMVNASTRFADGFEFGLGAEIGISNDKLHARGPVGLEGLTSLKYVVLGHGEGRQ

SEQ ID NO: 23873 - protein, 378 aa, Sulfolobus tokodaii
MVTSDKYYPYDRPPLSKEYLRGKIDRNSIFFEQPNYYTKRENIRIILNTSVEKINVKEKGVELSNGTIIHFDKALIATGGRPRKLKLPGEELEGIHYLRTLDDCDSLKQENGKEAVIIGGGFIGIEVASSLTMLGVKTTVIEVKPYIWNTFVDEKISRLIQNYFEKHGVNFILNEGVKEFIGDKRVSRVITEGGKTLNVDFALIAVGIVPNIEIAQKSGIEVDNGIIANEYLETSAKDIYVAGDVANIYDPSIGKRRRIEHWNNAEYTGKLAAKNMLGKREKYNFLSTIWSDIFDLHIESGGDTTDYDEYIIRGNFSVDNPNFNVIYLKGGVIKGYVAINRDYEELSALNKLIVSKVDVSNKKNELKDEKYDLSKLSL

SEQ ID NO: 23874 - protein, 503 aa, Triticum aestivum
RASPPSESRAPLRAPQRSATRQHQARQGPRRMCNGGRGPPYWTAGVTSAPARQTPLFSGRPSGGLSDPNEVAAVILGGGTGTQLFPLTSTRATPAVPIGGCYRLIDIPMSNCFNSGINKIFVMTQFNSASLNRHIHRTYLGGGINFTDGSVEVLAATQMPGEAAGWFRGTADAWRKIIWVLEDYYKNKSIEHILILSGDQLYRMDYMELVQKHVDDNADITLSCAPVGESRASEYGLVKFDSSGRVVQFSEKPKGDDLEAMKVDTSFLNFAIDDPAKYPYIAGMGVYVFKRDVLLNLLKSRYAELHDFGSEILPRALHDHNVQAYVFTDYWEDIGTIRSFFDANMALCEQPPKFEFYDPKTPFFTSPRYLPPTKSDKCRIKEAIISHGCFLRECKIEHSIIGVRSRLNSGSELKNAMMMGADSYETEDEISRLMSEGKVPIGVGENTKISNCIIDMNARIGRDVVISNKEGVQEADRPEEGYYIRSGIVVIQKNATIKDGTVV

SEQ ID NO: 23875 - protein, 259 aa, Bacillus cereus
MKVACIQMDIVFGDVEKNIENAKNKISEAMKERPDVIVLPELWTTGYDLTRLSEIADRDGLETKEKLIEWSKQYGVHIVGGSIAKQTEQGVTNTMYVVTNKGELVHEYSKVHLFQLMDEHKYLIAGNRTGEFKLDDVECAGTICYDIRFPEWMRVHTAKGAKVLFVVAEWPLVRLAHWRLLLQARAVENQCYVVACNRAGKDPNNEFAGHSLIVDPWGEVVVEANEEEAILFGELTFEKIKEVRKGIPVFADRRPELYK

SEQ ID NO: 23876 - protein, 428 aa, Geobacter metallireducens
MKLLFVSPGWPRGRLWGELGFKFPSLSLAALAAVTPESWDVALCDENIEPLDLNSDADLVAITAMTPQAPQAYRIAAAFRARGKRVVMGGFHASNLPEEALQHVDAVVVGEGEVVWPQLLADLERGELQRIYRAATALAMEAIPVARRELFQGKRYLFTNTLQTTRGCPFDCEFCSVTAFYGRRYRKRPVDNVLAELELLRRRNSFAFFVDDNLVADRTYALSLFAGMKGMGFKWLSHAPIDFAHDREFLRAAGEAGCVGMFVGFESLNQDALAAMGKVTNTARSYLEDAQAFRDNGIGILGSFVLGCDNDTPAVFEGLLRFCEEARLEAAIFPILTPYPGTEVRRRLEAEGRIISSDWQDYDMEHVTFLPRGMSVDELQQGYDWLNRSFYSLPSMYRRIFKAHRSVQVFAPMNFGFRSAIRRKGRVA

SEQ ID NO: 23877 - protein, 343 aa, Arabidopsis thaliana
MANPAPNLECRMYESRYPDVDMAVMIQVKTIADMGAYVSLLEYNNIEGMILFSELSRRRIGSISSLIKVGRTEPVMVLRVDRERGYIDLSKRRVSDEDKEACEERYNKSKLVHSIMRHVAETVGVDLEELYVNIGWPLYKKHGHAFEAFKIVVTDPDSVFDALTREVKETGPDGVEVTKVVPAVSEELKDAFLKDIRRRMTPQPMKIRADIELKCFQFDGVLHIKEAMKKAEAVGTDDCPVKIKLVAPPLYVLTTHTHYKEKGIVTLNKAIEACITAIEEHKGKLVVKEGARAVSERDDKLLAEHMAKLRMDNEEMSGDEGSEDEEDTGMGEVDIDGGSGIIE

SEQ ID NO: 23878 - protein, 99 aa, Neisseria meningitidis
DDVREALTEIGITGMTVSEVKGFGRQKGHTEIYRGAEYAVDFLPKIKIELVLADDAVERAIDVIVEVARSGKIGDGKIFVLPVEEAIRIRTGERSDAAV

SEQ ID NO: 23879 - protein, 329 aa, Rhizobium leguminosarum
MMARTGMHMTKKGFSFQGPADGVHALKSWITPEDDLFLVTHMGFLEIDPEHWHLDVDGLVGNPTRLHLSDLQAMPQREYMSFHECAGSPLAPTVAKRRIGNVVWKGVPLSLVLERAKISTDASYVWTSGLEWGEYAEIEEAYQKDLPIEKALAEEVLLALEINGRPLTPERGGPVRLVVPGWYGTNSVKWVGSITAANRRASGAYTTRFYNDPTASGTKPVWDVTPESVIVSPSPNDLLSADMPTKIWGWAWGDCQISSVEVSVDGGGSWRTASVGPREGRSWQRFELTWSPEPGPHVLLCRCKNELGEEQPVSDARNAVHSVQVQVDF

SEQ ID NO: 23880 - protein, 545 aa, Unknown
  Bradyrhizobium sp. BTAi1
MPALAHVLLAALRDHGAREIFGIPGDFVLPLFKVIEESRILPAVTLSHEPAVGFAADAAARYHGGLGVAVVTYGAGAFNLVNSVAGAYAERSPVVVIAGAPGARERVSGFLLHHQARTVDTQLAVFKEITCDQAVLSDPATAPAQIARVLRSAKEMSLPVYLEFPRDMVDVEAEPVVPLPPRRADQDALGECVEEILGRIARAERPVIVVDVEIRRYGVEARIAALARKLGLPLVTTFMGRGLLDQADDVVAGTYLGAAGNPAITALVEDADLVLMLGVILSDTNFALSNRAPDPRRMILAASCEVQIGHHVYRDMPLGDLIDALDDRATPRAAPADRVRQRSAYPRGLVADSNPIAPSDIATAINDMFDRHGRMPMTADIGDCLFTAMEIDNTALAAPGYYAGMGFGVPAGIGVAATGLRPLILVGDGAFQMTGWELGNCRRYGLDPIVVLFNNCSWEMLRVFQPESRFNDLDDWHYADIAKSIGGVGERVTTRAELVAALERAVERRGQFSLVEVMLPRGKTSDTLARFVAGFKSARERMAGG

SEQ ID NO: 23881 - protein, 671 aa, Gibberella zeae
MCGISAFITHPGHSRSPVLNGDAKQVVEELETSLDLIAHRGPDARGRWFSDNHHVGLGHVRLSIIDLSPSGNQPFHDEQGGIHAVVNGELYDYERYKAQLADEFKFVGNSDCEIVIALYKHYGLSFISHLRGEFAFVLWDENRQQLIAARDRYGIKSLYYTVHQNKLLVATEIKSFLAFGLEPEWCVRSLRDQSWRVDSTTFFEGVYKVRPGHYLICRPNEREEQHPYWDLEYPDKFAKDLRSEDEITEGVRERLLEAVRIRLKADVPVAVYLSGGIDSSSVAGMVSHLIKQGTKLGNETSLLPSSMKCYTVQFDEGSGADESAIARRTADFLGVDIHLVKMDEEALVSRFEDTTWYSEVPLPDLNGMGRLALAEAVHAQGIKAVITGEGSDEHFGGYDAFRADSLSEPDHSWPAMMTDTERQEAHALASKEAQYGIFGDFTPKVPISTKRMFYSNHVASSIARVGSLPFSDWTKVYGNSIPETTMIEGFDGRVRDNILKRWHPVHTAQYMFVKTFMPHFILRYNGDNIDMVHQVESRCPFLDHHLTEYVNNVPPSLKMRYNAKDKSWREKHILREAVKPFVTDEVYNMSKKAYMGPRKFWPGGPLHKKISELVTKANVENLGFVDWQATQDAMDGAFNKQEGLALRRIITVAQFVVLGQRFGVKRASGRR

SEQ ID NO: 23882 - protein, 99 aa, Neisseria meningitidis
DDVREALTEIGITGMTVSEVKGFGRQKGHTEIYRGAEYAVDFLPKVKIELVLADDAVERAIDVIVEVARSGKIGDGKIFVLPVEEAIRIRTGERADAAV

SEQ ID NO: 23883 - protein, 266 aa, Zea mays
  misc_feature (194)..(194): Xaa can be any naturally occurring amino acid
MIKPVLTAYSKDDAETLKNYCTKEVIERRIPSFIRRRRLLSAAVAMGRRPARCYRQIKNKPYPKSRYCRGVPDPKIRIYDVGMKRKGVDEFPYCVHLVSWEKENVSSEALEAARIACNKYMTKSAGKDAFHLRVRVHPFHVLRINKMLSCAGADRLQTGMRGAFGKPQGTCARVDIGQVLLSVRCKDNNAAHAXSEALRRAKFKFPGRQKIIESRKWGFTKFSRADYLKYKSEGRIVPDGVNAKLLGNHGRLEKRAPGKAFLEAVA

SEQ ID NO: 23884 - protein, 112 aa, Unknown
  Bradyrhizobium sp. BTAi1
MKKIEAIIKPFKLDEVKEALQEVGLQGITVTEAKGFGRQKGHAELYRGAEYIVDFLPKVKIEIVIGDDLVERAIEAIRRAAQTGRIGDGKIFVSNIEEAIRIRTGESGLDAI

SEQ ID NO: 23885 - protein, 556 aa, Emericella nidulans
MLEDPSYAEIVRWGDDGDSFVVLECEKFTKTILPKHFKHSNFASFVRQLNKYDFHKVRQNNEENGQSPYGQNAWEFKHPEFRANSKESLDNIRRKAPAPRKQAQAHDDSVPTQQIDLLNQQIVAQQQQIQHISDRYAQMSVDHQLMLQEVLRVQKTVVNHENVIHQLVNYLVSIDARQKRDNKAGSFQAQVGASPSQVTPMDDGVSTPLQQASKLLSDMNAEVQFNLVPVESMGEPPKTGVVSTPTMETAPRRMEPVVYPVGATNGIDPMYGEHVNNVPYTVPPKQDMDDRRQFPDNRKKSNHVDPGWMRSPRILLVEDDATCRQIGGKFLYSFSCEIDTALDGLEAVNKVQDGSKYDLILMDIIMPNLDGVSACHLIRQFDRTPIIAMTSNIRSDDIQALLPAWYAASVICSRMDDVLPKPFTRKSLLEMLEKHLVHLKTVPQGMEGHQATTPVTIAGQSSAAQSVTIKEDTSSPSQSPAAAMTAWQSPNQFQPMAAVPANLQQVQGQYVPANPATTAYAMDQEWYAISSTAYGSDGRCWARSKCDRSHVGTSLN

SEQ ID NO: 23886 - protein, 304 aa, Thermus thermophilus
MRVEGAIGKTPVVRLAKVVEPDMAEVWVKLEGLNPGGSIKDRPAWYMIKDAEERGILRPGSGQVIVEPTSGNTGIGLAMIAASRGYRLILTMPAQMSEERKRVLKAFGAELVLTDPERRMLAAREEALRLKEELGAFMPDQFKNPANVRAHYETTGPELYEALEGRIDAFVYGSGTGGTITGVGRYLKERIPHVKVIAVEPARSNVLSGGKMGPHQFQGMGPGFIPENLDLSLLDGVIQVWEEDAFPLARRLAREEGLFLGMSSGGIVWAALQVARELGPGKRVACISPDGGWKYLSTPLYAEP

SEQ ID NO: 23887 - protein, 265 aa, Burkholderia caledonica
DDCNSGLAFGGNKTRKLEYLIPEAIEQGCDTLVSIGGIQSNQTRQVAAVAAHLGMKCVLVQENWVNYSDAVYDRVGNIEMSRIMGADVRLDAAGFDIGIRPSWEKAMSDVVEQGGKPFPIPAGCSEHPYGGLGFVGFAEEVRQQEKELGFKFDYIVVCSVTGSTQAGMVVGFAADGRSRNVIGIDASAKPEQTKAQILRIARHTAELVELGREITEEDVVLDTRFAYPEYGLPNEGTLEAIRLCGSLEGVLTDPVYEGKSMQGMI

SEQ ID NO: 23888 - protein, 168 aa, Avena agadiriana
VMASSATSVAPFQGLKSTAGLPVSRRSNAGLGSVSNGGRIRCMQVWPIEGIKKFETLSYLPPLSEEALLKQIDFLIRSKWVPCLEFSKVGFIFREYGSTPGYYDGRYWTMWKLPMFGCTDASQVIKEVEEVKKEYPDAYVRIIGFDNIRQVQCVSFIAFKPPGCEESG

SEQ ID NO: 23889 - protein, 265 aa, Pseudomonas fluorescens
EDCNCGFAFGGNKTRKLEYLIPEALAQGCDTLVSIGGIQSNQTRQVAAVAAHLGMKCVLVQENWVNYSDAVYDRVGNIQMSRILGADVRLVPDGFDIGFRKSWEDALESVRAAGGKPYAIPAGCSDHPLGGLGFVGFAEEVRQQEAELGFKFDYIVVCSVTGSTQAGMVVGFAADGRADRVIGIDASAKPAQTREQITRIASRTAEKVGLGRDIMAKDVVLDERFGGPEYGLPNDGTLQAIRLCARLEGVLTDPVYEGKSMHGMI

SEQ ID NO: 23890 - protein, 637 aa, Cryptococcus neoformans
MSPTAIIDNHKVDLADLKSKVVDGHVELEETPRPPVADNFMYDFKYNHALPTTDALGVSIPDDVDAQNAAEEIVAKLSKVLSEGDAKGFTGLFLEYGVWRDKLAFTWDYRTFNFTENIARAAADLLPSTHCTNFKLLKPAPAIQKPYPDLSFLQFVLSFDTPLVQASAVINAVFTQEGWRLWTVHSVAESLLKFPELDPADGHMTGPVSWEKQREMDDEEIVPDVLIVGGGQNGLALAARLKALGVPNLIVERNAQIGEIWRKRYEYLSLHFPHWADHFPYFPFPKYWPTYTPAQKLGIFMEWYASAMELPVWTKSTVVKAEQDADGKWTVEVNKNGETRVLNPKHVVMATSLCGVPMTPVIPGMDKWKGTARHSTSHDSSREWVGKKVLVVGTSSSGFDTAYDCARRNIDVTLLQRSPTYIMSLTHSVPRNIGSFEPKNGVAPNIEEQDRLFNSMPVGPGEELARRNRAVLEELDKEMLDGLRAKGLKTYKGQRGTGQATLGSTRNGGFYFEAGACEQIIKGKIKVEQGYVESFTEDKVILSGGREREFDLVVFATGFSNTIDSVRQTLGDKIADQCGPIWGVDEEGEMKSAWKECGVPNLWLVIGYLPLTRYHSKLVALRIKALLEGVSPAPYKA

SEQ ID NO: 23891 - protein, 317 aa, Desulfitobacterium hafniense
MPKIADNLTDLIGKTPLLRLNRYSKGKNLFAEIIAKLEYFNPQSSVKDRIAYAMIEDAEKQGAIDQDTTIIEPTSGNTGIGLAFVAAAKGYRIVLVMPDTMSVERRRLLRALGADLVLRPGTQGMGGAIRKAEELKEQISKSFIPDQFSNPVNPSFHRETTAKEILEDTEGKVDVFVAGVGTGGTVTGVGEALKAVNPGIKVVAVEPYNSPVLSGGQPGPHAIQGIGAGFIPKVFNSSFVDEIFQVKNEEAFEASREVAKLEGLLVGVSSGAALYAATRIAARRELEGKKIVVLLPDTGERYLSTPLFPYDEGSNHF

SEQ ID NO: 23892 - protein, 532 aa, Unknown
  Burkholderia sp. 383
MLDANLKNQLKAYLEKITRPIELVASLDDSAKSQELLALLNEIASLTDRVTVTERRDDAERKPSFSIGEPGKPAGIRFAGIPMGHEFTSLVLALLQTGGHPIKLDDDVIEQIRALDGEYAFETYFSLSCQNCPEVVQALNVMSLINPCIRHVAIDGALFQSEVESRQIMAVPTMFLNGASFGQGRSSVKEILAKLDTGASARAAKSLENKPVFDTLIVGGGPAGAAAAIYSARKGIATGVVAERFGGQVLDTMAIENFVSVQETEGPKFATALEQHVKQYDVDIMDVQRADALIPGDVHQIRLANGAVLKAKTIVLATGARWREINVPGEREYRNRGVAYCPHCDGPLFKGKRVAVVGGGNSGVEAAIDLAGIVKAVTLIEYGAQLRADEVLQRKLRSLPNVTIVTQAQTTELTGDGSKLNGLVYKDLRSGDTQRIDLEGVFVQIGLVPNTEWLKGTVELSKHGEIVVDARGATSVPGVFAAGDVTTVPFKQIVIAVGEGAKASLGAFDHLIRQDVAPVAAAQPQAEEAVTA

SEQ ID NO: 23893 - protein, 568 aa, Propionibacterium acnes
MRPSPRRSTSSARSEFRPEHLLQGRSSLRRIPGPVPFPPPFRRTMLDNALTTQLKTYLEMVREPIVLVPSPYRGDDAAKSSKSAHMDELLSEIAALSDKVSVGKPVDNERTPSFAITRPGSPIDIRFAGLPMGHEFTSLVLALLQVGGHPVKEEQSLIDAVRAVKGEHHFVTYMSLTCQNCPTVVQALNAMAVLNPNIHHTAVDGGTHTDEVEAKGIASVPAIYLDGEDWGSGRMDMAEILERLDADAAQGAKEDLSQRDPYDVLVVGAGPAGAAAAVYAARKGIRTAMVGSRIGGQVLDTEAIDNLISVPHTTGPRLADALRSHVNDYNIDVIERQTASAIETTGGMTTVHLTDGDLRARSVIVATGARWRNLGVPGEKEYRTKGVTYCPHCDGPLFTGKKVAVVGGGNSGIEAAIDIAGVVDHVTVVEFLDALKADDVLLRTLNSLPNVDVITSARTTQILGDGSKVTGLEYEDRTSGDVKTIELAGVFVQIGLLPNTEWLEGALERNQRGEIVIDERGTTSAPGIFAAGDCTTQPYKQIIISMGAGATAALGAFDHLIRQNPTQN

SEQ ID NO: 23894 - protein, 466 aa, Shewanella oneidensis
MSIASVASVFKGEHAVGSTVTVRGWVRTRRDSKAGISFLAVYDGSCFNPIQGVVPNSLENYDNEVLKLTAGCSVIVTGDIVESPGAGQAYELQVTAVEVTGWVEDPDTYPMAAKRHSIEHLRELAHLRPRTNIIGAVARVRNCLSQAIHRFYHENGFVWVSTPLITASDCEGAGEMFRVSTLDMENLPRTSDGKVDYDKDFFGKEAFLTVSGQLNGETYACALSKIYTFGPTFRAENSNTSRHLAEFWMVEPEVAFATLNDIAGLAEGMLKYAFNAVLTERMDDLQFFAQHVDKTVIERLQSFVSSDFAQVDYTDAVEILQKSGREFEFPVSWGIDLSSEHERYLAEEHFKAPVVVKNYPKDIKAFYMRLNEDGKTVAAMDVLAPGIGEIIGGSQREERLDVLDMRLEEMDLNKEDYWWYRDLRRYGTVPHAGFGLGFERLVSYVTGVSNIRDVIPFPRAPRTANF

SEQ ID NO: 23895 - protein, 316 aa, Pseudomonas aeruginosa
MPDTLRHARVIILGSGPAGYSAAVYAARANLKPLLITGMQAGGQLTTTTEVDNWPGDPHGLTGPALMQRMQEHAERFETEIVFDHIHAVDLAGKPFTLRGDNGTYTCDALIVATGASARYLGLPSEQAFMGKGVSACATCDGFFYRNREVAVIGGGNTAVEEALYLANIASRVTLVHRRETFRAEKILQDKLQARVAEGKIVLKLNAEVDEVLGDTMGVTGVRLKNRDGGSEEIAVDGMFVAIGHTPNTSLFEGQLALKDGYLVVNGGREGNATATNVPGVFAAGDVADHVYRQAITSAGAGCMAALDVERYLDSL

SEQ ID NO: 23896 - protein, 264 aa, Burkholderia cepacia
EDCNTGFAFGGNKTRKLEYLVPDALAQGADTLVSIGGVQSNQTRQVAAVAAHLGMKCVLVQEHWVNYEDPVYDRVGNIQLSRMMGADVRLVADGFDIGIRRSWEEAMESVRQSGGKPYPIPAGCSEHPLGGLGFVGFAEEVREQEAQLGFKFDYIVVCSVTGSTQAGMVVGFAADGRADRVIGIDASATPERTHEQITRIARHTAELVGLGRDIETKDVVLDTRYAGPEYGLPNDGTLEAIRLCARLEGMLTDPVYEGKSMHGM

SEQ ID NO: 23897 - protein, 563 aa, Xylella fastidiosa
MCSIFGIFNLQPSDNLQILRHQALECSQRQRHRGPDWSGVYVDVGAILVHERLAIVDPAGGAQPLFSEDGTLALAVNGEIYNHAVLKGTLQQPYAFQTHSDCEVINALYREETPTSFLNRLNGIFAFALWDKTTGRGLIARDPMGVVPLYWGHDQDGRLRVASEMKALVEHCPDVAQFPPGHWYDTTTGTLVKYYERPWKNYSAVEGVQVSLQELREAFERAVHRQLMTDVPYGVLLSGGLDSSLVAAVAARYARHRIETNDQSEAWWPRLHSFAIGLKDSPDLSAANVAAEALNTVHHRFEYTFQEGLDVLPEVIRHIETYDVTTIRASTPMFLLARRIKAMGVKMVLSGEGSDEIFGGYLYFHKAPNAREFHEELVRKLNALYYYDCLRANKAMMAWGVEPRVPFLDREFLDVAMRMDAQHKMVDKTSNGPQRMEKGILRAAFDGYLPPSILWRQKEQFSDGVGYGWIDGLKAHAETQVSDHALATAETRFQVNPPQTKEAYYYRSIFERFFPSPAAAETVPGGKSIACSSPAAIAWDASFATMADPSGRAVSGVHQQALL

SEQ ID NO: 23898 - protein, 415 aa, Haloarcula marismortui
MSYETVREADPAVADALEGERGRQNDTLAMIASENHVSEAVMEAQSSELTNKYAEGYPGERYYGGCEYADDVEELAIDRAKELWGADHVNVQPHSGSQANMGVYLGVLEPGDKILSLDLTHGGHLSHGHPANFAGQVYEVEQYKVDEETGYVDYEGLHDHAEEFEPDIIVSGYSAYPREVDFERIQEAADAVDAYHLADIAHITGLVAAGVHESPVGVADFVTGSTHKTIRAGRGGIIMCDEEYADDIDAAVFPGSQGGPLMHNVAGKAVGFGEALAPEFEQYAQQTVDNAIALGEQFKEHGLSLVSGGTDNHLVLIDLRPSHPDTTGKEVEEALEEAGIVLNANTVPGETRSAFNPSGIRAGTPALTTRGFDEDACREVADLIYKVVDAPHDDDVVAEVSDRVDEMTDEYTLYE

SEQ ID NO: 23899 - protein, 452 aa, Triticum aestivum
MKDLVGLGHLFVVAFLFHFSSFMVLPAITDVTMEAVCPGRDECSVAIYLSGFQNAITGLGALVVTPIVGNLSDKYGRKALMTLPVTVAILPLFILACNRSEVYFYAYYVMKILAGIFCEGSIHCLLLAYVADHVGTKRRAAAFGLLSGVSAAGFLSGTLTARFLATSSTFQVAAAVGAAGAIYLRAFVPDSGAAVSFHDDACDPLLQDSSCSSAASSSASSDEELSPRLPPYKGVLPSPSDMVALLTGSLTLSTAAMITFFYSLGEHGLQTALLYYLKAQFGYSKDEFANLMLIAGAAGMISQLTVMPIFAPIVGEEMLLIVGLLGGCTHVFLYGIAWSYWVPYFAASFIILSAFVHPSIRTNVSKSVGSNEQGIAQGCISGISSFASILAPLVFTPLTAWFLSETTPFNFKGFSIMVAGFCTLIAFVISIRMRAARCGVSEKVSLVQHEQA

SEQ ID NO: 23900 - protein, 1145 aa, Saccharomyces cerevisiae
MSDISKLIGAIVGSDDPVIIEFVLNIINKSGNLQEFIRNIQKLDAGISYEDSIKMYNAFLGKQEEEKVRNKVKSSPLSQKINQVLKDDVNLDDPVVTEFVLSILNKSKSITEFQEQLNLMQSGLDNETIFKIYQIASPPVMKEEVSVLPSTKIPAKIEAKIEEEVQKIESLDPSPVLHKVYEGKVRNITTFGCFVQIFGTRMKNCDGLVHISEMSDQRTLDPHDVVRQGQHIFVEVIKIQNNGKISLSMKNIDQHSGEIRKRNTESVEDRGRSNDAHTSRNMKNKIKRRALTSPERWEIRQLIASGAASIDDYPELKDEIPINTSYLTAKRDDGSIVNGNTEKVDSKLEEQQRDETDEIDVELNTDDGPKFLKDQQVKGAKKYEMPKITKVPRGFMNRSAINGSNAIRDHREEKLRKKREIEQQIRKQQSFDDPTKNKKDSRNEIQMLKNQLIVTEWEKNRMNESISYGKRTSLPISAQRQTLPVYAMRSELIQAVRDNQFLVIVGETGSGKTTQITQYLDEEGFSNYGMIGCTQPRRVAAVSVAKRVAEEVGCKVGHDVGYTIRFEDVTGPDTRIKYMTDGMLQREALLDPEMSKYSVIMLDEAHERTVATDVLFALLKKAAIKRPELKVIVTSATLNSAKFSEYFLNCPIINIPGKTFPVEVLYSQTPQMDYIEAALDCVIDIHINEGPGDILVFLTGQEEIDSCCEILYDRVKTLGDSIGELLILPVYSALPSEIQSKIFEPTPKGSRKVVFATNIAETSITIDGIYYVVDPGFAKINIYNARAGIEQLIVSPISQAQANQRKGRAGRTGPGKCYRLYTESAFYNEMLENTVPEIQRQNLSHTILMLKAMGINDLLKFDFMDPPPKNLMLNALTELYHLQSLDDEGKLTNLGKEMSLFPMDPTLSRSLLSSVDNQCSDEIVTIISMLSVQNVFYRPKDRQLEADSKKAKFHHPYGDHLTLLNVYTRWQQANYSEQYCKTNFLHFRHLKRARDVKSQISMIFKKIGLKLISCHSDPDLIRKTFVSGFFMNAAKRDSQVGYKTINGGTEVGIHPSSSLYGKEYEYVMYHSIVLTSREYMSQVTSIEPQWLLEVAPHFYKAGDAESQSRKKAKIIPLHNKFAKDQNSWRLSSIRQSRERALGIKR

SEQ ID NO: 23901 - protein, 316 aa, Picrophilus torridus
MSDIKENVLNAIGNTPLVKLNKINVKNIEIYVKLEYYSPGMSIKDRIALGMIEDAERKGLIEPGDTIIGKTSGNTGIGLAIACAVKGYRFVAVMSAGNSAERQKILRALGAEVVLVPQQPGEEPGRISRKDNDAVEKKTQELTEKLNAYRPNQYINSMNWKVHQHTTGQEIIRQTSGRLDAFVAYIGTGGTFVGIARALKSFNNDIKCYPVEPDVAAFLAGKKVITTQHLIQGGGHAVKPPFWDESIVDGYIQVSEDEAIKTARALAKNEGILTGFSGGANVAAAAKLDDSLRPGSIVVTVLPDTGLKYLSTVLYE

SEQ ID NO: 23902 - protein, 220 aa, Magnetospirillum magnetotacticum
SFLQHEITEGSVVKGTVVGIEKDVAVIDIGAKTEGRVPLKEFTGPGREGELKVGDEVEVYVDRIENALGEAVISRDKARREESWVKLEKAFEANERVTGTIFNQVKGGYTVDLDGAVAFLPRSQVDIRPVRDVTPLLGTPQPFQILKMDRRRGNIVVSRRTVLEESRAEQRSELVANLEEGQVIDGVVKNITEYGAFVDLGGIDGLLHVTDMAWRRVNHP

SEQ ID NO: 23903 - protein, 747 aa, Moorella thermoacetica
MQGVLRKTLVVAGRDLTLETGRLAKQAGGAVMVSYGGTMVLVTATASEEPREGIDFFPLTVDYEERLYAAGKIPGGFIKREGRPSEKAILSARLIDRPIRPLFPKFYRNDVHVVATVMSVDQDCPPNVAGIIGASAALMLSAIPFAGPIGAVSVGLIDNRPVINPTLEEDSRSSLNLTVAGTANAIMMVEAGAKEVPEDLMLECIMQGHEEIKRIVAFINEFRAEALAMGLAKEKPELVAPQLDPAWESRVREIATPRLREVIYRSRDEKWSKQERDKQLDACREEINNLILEGQEEALAANPELPGLIKELITKIEKEIVRRMILTEGIRVDGRTLEEIRPITCEVGVLSRTHGSGLFTRGETQVLTVTTLGPISDEQILDDLGVDESKRYMHHYNFPPYSVGEARPIRAPGRREIGHGALAERALEPMIPSEEEFPYAIRLVSEVLGSNGSTSMGSVCGSTLSLMDAGVPIKAPVAGVAMGLVKENDQVAILTDIQGLEDALGDMDFKVAGTKKGITALQMDIKIAGIDRSILERALEQARRGRLFILDKILATIPEPRKELSPYAPRMLTITIDPDKIRDIIGPGGKIIKKIIEETGVEIDVEDDGRVFIASTDAAAGERALKIIESLTQDVETGKVYNGKVTRVTDFGAFVEVIPRVLGMPGKEGLVHISQLANERVEKVEDVVQEGDYILVKAIGFDPQGRLKLSRKEALNESTVGEGGHRHFRRAGREGGHRGLNNRRQSR

SEQ ID NO: 23904 - protein, 182 aa, Burkholderia xenovorans
MNQTGEVATLGGGCFWCLEAVYLGVEGVNAVESGYAGGEARHPTYEDVCDGETGHAEVVKVDFDPAKISYREILDIFFAIHDPTQLNRQGNDVGTQYRSVIFTHSDAQREIALQAIREIGEQQIYDGQIVTQVLPLNDNYWPAEDYHQNYFAHHPNQGYCSFVVAPKVAKFRQKFAHRIKAS

SEQ ID NO: 23905 - protein, 427 aa, Ralstonia metallidurans
MATPNLPSSKPEPVSSGAWTTLWSSTFAFTICFAVWMLFAVLGIPLKKELGLNDTEFGLLAATPVLSGSLIRVPLGIWTDRYGGRIVFFVLMLLTVIPIWLISYAHTLWQLLVLGLFVGLAGGSFSVGTPYVARWFPRSRQGLAMGIFGAGNSGAALTKFVAPALILAAGTWEIVPRVYSVAMLITAIVFWLFSRSNPAHRVSSATSWRAQLAVMRDPRVWRYSQYYSVVFGGYVGLSLWMTKYYIGEYGFDMKTAAFLAACFSLPGGVLRAIGGWISDRYGAHRTTWWVMWVSWVTFFLLSYPRSDFTIHTANGPESFHIALSPTVFTILMFVVGIAFAVGKASVFKFISNDFTHNIGAVSGVVGLAGGLGGFILPILFGALADLTGIRTSCFMLMYGAVCVSLVWMHYSQRAANARPTPETLQAA

SEQ ID NO: 23906 - protein, 323 aa, Streptomyces coelicolor
MTHTEQQPLNSPFSAATTAEDVMAGHDLSGVTAVVTGGYSGLGLASTRALTAAGARVLVPARRPDIARAALRDVKGSEVVPMDLTDLDGVRSAAAHIGDRIDRIDLLMAAAGVMATPERRVGPGWEFQLAANHFGHFTLACELYPLLAAAGGARVVAYSSAGHAMTDIRRHDPHFRTGYDRWLAYGQAKTANALFAVHLDALGKDDGIRAFALHPGKIITGLQREMPLQEQIDAGWVDEHGNVVAADFKTASQGAATGLWAATSPLLDGRGGLYLADCDVARVFPPDTPMDDNGVRPYAVEPANAARLWEMSLAATGATPPTR

SEQ ID NO: 23907 - protein, 369 aa, Oryza sativa
MSSGGELALRQEYVIGDEIGRGRFGTVRRCYAVATGEAFAVKSTPKAPLREAEAADALDLALAEQEPKVHLVASAPGPGASPHVVALHAAFEDDAAVHLVVDLCAGGDLLSLVSSRGRLPEHEAADLVAQLASALASCHRRGVAHRDVKPDNLLFDGGGVLKLGDFGSAGWFGDGRPMTGLVGTPYYVAPEVVAGREYGEKVDVWSAGVVLYMMLSGTLPFYGATAAEVFQCVLRGNLRFPPRAFASVSPEAKDLMRRMLCKDVSRRKCEVFLLTIGSFGVRVAGHPWILEGSTSEDPVACRTGDRCPFLPVKPGESKAKPNRSLWLQSRSAPCSQSNRSPPLLRPARLAAPCSSRAASRKSSGRFASP

SEQ ID NO: 23908 - protein, 108 aa, Neisseria meningitidis
EADVKPFKLDDVREALTEIGITGMTVSEVKGFGRQKGHTEIYRGAEYAVDFLPKIKIELVLADDAVERAIDVIVEVARSGKIGDGKIFVLPVEEAIRIRTGERSDAAV

SEQ ID NO: 23909 - protein, 368 aa, Unknown
  Halobacterium sp. NRC-1
MRDRLLDANAENNKYQQKLERLSHENKKLKQSPLFIATVQELTDEGAVIKQHGNNQEALTEVTDELRATLEPGSRVAVNNSLSVVRQLDDEADVRARVMEVDDSPDVGYEDIGGLDDQLREVRETVELPMKDPGLFETVGINPPSGVLLHGPPGTGKTLMAKAVASQTDASFIKMAGSELVHKFIGEGAKLVRDLFQVARDHEPAVVFIDEIDAIASKRTDSKTSGDAEVQRTMMQLLSEMDGFDERGDIRIIAATNRFDMLDRAILRPGRFDRLIEVPHPNVGGREKIFRIHTRAMNVADSVDFGELAADTGDLSGADVKAICTEAGMFAIRDDRTEVRMQDFQSAREKLDQDSEPAAATDVSRTFA

SEQ ID NO: 23910 - protein, 805 aa, Candida albicans
MSHLVSSSLGTTTTATPTSRSPHTNHSTPYNQNSITSNRSSPVPKNSVNSRIIPQTMNPPIDMKSNNILNPEKDTDTSRGDHSESKASSISSASGTTTTNNNNVSNNNSTGKTQIVFIHKLYDMLHDESISHLIWWSPSLDSFYVTPGEEFSRVLSQYFKHTNIASFIRQLNMYGFHKVNEPFLNQDDQQQQQQLQSNRWEFRHSTNQFRKGDTESLKNIKRRSSKTLNAQKEVVNIKSLPPTSHPMEYNTGYSYQNEDSAHYFVHHHSITTMQSPADMRPRSPSTPIPMQPLAQQQQQQQQQQQQQQQQLPSQPVPNGPPVFSGPIPPGAVNQSPQEYLTRPSILNNVQGSFENATNFKFVELTNQINLLRNDFFTMNNRYEILQNELKYQTADSMAVLEILEKLSNDNRIATDIRDLKNVVSQRMQRLNNQFIPQQSNFAPHIPGQQQQQQHGNSVSSNYHLESTNVSRNPSTTNLNVAPQPYPLNPHYTIYANNRASGSSEINNGVFRAREDSNNSKRNLSVYDPLQPVPSRNSSRILIEESTPTHPPTNFNPQQSQSQSQVQLGPAMPPQGFRNRAESTYSPLSHSSNKSQILNKAPTPVNHSPLVQQQQKEAKQELNDSSVAPPSQSSLPVTRPLSRQQQQQQQTLHHPSTTSSRTNSLPNPVAEHPAPQSSYFMQRNSFNTIYEHQKSLRVPSPKRVRYATPPRSIPEQPISSTAPTTMITSTSKTTSTSGAAISRSENHSVVSLTGGALPSVSELDKSIRTGSSVSLPPIKSIKDNDNKNDNGNSDDNGNDHKKRKLE

SEQ ID NO: 23911 - protein, 429 aa, Anabaena variabilis
MVSMPTLPLEGASPAHICPFDQACSYLEAAAKELRLDQGTLEILSHPRKVVTVSIPVRLDNGDIRVLAGHRVQHSDILGPYKGGTRYHPAVTLREVSALAMLMTWKCALLGIPYGGAKGGIAINPQHYSVGELEKITRRYTSELIKDIGPAVDIPAPDVGTSAREMAWMMDTYSVNVGHAVPGVVTGKPISIGGSRGREMATGRGVMIIVREALADMGRTLEGVKVVIQGFGNVGGAAAELLYQAGAKILAVSTGAGGLFAADGLDIPALKAYAAENHRSIVGFPQAVAISNAELLTLPCDVLIPAALENQITEENVDQIQAQIVAEAANGPVTLEANRVLEGRGVTVLPDILANAGGVVVSYLEWVQGLSYLFWDEERVNREMEHLMVQAYHQVIKQSQMRQVPLRLAAYTLGVGRVAQALSDRGLYP

SEQ ID NO: 23912 - protein, 1244 aa, Unknown
  Magnetococcus sp. MC-1
MGNVAGISHRILNWLRYCCFVGLFQRQLRTEPENIVIVTCENCDARFDVDPQLLGSKGRKLKCSQCHHIFFQAPPEPKSAQPPASEQPGLEDESTAQDNDTESRDYAEFAFEESPLEEVDLDEIEKLTAQATLDMALEATRDKRQEPSFDEDTQVDEDAVIEPSLEEVDVDQMIQAATALPTEPEAASEAEEELEAEEELEAEEEPEAEEEPEAEEEPEAEEEPEAEEELEAEEEPEAEEEPEAEEESEAEEESEAEEEPEAEEESEVEEAPEVEEELELEEEAEEEPEAEEEAAPEAEEEAAPEVEEEPEVEEELELEEEAEEESEAEEESEAEEEAAPEAEEEAAPEAEEEAAPEAEEEAAPEAEEEAAPEVEEEPEVEEELELEEEAEEAPEAEEAPEIEEELEAEEELEAEEELEAEEELEAEEELEAEEELEAEEELEAEEELEAEEELEAEEELEAEEELEAEEELEAEEELEAEEELEAEEELEAEEEPEAEEAPEIEEELEAEEESEAEEVPEIEEELEAEEEPEVEEEPEVEEEPEVEEEPEVEEEPEVEEEPEVEEEPEVEEEPEVEEEPEVEEELELEEEAEEAPEVEEELELEEEAEEEAAPEVEEEPEAEEESEAEEEAAPEVEEELELEEEAEEEPEAEEELEAEEEPEAEEEPEAEEEPEAEEEPEAEEEPEAEEEPEAEEEPEAEEEPEAEEEPEAEDAFALDVDEQVPAADFADDGDFLSESALQEEQDKLLDVDDFNAATMVEPASLVEEDELDLAEVMENAERTADEAFNPSAMAEPDLLESELQLEDVEAEVVEEGGAELTLEGEEQAAFADLLTEEDDLSALADDALDLDDDDDVTVLADPPAMDLEGLVDAVESDHEVAFEDESVEAFAPLGDDLPNDLDDLTELVNEPGGELMLDDDLAALAPSPVMQERLVPADGMDELSALASDDQDEINLDLPESNDLSLGDLGEAESWSPDDELLEPEDETILAVPDSDETIEELDFPEPDIPQPKEEIIELDYGQQEEEPFDLSSSPDDEDEDLEWANTATPAKEKGGLGGLLGWGVAAMMLLAVIGAWFGKDYLSRGGATNRVDDFTLDGVEVKWRESDHGVLLIVEGSMTNQMNRRSARRPMMARVTLLDENNRNLNSVSVIPERIIPERAMNLNPNNMARIITKQGDIETRFNKMNPKQPVKFQAIFMDPPMEAVRYRIDFDATPEAEWEKQKKARSQAIKNREGTTTFMGNF

SEQ ID NO: 23913 - protein, 116 aa, Brassica napus
MAVVDVHRFAESITCHAWSPDHSMVAFCPNNNEVHIYKSVQDQWERLHVLEKHDQIVSGIDWSSKSNKIVTVSHDRNSYVWSLEGGEWVPTLVILRLNRAALCVQWSPPVSTPSPH

SEQ ID NO: 23914 - protein, 532 aa, Scenedesmus obliquus
METLEKNFKKEKSVFSAAKKKKNLSFAKNEKTTTLKDALQAGDILTVKITALGSKNIGVAELKNGYTVLVPNTKCGDKVQVKVEKIFLGKGTNSILNQKIKYVVARVDNSGTKTSNFEKTSNSLKFDFKVGQKFRVTIAKKGPKNSGLVPVAKNFLFIVPNTKVGENIVVEIQKIKQNYAFAKPILSKQMNVVQENNQMIGQQFHIVIPSSAKTIANSFVVKLNGQFVFVKKSLGVQLEDTVKIQIQKSTGTFALAKILKISPISSKEKKAMVKETVQKMIQSSMHFGEKAIRCNANMRKYIWYRKKGLGMYTNSKNTFVSIKETKKPMVKRGRHVLNVLKTQRCFAEALKQLAKYAAKGKTFLFVGTKKPAASLVAKTALLSNTSFFVNTRWLGGMLTNWKTILKSISQIRPILKQKQKILQKILEKREKIQRRLFNKVYLLRKKSQKFMIKGKYLIQQILRSKNFLIEKSQKFIQTKNALFSANALLLNASKNLKMKKIQILKQIQQLEFAAVEILKQKQPIKSFNSIKS

SEQ ID NO: 23915 - protein, 168 aa, Avena strigosa
VMASSATSVAPFQGLKSTAGLPVSRRSNAGLGSVSNGGRIRCMQVWPIEGIKKFETLSYLPPLSEEALLKQIDFLIRSKWVPCLEFSKVGFIFREHGSTPGYYDGRYWTMWKLPMFGCTDASQVIKEVEEVKKKYPDAYVRIIGFVNIRQVQCVSFIAFKPPGCEESG

SEQ ID NO: 23916 - protein, 328 aa, Arabidopsis thaliana
MSSPERKRKKRSLEPSPESTPNPSLPDDLIVSILARVSRLYYPILSLVSKSSRTLVTSPELYKTRSFFNRTESCLYVCLDFPPDPNPRWFTLYRKPNQNITEKTKNSSGSHTWHEAPSMRMKRNYPAANVVDGKIYVAGGLEEFDSSKWMEVFDIKTQTWEFVLSPLAERFIYRSLVIEGEIYIFGDKVVTYKPKEDRWGGVGEHQSMDLGLFFHSYCVIDNVLYCYRPGGIKWYESEKRSWRKLRGLKGLSKLASSCVKLADYGGKMALLWDKYIPCSGNKSHSISCAVVSLERCKNQGIRGKVEWFDDMLTVPSSYNFVGALAATL

SEQ ID NO: 23917 - protein, 379 aa, Scenedesmus obliquus
MKLVQFFEIGQQLLKTKDFVEKNKNTTVVTLSYEKLLTLQNSTGGDNLQVTATLPNPSPEIFKKMIAIVSNLRKEENGFFATNQMGTSSNRAKSTDTPAVSTSQNVGGANEPKTILISKFLNKFILLLPFFKNSLQTLSDRLVQQEKMLKELNSTFTKITESQKSLKQLYKKTISQYAVVSSKFIVQQNNFKKFQKNLKQFASEQRLLKFLPKLRYLPTSQTKMYEIVELFMKKFVDPKLSYPMEQIYDQKLKFTSKKIAATRKQKWQRLEKYFGGITKMAKMNTKQISKNVAIIIGQQEEMNAVHECRKLGMKIFAVVDTNCNPKFVDHIIPANDDSRNSIKYILGEMLTYIRLGQKLRKKVSLRAKIQQNRKKRFAY

SEQ ID NO: 23918 - protein, 288 aa, Guillardia theta
MKNKDYWYHQAKKFNLRSRAAFKLLHLNDKFNFFKKSRSILDLCSAPGGWLQMCRILSNENCKIFGVDAQKISPIKKCETFIGDITSPNLIGLLEKIVIKTNRKFCIILNDGSPKMGTFWNRDAYNQNILVLYCLRIIRLFLKNNGWFITKIFRSENFNKILFVVKNMFEKVFIKKPKSSRPNSAEIYLICKKFKFKNIDSSKDFSLKSFFNEKIRCGSNIFNSTNNVLGVTNYKDYKYYFMFTKNEFLITFSISNIIKFCLFNSIFKKLISQHILIVLVIKKYIEIL

SEQ ID NO: 23919 - protein, 101 aa, Scenedesmus obliquus
MNQLKKSFSPTEGKKDQNNLINDPQKNKQKKQKKLVDMEGLVTHNLSNGKFRLKLENGVEVIGHLSGKIRQNRIKIVVGDKVTVELSPYDLTKGRITYRHR

SEQ ID NO: 23920 - protein, 553 aa, Exiguobacterium sibiricum
MKLLIIGSVAAGTSVGAKARRNSEDLQITIYDRDQDISYSGCGIPYFVGGEIADIDELTPRDAAFFKKRYNIDIHTRHEVESIDHATKTATIVNLATGDRLTDTYDTLVLATGASSIVPPLQGVDHDNVFTVRNVRNADAIRSYIDAHNPKTATIVGGGFIGLEMAEQLSYRGIQVTLVERLPQVMPPLDRDMAERVADHLRDKGVSLLLGESVTALNGTERVTDIALESGKSIATELVILSVGVKPNTELAKQIGVGLGQTGAIAVNRKMQTNVADIYAVGDVAESFSVITGEAIYRPLGSTANKMGRIAGMVITGEEAEHRGILGTGIFKAFDLTVAQTGLTEKEAREAGYDIEVLHNIKPDRPEYMGGKEMTIKAIADRATGRVLGAQIVGPQGVDKRIDVLATAITFKAKAEDLFHLDLAYAPPFATTKDPVLYTGMALDNAIKKTARLMTPNELIEQVAGGKSFQIIDTRSKAQFEKNHVDGAIHIPLGELRTRAKELDPTLPTIVYCNKGVTGNAAQNVLKNLGFTDVCNLSGGNKNYQHCKKCLTE

SEQ ID NO: 23921 - protein, 657 aa, Escherichia coli
  misc_feature (76)..(76): Xaa can be any naturally occurring amino acid
  misc_feature (85)..(85): Xaa can be any naturally occurring amino acid
MTQLAIGKPAPLGAHYDGQGVNFTLFSAHAERVELCVFDANGQEHRYDLPGHSGDIWHGYLPDARPGLRYGYRVHXPWQPAEGHXFNPAKLLIDPCARQIDGEFKDNPLLHAGHNEPDYRDNAAIAPKCVVVVDHYDWEDDAPPRTPWGSTIIYEAHVKGLTYLHPEIPVEIRGTYKALGHPVMINYLKQLGITALELLPVAQFASEPRLQRMGLSNYWGYNPVAMFALHPAYACSPETALDEFRDAIKALHKAGIEVILDIVLNHSAELDLDGPLFSLRGIDNRSYYWIREDGDYHNWTGCGNTLNLSHPAVVDYASACLRYWVETCHVDGFRFDLAAVMGRTPEFRQDAPLFTAIQNCPVLSQVKLIAEPWDIAPGGYQVGNFPPLFAEWNDHFRDAARRFWLHYDLPLGAFAGRFAASSDVFKRNGRLPSAAINLVTAHDGFTLRDCVCFNHKHNEANGEENRDGTNNNYSNNHGKEGLGGSLDLVERRRDSIHALLTTLLLSQGTPMLLAGDEHGHSQHGNNNAYCQDNQLTWLDWSQASSGLTAFTAALIHLRKRIPALVENRWWEEGDGNVRWLNRYAQPLSTDEWQNGPKQLQILLSDRFLIAINATLEVTEIVLPAGEWHAIPPFAGEDNPVITAVWQGPAHGLCVFQR

SEQ ID NO: 23922 - protein, 436 aa, Triticum aestivum
  misc_feature (175)..(175): Xaa can be any naturally occurring amino acid
  misc_feature (187)..(187): Xaa can be any naturally occurring amino acid
  misc_feature (208)..(208): Xaa can be any naturally occurring amino acid
  misc_feature (220)..(220): Xaa can be any naturally occurring amino acid
MDLSSLASPQALRGGSTGALGAHAARRRSVQLLRPRRPTFRCSVEAANARQQVQGTLAAEAEAARKECFGVFCTTYDLEADEKTKSWKKLVNVSVSGAAGMISNHLLFKLASGEVFGQDQPIALKLLGSERSLQALEGVAMELEDSLYPLLREVSIGIDPYVIFKDADWALLIGXAKPRGPGVERAXRLLDINGQIFAEQGKALNAVXASRNVKVIVVGXPCNTNALICLKNAPNLPAKNFHALTRLDENRAKCQLALKAGVFYDKISNMTIWGNHSTTQVPDFLNAKINGRPVKEVIKDTKWLEEDFTITVQKRGGVLIQKWGRSSAASTAVSIVDAMRSLVTPTPEGDWFSTGVYTTGNPYGIAEDIVFSMPCRSKGDGDYELVKDVAMDDFLWGRIKKSEAELIAEKRCVAHLTGEGNAFCDLPGDTMLPGEM

SEQ ID NO: 23923 - protein, 244 aa, Oryza sativa
  misc_feature (145)..(145): Xaa can be any naturally occurring amino acid
  misc_feature (197)..(197): Xaa can be any naturally occurring amino acid
  misc_feature (220)..(220): Xaa can be any naturally occurring amino acid
MAGKDDDVKVLGLVMSPFAIRVCIALKLKGVSYEYIEEDLANKSELLLSSNPVHKKIPVLIHGGKPVSESLVIVQYVDEAWAPSPTSPSILPADPYDRAVARFWAAYVDDKMVPGMVGVLRAATEEERAAKADETLAAMAQLEKXAFAEVAAKNGKPFFGGDTVGYVDLALGCNLHFLEAIRRLHGVALVDARQDPXLLAAWAERFVEVEAAKGVVPDAXDDAVEFARKVQARVAAAAASTAAK

SEQ ID NO: 23924 - protein, 267 aa, Burkholderia phenazinium
CEDCNSGLAFGGNKTRKLEYLIPEALAQGCDTLVSIGGIQSNQTRQVAAVAAHLGMKCVLVQENWVNYSDAVYDRVGNIQMSRIMGADVRLVADGFDIGFRKSWEDALESVRQAGGKPYAIPAGCSDHPLGGLGFVGFAEEVRQQEAELGFKFDYIVVCSVTGSTQAGMVVGFAADGRAERVIGIDASAKPAQTRDQIFRIAKQTAEKVELSRDIVAKDIVLDERYGGPEYGLPNEGTMDAIRLCARLEGMMTDPVYGGKSMHGKGS

SEQ ID NO: 23925 - protein, 168 aa, Avena sterilis
VMASSATSVAPFQGLKSTAGLPVSRRSNAGLGSVSNGGRIRCMQVWPIEGIKKFETLSYLPPLTEEALLKQIDFLIRSKWVPCLEFSKVGFIFREHGSTPGYYDGRYWTMWKLPMFGCTDASQVIKEVEEVKKEYPDAYVRIIGFDNIRQVQCVSFIAFKPPGCEESG

SEQ ID NO: 23926 - protein, 198 aa, Glycine max
MDKSEQTQQQHQHGMGVATGASQMAYSSHYPTAPMVASGTPAVAVPSPTQAPAAFSSSAHQLAYQQAQHFHHQQQQHQQQQLQMFWSNQMQEIEQTIDFKNHSLPLARIKKIMKADEDVRMISAEAPVIFAKACEMFVLELTLRSWIHTEENKRRTLQKNDIAAAISRNDVFDFLVDIIPRDELKEEGLGITKATIAL

SEQ ID NO: 23927 - protein, 244 aa, Azospirillum lipoferum
GLAMGGNKLRKLEYIVPDAIASGADTLVSIGGVQSNHTRMVAATAAKIGMKCVVVQESWVPHEDAVYDRVGNILLTRLMGADSRIVPDGFDIGIRKSWEDAIQSVKDAGGKPYGIPAGASVHKYGGLGYVGFAEEVRKQEAELGFKFDYIVVCVVTGSTQAGMIVGFAADDRADRVIGIDASGTPEQTRTQVRQIVDNTAELVELGRKVRDDEIVILEDYAYPAYGVPSAETNEAIRLAARTEA

SEQ ID NO: 23928 - protein, 301 aa, Schizosaccharomyces pombe
MAPATAVVTPQTAFKTDLPVEKTAHNTVVKSEMGALSKAYPTYSLDESFSFAPIRESTVSRAMTRRYFSDLDKYAESDIVIVGAGSAGLTAAYYIGTRRPDLKIAIIEASVAPGGGAWLGGQLFSAMVVRKPADLFLNEIGVPYEDEGDYVVVKHAALFTSTVMARTLALPNVKLFNATAVEDLIVKEGKDGKQRIAGVVTNWTLVSLNHGLQSCMDPNTINAHLVVSATGHDGPFGAFCVKRLASAQLVSNLHDMRPLDMNRAEDLIVKGTREVFPGMIVGGMELSEFDGANRMGPTSVV

SEQ ID NO: 23929 - protein, 265 aa, Burkholderia tropica
EDCNSGLAFGGNKTRKLEYIVPDVLASGADTLVSIGGIQSNQTRQVAAVAAHLGLKCVLVQENWVNYSDAVYDRVGNIQMSRMMGADVRLVSDGFDIGIRPSWEEALESVRNAGGKPYPIPAGCSEHRLGGLGFVGFAEEVRAQEAELGFKFDYIVVCSVTGSTQAGMVVGFAADGRADRVIGIDASAKPEQTREQILRIARQTADLVELERPIADADVVLDTRYGGPEYGLPSEGTLEAIRLCAKTEGMLTDPVYEGKSMHGMI

SEQ ID NO: 23930 - protein, 452 aa, Arabidopsis thaliana
MASGVFEDEAEGTITINEYIERLDAEELAADLVLGGDEGDECTFPKGYMKRQAIFSCITCTPEGNAGICTACCLSCHDGHELLELWTKRNFRCDCGNSKFGTLACKLLPSKDIENSENSYNHNFKGLYCTCDRPYPDPNVEEQVEMIQCCLCEDWFHEEHLGLTPSDSVGSQIPRDEESEPIYEDFICQNCSPACSFLTLYPENLWVVAKVDSTGSANACSETIELDKNHMDYEPGQPENGTDAEKSVVGKCSETISDSEPGQPENGTEAEKSVVQKCSEKIDESEAGQPENSTEAEKFVVRKCSEKIDGSENVPAAGCVIRTDLNSCPEFEKKPLFLTKNWRNILCRCEKCLEMYKQRKVSYLLDAEDTIVEYEKKAKEKRTEKLEKQEGEALDLLNNLDHVSKVELLHGIKDFQDGLQGLMESAGPSKAITSADIEQMFSKLKNKRKRME

SEQ ID NO: 23931 - protein, 468 aa, Escherichia coli
MSKQQIGVIGMAVMGRNLALNIESRGYTVSVYNRSREKTEEVVAENPGKKLVPYYTVKEFVESLETPRRILLMVKAGAGTDAAINSLKPYLDKGDIIIDGGNTFFQDTIRRNRELSAEGFNFIGAGVSGGEEGALKGPSIMPGGQKDAYEMVVPILTKIAAIAEDGEPCVTYIGADGAGHYVKMVHNGIEYGDMQLIAEAYSLLKGALNLSNEELASIFNEWNEGELSSYLIDITKDIFNKKDEEGKYLVDVILDEAANKGTGKWTSQSSLDLGEPLSLITESVFARYISSLKDQRVAASKVLSGPQAKLASDKAEFVEKVRRALYLGKIVSYAQGFSQLRAASEQYNWDLNYGEIAKIFRAGCIIRAQFLQKITDAYAENKDIANLLLAPYFKHIADEYQQALRDVVSYAVQNGIPVPTFSAAVAYYDSYRSAVLPANLIQAQRDYFGAHTYKRIDKEGVFHTEWLE

SEQ ID NO: 23932 - protein, 150 aa, Arabidopsis thaliana
MAPRAEKKPAEKKPAAEKPVEEKSKAEKAPAEKKPKAGKKLPKEAGAGGDKKKKMKKKSVETYKIYIFKVLKQVHPDIGISSKAMGIMNSFINDIFEKLASESSKLARYNKKPTITSREIQTAVRLVLPGELAKHAVSEGTKAVTKFTSS

SEQ ID NO: 23933 - protein, 659 aa, Zea mays
RTRGRRLNLHGNRLSGVIPAALSNASSLHSLYLYGNRLTGGLPVALCDLPHLQNLDVSGNALSGELPLDLRGCRSLQRLVLARNAFTGELPAGVWPEMPNLQQLDLSSNAFNGSIPPDLGELPRLAGTLNLSHNHFSGVVPPELGRLAATVTLDLRFNNLSGAIPQTGSLASQGPTAFLNNPGLCGYPLQVPCRAVPPPTESPTPPATTTPLPSTASSDQHQPIRTGLIALISVADAAGVALVGVILVYMYWKVKDRKGRRDGGGDDSSKSGLCRCMLWRHGGSDSSDASSGDGDGEGKYSGGEGELVAMDRGFRVELDELLRSSAYVLGKGGKGIVYKVVVANGTTPVAVRRLGGGGGGADRCKEFAAEARAVGRVRHPNVVRLRAYYWSADEKLVVTDFVGNGNLTTALRGRPGQTVLSWSARLKIAKGAARGLAYLHESSPRRFVHGEVKPSNILLDADFTAHVADFGLARLLAVAGCAPDGPPSTGGAGLLGGAIPYVKPPATGTGPDRFGAGGGYRAPEARAPGAKPTQKWDVFSFGVVLLELLTGRGPAADHASPSTSASFSAPVSGSTATDRSGSGEHGGGAVPEVVRWVRRGFEEDVRPLAEMVDPALLRGPALPKKEVVAAFHVALQCTESDPELRPRMKAVADSLEKIG

SEQ ID NO: 23934 - protein, 260 aa, Azospirillum lipoferum
EDCNTGLAMGGNKLRKLEYIVPDAIASGADTLVSIGGVQSNHTRMVAATAAKIGMKCVVVQESWVPHEDAVYDRVGNILLTRLMGADSRIVPDGFDIGIRKSWEEAIQSVKDAGGKPYGIPAGASVHKYGGLGYVNFAEEVRKQEAELGFKFDYIVVCVVTGSTQAGMIVGFAADDRADRVIGIDASGTPEQTRTQVRQIVNNTAELVELGRKVRDDKIVILENYPYPAYGVPSAKTNKAIRLAAFPEGRIHDPVFEGKS

SEQ ID NO: 23935 - protein, 241 aa, Pseudomonas fluorescens
AFGGNKTRKLEYLIPEAIEQGCDTLVSIGGIQSNQTRQVAAVAAHLGMKCVLVQENWVNYSDAVYDRVGNIEMSRIMGADVRLDAAGFDIGIRPSWEKAMSDVVEQGGKPFPIPAGCSEHPYGGLGFVGFAEEVRQQEKELGFKFDYIVVCSVTGSTQAGMVVGFAADGRSRNVIGIDASAKPEQTKAQILRIARHTAELVELGREITEEDVVLDTRFAYPQYGLPNEGTLEAIRLCRSLE

SEQ ID NO: 23936 - protein, 169 aa, Bacillus cereus
MFCYQCEQTPTGGCKVIGVCGKNETIASLPDTIVFGLKGIAAYRTHAAQLGYTDAFVDATTQEALYMTLTNSNFNEREHIDMAMKVGKSALRVMELLDEAHTNHFGVPEPVQITQNHVEGKAIVVTGHNLFALEELLKQTEGKGINIYTHSEIVDFRKNIKIELTFIAT

SEQ ID NO: 23937 - protein, 236 aa, Lotus japonicus
MTKRYWNITFEEMMEAGVHFGHGTRKWNPKMAPYISMKRKGIHIINLTRTARFLSEACDLVFDAASRGKRFLIVGTKKKAADLVARAAIRARCHYVNKKWLGGMLTNWYTTETRLRKFRELRTEQKTGKLNCLPKRDAAILKRQLSHLETYLGGIKYMTGLPDIVIIVDQQEEYTALRECITLGIPTICLIDTNCDPDLADISIPANDDAIASIRLILNKLVFAICEGHSSYIRNF

SEQ ID NO: 23938 - protein, 558 aa, Aspergillus oryzae
MKDASCDNGSPAPLLTAVYAESQVHLIIGGNPLAAARCAKSLEAGAKPVIIAPDTGDLHFSLSERIENGSVQWVRREFQDDDLKTLGREEVDHVVDTVFVTLGGNHPLSAHISKLCRRLRIPVNVSDAPELCTFSLLSTYSDGPLHIGITTSGRGCKLASRLRREISSSLPSNLGTAIDRLGAVRRRLWAEDYAAGLCTAPLEGDEDDITGQSHTFNKLVTEDDISAAKTRRIRWLSQICEYWPLQKLAAISDADIDAILQAYSSGKNSLDSTNGLGHLEKKGKIVLAGSGPGHPDMLTRATYNAIQNADIILADKLVPEPVLKLIPRRTEVHIARKFPGNADQAQEEFLQMGLDSLRRGRYVLRLKQGDPYLYGRGGEEFEFFRGEGYTPVVLPGITSALSASLFAEIPATHRGVSDQVLICTGTGRKGAAPEPPTYVPTQTVVFLMALHRLSALVESLTTPPQEGSRPRTPWPKDTPCAIIERASCTDQRVIRSTLENVCLAFEAEGSRPPGLLVVGASCHILHPRKDEKWTVEEGFRGLDDLRGEIVPENDQKHD

SEQ ID NO: 23939 - protein, 167 aa, Zea mays
ETLATRVEEGAWRRGAVASSGRTKGVQLHADEETYRSMGKEHALVISNHRSDIDWLIGWILAQRSGCLGSTLAVMKKSSKFLPVIGWSMWFAEYLFLERSWAKDEKTLKWGLQRLKDFPRPFWLALFVEGTRFTPAKLLAAQEYAASQGLPAPRNVLIPRTKYLFLR

SEQ ID NO: 23940 - protein, 181 aa, Brassica napus
MASSMLSSAAVVTSPAQATMVAPFTGLKSSSAFPVTRKANNDITSIASNGGRVSCMKVWPPVGKKKFETLSYLPDLTEVELGKEVDYLLRNKWIPCVEFELEHGFVYREHGSTPGYYDGRYWTMWKLPLFGCTDSAQVLKEVQECKTEYPNAFIRIIGFDNNRQVQCISFIAYKPPSFTGA

SEQ ID NO: 23941 - protein, 553 aa, Debaryomyces hansenii
MSQPEFKLSTELPAWKKLEATFKSKGEKFQVKEAFDKDPKRFEKLSKTFQNFDNSKILFDFSKNLIDDEILEQLVQLAKEAKVEELRDAMFNGDKINTTEDRAVYHVALRNRSKREMKVDNVDTFPEVDEVLQHMKEFSNQIRSGEWTGYTNKAITDVVNIGIGGSDLGPVMVTEALKAYGKPGLNVHFVSNIDGTHIAETVKKCDPETTLFLIASKTFTTAETCTNANSAKKWFLAKALDTKHIAKHFAALSTNAEEVSKFGIDTKNMFGFESWVGGRYSVWSAIGLSVAIYIGFDNFESFLKGAEAVDKHFVETPLEENIPVLGGLLSVWYNNFFGAQTHLVAPFDQYLHRFPAYLQQLSMESNGKSVTRANAFTNYETGTILFGEPATNAQHSFFQLVHQGTKLIPSDFILAAQSHNPIENNLHQKMLASNFFAQAEALMVGKNEDEVKKEGATGGLVPHKVFSGNRPTTSILAQKITPAALGSLIAYYEHLTFVEGAIWNINSFDQWGVELGKVLAKVIGKELENNNEKVDTHDPSTKGLINQFKDWAE

SEQ ID NO: 23942 - protein, 186 aa, Unknown
  Populus tremula x Populus alba
DPELDQFMGAYYDMLVKYREELTRPIQEAMDFMRRIETQLNMICHGPLRIFNSDDKSEGVGSSEDDQDNSGGETELPEIDPRAEDRELKNHLLRKYSGYLGSLKQELSKKKKKGKLPKEARQKLLSWWELHYKWPYPSETEKVALAETTGLDQKQINNWFINQRKRHWKPSEDMQFMVMDGLHPQN

SEQ ID NO: 23943 - protein, 566 aa, Oryza sativa
MNELCDLKVHINGHHTLLLHQSVMCAFSGRLRTMVTQEKKKRKTSRAESLSVKLADFPGGGEGFELVARFCYNNGRVPLCPSNLPLLHCAAVFLEMTEEVCTCNLLTQAEAFVDGLYYWTWADVLAAVKSCEPFAAAADASGLLERLISALFSKITANPETPVAAGAVGTPNRSSSSCSSSPDTLGFGRSSSTKTPESMKPCFAREWWFDDMTSLCPQTIEKAMRVLGCYGIENKNLILTRFLLHYLRAATRRPALCREGGGGLAGLADTAVHGVALVGGTAFSCRGLFWVLRIVSAVGLSKECRHKLERLMGLMLDQATLDDLLVSGDDGGVYDVNLVMRLVRVFVGSEEEADLPSQRMRKVGRLVDKYLGEISPDHGLRVSKFLAVAESLPDSARECYDGVYRALDIYLESHPTLTIEERTTLCRCLNYEKLTLEACKDLAKNRRIPPGIAVQALASQQSKLQIRPAAAAAKGTGGCRPDPSQTPRKIIVSGSRARSVDLDAMDEKELLKLNLQKMQNRVVELERACKEMRGQMSKMAKGGRPSSSFGAAACHQTGGRGLPRLC

SEQ ID NO: 23944 - protein, 676 aa, Ashbya gossypii
MSPTPLYPSVSSPSHAKKTLRQKQIEEYYAAEIYPPIIDGPVDYDLPQLKVYGDQRPCPELILDDSENALRPLVEEWLEKLNAMLESINTGARREIIHSNMDNVFTNHAAWRDHLAVSWDLHTFNTLDDLKDRLVPFLESALLENVKLDDLADYHYKYGFGKVLVHEETWDHPPIEWIQVYYSFENKIGYGKGIARLAAVEDELTGEATLKCFTFYTVLEDLKAYPEKILRNRPEGVNHGQHVGRQSWLELRAKETTFDRNNQPTVLIVGGGQGGLAVAARLKSFGISSLIIEKNARVGDNWRNRYKFLVLHDPIWYDEMPYLRFPPTWPVYTPKDKLGDWFDAYAKSLDLNTRCASTVTGASFDELTGRWRVEVTDNLSGGVTYFAPSHLILATGHSGEPRLPKFKDQELFEGKIVHSSEHGTGAEYKGKRALVVDDCNSAHDICQDFYEQGADVTMLQRSSTCIITATHGTIHNNRGLYDEDGPVTETADHIFHSMPIHLLNGMMQQQYRVSCRDDEELLRSLQRVGFKLNGGYNGTGLFGLYFRQGSGYYIDVGCSGLIADGKVKLKQGVGIERFLKNGVVFTDGSRLENIDIVVLATGYTNMRETARRLFGNKVAGRLDPVWGLDEEGETKTMWRNSGHPNFWFMGGNLALARYYSKRLALKIVAQEMNIFY

SEQ ID NO: 23945 - protein, 223 aa, Saccharomyces cerevisiae
MSSEDYGYDYDLLFKIVLIGDSGVGKSNLLSRFTKNEFNMDSKSTIGVEFATRTLEIDGKRIKAQIWDTAGQERYRAITSAYYRGAVGALIVYDISKSSSYENCNHWLSELRENADDNVAVGLIGNKSDLAHLRAVPTEESKTFAQENQLLFTETSALNSENVDKAFEELINTIYQKVSKHQMDLGDSSANGNANGASAPNGPTISLTPTPNENKKANGNNCC

SEQ ID NO: 23946 - protein, 72 aa, Colwellia psychrerythraea
MAKEENIEMQGTVLDTLPNTMFRVELENGHVVTAHISGKMRKNYIRILTGDKVTVELTPYDLSKGRIIFRAR

SEQ ID NO: 23947 - protein, 101 aa, Neisseria meningitidis
KLDDVREALTEIGITGMTVSEVKGFGRQKGHTEIYRGAEYAVDFLPKIKIELVLADDAVERAIDVIVEVARSGKIGDGKIFVLPVEEAIRIRTGERSDAAV

SEQ ID NO: 23948 - protein, 450 aa, Prosthecochloris aestuarii
MQKNVDILVIGGSAAGIVAATTARAFYPDKAVMIVRKEQKAVVPCGIPYIYGTLKSIEQNIIPAGHITDAGVEMMIDEVVSIDSEKKTATTVSGTVISWDKLVIATGSVPKVPGWLKGTDLDNVFTIPKDCQYLDHVQHAMEGSRKVVIIGGGFIGVEIADELSKKGLDITLVELLPHVLQMAFDEEMSVRAEEILTTSGVKLKLGCKVEEIEGDGKVTGVRLDGGEVLEADLVILSTGYLPNTTLAADAGIKLNELGAIRVDEYMRTENKDIFAVGDCAEKFSFFTRIVKGLMLASTACSEARIAGMNLYKLSRLRTFGGTLSIFSTAIGGTTFAAAGVTEQMAIERGFDIVSASAEGIDKHPKTLPGVHAQRVKLIVNRESGLVLGGSVIGGVSAGELINVIGVIIESMMTIHQVLTLQLGTHPLLTGPPTGYPLLKAAENVAKKMRQ

SEQ ID NO: 23949 - protein, 242 aa, Arabidopsis thaliana
  misc_feature (52)..(52): Xaa can be any naturally occurring amino acid
  misc_feature (159)..(159): Xaa can be any naturally occurring amino acid
MANHETIFDQLKKQIPVDEEEPLILNRDSSVGLVIVDVVNGFCTIGSGNMVXAPTKHNEQISKMVEESAKLAREFCDRKWPVLAFIDSHHPDIPERPYPPHCIIGTEESELVPALKWLESEDCATLRRKDCINGFVGSMESDGSNVFVDWVKEKQIKVXICTDICVFDFVATALSARNHGVLSPVEDVVVYSRGCATFDLPLHVAKDIKGAQAHPQELMHHVGLYMAKGRGAQVVSKISFET

SEQ ID NO: 23950 - protein, 564 aa, Candida glabrata
MTEITLGRYLFERLHQIHIDTIFGLPGDFNLTLLDKIYEVEGLRWAGNANELNAAYAADGYARLKGMACLLTTFGVGELSALNGIAGSYAEHVGVLHVVGVPSTVSRAKQLLLHHTLGNGDFDAFHRMSSVISETTFIVSDPQTAPAEIDRCIRVCYLTQRPVYLGIPANMFDSKVSSKLLDTPIDLALRPNLPDAEREVLDEIITMIKASKRPIILADACTSRHDVKKETKRLIEVTQFPSFTTPMGKGSIDEDTPRFGGVYVGNLSDPEVKTFVEESDLVLSVGALLSDFNTGSFSYSLNTRNVIEFHSDHMKIRNATFPGVQMKFVLEKLLEELPAVVKGRTDNRVVPRQKEPSTTLNGKDAIKQEWMWKHVGKFLQEGDVVVTETGTSGFGIVESKFPRNTVGISQVLWGSIGYALGSTVGAAFAAQEIDPKKRVILFIGDGSLQLTVQELSTAARWGLTPYIFVLNNNGYTIERLIHGETQGYNDIQSWDHSLILPAFGAKNYENKRVATYGEWNDMVNDKQFNKNDKLRMIEVMLPTMDGPENLKKQAKLTASINAKN

SEQ ID NO: 23951 - protein, 415 aa, Lactobacillus sakei
MLAKTDPVINDLIKQEENRQRHNIELIASENIVSGAVQEAQGSVLTNKYAEGYPNKRFYGGCEYIDQIETLAIERAKELFGADHVNVQPHSGSQANMAVYQALLEPGDKILGMNLTDGGHLTHGSPFNFSGQLYDFYSYGVADTNEQLDYASLAAKAQEVHPKMIVAGASAYSRTIDFPRLREIADQVGAYLMIDMAHIAGLVATGVHPSPVPYADVVTTTTHKTLRGPRGGMILCKAEYAKAIDSAIFPGIQGGPLEHVIAAKAVAFGEALQPEFTAYTKQIVANAQAMAAVFDQSDLVRVVSGGTDNHLMLLDLTNSGLNGKELQNLLDSVHITVNKNTIPFEKLSPFKTSGIRIGTPAITSRGFKEKDCEQIANLILEVIEKHDQLEAMTAISEAVLKLTDQFPITQAKFLD

SEQ ID NO: 23952 - protein, 752 aa, Guillardia theta
MNRLIVDEINQNADDNSVVYLNSNKIDNLKLFRGDTILIKTKKKKDTVCIIMSDDNCELEKIRINKTVRENLNIGIGDIVTIHHFTDLKFGKRIHVLPFKDSILGYNGNIFEDFLKPYFLDAYRPIKKGDVFNIKSGNNTFDFRVIEIDPVDYCIVGPDTIIFCEGEPLDRLDTVDYEKITYESIGGCQKQLSQIRELVELPLKHPQLFNTVGIKPPRGVLMYGPSGCGKTLIAKAVANETGAFLYSINGPEIMSKLAGESESNLKKAFDEAEKNSPSIIFIDEIDSIAPKRDKSQGEVERRIVSHLLTLLDGINLNSQVVVIACTNRPNSVDQALRRFGRFDREIDISVPDDKGRLEILQIHTKNMLIDNSVDLEAICKETYGFVGADLAQLCTEAALLCIKESIENFDLEEENIPLVVLNSLRVSQDHFKLALDQSNPSAFRETAVEIPNITWEDIGGLENVKRELQETVQYPVEHPEKFEKFGMQPSKGVLFYGPPGCGKTLLAKAIANECQANFISIKGPELLTMWFGESENNVREVFDKARQASPCVLFFDELDSIARARGSSGSDGGGAGDRVINQILTEIDGVGVRKNVFVIGATNRPDILDPAIMRPGRLDQLVYIPLPDRKSRIQIFRATLRKSPLSKEIDLEVLSRATSGFSGADITEICQRACKLAIRESIFKDIQFAKNSESIVSNNEKYIDPVPEITKEHFLEAMKYARRSVSDSDIRKYEMFAQKLQTSRGFSKEIKF

SEQ ID NO: 23953 - protein, 457 aa, Escherichia coli
MMEGQQHGEQLKRGLKNRHIQLIALGGAIGTGLFLGSASVIQSAGPGIILGYAIAGFIAFLIMRQLGEMVVEEPVAGSFSHFAYKYWGSFAGFASGWNYWVLYVLVAMAELTAVGKYIQFWYPEIPTWVSAAVFFVVINAINLTNVKVFGEMEFWFAIIKVIAVVAMIIFGGWLLFSGNGGPQATVSNLWDQGGFLPHGFTGLVMMMAIIMFSFGGLELVGITAAEADNPEQSIPKATNQVIYRILIFYIGSLAVLLSLMPWTRVTADTSPFVLIFHELGDTFVANALNIVVLTAALSVYNSCVYCNSRMLFGLAQQGNAPKALASVDKRGVPVNTILVSALVTALCVLINYLAPESAFGLLMALVVSALVINWAMISLAHMKFRRAKQEQGVVTRFPALLYPLGNWICLLFMAAVLVIMLMTPGMAISVYLIPVWLIVLGIGYLFKEKTAKAVKAH

SEQ ID NO: 23954 - protein, 505 aa, Medicago truncatula
MGLTEPKVVTGPAGYVLEDVPHLSDYIPDLPTYPNPLQDNPAYSVVKQYFVHVDDTVPQKVVVHKDSPRGVHFRRAGPRQKVYFESDEIQAAIVTCGGLCPGLNTVIRELVCSLHHMYGVTRVLGIEGGYRGFYARNTITLTPSSVNNIHKRGGTILGTSRGGHDTNKIVDSIQDRGINQVYIIGGDGTQRGASVIFEEVRRRGLKCAVVGIPKTIDNDIPIIDKSFGFDTAVEEAQRAINAAHVEAESFENGIGVVKLMGRYSGFIAMYATLASRDVDCCLIPESPFYLEGPGGLYEYIDRRLKENGHMVIVIAEGAGQELLTESLQSGKKQDASGNKLLQDVGLWISQSIKDHFAREKTLPITLKYIDPTYMIRAVPSNASDNVYCTLLAQSAVHGAMAGYTGYTSGLVNGRQTYIPFYRITERQNNVVITDRMWARLLSSTNQPSFMEVKVSDEDTKGENSLDELPDGHCSEDTSVDEITHNLGCLAPLAVPVLRTGGISGV

SEQ ID NO: 23955 - protein, 261 aa, Enterococcus faecalis
MAVISMKQLLEAGVHFGHQTRRWNPKMKKYIFTERNGIYIIDLQKTVKLVDAAYDYMKNVAEEGGVALFVGTKKQAQEAIKDEAIRAGQYYVNHRWLGGTLTNWDTIQKRIARLKKINAMEEDGTFEVLPKKEVAGLNKERERLEKFLGGIADMPRIPDVMYIVDPRKERIAVQEAHKLNIPIVAMVDTNCDPDEIDVVIPSNDDAIRAVKLITAKMADAFIEGNQGEDQATEELFVEETPEATSIEEIVDVVEGNNESAE

SEQ ID NO: 23956 - protein, 302 aa, Clostridium perfringens
MKYYNDIRDLIGNTPILKLNNISTKEGVNIYAKIEGTSPGGSCKDRVGIYMVEKAEKEGKLKPGSTIIEATAGNTGIGIALAAINKGYKIIFIVPDKFSIEKQKIMKALGAEIINTPKEEGMEGAINLANSLLSEIPNSLSLNQFKNEANPLAHYETTGRELYDGLDGEIDYFVAGAGSGGTISGVLKFLKENISEVKGILADPVGSIIGGGQCGTYKIEGIGNNFIPETMDMSLVDDVIKVNDEEAFDAVKLLAKKEGLIVGSSSGAAFAAVLKLAEKIEKGNIVTIFPDRGDRYFSTDLF

SEQ ID NO: 23957 - protein, 168 aa, Avena maroccana
VMASSATSVAPFQGLKSTAGLPVSRRSNAGLGSVSNGGRIRCMQVWPIEGIKKFETLSYLPPLSEEALLKQIDFLIRSKWVPCLEFSKVGFIFREHGSTPGYYDGRYWTMWKLPMFGCTDASQVIREVEEVKKEYPDAYVRIIGFDNIRQVQCVSFIAFKPPGCEESG

SEQ ID NO: 23958 - protein, 417 aa, Coccidioides immitis
MAAILKKPLKLALVQLATGPDKAVNLARARSKVLEAARSGASLIVLPECFNSPYGTQFFPHYAETLLPSPPTTEQSPSFHTLSSIAAEAKAYLVGGSIPEYVPETKQYFNTSLVFSPTGSLIATHRKTHLFDIDIPGKIKFKESEVLSAGNKITIVDLPEYGKVGLAICYDIRFPESAMIAARKGCFLLVYPGAFNTTTGPLHWSLLGRARALDNEVYSALCSPARDMNATYHAWGHSLVVDPRGEILVEGAESEDILYADLDQGVIDETRKSIPIYDQRRFDVYPDISKGDVKLEDAKAGKKGGRSAIADVVTREYTIHLHKRVHGVSFKKRAPRAIKEIRAFAENAMGTRDVRLDPQLNKKVWEAGIKGVPFRLRVRISRKRNDEEGAKEKLYSYVQAVNVKDPKGLQTSVIEDA

SEQ ID NO: 23959 - protein, 266 aa, Methanothermobacter thermautotrophicus
MEIHAGVKMKLDDIKISRAIVEGYMEDLLDYMEMDVAIGGGGPSGLTAGYYLARAGLKVALFERKLSIGGGMWGGGMMFNKIVVQDEGREILDEFGIRSEPYDEGYHVADSVEATSTLCSRACQAGLKIFNLMSIEDVMIRDEGITGLVLNWSSVEMAGLHVDPLTVRARAVIDATGHDCEIVKVVERKIGPELNTPDGRIQGERSMWADVGEAALIENTREVYPNLYVAGMASNAVYGAPRMGPIFGGMLVSGRRVAEMIIEKLK

SEQ ID NO: 23960 - protein, 141 aa, Nepenthes distillatoria
  misc_feature (48)..(48): Xaa can be any naturally occurring amino acid
  misc_feature (96)..(96): Xaa can be any naturally occurring amino acid
CLDKAAVVSDKEIKCEDFSNPWRLCTVTQVEELKILIRMFPIWATGIXFSAIYAQMSTMFVEQGEVMDRTIGSFTIPAASLSMFDTISVIFWVPVXDKILVPLARKFTGKQRGFSELQRMGIGLFISILSMAAAALVEMKR

SEQ ID NO: 23961 - protein, 251 aa, Azospirillum lipoferum
GLAMGGNKVGKLGYIVPDAIASGADTLVSIGGVQSNHTRMVAATAAKLGMKCVVVQESWVPHEDAVYDRVGNILLTRLMGADSRIVSDGFDIGIRKSWEDAIQSVKDVGGKPYGIPAGGSVHKYGGLGYVGFAEEVRKQEAELGFKFDYIVVCVVTGSTQGGMIVGFAADDRADRVIGIDASGTPEQTRAQVRQIVDNTAELVELGRKVRDDEIVILEDYAYPAYGVPSAETNEAIRLAARTEAMITYPLY

SEQ ID NO: 23962 - protein, 264 aa, Triticum aestivum
MAVAGCGSREERWSLAGATALVTGGSKGIGHAIVEELAGFGARVHTCSRNAAELEECRRRWEEKNLRVTVSVCDVSVRAQREKLMETVRQTFDGKLDILVNNAGQLLFKPAAECTAEDFSNLMTTNLEASFHLSQLARPLLIHASIAGGGSIINVSSIGGSIAFAGSTVYAITKGALSQLTRNLATEWAPNKIRVNGVAPGFVTTDMIKDVDPEYMKQENSKTPLGRSGKPVEIASAVSFLCMPAASYITGQVICIDGGRTISS

SEQ ID NO: 23963 - protein, 101 aa, Glycine max
  misc_feature (32)..(32): Xaa can be any naturally occurring amino acid
LDRFCDALISIRQEIAEIEKGKADINNNVLSXAPHPPSVLMGDAWTKPYSREYAAFPASWLRVSKFWPSTGRIDNVYGDRNLVCTLLPTSQVVEEQAAATA

SEQ ID NO: 23964 - protein, 264 aa, Burkholderia cepacia
DNCNTGLAFGGNKTRKLEYLVPDALAQHADTLVSIGGVQSNQTRQVAAVAAHLGMKCVLVQEHWVNYDDPVYGRVGNIQLSRMMGADVRLVDDGFDIGIRRSWEEAMESVRQAGGKPYPIPAGCSEHPLGGLGFVGFAEEVRAQEAQLGFRFDYIVVCSVTGSTQAGMVVGFAADGRADRVIGIDASATLERTREQITRIARHTAELVDLGRDIGDRDVVLDTRYAGPEYGLPNDGTLDAIRLCARLEGVLTDPVYEGQSMHGM

SEQ ID NO: 23965 - protein, 579 aa, Desulfovibrio vulgaris
MSGLFKKKETAAQAADTQTQTPTPEAHEWLIPEEGRDQLQKVFAGLPGDVTIEVYTGGDPKNLFDDYARRFVADLALLAPRIKPAFHGLDSDMARKRGVTLSPTLLFNPEEYRIRFTGAPLGEEARAFIEAIFLVSARTSGLSQAAKTILAQLDGARSPRVFSSPGCPYCPAQCANAIKCAIERPDLVSAECVNADEFPDLSARYGVGSVPHTQFDESYKGIGLMPEERFVVELVALKDAERWLNEHAAKGGAHGAGTGQGAGSDAGVEVTETDLLVLGAGPAGLSAAIYAERSGLATVVLDKGIVGGQVTVTPVVENYPGFADIAGIKLVEVLSSHARQYATIRENEGVDDIKLGRRIEVHTPRNVFLARAVLFATGAQWRKLDVPGEDRFYGKGVSYCASCDGFVYRGRKVAVVGGGNTALTDALHLRNLGVEVTVIHRRDTFRAEKALQDSLTREGIPVIWNAVVEEVMGDTEVRGVRLRDTKTGETRDVPFDGVFVAIGHVPNSEQAADLGVDLEPDGSIKVDRHMRTNIPRVYAAGDVIGGVRQIVTAVGSGATAALSAFEDLQQPRWKKDKSA

SEQ ID NO: 23966 - protein, 266 aa, Burkholderia cepacia
CEECNTGLAFGGNKTRKLEYLIPDALAQGADTLVSIGGVQSNQTRQVAAAAAHLGMKCVLVQEHWVNYDDPVYDRVGNIQLSRMMGADVRLVADGFDIGIRRSWEEAMESVRQAGGKPYPIPAGCSEHPFGGLGFVGFAEEVRAQEAQLGFKFDYIVVCSVTGSTQAGMVVGFAADGRADRVIGIDASATPDKTHEQIARIARHTAELVELGRAITDADVVLDTRYAGPEYGLPNDGTLDAIRLCARLEGVLTDPVYEGKSMHAHD

SEQ ID NO: 23967 - protein, 499 aa, Brassica oleracea
MGKVAVGATVVCAAAVCAATVYVVRRRMKSCGKWGRVIEILKVFEEDCATPIGKLRQVADAMTVEMHAGLASEGGSKLKMLISYVDNLPSGDEQGFFYALDLGGTNFRVMRVLLGGKQDRVVKQEFEEVSIPPPLMTGASDELFNFIAEALAKFVATEGEDFHLPAGRQRELGFTFSFPVKQTSLCSGTLISWTKGFSIEDALGQDVVGELIKAMERVGLDMNVTALVNDTVGTLAGGRYYNSDVVAAVILGTGTNAAYVERANAIPKWQGLLPKSGEMVINMEWGNFRSSHLPLTEYDHLLDFDSLNPGEQILEKIISGMYLGEILRRVLLKMAEEAAFFGDSIPPKLKVPFIIRTPTMSAMHSDTSPDLKVVGSKLKDILEVPTTLKMRKVVISLCNIIATRGARLSAAGIYGILKKLGRDAPKDGETTQKSVIAMDGGLFEHYTQFSECMESSLKELLGDEASESVEVIHSNDGSGVGAALLAASHSQYLEDSETS

SEQ ID NO: 23968 - protein, 922 aa, Unknown
  Candidatus Pelagibacter ubique HTCC1002
MSSEKRKIAYIDGKPYEIGPNHTSVLNFVKSYLGEKKVPTLCDDPNLAPYGACRVCSVEVALVKDGPTKVVASCHTPVGENQYIFTNNENLTALRKNIVELVLTDHPMECGTCEVNNNCELQDVANDLGISDHRYNSPKQHKGITKDTSHDYMRMNLDNCINCGRCVRACDEIQGSFVLTMSGRGFESKITTDNDALFGDSSCVSCGACAHTCPTDAISDVYQSKSVAVDKKVRTTCSYCGVGCNLEASIKDNKVVAISTPKESEVNAGHTCIKGRYAFGFYDHPDRLKTPLIKRNGKFEEASWDEAYDFIKKELNRITKESGPDAVAGISSARCTNEENYVFQKMIRAAIGTNNIDCCARICHSPTAWGMQQTFGTGAATNSTEDIYHADLFMVIGANPTNAHPVTGAKIKQQVMKGKKLIVLDPITTELAKLADYHIKLRPGTNVAVLNMMLHFILKANLYDKDFVRDRTEGFANFIKEIERQDMDHLAKVAGVDKQLVKEAAIAYATAKNSMEFHGLGVTEQEQGSKTVMLIADLAMITGNIGRKGVGVNPLRGQNNVQGAADMGCQPHQGAGYFEVADEKVQNFYTEKYGVVHPTKAGLKIPEMFDGAINKEVKAVWIIGEDIVQTDPNSAHVVQAMNSLELLVVQEIFMSETAKLATVVLPGTTFLEKNGTFTNTERRIQRVNRAVPPLPGTKTDGTIVTDMMQKLGFDQPEYDADQVLAEIADVVPFFKGVTRERLGKMGLQWPVQEDGTDTQILHQETFKLGKGRLKNFDWKESTEIETNKKEYPLILTTSRVLQHYNAATMTRRTSNINIVSEDLLLVHPNDANKRELNTGDIGRLYSGRGEVALKVEVTDKVKEGIVFTTFHFPEHMVNMVTGHGKDEETMCAEYKVSAVEVQKISNQFKTEIKPKENQAEVN

SEQ ID NO: 23969 - protein, 410 aa, Pseudomonas sp.
MATHVAIIGNGVAGFTTAQALRAEGFEGRISLIGNEPHLPYDRPSLSKAVLGGSLEHPPVLAEADWYGEARIDMLSGRSVTNLNVDARTISLDDGSTFAADAIVIATGSRARTLALPGSQLTGVVTLRTYDDVRPLCRGWTPATRLVIAGGGLIGCEVATTARKLGLAVTILESADELLVRVLGRRIGAWLRGLLTELGVRFELGTGVAGFSGDDRLEEVLASDGRRFAADNALVCIGAEPEDQLARQAGLSCDRGVIVDDHGATHAEGVFAVGDAASWPLRDGGRRSLETYMNAQRQAAAVAAAILGKHGSAPQVPVSWTEIAGHRMQMAGDIEGPGEFVLRGTLGDGAALLFRLRDGRIQAVVAVDAPRDFAMAPRLVEARAAIEPARLADFSNSMRDLVRAQQGDSA

SEQ ID NO: 23970 - protein, 499 aa, Brassica oleracea
MGKVAVGATVVCAAAVCAASVYIVRRRMQSSGKWARVIEILRVLEEDCATPIGKLRQVADAMTVEMHAGLASEGGSKLKMLISYVDNLPSGEEHGFFYALDLGGTNFRVMRVLLGGKQGRVVKQEAKEVSIPPHLMTSGSDELFNFIAEALANFVATEGEDFHLPEGRQRELGFTFSFPVKQTSLSSGTLIKWTKGFSIEDTVGQDVVGALVKAMERVGLDMNVTALVNDTVGTLAGGRYYNPDVVAAVILGTGTNAAYVERAHAIPKWHGLLPKSGEMVINMEWGNFRSSHLPLTEYDHLLDFDSLNPGEQILEKIISGMYLGEILRRVLLKMADEAAFFGDSVPPKLRIPFIIRTPNMSAMHSDTSPDLKVVGSKLKDILEVPTTSLKMRKVVVSLCDIIACRGARLSAAGIYGILKKLGRDAPKDGETQKSVIAMDGGLFEHYTQFSECMESSLKELLGDEASDSVEVIHSNDGSGVGAALLAASHSQYLDDSQTS

SEQ ID NO: 23971 - protein, 309 aa, Prochlorococcus marinus
MTATISRPKISNWETSNIPNLTGKIALITGANSGLGYYTAKALAEKNAHVVIACRSLEKANQTIKKLKGLNPEGLFTPLELDLSDLKNIVEVQSKIFDNFENLDLLINNAGIMHPPKTLSAQGYEIQFAVNHLAHMLLTLKLLPIIEKKEESRIVTVTSGAQFFGKVGWKNLKAENYYNKWESYSNSKLANVMFALELNENLKHKNILSLAAHPGIAKTNLFTAQKPNPGPLETFSLELFSPIFQTAEMGALPQLFAATSPDARGGDHYGPRFNFRGHPKLSPTSPFAMNKKERKNLWEKSLEIINNFL

SEQ ID NO: 23972 - protein, 285 aa, Xylella fastidiosa
MTTNDTWFTEHFQATGSAIGFRVTGKLDEVQSPFQKIEIYNSTDWGKLMVIDGALMLTSRDNFLYHEMISHPALFTHTAPKCVVIIGGGDCGTLREVLKHPDIEQVTQCDIDEQVTRMAEKHFPELCTSNNDPRATLLFSDGVAYMADCPTNSVDVIIVDSTDPVGPAKGLFNRTFYESCFRALKNDGLLIQQSESPLALLELIKEMRHEMSKAGFKAFKTLPFPQPCYPTGWWSVTLSSKQPNANFAFRQTDAQTKPFDTLYYNAHLHHGVLVPPPFIAHALGE

SEQ ID NO: 23973 - protein, 578 aa, Coprinopsis cinerea
MASTASSPPSESTTSSSPVTTIEAPVQSTTGQPQSANEQQPQPPQQGRQNQFHPPAKRILIPDQLTAFQNSQTHADIVEFITRLNKSVKGAKLSDRFEGEGRPIIQAILKILDEVQQIAKETPPIENPGSRFGNPAFRTFYDRVGEATEPLHTTHLVPLGLPPASIPEIGTYFKECWGNRTRIDYGNASNTTSPSSTGTSSSTSPSPAEDLATPLVLRIFWTYIQTMRLLQSQYWLEPAGSHGHKFIRPRAIHDAEVVEEYAKDYMYFACIAFINSIKTASLRWHSPMLDDISAVKTWDKVNEGMIKMYKAEVLGKLPVMQHFLFGSLLPFPVYVPSTEAGSVVAPSVPNASAIVVPSSASPSASSSTTSSAPTRGAPDGKEGDKKEHVHDPNCLNAVGVGGGPEAQGHAHHAHSHVPRNIHPKVLASLKARGEVVEGLGGGHGHREYEEAIERFQNAPSEREAEDAEDAKSKLHDVVLVCVVIVLAATGPFSECSAGKEWAQLSKSEVTPASTSTRTSDYALLPTSGHHPKDAFRSGFCVGAFVRFGQPPWSEDFSRFADDVAPAPPPLHYNYNDCY

SEQ ID NO: 23974 - protein, 478 aa, Parvularcula bermudensis
MTDPVILWLREDLRFDDNPAMREAAASGAPVLCLYVLDDATAGDFAMGAAQRWWLHHSLCAFKEDLETRGGALILRRGKETEIVPALAKEIKASHVFWNRRYMKWQTDPDTEIKSALQDMGIKGISCNGRLLYEPWEIETKSGDPYKVYTPYWKSLQQKEGPRAALPRTDKLNAPPSLPSTDRLDDWNLLPRSPNWAEGFEPVWTPGEKGARARLRAWLDTDAASYDDCRNRPDQDRTSRLSPHLHFGEISPVVLWHSVSDAMEAGDIPKDQGTSFLSEIAWREFSYQLLYYHPTMRDQPLMEKFTDFEWDTDKKALNAWQRGRTGYPIVDAGMRQLWTEGWMHNRVRMIVGSFLVKDLLLDWRDGMRWFWDCLVDADPANNTASWQWIAGCGADAAPFFRIFNPTTQSEKFDPDGAYIRRYVPELRDLPTRFIHEPRKASTAILKDAGIVLGETYPDPIVDHSDRRKQALSRYEAIK

SEQ ID NO: 23975 - protein, 565 aa, Unknown
  Candidatus Kuenenia stuttgartiensis
MQISKGSIALSIVLLEHPRLNNSVRCEEVVNAPLSACLFTGYIASVLRENKLTVEVANAHLYDWSIEETITHIIANKQLQLLCVHTVYLWERTMDIFDMLSTLKTANEALHINLYGYFPTFAYKNILTDYPFVDSVTVGEPEFTTLDLARGIVSENRTSTEIQGSNTLLKKKRNPLSCPPLANPGNEVRRSVFPDGMNIAGLASKDKDGRVVFTPRPPIHNLDQLPYPCRQDVTLCQKKGIVTYIQGSRGCYGHCAFCYLNPFYEQTSLWRGRSANNIFDEIFKLHTKYSIENFYFSDANFFGPGKYGSERASALADLILANGLNIRFGFECRVNDIEEKTIEKLVMAGLANVFLGLESGDDNSLKRFKKHTTSEENKKAIRLLRNYGIEPTFGFIMFEPHATMQSIRNNFEFLKETGIMTSPAVTAHLLHHRQTVFQGTPAYQSMMQSQTKLDDSFSPYEIFYKIKDLKADAFSVIITNICKDILALLPHTFVECNDMLSDTRFDYPLLKKLNDALITAFEDILHKFESASIVPNGEYFHSTHREIINDIQSLLLHANALHETK

SEQ ID NO: 23976 - protein, 322 aa, Vernicia fordii
MGMVEVKNEEEVTIFKSGEIYPTNIFQSVLALAIWLGSFHFILFLVSSSIFLPFSKFLLVIGLLLFFMVIPINDRSKLGQCLFSYISRHVCSYFPITLHVEDINAFRSDRAYVFGYEPHSVFPIGVMILSLGLIPLPNIKFLASSAVFYTPFLRHIWSWCGLTPATRKNFVSLLSSGYSCILVPGGVQETFYMKQDSEIAFLKARRGFIRIAMQTGTPLVPVFCFGQMHTFKWWKPDGELFMKIARAIKFTPTIFWGVLGTPLPFKNPMHVVVGRPIEVKQNPQPTAEEVAEVQREFIASLKNLFERHKARVGYSDLKLEIF

SEQ ID NO: 23977 - protein, 253 aa, Brassica napus
  misc_feature (239)..(239): Xaa can be any naturally occurring amino acid
MGRFDEAFIQAPEHRPINHLTNSGEFIFSDEIPTIDLSSLQDPNCDKTTIATEIGKACERWGFFLVINHGLPLDLRRRVENTAAEFFNLTAEEKRRLRRDEVNPMGYHDEEHTKNVRDWKEIFDFFLQDPTIVPATPEPEDTDKRKLTNQWPQHPSDFREICQEYAREVEKLAFKILELISISLGLPGDRLSGYFKEQTSILRFNHYPPCPNPELALGVGRHKDGGALTVLAQDSVGGXQVGRRSDENDPSET

SEQ ID NO: 23978 - protein, 406 aa, Bacillus subtilis
METPRKILLMVKAGTATDATIQSLLPHLEKDDILIDGGNTYYKDTQRRNKELAESGIHFIGTGVSGGEEGALKGPSIMPGGQKEAHELVKPILEAISAKVDGEPCTTYIGPDGAGHYVKMVHNGIEYGDMQLISESYFILKQVLGLSADELHEVFAEWNKGELDSYLIEITADIFTKKDEETGKPLVDVILDKAGQKGTGKWTSQSALDLGVPLPIITESVFARFISAMKEERVKASGLLSGPEVKPVTENKEELIEAVRKALFMSKICSYAQGFAQMKAASEEYNWDLKYGEIAMIFRGGCIIRAAFLQKIKEAYDREPELDNLLLDSYFKNIVESYQGALRQVISLAVAQGVPVPSFSSALAYYDSYRTAVLPANLIQAQRDYFGAHTYERTDKEGIFHTEWMK

SEQ ID NO: 23979 - protein, 674 aa, Unknown
  Synechococcus sp. WH 8102
MCGIGGVFLADRHQTLDRQLLVNMAAIQSHRGPDGFGVECLDAAGVGFCHARLSIIDLNESRARQPFLSNDRQVLMAHNGEFYDFQRIRADLTAQGVRFSSKSDSEILLRLYQRQGLESTLPLLRGEFAFALFDAADDCLYLVRDRFGIKPQYWTMTPEGLVFGSELKVLFAHQAVERRFTSEGLFHQLMQTMVPGTTAFAGVHQVQPGHVLKVQRRSDRLEVSESTYWDVDFPRLDQRDSTLTEADHIANVRAALLEAVEMRMVADVPVGCYLSGGIDSCSILGLASAVSQGPVKAFTIGFDDARYDETPIAAEMAEATGAEQDVMRLSGRELYGHMEQTLWHTERTIYNTLAVAKYLMSRHVNSVDYKVVMTGEGSDELFGGYPAFRRDMFLHGLEDLPQSDRQDWESLLQTNNSLVQGAMLAADQVDDPDLDAVVGFTPSCLQPWLACAPLVPDLLADEHRQALVEYSPGKAIAEQLNPQQLDGRHALDKAQYVWIKTMLEGQILTWGGDRVDMANSMEARPAFLDHHLAAAAVQVPPELRIKGKTEKYVLREAMAGLLPEVLYKREKFAFMAPPAHTEPEKWAQMKQLADDYLSDEAIDAAGLLSKEGVRALFARHDDPATTDAERVQMDAVINHLLGVQMLHRMFVAADVPAQAREQADRLGWRVLMPV

SEQ ID NO: 23980 - protein, 606 aa, Aspergillus oryzae
MNSKLPGLSMQTVVTELDLTYRRRFSDLKIPEAYESLILDALKGDHSNFVRDDELDASWRIFTPLLHYLDDNKEIIPMEYPYAARWVGSPSIKGRTEAMRMALLTFSLLGLQFTWGIEMTYRSRSKWGRRRPFMIIGSLIVAMCLLVLGWTTEIVGLFVKDAEKANRVTIALAVLSIYAVDFAINIVQACCRSLIVDTLPIPSQQAGSAWATRMSAIGQLISYVIGSIDTVSIFGTTIGDTQFKQMTVIAALSLLIAVLVTCYAVKERVLITARDSEGKAGAFQVMSQLFKTTMDLPPRIQAICWAQFWAWIGWFPFLFYSTTWVGETYFRYEVPKDATHPTDMLGEVGRVGSLSLVVFSSITFFSSVLLPFCVQPPDDRRPRFTPRPPPGIAALLKKITLIRPDLQTTWLISHVMFAATMIFAPLARSRAFATFLVALCGIPWAVSSWAPFAFMGVEINKLALGPTQASRLSGVTMITSSSIRSGAYSDRSGDTEMDVLRLNHNDTDSDSDTEGGASDLPSTGELAGIYLGVLNVYTTLPQFVGTFISWIVFSVIEPGSTKRDASETQWINLDKGSPNAISICLFIGALSTLVAIEATRRLRHVR

SEQ ID NO: 23981 - protein, 419 aa, Yersinia pseudotuberculosis
MNLLEHMGKAAKQASWQLAMLSTAKKNQALAVIANLLESESQTILQANERDMAAARESGMSEALLDRLLLTPARLAAIANDVRQVCRLNDPVGRVIDGSLLDSGLKLERRRVPLGVIGVIYEARPNVTIDVASLCLKTGNAVILRGGKETHHTNQATVNVIQRALEQCGLPAAAVQAIESPDRQLVNELLRLDRYVDMLIPRGGASLHKLCREQSTIPVITGGIGVCHTFVDENADFEKALLVIENAKIQRPSACNSLETLLVHQAVAKTFLPLLSARMHAFGVTLHASPLAMPYLADGKAKVVAVEAADYDDEWLSLDLNVDIVTDIDAAIDHIREHGTSHSDAILTRSLSHAEYFVRAVDSSAVYVNASTRFTDGGQFGLGAEVAVSTQKLHARGPMGLDALTTYKWIGYGDDLVRS

SEQ ID NO: 23982 - protein, 189 aa, Brassica rapa
MVEVEELEPLSPVEDGDEGEEEEEEDISYDDLKRRMWKDQNLMEKLKQQKRDNTDVVSLPTHRAEASRRKKMARSQDSVLKYMMKIMEVCKAKGFVYGIVPEKGKPITGSSDSLRRWWKENVDFDQNAPNAVAGYLTLAAAAAELIEKEPSSLLHMLQELQDTTLGSLLSALMQHCAPPQRRCKLEKIL

SEQ ID NO: 23983 - protein, 380 aa, Coccidioides immitis
MGKSSKDKRDAYYRLAKEQNWRARSAFKLIQIDEQFDLFAHSDPDSVTRVVDLCAAPGSWSQVLSRVLIKGESFGRRAWEEKRKKQLRDLRRCEEETGRESFSEETQKKGDIDEDGSQILKPRKNVRIVAIDLQPMAPLDGITTLKADITHPSTIPLLLKALDPDLYSENENGNTSTPSPSRPHPHPVDVVLSDGAPDVTGLHDLDIYIQSQLLYAALNLAIGVLRPGGKFVAKIFRGRDVDLIYAQLKTVFEKVSVAKPRSSRASSLEAFVVCEGFIPPVDSSGESRASFENPIFGGARSGVPATAEATEVDNIRWIPPFIACGSLSAWDADASYELPPDHVSLDPIQPPTAPPYKRALELKKAKGGAYGKTKGVVYEF

SEQ ID NO: 23984 - protein, 314 aa, Medicago truncatula
MMMDEGEGKKKVVVQKTEACGFMAGVEDELGFVNVKGDNNNGSGQRIHHDHGFVAAAFGTVHRKKRMARQRRSSSSTITIHLKNLPSSTTTTTTTTTSHVPISPIPPLFHSLPPAREIDHRRLRFLFQKELKNSDVSSLRRMVLPKKAAEAFLPVLESKEGILLSMDDLDGLHVWSFKYRFWPNNNSRMYVLENTGDFVSTHGLRFGDSIMVYQDNQNHNYVIQAKKACDQDEYMEEANDTINHIFVDDYEVNKSCFDVAYPAMNDTSMSFIYDTTISNDSPLDFLGGSMTNYSRIGSVETFGSVENLSLDDFY

SEQ ID NO: 23985 - protein, 288 aa, Escherichia coli
MAEKKQWHETLHDQFGQYFAVDNVLYHEKTDHQDLIIFENAAFGRVMALDGVVQTTERDEFIYHEMMTHVPLLAHGHAKHVLIIGGGDGAMLREVTRHKNVESITMVEIDAGVVSFCRQYLPNHNAGSYDDPRFKLVIDDGVNFVNQTSQTFDVIISDCTDPIGPGESLFTSAFYEGCKRCLNPGGIFVAQNGVCFLQQEEAIDSHRKLSHYFSDVGFYQAAIPTYYGGIMTFAWATDNDALRHLSTEIIQARFLASGLKCRYYNPAIHTAAFALPQYLQDALASQPS

SEQ ID NO: 23986 - protein, 376 aa, Unknown
  uncultured archaeon GZfos17C7
MAGVRDISKAKRIVIKVGTSNLTDTSYRLDPRKVEKLAKEIIELKNEGKEVIVVTSGAIGAGIGKLDLKQRPRDIKVLQATAAVGQNILMSTYDRYFAKYEQTIAQLLLTHDNFFNRQRYLNLRNTLITLLKSGVIPIINENDTVAVDEIKLGDNDNLSALVASSLGADLLIILTDIDGLYTYDPKRSEKAEFISVVEDITPEIERIASGRGKTGVGGMKTKVQAAEVTMKAGIPMIIANGGEENILSRVIAGEPVGTLFMPKKKRMNDKEHWILFSASPKGKIKVDEGAKTALVEGGGSLLPSGITDVEDEFMRGDPVSIVDARSVEFARGITNYSSAEIKKIKGVQSKEIEQILGRKDYGYGEVVVYRGNLVLL

SEQ ID NO: 23987 - protein, 385 aa, Guillardia theta
MNHNIKVFKRAETFEEMELKRELLKGIYGYGFERPSFIQQRGILPIINKEDVVAQSQSGTGKTATFVIGTLQNLSNIENKIKNLVLVPTRELATQVEQVFKSIGFFMKIKTQLLTGGDRIQITNKEQYKKPQIVIGTPGKVLDSLSKKTYYIENLEYLVVDEADEMFSRGFKIQVLKIIKYLPLEAKIALFSATMPIETLEIVELFMTNPVKILVKKDELTLEGIKQFYIAIEKEEWKLDSVIEIYSKIKITQSIIYVNTRRKTEWLANIMKKYGFDVGYLHGEMLQIDRSSVMKDFRSGLFRILISTDLVSRGIDIQQVCLVINYDLPKLKEVYIHRIGRSGRFGRKGVAINFLSRSDVSILRSIEGYYNTNIEEMPNDISEFL

SEQ ID NO: 23988 - protein, 485 aa, Pseudomonas syringae
MSEEILINITPMESRVAVVENGVLQEVHVERTQRRGIVGNIYKGKVVRVLPGMQAAFIDIGLDRAAFIHASEISMREGPAVESIASLVHDGQSLVVQVTKDPIGSKGARLTTQLSIPSRYLVYMPRTAHVGISLKIEDEAERERLKKVVSDCVALEGIKEAGGFILRTAAEGAGADEILMDIRYLRRLWDQIGEQIKTVSPPTVIYEDLGLALRTLRDLVSPRIEKIRIDSRETFQKTTQFVAELMPEIADRLEHYPGERPIFDLYGVEDEIQKALERKVPLKSGGYLVVDPAEAMSTIDVNTGAFVGHRNLEETIFKTNLEAATAIARQLRLRNLGGIIIIDFIDMEDGEHQRQVLRTLEKQLERDHAKTNIIGITELGLVQMTRKRTRESLEQVLCEPCHCCAGRGKLKTPETICYEIFREILREARAYRAVGYRVLANQRVVDRLLDEESGNVAELESFIGRTIRFQVETMYSQEQYDVVLL

SEQ ID NO: 23989 - protein, 228 aa, Nepenthes mapuluensis
  misc_feature (1)..(2): Xaa can be any naturally occurring amino acid
  misc_feature (6)..(7): Xaa can be any naturally occurring amino acid
  misc_feature (9)..(9): Xaa can be any naturally occurring amino acid
  misc_feature (18)..(18): Xaa can be any naturally occurring amino acid
  misc_feature (32)..(32): Xaa can be any naturally occurring amino acid
  misc_feature (48)..(48): Xaa can be any naturally occurring amino acid
  misc_feature (59)..(59): Xaa can be any naturally occurring amino acid
XXGWAXXFXIPAISMGIXITSFFSGTALYRLXKPGGSPLTRMCQVLVXSFRKSRLALPXDSSLLYETSDKNSVIEGSRKLEHTNELKCLDKAAVVSDKEIKCEDFSNPWRLCTVTQIEELKILIRMFPIWATGIIFSAIYAQMSTMFVEQGEVMDRTIGSFTIPAASLSMFDTISVIFWVPVYDKILVPLARKFTGKQRGFSELQRMGIGLFISILSMAAAALVEMKR

SEQ ID NO: 23990 - protein, 411 aa, Oryza sativa
MNALAATSRNFRQAARLLGLDSKLQKSLLIPLREIKVECTIPKDDGTLATFVGFRVQHDNSRGPMKGGIRYHPEVDPDEVNALAQLMTWKTAVAAVPYGGAKGGIGCTPGELSRSELERLTRVFTQKIHDLIGINTDVPAPDMGTNAQTMAWILDEYSKFHGHSPAVVTGKPIDLGGSLGRDAATGRGVMYATEALLTEYSESISGSTFVIQGLGNVGSWAAKLIHQKGGKIVAVGDVTGAIRNKSGIDIPALLKHRSEGGSLEDFYGAEVMDAAELLVHECDVLVPCALGGVLNRENAAEVKARFIIEGANHPTDTEADEILAKKGVIVLPDIYANSGGVVVSYFEWVQNIQGFMWDEEKVNRELQKYMKNAFQNIKDMCKSQNCNLRMGAFTLGVNRVAKATLLRGWEA

SEQ ID NO: 23991 - protein, 224 aa, Nepenthes madagascariensis
  misc_feature (13)..(13): Xaa can be any naturally occurring amino acid
  misc_feature (32)..(32): Xaa can be any naturally occurring amino acid
  misc_feature (51)..(51): Xaa can be any naturally occurring amino acid
  misc_feature (62)..(62): Xaa can be any naturally occurring amino acid
  misc_feature (107)..(107): Xaa can be any naturally occurring amino acid
  misc_feature (131)..(131): Xaa can be any naturally occurring amino acid
  misc_feature (136)..(136): Xaa can be any naturally occurring amino acid
  misc_feature (157)..(157): Xaa can be any naturally occurring amino acid
  misc_feature (213)..(213): Xaa can be any naturally occurring amino acid
NLGWALGFGIPAXSMGIAIASFFSGTALYRLXKPGGSPLTRMCQVLVASFXKSKLTLPEDSXLLYETSDKNSVIEGSRKLEHTDELRCLDKAAVLSDKEIKCEDFSXPWRLCTVTQVEELKILIRMFPIWXTGIVXSAIYAQMSTMFVEQGEVMDRXIGSFTIPAASISTFDTISVIFWVPVYDKILVPLARKFTGKQRGFSELQRMGIGLFXSILSMAAAALV

SEQ ID NO: 23992 - protein, 439 aa, Xanthomonas axonopodis
MSSTVPPLSFARILALNAGFFGVQYSFGLQQSNMSPIYNYLGADHANLPYLWLAGPITGLVLQPFVGAWSDRSVTRWGRRMPYMVLGALVCSLCLLAMPFSTALWMAVCLLWVLDAANNVAMEPYRALVSDVLTPPQRPLGYLTQSAFTGLAQTLAYLTPPLLVGMGMNQDAANAHHIPYVTIAAFVIGAGFSAGSILLTARSVREPAIAPAEIARIRQSGAGLGATVREIGSALREMPPTMRQLAPVMLFQWYAIFCYWQYIVLSLSTTLFGTTDPTSHGFREAGLVNGQIGGFYNFVAFLAAFAMVPVVRRFGPKYTHAACLVAAGIGMWLLPGIENRWLMLLPMIGIGLAWASMMGNPYLMLADSIPPERTGVYMGLFNLFIVLPMLIQIVTLPLYYEHVLHGDPRNVVRLAGALMLAAAAAMLCVRLRKPKAVAA

SEQ ID NO: 23993 - protein, 502 aa, Propionibacterium acnes
MTHTTQRSHEDNPQGPKVSVTRDDPRAATIEEIQPIVDRGDQGYAETLTNRQVQMMAIGGAIGVGLFLGAGSRLRSAGPAVLISYAFCAVIAFLVMRALGELVIHRPSSGSFVSYARELLGDRWAYAVGWMYMLNWMTSGIAELTAIGTYLQFWWPSLPMWVPSLVALMILVSVNLISVKAFGEFEFWAALLKVVALTAFIIVAIGLVASHVNVGGHRAAVSNLWRFDGGFAPQGVLPLILVIQGVIFAYATIELVGTASGETQNPRKVIPKAVHAVVFRLVVFYLGSLALLAMLLPYKEYSADESPFVTAFSAMGVGWIGDAMNIVVITAAFSSVNSGLYATGRVLKSLAAAGEAPKFAGTLNRFKTPAGGILMTASVFLLGVGLEYVVPERAFEISINTAAVGVIWTWATIFWCQLVLRRRVNEGRITDSGFHMPGYPITGIFGIVSLAGVTALMVLDPQNRIVLAAALVYIAVMLVAWPAVKRNKARHPELNAQEDITF

SEQ ID NO: 23994 - protein, 235 aa, Nepenthes khasiana
  misc_feature (7)..(7): Xaa can be any naturally occurring amino acid
  misc_feature (9)..(9): Xaa can be any naturally occurring amino acid
  misc_feature (32)..(32): Xaa can be any naturally occurring amino acid
  misc_feature (37)..(37): Xaa can be any naturally occurring amino acid
  misc_feature (39)..(39): Xaa can be any naturally occurring amino acid
  misc_feature (44)..(44): Xaa can be any naturally occurring amino acid
  misc_feature (69)..(69): Xaa can be any naturally occurring amino acid
LIVWVQXNXGWALGFGIPAISMGIAIASFFSXTALYXLXKPGGXPLTRMCQVLVPSFRKSKLALPEDSXLLYETSDKNSAIEGSRKLEHTDELRCLDKAAVLSDKEIKCDDFSNPWRLCTVTQVEELKILIRMFPIWATGIVFSAIYAQMSTMFVEQGEVMDRTVGSFTIPAASLSTCDTISVIFWVPVYDKILVPLARKFTGKQRGFSELQRMGIGLFISILSMAAAALVEMKR

SEQ ID NO: 23995 - protein, 360 aa, Synechococcus elongatus
MAVRKLGVLTSGGDCPGLNAVIRAIARHAVGNYGWELWGIAYATQGLLKRQAIALSPHHFDRQSLDPLLCSGGTILGSINRGDTLAHQAEILAGYQELGLDALIGIGGDGSLAILRQLAEAGRWQFIGIPKTIDNDVALTERAIGFDTAIHTVAEALLSLGSTAASHDRIMIAEVMGRQSGHLALQGGIAGGADVILLPEIPYRLLELCHYLQQLRDRWQRRYAVIAIAEGTHHPPEVTQGPGSLGEQLVQAITAQDPTLDARVTVLGHVQRGGNPVASDRLLATQMGYAAVERLAAGASGEMMAWQGGRVVSVPLEAVCLQSPTLVDPHSPLVDTAAGLGIFLGDRSLTPWRGSACPTH

SEQ ID NO: 23996 - protein, 223 aa, Nepenthes pilosa
  misc_feature (223)..(223): Xaa can be any naturally occurring amino acid
LGWALGFGIPAISMGIAIASFFSGTALYRLQKPGGSPLTRMCQVLVASFRKSKLALPEDSNLLYETSDGNSVIEGSRKLEHTNELKCLDKAAVVSDKEIKCEDFSNPWRLCTVTQIEELKILIRMFPIWATGIIFSAIYAQMSTMFVEQGEVMDRTIGSFTIPAASLSMFDTISVIFWVPVYDKILVPLARKFTGKQRGFSELQRMGIGLFIAILSMAAAALX

SEQ ID NO: 23997 - protein, 503 aa, Unknown
  Burkholderia sp. 383
MTHNSERPADPAGGADSRHADPDAMFASHEAGYAKQLKPRHVQMIAMGGAIGTGLFLGAGGRLQHAGPALALVYLVCGVFAFLIMRALGELVMHRPTSGSFVSYAREFMGERASFVAGWMYYLNWATTGIVDITAVAIYMKYWAVFTDVPQWVFALGALGIVSVMNMIGVKVFGEMEFWFSIVKVGTLAVFLAVGAVFLASGHPVAGQMPGLHLVADHGGIFPHGILPAVLIVQGVVFAYASIELVGVAAGETADARKVLPKAINSVMWRIALFYVGSVVLLTMLLPWTAYSAHESPFVTFFSKLGVPYVGTVMNVVVLTAALSSLNSGLYSTGRVLRSLAMGGSAPRFVSRMNARGAPYGGILITVAINAIGVPLNYIVPAQAFEIVLNMASLGIITTWGFIVMCQILFRRAVDRGELKAVSFRMPGAPFTSWLTLAFLVGVLVLMAFDYPGGTWTIATIPVVVLALVVGWKLAKRGAAREQVADARASAATHAVADPARGA

SEQ ID NO: 23998 - protein, 234 aa, Nepenthes insignis
  misc_feature (12)..(12): Xaa can be any naturally occurring amino acid
  misc_feature (15)..(15): Xaa can be any naturally occurring amino acid
  misc_feature (219)..(220): Xaa can be any naturally occurring amino acid
IVWVQENLGWAXGFXIPAISMGIAIASFFSGTALYRLQKPGGSPLTRMCQVLVASFRKSKLALPEDSNLLYETSDENSVIEGSRKLEHTNELKCLDKAAVVSDKEIKCEDFSNPWRLCTVTQIEELKILIRMFPIWATGIVFSAIYAQMSTMFVEQGEVMDRTIGSFTIPAASLSMFDTISVIFWVPVYDKILVPLARKFTGKQRGFSELQRMGIGLFXXILSMAAAALVEMKR

SEQ ID NO: 23999 - protein, 417 aa, Desulfitobacterium hafniense
MDFAPELITIGQKAKDAARKLAYAGTAAKNKALLAMAEALLNHEQKILEANRKDVEAAIQKGTKKSLVNRLALTSEGIRQMSDALKEVVNLGDPVGEGEFWTRPNGLRIQRTRVPLGVVAMIYEARPNVTVDAAALCLKSGNAVILRGGSEAIESNKILSKVIAGAAESQGMPTACIQLLENTNRQWVQQLMKMNGYVDVIIPRGGAGLIETVVKEATVPVIETGTGVCHAYVDGEADLAKGVSIVFNAKTQKPGVCNALEAVLVNEAVAQEFLPLLGEKFRDYGVEIRGCEKTCAILPYAAKATEEDWGTEYLDLIISAKVVQGVDEAMDHIYQYGTKHSETIITENYTTAQRFLNEVDAAAVYVNASTRFTDGGRFGFGAEIGISTQKLHARGPMGLQALTTMKYMVYGEDHIVT

SEQ ID NO: 24000 - protein, 216 aa, Agrobacterium tumefaciens
MFLFDTLSKKTTMPTEETALPGREEALAVPETHFVNGRPLKGPYPDGLEIIYLGMGCFWGAERLFWKTPGVWVTAVGYAGGFTRNPTYHETTTGQTGHAEVVKVVYDPAVISLSGLLKIFFEEHDPTQGMRQGNDVGTTYRSAIYATTEGQLQQAQKARDAFQQALDEAGHGHAITTEIGPLETFYYAEDYHQQYLAKNPGGYCGLRGTGVSCNIG

SEQ ID NO: 24001 - protein, 372 aa, Thermoanaerobacter tengcongensis
MRIVVKVGTSTLTHENGKLNLEIMEKLVRQIANLSNKGEEVILVTSGAIGAGMGKLNLTEKPKNLPQKQALAAIGQGLLIEIYEKFFNEYGKITAQLLLTREDFSDRKRYLNMSYTLSNLLKWGVIPVINENDTVAVEEIKIGDNDTLAALVASLVEADLLIILTDIDGLFDKDPRIYKDAKVIEVVEEFSDDLFKIAGGAGTKRGTGGMYTKIQAAKICYNSGVKMVIANGKIDNVLNRIAAGEKIGTTFLPMKNPISSRKIWIAFNAKVNGFLFVDEGAAKALVKHGKSLLPSGIVKTEGQYDVGDCVAVVDHQGREIARGLVNYSSEEVEKIKGCKTHDIESILGYKYYDEVIHRDNLVVLERGEKYGG

SEQ ID NO: 24002 - protein, 414 aa, Thermoanaerobacter tengcongensis [sequence omitted]

SEQ ID NO: 24003 - protein, 472 aa, Bacillus cereus
MNHLRGGSEVANKELKRGLEARHIQMIALGGTIGVGLFMGSASTIKWTGPSVMLAYAIAGIFIFFIMRAMGEMLYMEPSTGSFATFGHKYIHPLAGYMTAWSNWFQWVIVGMSEIIAVGAYMQYWFPDLPAWIPGVIAMVILGAANLISVKSFGEFEFWFAMIKIVTILLMIIAGFGLIFFGIGNGGEAIGISNLWSNGGFFTGGFSGFFFALSLVVGAYQGVELIGITAGEAKDPKKTLTRAIQSTIWRILIFYIGAIFVIVTVYPWDQLSTIGSPFVATFAKVGITAAAGLINFVVITAAMSGCNSGIYSAGRMLYTLGVNGQAPKYFTKLSGNGVPLFGTVGVIIGLAIGVVLSYIAPKNLFVYVYSASVLPGMVPWFVILISQINFRKEKGAEMKDHPFKMPFAPVTNYLTIAFLIMVLIGMWFNDDTRISLIVGIIFLAIVTISFYAFGIGKRTPLDVQNDQEISSK

SEQ ID NO: 24004 - protein, 147 aa, Ralstonia metallidurans
MSTESTNPPDGQSNQPEEQREQITAYELIGGEARVRELVDRFYDLMDLETEFAGLRALHPPSLEGSRDKLFWFLCGWLGGPNYFIERFGHPRLRARHLPFEIGTSERDQWMRCMALAMQDVGLSEDLQMRLMQALFQTADWMRNVQR

SEQ ID NO: 24005 - protein, 263 aa, Brassica napus
MENNDKRWSLAGKTALVTGGTRGIGRAVVEELARFGATVHTCSRSQEELKSCLDDWKSNGLVVTGSVCDASDRDQREKLIQEVSSAFSGKINILVNNVGTNLRKPTVEYSSEDYAKIMSTNLESAFHFSQLAHPLLKASGVGSIVFISSVAGLVHLSSGSVYGATKGALNQLTRNLACEWAGDNIRTNCVAPWYIKTSLVKPLLEKKGFEEAIVSRTPLGRVGEPEEVSSLVAFLCLPAASYITGQVISVDGGFTVNGFSYTM

SEQ ID NO: 24006 - protein, 293 aa, Unknown
  Mesorhizobium sp. BNC1
MTEAQQRRALLLVNNKARRGQEAIEPVMQRLQQGGLSVAFEPFEALPEIARDIMRLRKRADLIVVGGGDGSVSSAALAVMESGLPMGIIPLGTANDLARTLDIPMDLTAAADVIVKGKERRVDVGTVNGHAFFNVASIGLSSELAKGLDPALKKRFGRLGYAIAALRVLAKSGHFKARIVEKGQAIEVDTYQIAVGNGVHYGGGNVVQEDAEIDDGHLDLYSLEMKNLWKLALMLRSFRTGKHGAWNEVRTAKCVEFDIETEAPMPVNADGEIVTSTPAHFKVHPKAISVFAP

SEQ ID NO: 24007 - protein, 184 aa, Saccharomyces cerevisiae
MSSLISKTIKYDPAKDKLITLACGCFWGTEHMYRKYLNDRIVDCKVGYANGEESKKDSPSSVSYKRVCGGDTDFAEVLQVSYNPKVITLRELTDFFFRIHDPTTSNSQGPDKGTQYRSGLFAHSDADLKELAKIKEEWQPKWGNKIATVIEPIKNFYDAEEYHQLYLDKNPQGYACPTHYLREM

SEQ ID NO: 24008 - protein, 384 aa, Schizosaccharomyces pombe
MSGYGQQGVSAANIDSIRPKKRLSIGVVGSGNWGTAIAKICGENARAHGHHFRGKGRMWVFEEEIEYKGEKRKLTEVFNEAHENVKYLPGIECPPNVIAVPDVREVARRADILVFVVPHQFIERVWHQMVGLIRPGAVGISCIKGVAVSKEGSLYSEVISEKLGIYCGVLSGANVANEVAREQFCETTIGFNPPNEVDIPREQIAAVSDRPYFSVVSVDDVAGVALGGALKNVVAMAVGFADGLEWGGNTKAAIMRRGLLEMQKFATTFFDSDPRTMVEQSCGIADLVTSCLGGRNNRCAEAFVKTGKSLETLEKELLGGQLLQGAATSKDVHEFLLTKDMVKDFPLFTAVYNISYEDMDPKDLIIVLQPLKEDSENEGGTETE

SEQ ID NO: 24009 - protein, 354 aa, Pseudomonas syringae
MHPKNAWYVACTADEVADKPLGRQICNERMVFYRDQNQQVVALEDFCPHRGAPLSLGYVENGQLVCGYHGLVMGGDGKTAAMPGQRVRGFPCNKTFAAVERYGFIWVWPGDREKADPALIHHLEWAVSDEWAYGGGLFHIQCDYRLMIDNLMDLTHETYVHASSIGQKEIDEAAPVTTVEGEEVITARHMENIMPPPFWQMALRGNNLADDVPVDRWQICRFTPPSHVLIEVGVAHAGKGGYHALHEFKASSIVVDFITPETDTSIWYFWGMARNFNPADEQLTATIREGQRKIFSEDLEMLERQQQNLLQHPQRNLLKLNIDAGGVQSRKILERLIAAERASTAEQIPVMATK

SEQ ID NO: 24010 - protein, 232 aa, Unknown
  Synechococcus sp. WH 8102
MLGDLWSFQGRYRTLHLTWIAFFLTFVVWFNLAPLATTVKADLGLTVGQIRTVAICNVALTIPARVLIGMLLDKFGPRITYSSILVFSAIPCLLFASAQSFNQLVVARLLLSIVGAGFVIGIRMVAEWFPPKEIGLAEGIYGGWGNFGSAFSALTMVALAGFLSFSGGFELPTGTVLNWRGAISLTGIVSAVYGLFYFFNVTDTPPARPISALRKPQAWRSPPCATSGVCSA

SEQ ID NO: 24011 - protein, 290 aa, Unknown
  Synechococcus sp. WH 8102
MRDFWGLLGMNVPFAAILCVLCWRLGKVGFLTPSTYPLALGAVAVWFAFQTWGIIRTNRDLILGNKVYPKEDRYEFRQVAILELTYIVNFGSELAVVSMLPTFFETTFDLPKATAGILASCFAFVNLVARPAGGLISDSVGSRKNTMGFLTAGLGVGYLVMSMIKPGTFTGTTGIAVAVVITMLASFFVQSGEGATFALVPLVKRRVTGQVAGLVGAYGNVGAVTYLTIFSLLPMWMGGGGEPTPEVIAASNSAFFQILGVAGLIVAFFCFFFLKEPKGSFAELHEGETA

SEQ ID NO: 24012 - protein, 743 aa, Unknown
  Synechococcus sp. WH 8102
MSDGPRSVRSQCPYCGVGCGLELLPPAVKGQAVKRDAEGNPMWTARGDREHPSSLGQVCIKGATVGETLARGRLRQPLFRSKLTDAFAPISWDDALDKITGQIKASLARRGNADGIAMYGSGQFHTEDYYLAQKLLKGALGTNNFDANSRLCMSSAVAGYTRSLGSDGPPCSYEDLDHCTVAFLIGTNTAECHPVLFQRLLKRKRKNPGSVKIVVVDPRRTDTAKAADIHLPIAPGSDLALLHGIAHLVLRDNGQDPAFIDNHTENYDAFFDVAARWTPRRVALFCNIPEKRLRDVAALFHRRQKVLSLWSMGVNQRREGTAVVQGLINLHLLTGQIGNEGAGPFSLTGQPNAMGGREAGGLAHLLPGYRLVANPEHRAEVEQAWKLPAGQIAAKPGLAAWQQVEAMERGDLDLWWVAATNPLVSMPDLDRVKQAMGNCPLVVVSEAYADSETSHYAHLLLPAAQWSEKAGAMTNSERRVTFCPAYRLRFGESRPDWEVFADVGRRLGYTEQFRFDSAAEVYAEFTRLTQGRLCDVSGLSHELLEQAGPQQWPYPMGSIPSTAAKRLYENHLFATPSGRARFSTDQPLGLAEPPCDTYPLVLTVGRYLGQWHTMTRTGKVERLMKQHPEPLLEIHPSDAQELQLRNGELAAISSRRGHLTATVKVTDRIRCGTVFLPMHWGFTQEKACEANTLMHDDACPVSKQPELKACAVIVAPAVSVVKPVEQEKGRLEALRRLLTPALR

SEQ ID NO: 24013 - protein, 149 aa, Rhizobium leguminosarum
MTDIYSGPVFEMARTQFNRIADRLDLPDGQRNRLLYPKRAITISCPIHLDNGEVAVFQGYRVQHHLTLGPTKGGTRFAPNVDIGEVAALAVWMSWKCALAGLPYGGAKGGITVDPRQLSIRELEALSRRYMQGMILALRMPGQPCCQDW

SEQ ID NO: 24014 - protein, 359 aa, Ashbya gossypii
MSDGAELKMAAQKRLLTGSDLDKWKASKTFEELLRFVSSLAQSVRGRENSEHAEPVSPAIEALEALLEEMQGIAAHHPVLQDAATSRFGKVEFRDFHKEVQARAEALVLQVDPSLTDEQAQELAVYLGNAWGDCKRIDYGSGHELNFVCFLYGLWKYGVLSEHDFTNAVLRVFVKYMDVMRVLETKYWLEPAGSHGVWGLDDYHFLPFLFGAFQLATHKHLKPKSIHNPEVVELFENRYLYFGCIAFINRVKTTASLRWHSPMLDDISGVRSWTKVSEGMVKMYKAEVLGKLPIMQHFFFSRFLPVPDGVSPPRTSEEELADCSEHAHSTWGDCCGIPIPSAVAASEATRKHSKPLPFD

SEQ ID NO: 24015 - protein, 461 aa, Ashbya gossypii
MQDSMDDSLREAEGRQDDSEVSSGTTLGSSTPEDSGVTAKLRKKYQMASALLRRELEELSVYDAKTAGVSGRSSGSGSGGLALLGGRFHVAPLRIPARRRLQTLVVAWHTSSFIYMTVLVLFLAANPLMWWFMVPYMVYYVWNRSPANGGVVRRYSPRLRSLALWRYYCEYYPISLHKSEDLAPTFVPDPRGAEPREWKLRLWLWPTRVELLNLTLQWTRARPQVATGPRYIFGYHPHGVGALGAFGAIATEGCNWSKVFAGIPACLCTLVNQFQIPIYRDYLLGLGCTSVARKNVLKVLEQNYSVCIVVGGAQEALLSRVGSTELVLNKRKGFIKLALETGNVNLVPIYAFGETDCFNVLDTGNESYLRKFQLWIKKTYGFTIPFFFARGVFNYDFGFLPFRNPINVVVGKPVYVDKRRTNPTMEEIDHYHDLYVQELRNVFDKNKHKFGYAGKELKIVE

SEQ ID NO: 24016 - protein, 560 aa, Mycobacterium tuberculosis
MTPQKSDACSDPVYTVGDYLLDRLAELGVSEIFGVPGDYNLQFLDHIVAHPTIRWVGSANELNAGYAADGYGRLRGMSAVVTTFGVGELSVTNAIAGSYAEHVPVVHIVGGPTKDAQGTRRALHHSLGDGDFEHFLRISREITCAQANLMPATAGREIDRVLSEVREQKRPGYILLSSDVARFPTEPPAAPLPRYPGGTSPRALSLFTKAAIELIADHQLTVLADLLVHRLQAVKELEALLAADVVPHATLMWGKSLLDESSPNFLGIYAGAASAERVRAAIEGAPVLVTAGVVFTNMVSGFFSQRIDPARTIDIGQYQSSVADQVFAPLEMSAALQALATILTGRGISSPPVVPPPAEPPPAMPARDEPLTQQMVWDRVCSALTPGNVVLADQGTSFYGMADHRLPQGVTFIGQPLWGSIGYTLPAAVGAAVAHPDRRTVLLIGDGAAQLTVQELGTFSREGLSPVIVVVNNDGYTVERAIHGETAPYNDIVSWNWTELPSALGVTNHLAFRAQTYGQLDDALTVAAARRDRMVLVEVVLPRLEIPRLLGQLVGSMAPQ

SEQ ID NO: 24017 - protein, 332 aa, Pseudomonas syringae
MIKNQLARFNRLDLISAPTALEKLERLSIWADRDIYIKRDDTTTLALGGNKVRKLEYLAADALAQGADTLITAGAIQSNHVRQTAALAARLGFGCVALLENPIGTEDPSYLKNGNRLLLELFDAKVELVENLDNADEQLHALAARLRSSGKKPYLVPIGGSSPVGALGYVRAGLELAEQIKQTGIDFAAVVLASGSAGTHSGLALALAHELPQLPVIGVTVSRSEEAQLPKVQGLAERTAELLDIALPEHFKVELWDEYFAPRYGEPNAGTLAAIKLVASHEGLLLDPVYTGKAMSGLLDGIGRQRFNDGPLIFLHTGGAPALFAYPDAFDQ

SEQ ID NO: 24018 - protein, 226 aa, Unknown
  uncultured bacterium
MAGVQLGAGCWICEYLSPWDVYAHGVAKTLVHRKTKFQEMHIIETGTFGKALILDGFWQSCTGDEFLYHEPLVHPAMLLHGRPRRVLVLGGAEGAAVREVLRWKSVEQVVMVDIDGEVVEACRQHLPEMHQGACDDPRVEVRIQDALVYLDETRSTFDVIISDLSDPIEDGPSFKLFTRETFERARGSWRRRGCSSCKPAASRRPSCTCTPAWSARSDGCSPTPPH

SEQ ID NO: 24019 - protein, 448 aa, Lactobacillus plantarum
MKETSKTTAGLPKLSSNKIWMMSLGFLGVQMAFTLQSSQMSRIFQTLGADPNNLGWFFILPPLAGLIVQPIIGSLSDRTWAPRLGGRRLPYLILGTVVAAIVMLLLPNSGSFGFGYASMAALVFGAITVAFLDLSSNVAMQPFKMMVGDMVNDDQKSYAYGIQSFLLNTGAVIAAIFPFLLTLFGVANTASKGVIPNSVIWSFYIGAAILVVSTIITIARVREYDPVTYAKYHGIDESANKSGGNWLALLKKAPKVFWLVALVQFFCWMAFQYLWTYSTGAMAANVWHTTNASSAGYQAAGNWYGILSAVQSVAAVVWSYVLAKVPNNRHKLGYALSLLLGAIGFFSIFFIHSQSALVVSFILVGMAWAAMNTYPLTMVTNALSGEHMGTYLGLFNGSICLPQIVASLLSFALYPLFGNSQANMFIFAGIVLAVGAGTVGLIKETYKN

SEQ ID NO: 24020 - protein, 117 aa, Arabidopsis thaliana
  misc_feature (80)..(80): Xaa can be any naturally occurring amino acid
MASSMLSSATMVASPAQVTMVAPFSGFKESVAFSVTRKVNNDITSIISNGGIVNCMQVGPPIGKKKFETLSYLPDLNDSXLAKEVDYFIREKRVPLGGTCRGGMEFEHREARVLTPE

SEQ ID NO: 24021 - protein, 98 aa, Neisseria meningitidis
DVREALTEIGITGMTVSEVKGFGRQKGHTEIYRGAEYAVDFLPKIKIELVLADDAVERAIDVIVEVARSGKIGDGKIFVLPVEEAIRIRTGERSDAAV

SEQ ID NO: 24022 - protein, 510 aa, Anabaena variabilis
MQNNPFLKPTFFNMQSYKYQQKETSEKSYTREDWQGGYKSLTQEFDYWIDDVEGEIPAELQGTLFRNGPGLLDIKGQSIHHPFDGDGMISRISFVNGRAHYRNSFVKTAGYLAEKNAGKILHRGVFGTQKPGGWLANIFDFKLKNIANTNVIYWGNKLLALWEAAEPHRLDPKTLETLGKEYFDDVLSAGEAFSAHPRFDPSCEQDNGAPCLVNFSVKPGLSTKITIFELNLAGEVVRKHAHNVPGFCFIHDFVITPNYCIFFQNPVSFNPIPFALGLRGAGECIQVKPNQPTRIIIIPRFPQSGQKEIKTLEVRSGFIFHHVNAFVVGDEILVDSICYDSLPEVEPESDFRQVDFEAIAPGQLWRFYLNLKDGTVQKKLIESRCCEFPAIHPRNVGRSYRYLYMGAAHRDSGNAPLQALLKIDLESGEKQIWSAAPRGFTGEPIFVPRPGSEKEDDGWVLALVYDAAHHRSDVVILDASDFTKGAIARLHLQHHVPYGLHGNFTPQVFV

SEQ ID NO: 24023 - protein, 417 aa, Arabidopsis thaliana
MISLNLSPSLNPGLLHKTRTCQQPTRLSALLVTNPKPFNHRHPLGLSPIPNLQIRDVSAKPLLSLTNPESSSGFSRKPRSIAAVGSSDSNPDEKSDLGEAGKKEKKAKTLQLGIVFGLWYFQNIVFNIFNKKALNVFPYPWLLASFQLFAGSIWMLVLWSFKLYPCPKISKPFIIALLGPALFHTIGHISACVSFSKVAVSFTHVIKSAEPVFSVIFSSLLGDSYPLAVWLSILPIVMGCSLAAVTEVSFNLGGLSGAMISNVGFVLRNIYSKRSLQSFKEIDGLNLYGCISILSLLYLFPVAIFVEGSHWVPGYHKAIASVGTPSTFYFWVLLSGVFYHLYNQSSYQALDEISPLTFSVGNTMKRVVVIISTVLVFRNPVRPLNALGSAIAIFGTFLYSQATAKKKKIEVGGDKKN

SEQ ID NO: 24024 - protein, 162 aa, Pseudomonas putida
MAATMLNIPCVTLGGEHKTLGDFPGKVLLVVNTASQCGFTPQYKGLEQLWQAYRDRGLVVLGFPCNQFGKQEPGDAREIAQFCERNFGVSFPLFRKVEVNGPGAHPLFVELKQRAPGILGSQKIKWNFTKFLVDPASGQVKRYAPTTKPQALEADIERLLSR

SEQ ID NO: 24025 - protein, 639 aa, Oryza sativa
LTCAWLINGRWVQYVLYGAVVWKVAEEWRQQEAAPVGSWWLHLLLLFAARGLTYQFWFSYGNMLFFTRRRRVVPDSVDFRQVDAEWDWDNFLLLQTLIGATLVGSPAVARQQLLLPSLKQAWDPRGWAIALLLHVLVAEPLFYWAHRALHRAPLFSRYHAAHHHASVTTPLTAGFGTPLESLLLTVVIGVPLAGAFLMGVGSVGLVYGHVLLFDFLRSMGYSNVEVISPRVFQAVPLLRYLIYTPTYLSLHHREKDSNFCLFMPIFDLLGGTLNHKSWELQKEVYLGKNDQAPDFVFLAHVVDIMASMHVPFVLRSCSSTPFANHFVLLPFWPVAFGFMLLMWCCSKTFLVSSYRLRGNLHQMWTVPRYGFQYFIPAAKKGINEQIELAILRADRMGVKVLSLAALNKNEALNGGGTLFVNKHPELRVRVVHGNTLTAAVILNEIPSNVKDVFLTGATSKLGRAIALYLCRKKIRVLMLTLSSERFLKIQREAPAEFQQYLVQVTKYQPAQNCKTWLVGKWLSPREQRWAPAGTHFHQFVVPPIIGFRRDCTYGKLAAMRLPKDVQGLGYCEFADMVGRRSPGNICVQYTMERGVVHACHAGGVVHFLEGWEHHEVGAIDVDRIDVVWKAALKHGLTPA

SEQ ID NO: 24026 - protein, 526 aa, Moorella thermoacetica
MTNSIADIASADCIFVIGSNTTENHPVIALKVKEAVRRGARLIVADPRRIELVNFSYLWLRQKPGTDLALLNGLLHVIIKEELYDKEFIAQRTEGFEALKLAVEEYTPAKVSEVTGVPAGDIIEAARTYARGPSSTILYAMGITQHITGTANVMALANLAMACGQVGKEGSGVNPLRGQSNVQGACDMGGLPNVLPGYQPVTDPGVRHKFSEAWGVPDLPGEPGLTLMEMMAAAQEGKLKGMYILGENPVLTDPDVSHVKEALKNLEFLVVQDIFLTETARMADVVLPGASFAEKEGTFTSTERRVQLLHKAIEPPGEARPDWLILNDLLLLMGYPRKYSSPGEIMQEIAGLTPSYAGITYERLEDKGLQWPVLSLEHPGTPVLHREKFSRGYGQFQVVHYRPPAEEPDEEYPFLFTTGRNLYHYHTVISRKSRGLEEMCPAPVVEINDNDAARLGIREGEMIEIVSRRGKVRVKALVTDRIPRGQVFMNFHFHEAAANLLTIAALDPVAKIPEYKTCAVAIKVKK

SEQ ID NO: 24027 - protein, 235 aa, Nepenthes villosa
  misc_feature (39)..(39): Xaa can be any naturally occurring amino acid
LIVWVQENLGWALGFGIPAISMGIAIASFFSGTALYRLXKPGGSPLTRMCQVLVASFRKSKLALPEDSNLLYETSDENSVIEGSRKLEHTNELKCLDKAAVVSDKEIKREDFSNPWRLCTVTQIEELKILIRMFPIWATGIVFSAIYAQMSTMFVEQGEVMDRTIGSFTIPAASLSMFDTISVIFWVPVYDKILVPLARKFTGKQRGFSELQRMGIGLFISILSMAAAALVEMKR

SEQ ID NO: 24028 - protein, 140 aa, Lactobacillus sakei
MKIALIAHDRQKPLIVKLATAYQPILAQHELFATGTTGQKIIDATGLSVKRFKSGPLGGDQQIGALISENKMDLVIFLRDPLTAQPHEPDVNALIRLSDVYEVPLATNIGTAEVLLRGLDQGLMAFREVVHDQDSNPINL

SEQ ID NO: 24029 - protein, 732 aa, Methanothermobacter thermautotrophicus
MGCMTKKEIKLKVAEALAQQDVGRGIARVDPACMEKLGLSDGDIIEIEGKKLTAATVVSSQSDIGLGIIRIDGYLRKNAGASIGEEVTVRRADVKDAQKVVLAPVDQEVIIRGDIRSAFLNRVLVKGDIIVSGIRQHISGGGLFDEFFRDFMDISPLGEIKLAVVSTSPAGVVRVTPSTQVEMQQKPVDVSKLEGVKNLVDVTYEDIGGLKEEVKKVREMIEIPLKRPELFERLGITPPKGVLMHGPPGTGKTLLAKAVANESDAHFIAINGPEIMSKYVGGSEERLREFFEEAEENAPSIIFIDEIDAIAPKREDVSGEVERRIVAQLLTLMDGLKSRGQVVVIGATNRPDALDPALRRPGRFDREIEIGVPDREERKEILQIHTRGMPLADDVDLDELAEITHGFVGADLESLCKESAMRVLRRVLPEIKADEEIPKEVLKKMVVTRADFKDALKEIQPSALREVLVQVPNVSWDDIGGLEGAKQELREAVEWPLKYPDRFKKFGIRPPKGILLHGSPGTGKTLLAKAVANESQANFIAVKGPELLSKWVGESEKGVREVFRKARQTAPTVIFFDEIDSIASVRSGSTADSGVTQRVVNQLLTEIDGLEELQDVAVIAATNRPDILDPALLRPGRFDRHVKVEDPDKEARLAIFRVHTKDMPLADDVDLEKLAEKTEGYVGADIEAVCREAAMLTLRDNMDAEEVSMKYFLEAMEKVKPKGGVEEQVQYH

SEQ ID NO: 24030 - protein, 235 aa, Nepenthes clipeata
  misc_feature (7)..(7): Xaa can be any naturally occurring amino acid
  misc_feature (39)..(39): Xaa can be any naturally occurring amino acid
  misc_feature (138)..(138): Xaa can be any naturally occurring amino acid
LIVWVQXNLGWALGFGIPAISMGIAIASFFSGTALYRLXKPGGSPLTRMCQVLVASFRKSKLALPEDSNLLYETSDENSVIEGSRKLEHTNELKCLDKAAVVSDKEIKREDFSNPWRLCTVTQIEELKILIRMFPIWXTGIVFSAIYAQMSTMFVEQGEVMDRTIGSFTIPAASLSMFDTISVIFWVPVYDKILVPLARKFTGKQRGFSELQRMGIGLFISILSMAAAALVEMKR

SEQ ID NO: 24031 - protein, 522 aa, Unknown
  Frankia sp. EAN1pec
MATDTPRATSADSPLPARTRPLLLAAVAVCAACGLVYELVLLTLSTSLAGGGITQTSLIVAGFVAALGAGALLVKPFLGHAAAAFVAVETLLGILGGLSAVTLYVTFSFYATSGPVLVLGTALLGTLVGAELPLLVTLLQTGRTDVDARASGRLLADLNAADYAGALVGGLVWPFVLLPTAGMIRGAALTGLVNLTAATVVATLLLRRWLTRRALVTALGALLAAATLLGTLLLRARDIETDARQRLYADPIVVATRSAYQEIVVTRRVGDMRLYLDGDLQFSSADEHRYTEALVAPALARDPARVLVLGGGDGLAARELLRHPTVRQVVQVELDPRMIELARTTFARLNRAALNDPRVRVVVADAFRWLRDPPPEPFDAVVVDMPDPDTPTLGRLYSQEFYGLVRAVLAPGGLLTVQAGSPYATPSAYWRTVSTVRAAGLATTPYHVDVPSFGDWGFVLATTGGTPPPLVLSERATPARFLDQAVLTAAGVFPLDRPPRTLEPSTLDRPRIVDDLRTGYQR

SEQ ID NO: 24032 - protein, 348 aa, Prochlorococcus marinus
MTKAPSSTVHSRRILLTGASSGIGYQAAVRMHRAGHQLVLPCRDRSTATATLKKLSEETVQHQQERSPVSAPVMDLADLESIKHCADELLSIGKPIDTLILNAGLQYTGAAKAQLSSQGYELTIAVNHLGHQALSIRLLPLLDAGMSPRVVVTASEVHDSNSPGGRFGKPAGLGDLTGLKTGAGFEMIDGSSSFNADKAYKDSKLCNVLFARELARRLSLRSIQMPVLAWAPGLVIPRSSGGFFRYSRRYNEWGQRVFSLVVRDVLRISESAENAGALLSRLATEQSLNTSPFSYRSNRLDGPGQHRFEEANISKEAQDNNLAKSLWEVSAELIGLPTELPPASVSQC

SEQ ID NO: 24033 - protein, 603 aa, Oryza sativa
METHIGSVDGAAAAADNGAVGCPASAVGCPMTSARPGVSARRGVAGTAPGEAAGAGGRQRRVRVPGDFNLTLLDHLIAEPGLLVGCCNELNAGYAADGYARSRGVGACAVTFTVGGLSVLNAIAGAYSENLPVICIAGGPNSNDYGTNRILHHTIGLPDFSQELRCFQTVTCTQAVVTNLEDAHEQIDTAIATALRESKPVYLSISCNLPGLPHPTFSRDPVPFFLAPRLSNKMGLEAAVEATVEFLNKAVKPVLVGGPKLRVAKAGKAFVDLVDASGYPYAVMPSAKGLVPETHPHFIGTYWGAVSTAFCAEIVESADAYLFAGPIFNDYSSVGYSFLLKKDKAIIVQPERVIVGNGPAFGCVMMKEFLSELAKRVNKNTTAYENYKRIFVLRASAGEEPNEPLRVNVLFKHVQKMLNSDSAVIAETGDSWFNCQKLKLPEGCGYEFQMQYGSIGWSVGALLGYAQGAKDKRVIACIGDGSFQVTAQDVSTMIRCAQNSIIFLINNGGYTIEVEIHDGPYNVIKNWNYTGLVDAIHNGEGKCWTSKVKCEEELTEAIGMALGEKKDCLCFIEVIAHKDDTSKELLEWGSRVSAANSRPPNPQ

SEQ ID NO: 24034 - protein, 235 aa, Nepenthes gymnamphora
  misc_feature (7)..(7): Xaa can be any naturally occurring amino acid
  misc_feature (39)..(39): Xaa can be any naturally occurring amino acid
  misc_feature (138)..(138): Xaa can be any naturally occurring amino acid
LIVWVQXNLGWALGFGIPAISMGIAIASFFSGTALYRLXKPGGSPLTRMCQVLVASFRKSKLALPEDSNLLYETSDENSVIEGSRKLEHTNELKCLDKAAVVSDKEIKCEDFSNPWRLCTVTQIEELKILIRMFPIWXTGIVFSAIYAQMSTMFVEQGEVMDRTIGSFTIPAASLSMFDTISVIFWVPVYDKILVPLARKFTGKQRGFSELQRMGIGLFISILSMAAAALVEMKR

SEQ ID NO: 24035 - protein, 605 aa, Unknown
  Burkholderia sp. 383
MSEQSTSLRASANGPQDMTPSEAFVETLAANGVTDMFGIMGSAFMDAMDIFAPAGIRLIPVVHEQGAGHMADGYARVSGRHGVVIGQNGPGISNCVTAIAAAYWAHSPVVIVTPEAGTMGIGLGGFQEANQLPMFQEFTKYQGHVTHPARMAEFTARCFDRAQAEMGPTQLNIPRDYFYGKVKVEIPQPRRLDRGAGGEQSLDDAAALIAQAKFPVIISGGGVVMADAIEECKALAERLGAPVVNSYLHNDSFPANHPLWCGPLGYQGSKAAMKLLSRADVVIALGSRLGPFGTLPQHGMDYWPKDAKIIQIDADHKMLGLVKKISVGICGDAKAAAVALTQRLEGRTLACDGSRGDRADQIATEKAAWEKELDDWTHERDAYSLDMIEEQKHEKPFSGGQYLHPRQVLRELEKAMPEDVMVSTDIGNINSVANSYLRFNKPRSFFAAMSWGNCGYAFPTIIGAKVAAPHRPAVSYAGDGAWGMSLMETMTCVRHNIPVTAVVFHNRQWGAEKKNQVDFYNRRFVAGELDNQSFAEIARAMGAEGITVDRLEDVGPALKRAIDMQMNEGKTTIIEIMCTRELGDPFRRDALSKPVRTLDKYKDYV

SEQ ID NO: 24036 - protein, 452 aa, Propionibacterium acnes
MTEPDQQLHRSLRNRHIQLIALGGAIGTGLFYGAADSIAAAGPAVIVSYLIGGVVIYLIMRALGEMSVHNPTSGAFSEYAHQWWGDLPGFISGWNYWFNYIFVSMAELSVVGIYINYWFPVVPRWVSAAVLLAIVTTVNLLHVRAYGEVEFWFAIIKVVAIIAMIVLGLWIIFFGTGSTPATGIGNLWRNGGFLPHGVTGMLAGIIVVMFSFGGTELIGITAGEAEDPQRSIPRAINRVVGRILLFYVGALIVMVAIVPWTKIDGNASPFVQIFDLVGIPGAAAILNLVVLTAAISAYNSGLYANGRMLHALAHQGDAPAFLGKVNKAGSPWAGVLLSSAVTAIAVVVVGLLPEQAFVYIMSIAMIAAIINWATIIITQMLFRRRLDPESRSELRFTMPGAPVTNWIVLAFLVLMVVVMTTMPPYRIAVAIGPIWLAVLGLGWRVSRRRQTL

SEQ ID NO: 24037 - protein, 235 aa, Nepenthes sumatrana
  misc_feature (39)..(39): Xaa can be any naturally occurring amino acid
  misc_feature (138)..(138): Xaa can be any naturally occurring amino acid
LIVWAQENLGWALGFGIPAISMGIAIASFFSGTALYRLXKPGGSPLTRMCQVLVASFRKSKLALPEDSNLLYETSDGNSVIEGSRKLEHTNELKCLDKAAVVSDKEIKCEDFSNPWRLCTVTQIEELKILIRMFPIWXTGIVFSAIYAQMSTMFVEQGEVMDRTIGSFTIPAASLSMFDTISVIFWVPVYDKILVPLARKFTGKQRGFSELQRMGIGLFISILSMAAAALVEMKR

SEQ ID NO: 24038 - protein, 811 aa, Unknown
  Nostoc sp. PCC 7120
MKPLASHDSISLKSHPRKQSSRNFLIRFILGGTTLIVSISAYFSYLAARNMALADIRQNAFLEVQTGVDQIEAWLSVRKVEVKTLANTSTVRSLNWAVAEPYLKTEVERIKEFFLFQMSIADGSYYTTKSGRANNNVKDREYFQQGIAGKSSVSDPFISRSTGIPLIAIATPILSTSNSPIGVFHGSVKVDHITKVINSLTYGKNSYAFALNSQGEVIVHPDSTLMSTIEKPAPSLLKINDHSLQAIAQRMVNKQQGIELMAIDGKQKYIAYIPLKAANWSVALVIPRENIESRLQFLDLIALIVGGLTITMITVLWRVQAFEQAQLKKSKEAADLANHAKSEFLANMSHELRTPLNGILGCAQILQRSSTLPEQEQHHINIIEQCGSHLLTLINDILDLAKIEAKKLELHGEDVHFPSFIQGIAEICQIRAAQKDILFVYEPASNLPIWLHIDAKRLRQVLLNLLGNAIKFTDHGQVKLKVETIEESSTQKPVKHRIRYCIEDTGIGITDAELSKIFLPFEQVGEKKRQTEGTGLGLAITRQLVQMMGSDIHVTSQVGHGSTFWFELEMVATNEWVQSMMTTSARKIIGFEGNPRRILIVDDRWENRTVLNDLLQPLGFEIMEAVNGQDGLEQAIAISTDLIITDLLMPEMDGFTLIQNLRQIPQFKNLKIIVSSASVFESDQHRSLAVGGDDFLSKPIQANELLRQLERHLNLVWIYQPSESETQAISDVVTQNNDPSTQLITPPPEVLRELLTLAKKGNFNAIIKCADQLEAEDTNLATFAHQLRQLARQFDEDVILEFLTQYEVEMA

SEQ ID NO: 24039 - protein, 473 aa, Artemisia annua
  misc_feature (68)..(68): Xaa can be any naturally occurring amino acid
MELYTTSLLFIVSFSTIIFLLFRRNSAFWRSINTPPGSTGLPLIGETFQIISAYKTENPEPFIDARVXKYGSVFTTHVFGERTVFSADVEINKFILQNEGRLFESSYPGSIANLVGKHSLLLMRGGLHRRMHSLTMSFANSTIIKDHLLADIDRLVRLNLDSWTGRILLMDEAKKITFELTLKQLLSIEPCEWSENLRKEYMLVIEGFFCIPLPFFSLTYRRAIQARKRVTEALHLVVRERRIEREKGVKKNDMLAALFDSDGDEENFYDDEIVDFLVSLLVAGYDTTSTTMTLAVKYLTDTPSALAQLKEEHDAIRAKKGASVALEWDDYKSMPFTQCVVNETLRLSNIISGVFRRAITDVKIKDYTIPKGAKVFTSLRAVHLDQDNFEDARVFNPWRWQKTSDSASFMPFGGGPRRCPGHELARVALSVFLHHLITHFSWKPAEEDKVVFFPTTRTQKRYPIIVEQRNVVG

SEQ ID NO: 24040 - protein, 448 aa, Zea mays
MALVQFNGALVPQLGEKPRLLSSSPAIAKATYSDARFLTPKTGSRGRGKHLLSPSYSLHSQTSSEQLNHVPSSRFRQKRGSRFIVRAEADFYSVLGVSRNASKSEIKSAYRKLARSYHPDVNKDPGAEQKFKDISNAYEVLSDDEKRSIYDKYGEAGLKGAGMGTGDYSNPFDLFESLFEGFGGMGGMGGGRAARNRPMQGDDESYNLVLNFKEAVFGVEKEIEITRLEGCNTCDGSGAKPGTKATTCKTCGGQGQVVSSTRTPLGIFQQVSTCNTCGGTGEFSTPCNTCGGDGRVRRTKRISLKVPAGVDSGSRLRVRSEGNAGRRGGPPGDLYVFIDVLSDPVLKRDGTNILYTCKVSYIDAILGTTVKVPTVDGTVDLKIPSGTQPGTTLVMSKKGVPLLGKSNARGDQLVRVQVEIPKRLSSDEKKLIEELANLNKAQTANSRR

SEQ ID NO: 24041 - protein, 337 aa, Solibacter usitatus
MQLGMIGLGRMGSNMVRRLMRGGHNCVVYDRDPAGVASLAAEGATGAKSLDDLIAGLQPPRAIWLMVPAAVVDSALHDLVPKLQPGDTVIDGGNSYYVDDIRRASELSAKSIHYMDVGTSGGVFGLERGFCLMAGGERPVFDRLAPVLRTLAPGPGNAERTPGRDKAHSAAEEGYLYCGPAGAGHFVKMVHNGIEYGMMASFAEGLNILKHANAGESARAADAETTPLRHPELYRYRLDLAEITEVWRRGSVIASWLLDLTAAALLASPELDHFTGSVADSGEGRWTLTAAIDESVPAPVLAAALFQRFSSRGESGFANKLLSAMRAEFGGHHEPPH

SEQ ID NO: 24042 - protein, 222 aa, Mantoniella squamata
GSVAALKATKVQAKSVSTVVKADIYPEFGTYPGGGESPIIPFGSEKNAEREVIHGRWAMLGVTGAWAAENGTGIPWFTAGTLCTPDDCTAVADKFPGAVAPLAPEGSGYPSFWAVLAIEVVLVGLAEAYRTGLSDSPFEELTVGDVSPGGRFDPLGLAESGDLEELKIKELKHCRLSMFAWLGCIFQALATQEGPIANWQAHVADPVHANVLTNAASGFGFY

SEQ ID NO: 24043 - protein, 446 aa, Unknown
  Synechococcus sp. RS9917
MSPQPMTPQGVPEPSPELLRLATDVRRAATALGQTDDGQRQQALEAMAAALERHAESIVAANQQDLEQAMAEGLAQALVARLKLDAGKLAGAIDGVRQVAALPDPLGVRQLHRELDEGLVLERVSVPLGVLGVIFEARPDAVIQIASLAIRSGNGAILKGGSEANRTNRAVIEALQEGLGAAEVDTTIAADALALLTTRQESLALLRLDGLVDLIIPRGSNALVRFIQDNTRIPVLGHADGVCHLYVDAQVDVPQAVRIAIDSKTQYPAACNAIETLLVHQDSAPAFLAAAVPALEAAGVRLRGDSRSQALGVAEAATEDDWDREYLDLILSVRVVSDLEEALEHIRRHGSRHTEAIASQDGATAERFLRAVDSAGVYHNCSTRFADGFRYGFGAEVGISTQTLPPRGPVGLEGLVTYRYRLRGDGHVAADFAEGRRRFSHRDLEA

SEQ ID NO: 24044 - protein, 338 aa, Brassica rapa
MGRSPSSDDSGLKKGPWTPEEDEKLVNYVQKHGHSSWRALPKLAGLNRCGKSCRLRWTNYLRPDIKRGKFSPDEEQTILNLHAVLGNKWSTIANHLPGRTDNEIKNFWNTHLKKKLIQMGIDPMTHLPRTDIFSSLSQLMSLSSNLRGFVDMQQQFPNGQDQTILKLQTEMAKLQLFQYLLQPPTMSNNIRNPNDFDILSLLNSIASFKEITSNNLDLGSNLQDFNSLPSLKTLNSNIGPSSVLPQIPEDNHFKFCRIERENLPVSPIWLSDPTNSNQHMLPSLDPSSAVSDDMIRNQYVIEHVNSNLTSSSQESGASASAAWPDHLLDDSIFSDMIP

SEQ ID NO: 24045 - protein, 531 aa, Triticum aestivum
NPTLQPLPRGARGGRPPPPPTMAMATALRKLSARGQPLSRLTPLYSMASLPATEERSAVTWPKQLNAPLEEVDPEIADIIELEKARQWKGLELIPSENFTSLSVMQAVGSVMTNKYSEGYPGARYYGGNEYIDMAETLCQKRALEAFNLDPEKWGVNVQPLSGSPANFHVYTALLKPHDRIMALDLPHGGHLSHGYQTDTKKISAVSIFFETMPYRLDESTGLIDYDQLEKSAVLFRPKLIVAGASAYARLYDYNRMRKICDKQKAVLLADMAHISGLVAAGVIPSPFEYADVVTTTTHKSLRGPRGAMIFFRKGVKEINKQGKEVKYDFEDKINAAVFPGLQGGPHNHTITGLAVALKQATTQEYRAYQEQVMSNSARFAESLTSKGYDIVSGGTDNHLVLVNLKKKGIDGSRVEKVLENVHIAANKNTVPGDVSAMVPGGIRMGTPALTSRGFVEEDFAKVADFFDSAVNLALKVKAAAAGTKLKDFVATLQSDSNIQAEIAKLRHDVEEYAKQFPTIGFEKETMKYKN

SEQ ID NO: 24046 - protein, 317 aa, Yarrowia lipolytica
MEHIKNFWAAKPQYKEVEYADQRDKTFVVTGGLSGVGMECARLLLKKRARVVIVGRNKDFARDLLSELARDIPEGEAAFVELDLADLESVKKGGQEIARHYPVIHGVVLNAGTMAPPYAKTKQGHEIHWGTNVMGHHLLMKYLEPSVLRAAHDSPPGTVRIVWVAASSSTLIPGLEGSIRFNTNNEDEKKPPHVLYNMSKTGNAYEAYLWSKFHPHSGVSSVSMDPGNLSTNLTRHSGGLVHRFKDYVLYPAKFGAYTELAALLSPTIKDGDHLVPWGVPGTLRHDVDEARRGPKGEEMWIELERDTQAFFQPEEVH

SEQ ID NO: 24047 - protein, 254 aa, Moorella thermoacetica
MKVYFVGAGPGDPELITVKGRRLLGEAGVIIYAGSLVNPEILKYAAPGAVRYDSASLTLEEVLAIIRRAIAGGQVVVRLHTGDPSLYGAIQEQMDALERMGIPYEIVPGVSSYAAAAAAIGREYTLPGVSQTLILTRRGGRTPVPEMESLTELSRHRASLCLFLSSQSLAAATAELASGYGPETPAAVVYKASWPEEKVIRGTLGDIAAKAREAGIERTALLLVGDFLAGDYKRSRLYDPAFSHGYRGARNNNG

SEQ ID NO: 24048 - protein, 231 aa, Mantoniella squamata
MACIASSFAGSVAALKATKVQAKSVSTVVKADIYPEFGTYPGGGESPIIPFGSEKNAEREVIHGRWAMLGVTGAWAAENGTGIPWFTAGTLCTPDDCTAVADKFPGAVAPLAPEGSGYPSFWAVLAIEVVLVGLAEAYRTGLSDSPFEELTVGDVSPGGRFDPLGLAESGDLEELKIKELKHCRLSMFAWLGCIFQALATQEGPIANWQAHVADPVHANVLTNAASGFGFY

SEQ ID NO: 24049 - protein, 463 aa, Yersinia pseudotuberculosis
MELPVKNKLKRGLTTRHIRFIALGSAIGTGLFYGSADAIRMAGPSVLLAYLIGGVVAFVIMRALGEMSVNNPQASSFSRYAQDYLGPMAGYITGWTYCFEILIVAIADVTAFGIYMGLWFPDVAHWVWVLSVVLIIGAVNMMSVKVFGELEFWFSFFKVATIIIMILAGIGIIVWGIGNGGQPTGIHNLWTNGGFFSNGFVGMILSLQLVMFAYGGIEIIGITAGEAEDPKKSIPKAINSVPWRILVFYVGTLFVIMSIYPWNQVGTNGSPFVLTFQHMGITIAAGILNFVVITASVSAINSDVFGVGRMLNGMAEQGHAPKAFTAISKRGVPWVTVLVMMCAMLIAVYLNYIMPENVFLVIASLATFATVWVWIMILFSQIAFRRSLSKDQVKALDFPLRGGTFTSVLAIIFLVFIIGLIGWFPTTRISLYVGLVWIVLLLVGYYFKVKYQKKQATLIKNAD

SEQ ID NO: 24050 - protein, 368 aa, Brassica rapa
MARTKQTARKSTGGKAPRKQLATKAARKSAPATGGVKKPHRFRPGTVALREIRKYQKSTELLIRKLPFQRLVREIAQDFKTDLRFQSSAVAALQEAAEAYLVGLFEDTNLCAIHAKRVTIMPKDIQLARRIREGKFNVANPTTGCQKKLEIDDDQKLRAFYDKRLSQEVSGDALGEEFKGYVFKIMGGCDKQGFPMKQGVLTPGRVRLLLHRGTPCFRGHGRRTGERRRKSVRGCIVSQDLSVLNLPRMRGPKRASKIRKLFNLGKDDDVRKYVRKYVNTYRRKFTNKKGKEVSKAPKIQRLVTPLTLQRKRARIADKKKRIAKANADAAEYQKLLASRLKEQRDRRSESLAKKRSRLSSAAAKPVAA

SEQ ID NO: 24051 - protein, 93 aa, Arabidopsis thaliana
  misc_feature (21)..(21): Xaa can be any naturally occurring amino acid
  misc_feature (31)..(31): Xaa can be any naturally occurring amino acid
  misc_feature (52)..(52): Xaa can be any naturally occurring amino acid
GAIPENGHLKVPVLQNSKWYXFVHKLHRVYXGTNLTVNNVTSSSVQSIEVEXVTPSLSINVQSDGEHPVFLPREFQVSSGAIGITRWSEPQIS

SEQ ID NO: 24052 - protein, 856 aa, Populus nigra
MMSSLQKPFSMFLRVLFFLLLMCIIPSFFAFPSNSSATSFGAAKYEAAEGNEEAEALLKWRASLDDSHSQSVLSSWVGSSPCKWLGITCDNSGSVANFSLPHFGLRGTLHSFNFSSFPNLLTPNLRNNSLYGTIPSHISNLTKITNLNLCHNHFNGSLPPEMNNLTHLMVLHLFSNNFTGHLPRDLCLGGLLVNFTASYNHFSGPIPKSLRNCTSLFRVRLDWNQLTGNISEDFGLYPNLNYVDLSHNNLYGELTWKWGGFNNLTSLKLSNNNITGEIPSEIAKATGLQMIDLSSNLLKGTIPKELGKLKALYNLTLHNNHLFGVVPFEIQMLSQLRALNLASNNLGGSIPKQLGECSNLLQLNLSHNKFIGSIPSEIGFLHFLGDLDLSGNLLAGEIPSEIGQLKQLETMNLSHNKLSGLIPTAFVDLVSLTTVDISYNELEGPIPKIKGFIEAPLEAFMNNSGLCGNANGLKPCTLLTSRKKSNKIVILILFPLLGSLLLLLIMVGCLYFHHQTSRERISCLGERQSPLSFVVWGHEEEILHETIIQAANNFNFNNCIGKGGYGIVYRAMLPTGQVVAVKKFHPSRDGELMNLRTFRNEIRMLIDIRHRNIVKLHGFCSLIEHSFLVYEFIERGSLKMNLSSEEQVMDLDWNRRLNVVKGVASALSYLHHDCSPPIIHRDISSSNVLLDSEYEAHVSDFGTARLLMPDSTNWTSFAGTLGYTAPELAYTMRVNEKCDVYSFGVVTMEVIMGMHPGDLISFLYASAFSSSSCSQINQHALLKDVIDQRIPLPENRVAEGVVSIIKIAFACLLANPQSRPTMRQVASELIARWPPLPKSFSAITVEDLMPQTTVTG

SEQ ID NO: 24053 - protein, 1014 aa, Unknown
  Azoarcus sp. BH72
MKRMLFNATQAEELRVAIVDGQKLIDLDIESAAKEQRKSNIYKAVITRIEPSLEAAFVDYGAERHGFLPFKEISRSYFQPGVDAGKASIKEALREGQELIVQVEKDERGNKGAALTTYISLAGRYLVLMPNNPRGGGVSRRVEGDERAELRDVMDQLEVPGGMSLIARTAAIGRSAEELQWDLNYLLQLWTAIEGAATSQSGAFLIYQEGSLVIRAIRDYFQPEIGEILIDTDDIYEQARQFMAHVMPGNVNRVKRYQDDVPLFSRFQIEHQIESAYSRQVGLPSGGAVVIDHTEALVSIDVNSGRATKGADIEETAFRTNLEAADEIARQLRLRDLGGLIVIDFIDMESQKNQREVENRLRDALRHDRARVQTGKISRFGLLELSRQRLRPALAETSYIPCPRCNGTGHIRSTESSALHIVRILEEEAMKENTGAVHLQVPVDVATFLLNEKRVDIARIEMRHKVQLIIVPNRHLETPQHEIIRLRHDQLNLEDIALASYQMVQKPADEEMRLPTKNGDKPARQEAAVKGISPEQPAPIVEARAEAAPAPAAVAPAPRRGLLDWILGLFRSEPAPAATPAPAETPAKREARPRGERNGDARRGNGNRNRREGQRERTERDGETPRARPENGRHARGERSESVEREKPQQERAERPERADRPERTERGEGGRGRGRGQRQARTDELNEKPADKAAEVAAEVIAAAALASANDTEAVVPSGDDSAGENAAPEKRRRRGRGRRDRRPAEVAGVDGVTENEGSADAVAETADVLAPEAAPVVAEAEAVVQVAATVEAVEAPAVEAPAVEAPAVEAPAVEDAPAAAEAAPASAELPVVASAATAVESIVEAAPLPVAIETAVPTEEVAGAHVTETVAPETVPPLCVAEPPAADHPEVSVEAEAVATTLETATVQPVAAPEAEPVAEAPALVVAAEDSIVPPAPTETRAAGVEQKPAPSDPIDLGPALADSGLVLIETSRDKLSKFGTGAVEQSVPLGRKPRQAMVIAEEPLQQVETRK

SEQ ID NO: 24054 - protein, 475 aa, Streptomyces coelicolor
MTSAQVDTDKAPEEGYERGLNSRQVQMIAIGGAIGVGLFLGAGANIAKAGPSIILMYALAGVIIFFIMRALGELLLYRPVSGSFAEYSREFLGPFFGYFTGWTYWLMWVVTGMAELTAAAIYIHYWFPDIPQWVSALVFLVLLFVANLISVKLFGEIEFWFSMVKVTAIIGMIVIGVGVLTLGFSQAGDTAAVSNLWEFDGFFPKGIGSSLMTLQGVMFAYLAVELVGVTAGESENPEKTLPKAINTLPWRIALFYVGALTVILAVVKWTEFAEGVSPFVEAFAVIGIPAGAGIVNFVVLTAALSSCNSGMYSTGRMLRTLADNGEAPRIFNKLSSTKTPAIGIAVSVVFMAIGVVLNYLVPEKAFGYVTSVATAAGIWTWLMILISHVRYRRKVVAGRLPASSFPAPGGSVCSYIAIAFLLFVTCLIAYDADARVCLYVMAGWAAALGIGWAVLKSRNPQITERPGEPEFEKIG

SEQ ID NO: 24055 - protein, 198 aa, Zea mays
  misc_feature (52)..(52): Xaa can be any naturally occurring amino acid
  misc_feature (98)..(98): Xaa can be any naturally occurring amino acid
  misc_feature (146)..(146): Xaa can be any naturally occurring amino acid
CLARCYRQIKNEPYPKSSYCRAVPDPKIKIYHAGMKRNGVDEVPYCAHLVSXEKDNGYSEALEAARIACHHHMTKSARKDAFHLRHRVHPFHVLPINXMLSRAETDTLQTGMRYDFGKPQGTCARVDIGHDLLSVRCKDNNAAHAXKALRRDKFKIAVRLKIIEMRWRSYPQVRRGDYLKNEREGIIVPDGDNTNLLN

SEQ ID NO: 24056 - protein, 432 aa, Lactobacillus plantarum
MVQQINIIDAKDHVDEKVKIGAWLTNKRSSGKIAFLQLRDGSAFFQGVVVKSQVSEEVFELAKEVKQEASMWITGVIHEDSRSKFGYEIEVEDIVVVGESEEYPITPKEHGVDFLLDHRHLWLRSKRPWAIMNIRNEVIRGTYEFFNQEGFIKMDSPILTGSAPEGTTELFHTEYFDRDAYLSQSGQLYAEAGALAYGKVFTFGPTFRAEKSKTRRHLIEFWMIEPEMAFMHQEQSLEVQERYIAFLVQGVIDHCQYALDILGRDVETLKKYTKLPYPRISYDEAIELLKENDFDVDWGVDFGSPEETFLADHFDQPVFVLNYPKAIKPFYMKPHPTRDDVVICADLLAPEGYGEIIGGSERATDYNYLLDQIKQAGLNPDDYAWYLDLRKYGSVPHAGFGLGLERFLTWITAEDHVRETIPFPRLLNRIYP

SEQ ID NO: 24057 - protein, 362 aa, Unknown
  Halobacterium sp. NRC-1
MTEATADRTALTDGGRDVVEHRQLVIVGSGIAALSAATYAARSNNDPLLFEGDEPGGQLTLTSEVENYPGFPEGIAGAELIQEMKTQATRFGAEVEHGIVESVDDSGRPFRLTLTNGDVYTADAVIVASGASARTLGIPGEDELMGQGVSTCATCDGAFFRGEDMIVVGGGDAAAEEASFLTKFADTVYLVHRRDELRAEDYWADRIREHVADGDIEVLWNTEAVEVHGSPEEGVTGASLVRHPEGHPTAKLDADETEQLELDIGAFFIAIGHTPNTSFLADTGVVCDDAGYVQTVGGAGGGQTKTDVTGVFGAGDVVDYHYQQAVTAAGMGSKAAIDADEYLESVADGVTGETADATPADD

SEQ ID NO: 24058 - protein, 329 aa, Glycine max
GVTVLYLGQPEPHLLNICSKTKSLWKIFCLGPLLRALQKRKKCHHWTSQVICVDGGLTVNGFEPSIINRGARWSLNGTTALVTGGTRGIGHAIVSDLAAFGAAVHTCSRTQTELNKCLQEWQSLGFQVTGSVCDVSSPSQREKLIEEVTSILNGKLNIYVNNVGTNFRKPTIEYTAEEYSQLMTVNLDSSFHLCQLAYPLLKASENGSIVFISSVAGVVSLGTGAVYAASKAAINQLTKNLACEWAKDNIRSNCVVPWATRTPLVEHVRDQKFVDDIMSRTPIKRIAEPEEVSSLVTFLCLPAASYITGQVICVDGGLTVNGFQPSMRI

SEQ ID NO: 24059 - protein, 670 aa, Exiguobacterium sibiricum
METLSLILLMLALIILTQVLGHYIRFIPTALIQILVGTITALLISGLKIEVESEWFLLLFIAPLLYNDSSHFPRDELWKMRAAIFGNAIVLVLLTTVIGGYFINWLVPVIPVAAAFALAAILSPTDPIAVNGIAKRVQIPEQILNLVRGESLINDASGLVAFSYAVAAVVTGYFSIQQATTEFVYMFAVGAVVGLTISIAMNWLKMKLRRTGIEDVVFYALLQILTPFIIFFVAEEILHASGVIAVVTGGILHALIKERTETFFAQEQTLTDNIWTMIAYILNGIIFLLLGLTLPEATREIFADDAINNWRLMSFVIEIGTVILLIRLIWTMFFNWFDHRFLKKADHRKPSFKQDVITTLVGVRGTITMVGVLSLPFVTESGEGFPERSLIIFLAAGVIIFTLVLATILLPLLNRGEADAQPELDLNSYKQRMVKRAITEIKQVVQEENSTVAFDLLNEYHVMLRLLRAQEKSEEELTHFNQQLKKLRLEAVQWERDFTKQFLQEHKTPDQLKKEVFRSIDNRREAIEKEARFRLSQPIRKILWKRKRSNMSSDQLIHLTQVEHELYEQVMGEVISRLDGCRGDYPADVVQSVLEFYKRLRFKHTRWSSPVGGKADVDQQKEELCLRAIEVQRQEIASMSKEGDLSGEEEKELRRFIHYIESVVLYEYVE

SEQ ID NO: 24060 - protein, 232 aa, Oryza sativa
  misc_feature (85)..(85): Xaa can be any naturally occurring amino acid
  misc_feature (104)..(104): Xaa can be any naturally occurring amino acid
  misc_feature (167)..(167): Xaa can be any naturally occurring amino acid
MMGATSPSGLELTMAVPGLSSSGSEGAGCNNNNAGGGCNMRDLDINQPASGGEEEEFPMGSVEEDEEERGVGGPHRPKKLRLSKXSSPALLEESFRLNHTLTPXKQKEALAIKLKLRPRQVEVWFQNRRARTKLKQTEMECEYLKRCFGSLTEENRRLQREVEELRXAMRVAPPTVLSPHTRQPLPASALTMCPRCERITAATGPPAVRPPPSSAAAAAPSPFHPRRPSAAF

SEQ ID NO: 24061 - protein, 254 aa, Oryza sativa
MAVAAVARGDMSADRTECADQLVGLAPCLQYVQGEAKAPAPDCCGGLRQVLGKSPKCLCVLVKDKDDPNLGIKINATLALALPSACGATHANVSHCPQLLHIPPNSKDAAIFSPGGDKGSPAAPDHVVLQITDHDPYYIVEFTAVTNLPIETKNTGLDGARSISGRLYWTMPGEKLRLRECDASVHMLYMDTQVKLAVVVKVMGRTGSRGQVTQVRVKFLDDQNRLIMRNVKGPVREGDILTLLESEREARRLR

SEQ ID NO: 24062 - protein, 277 aa, Glycine max
MQTKRILKSFSRVFGLLLVFVLIPVDENSIFGHKLSKYICKHICSYFPITLHVEEAKAFRPDQAYVFGYEPHSVFPIGIVALGDSTGFMPLAKTKFLASSAVFYIPFLRHIWTWLGFTPVTKQNFISSLEAGYSCILVPGGVRETFFMEPGCEIAFLKQRRGFVRIALQMGLPLVPVFCFGQTKAYKWWKPPGRLMQNLARFLKIIPLFFWGIYGSPIPFKNPLYIVVGRPIELEKNPEPTMEQVAKVHSQFVEALQDLFDRHKAHAGYTNLELKIF

SEQ ID NO: 24063 - protein, 380 aa, Propionibacterium acnes
MSTKDWAEKDYYKILGVSKDAKPEEIKKAFRKIARDNHPDSHPGDKAAEARFKEASEANDVLSNAKKRKEYDQARSLFGSAGGFRFPRGGAQTSVNVEDFLRTASNGDGFGDLFGNLFGASGGRRTASRSPRRGADVEGETTISFDDAVSGTTVTMDMVSQAPCQACRGTGARAGTVPRVCSTCQGSGMHASSAGGVFEMTEPCPDCHGRGMIVEDPCQVCHGSGRAKSTKSMQTRIPAGVEDGQRIRIKGKGSPGENGGKAGDLYVKVTVRPHEIFGRDGHNLTVTVPVTFPEATLGAEVEVPTLAGTTVRLRIPAGTPNGRTFRVRGRGVPRSDGSRGDLLATVEIAVPESLDDDARHVVERLRDSLPQATPRPWEVK

SEQ ID NO: 24064 - protein, 499 aa, Unknown
  Malus x domestica
MPAPDTDRHRVGARPAVRTRVPLRQLLRVASVACGIQFGWALQLSLLTPYVQELGIPHAWASVIWLCGPLSGLVVQPLVGHMSDRCTSRYGRRRPFIVVGAACIAVSVLIIGFSADIGWLLGDRGGGVRPRAIAVFVFGFWILDVANNVTQGPCRALLADLTEKDYRRTRVANAYFSLFMAVGNVLGYATGSISYLFKVFPFSITPACNVNCANLKSAFFVDTAFIAITTWISISAAQVTPLGSSNRTTPFADEGPGQSSHIEEAFLWELFGTFRYFPGSVWLILLVIALNWIGWFPFLLFDTDWMGREIYGGKPNEGINYSTGVRMGALGLMLNSVILGITSVLMEKLCRKWGAGFVWGISSILMTLCFFAMLVITFVNKSIGVRGHDLPPDGIVIAALVVFAVLGIPLAITYSVPYALVSSRIESLGLGQGLSMGVLNLAIVIPQVIVSLGSGPWDQLFGGGNVPAFAVAAVASLASGLVAILAIPRSAAPKPRAVT

SEQ ID NO: 24065 - protein, 933 aa, Yersinia pestis
MTKYSLRARMMILILAPTLLLGLLLSTSFMVNRYNELQNQIVSAGTNIIEPLAVASEYGMSFRNRDTVRQLINLLHRRHSNIVRSISVFDVDNKLFVTSNYNYNSSQLRLPPGEPVPDSLMLSYRGDSLILRMPIVSESNLSSEQASGQGESDQILGYIAIDLDLQSVRLKQYKEIFISTLLLLFCMCVAILFAYRLMRDVTGPIRNMVNTVDRIRRGQLDSRVEGHMLGELDILKNGINSMAMSLAAYHEEMQQNIDQATSDLRETLEQMEIQNVELGLAKKRAQEASRIKSEFLANMSHELRTPLNGVIGFTRQTLKTSLTPTQTDYLQTIQRSANNLLCIINDVLDFSKLEADKLILEHIPFSLRETLDEVIILLAHTAHEKGLELTLHINNDVPDQVLGDAMRLQQIVTNLLGNAIKFTEEGNIDILVVVKAIASQQVTLMVEIHDTGIGISESQQAQLFQAFRQADASTSRRHGGTGLGLVITERLVKEMGGNISFQSQMSCGSIFRFHLTLELNESIPYRQPDMAHLEGKQLAYIERNSTAARATINILNTTPLQVTHRQSLAQLPEQHYDFLLVGVPIPFRNNMAIHQDKLLTALKIADHVILALPSQSQVEAEQLKQIGAKDCLLKPISSIRLIPLLLAEDTHSKVPSEEQPRKQPKLPFRVMAVDDNPANLKLIGTLLEEQIEETVLCDSGAMAITYAREHTLDIILMDIQMPEIDGIRASEIIHQIPHHQETPIIAVTAHAVKGQQEQLLRLGMADYLAKPIDEARLLQVLSRYQSDNPPLSTASTASTASTASTASTAESLPLPVPKGAGVIDWAQAVRQAANKEDLARDLLTMLLEFMPQITARVQAILAGADDGDILNLVHKFHGSCACSGVPRLRQLCMTIELQLRQQVNLQDLEPEWLELLDEIENVSEAAKTYLRTE

SEQ ID NO: 24066 - protein, 542 aa, Corynebacterium efficiens
MANDITTTAAWQSLTERYEAFQGTTLRELFQDGGRAEKLSFDAAGLRVDLSKNLLDDAILTDLVALAEQAGLTDRIEAMFRGEHINNTEDRAVLHTALRLPVEESLEVDGQDVAADVHEVLGRMRDFATALRSGAWLGYTGRTIKKVVNIGIGGSDLGPAMATKALRAYATAGITAEFVSNVDPADMVSVLEDLDAESTLFVIASKTFTTQETLANANAAKNWLIEQLGSEEAVSKHFVAVSTNAEKVTAFGINPENMFGFWDWVGGRYSVDSAVGLSLMAVIGPRDFMRFLGGFRAMDEHFRYTDFGQNVPVLMALLSVWYTDFFGAETHAVLPYSEDLSRFAAYLQQLTMESNGKSVRRDGSPVTTGTGEIYWGEPGTNGQHAFFQLIHQGTRLIPADFIGFARPKQDLPAGEKSMHDLLMSNFFAQTKVLAFGKTAEEIAAEGVDDNLINHKVMPGNRPTTTILAEELTPAVLGALIALYEHIVFVQGVIWDINSFDQWGVELGKQQASDLAPAVSGEVEVDSGDSSTDALIRWYRTNR

SEQ ID NO: 24067 - protein, 173 aa, Brucella melitensis
MSEPIGSPCVFKQRAHGQQNSATKEKTMRYLHTMVRIRDIDESLDFYVNKLGLEEIRRIENEKGRFTLIFLAAPSDTDRARAERAPELELTYNWDPETYTGGRNFGHLAYMVDDIYATCEKLKSAGVTINRPPRDGHMAFIKSPDGISIELIQKGERLAPQEPWASAENIGTW

SEQ ID NO: 24068 - protein, 451 aa, Xanthobacter autotrophicus
MRPAGVPRHYRRPAMASQDANRSSISEEMNRFFTAPLAESDPEIAGAVKAELGRQRDEIELIASENIVSRAVLEAQGSVLTNKYAEGYPGKRYYGGCQFVDVAENLAIERAKKLFGCGFANVQPNSGSQANQGVFFALLQPGDTFLGLNLAAGGHLTHGSPVNMSGKWFKPVPYTVREDDQRIDYDEVARLADEHKPKLIVAGGSAYPRVIDFPKMRAIADSVGAKLMVDMAHFAGLVAGGAHPSPFPHAHVVTTTTHKTLRGPRGGMILTNDEDLAKKINSAIFPGIQGGPLMHVIAAKAVAFGEALRPEFKLYAKNVVENAKALAETLKGHGFNIVSGGTDTHLMLVDLRPKRLTGKTSEGALGRAHITTNKNGIPFDPEKPFVTSGIRLGTPACTTRGFGVAEFQQVGDFIAEVLDVLSQKGVDEDSLVEATVREKVSGLLARFPIYP

SEQ ID NO: 24069 - protein, 218 aa, Acidosasa purpurea
GMDVSEWDPSKDKYISVKYDKTTVMEAKALNKEALQAEVGLPVDGKIPVVAFIGRLEEQKGPDVMAAAIPQLMEENVQIILLGTGKKKFERMLKSAEEKYPGKVRAVVKFNAPLAHQIMAGADLLAVTSRFEPCGLIQLQGMRYGTPCVCASTGGLVDTIIEGKTGFHLGRLSVDCNVVEPGDVQKVATTLKRAIRLVGTPAYQEMVKNCMAQDLSWK

SEQ ID NO: 24070 - protein, 473 aa, Unknown
  Burkholderia sp. 383
MQPSNQSDLKCGLKQRHMTMIALGGVIGAGLFVGSGVVIQQTGPAAILSFLITGGLVVLVMRMLGEMACAMPAVGSFYEYARLAFGNWRGPGKMAGFLTGWMYWYFWVIVVALEAVAGAKLIQFWLPDTPAWIISLALLVVLTLTNLISVGSYGEFEFWFSSIKVGAIIVFLFLGGLYVLGLWPASMHTTSVLPTLLGHGGFMPLGIGPVMSGAVAATGFYFGAEIVTIAAAEAKEPAKAVAKATNSVITRVLVFYVGSVALVVALVPWNSHQMATPYVSALEVMGLPAAANVMNAIVLTAVLSALNSGLYAASRMLFALTRHGDAPAALAKVNKRGVPVRAILLGTVFGYVSVVMSYVSPDTVFAFLVNSYGTVALFVYVLIAFSQLRLRKRLDPVAASKLRVKMWAYPYLTWVAIIGMVGILVAMAFIPDQRKPLWLGVASLGVLVVAYGLTRRSRREHLDDSELLAYPPR

SEQ ID NO: 24071 - protein, 235 aa, Nepenthes lavicola
  misc_feature (39)..(39): Xaa can be any naturally occurring amino acid
LIVWVQENLGWALGFGIPAISMGIAIASFFSGTALYRLXKPGGSPLTRMCQVLVASFRKSKLALPEDSNLLYETSDENSVIEGSRKLEHTNELKCLDKAAVVSDKEIKYEDFSNPWRLCTVTQIEELKILIRMFPIWATGIVFSAIYAQMSTMFVEQGEVMDRTIGSFTIPAASLSMFDTISVIFWVPVYDKILVPLARKFTGKQRGFSELQRMGIGLFISILSMAAAALVEMKR

SEQ ID NO: 24072 - protein, 255 aa, Exiguobacterium sibiricum
MYLPSFQLDQKTVLVTGAGRGIGRALAIGMAEAGADVLLVARTESDLQETAKQIEQLGRRAFVLTCDVTDRTQVQATVDRAYTYVDRIDVLVNNAGMNIRSKALDVTEDEWETIQQTNLKSAFLFSQEIGRRMQDTGGSILNIASVAGHVALRTGVVYATTKAALIQMTKVLALEWGPKNIRVNAIGPWYFKTPLTEPLLADPAYLQDIVDVTPLGRVGELTELVGPAVFLASDAGTYVTGQTLFVDGGMTIKGF

SEQ ID NO: 24073 - protein, 441 aa, Arabidopsis thaliana
  misc_feature (46)..(46): Xaa can be any naturally occurring amino acid
MGSTLKHLLLLLLVLIRHVDSAAIVKSLPGLEGRLPFELETGFVKXYIGIGEEEDIQLFYYFIKSENNPKEDPLLLWLDGGPGCSSLGGLLFENGPVALKSAVYNGSNPSLFSTTYSWTKMANIIYLDQPVGSGFSYSRTPIGKSSDTSEVKRIHEFLQKWLSKHPQFFSNPFYVTGDSYSGMIVPALVQEISKGNYICCKHLINLQGYVLGNPITYAEHEKNYRIPFSHGMSLISDELYESLKRNCKGNYENVDPRNTKCVRLVEEYHKCTDKINTQHILIPDCDKKGHGITSPDCYYYLYFLIECWANNERVREALHVTKGTKGQWQRCNWTIPYDNNIISSVPYHMDNSINGYRSLIYSGDHDITMPFQATQAWIKSLNYSIVDDWRPWMINDQIAGYTRTYSNKMTFATVKGGGHTAEYLPNESSIMFQRWISGQPL

SEQ ID NO: 24074 - protein, 512 aa, Salinibacter ruber
MPSTNPPAPATRDADTAEADVAIIGTGFAGLGAAIRLLQEGMTDIVVLERADEVGGVWRENRYPGCACDTASHLYSFSFAPKADWSRRFAGRDEIFAYLKQCATQFGVRPHIRFGHAVRRAVWDEDDRRWHIETSEGTYVARALICGVGAHSQPLIPDLPGQERFEGRAFHSSGWPEGFDPSGRRVAVVGTGASAVQIVPALQPHVEHLTLFQRTPAWVVPHGDREIPPAVHELFRRVPMLLRAWRFALHHLREATGWLFWDRRVARLVEPLVRYWMRSQISDPDLRETLIPDYALGCKRILHSDTYLPALSEPNVTVVDGAAREVHPEGVSGPEDVSGPAGPRDADVIVYCTGFQSTKMPLSHSIYGREGRALAETWGDSPRAHLGTTVAGYPNLFLLRGPNTGLGHNSILPMIEAQIEHILGALRHMGDAGIAAVEPRAAAQARFVRQVDRWSEGTVWTDGGCRSWYLDTTGRNAVLWPCSVAAFRRRVTDFDPSEYAMIRHTRRPAAAR

SEQ ID NO: 24075 - protein, 218 aa, Arundinaria gigantea
GMDVSEWDPSKDKYISVKYDKTTAMEAKALNKEALQAEVGLPVDGKIPLVAFIGRLEEQKGPDVMAAAIPQLMEENVQIILLGTGKKKFERMLKSAEEKYPGKVRAVVKFNAPLAHQIMAGADLLAVTSRFEPCGLIQLQGMRYGTPCVCTSTGGLVDTIIEGKTGFHLGRLSVDCNVVEPGDVQKVATTLKRAIKLVGTPAYQEMVRNCMAQDLSWK

SEQ ID NO: 24076 - protein, 235 aa, Nepenthes adnata
  misc_feature (138)..(138): Xaa can be any naturally occurring amino acid
  misc_feature (220)..(220): Xaa can be any naturally occurring amino acid
LIVWVQENLGWALGFGIPAISMGIAIASFFSGTALYRLQKPGGSPLTRMCQVLVASFRKSKLALPEDSNLLYETSDQNSVIEGSRKLEHTNELKCLDKAAVVSDKEIKCEDFSNPWRLCTVTQIEELKILIRMFPIWXTGIVFSAIYAQISTMFVEQGEVMDRTIGSFTIPAASLSMFDTISVIFWVPVYDKILVPLARKFTGKQRGFSELQRMGIGLFXSILSMAAAALVEMKR

SEQ ID NO: 24077 - protein, 981 aa, Glycine max
  misc_feature (533)..(533): Xaa can be any naturally occurring amino acid
MEQSEKSPTKISSLRSSFPRDPRGSLEVFNPNTSALASTSTNARVRSQPLWKSWTESEEPRNEIAATSWMAINPAAGESGEAAQRAAEWGLVLRTDTETGKPQGVAVRNSGGEEPNAAKLAAAASSSRKNSQNSARTSGDSSDGGGGGGGIPRISEDVMGALSAFQQTFVVSDATKADYPILYASAGFFKMTGYKSKEVIGRNCRFLQGADTDPEDVAKIREALQAGKIYCGRLLNYKKDGTPFWNLLTISPIKDEDGKVLKFIGMQVEVSKHTEGSKEKTLRPNGLPESLIRYDARQKEKATSSVTELLQAMKRPRALSESASRPSIRKSGSRSSDEEKLEQEQEDDKEKAQKTLRRISESGASFGRKSEGSGNRISMERISELPENKHRNSQRRSFMGFRRKSQSNDESMDSEVIEDESSESEDDERPNSFELDDKEKQREKRKGLDLATTLERIEKNFVITDPRLPDNPIIFASDSFLELTEYSREEILGRNCRFLQGPETDPATVRKIREAIDNQTEVTVQLINYTKSXKFWNLFHLQPMRDQKGEVQYFIGVQLDGSQHVEPLHNCIAEDTAKEGEQLVKQTAENVDEAVRDFPDANKKPDDLWTNHSKAVHPKPHRKDDPAWKAIQKVLESGEQIGLKHFRPIKPLGSGDTGSVHLVELRGTGQYFAMKAMDKGVMLNRNKVHRACAEREILDKLDHPFLPALYASFQTKTHVCLITDYCPGGELFLLLDRQPTKVLKEDAVRFYAAEVVIALEYLHCQGIIYRDLKPENVLLKSNGHVSLTDFDLSCLTFSKPQLIISATNSKKKKKKKQKSQEVPMFMAEPVRASNSFVGTEEYIAPEIITGSGHTSAVDWWALGILIYEMLYGYTPFRGKTRQKTFANILHKDLKFPKSKPVSLQGKQLIYWLLQRDPKDRLGSREGANEIKRHPFFRGVNWALVRCMKPPELDAPLLPETEEEKEGKDIDPGLEDLQANVF

SEQ ID NO: 24078 - protein, 106 aa, Zymomonas mobilis
MSVINVTDASFEADVLKSPVPVVVDFWAEWCGPCRQIAPALGEIASELEGKMTLAKVEVDNNIETASRFGIRNIPTLLLFKNGEVVATRTGGAPKSQLKSWIESSL

SEQ ID NO: 24079 - protein, 554 aa, Photobacterium profundum
MVCIQCEQTVQTPTAKGCSYTQGMCGKTADVSDLQDVLVFNLQGVSFWAELGRKYNIIDAEIDAWAPRAFFSTLTNVNFVPERITEYTEIAERYKIQLSTQVMAAAAAAGEALPELSPAAQFVLPATAEEIMNFAPEAAVNRGHEELHEDIIGLRLLCLYGLKGAAAYMEHANVLGQSEESICAEYHQIMAFLGTDPTDANALLETSMQIGLLNYRIMEILDRGETNTFGHPQPTQVNVKPVAGKCILVSGHDLHDLEKILQQTEGKGINVYTNGEMLPAHGYPELNKYPHLVGNFGSAWQNQQKEFANFPGAIVMTSNCLINPNVGQYADRLFTRSIVGWPGVVHIEGDDFSQVIECALAQEGIAHTEIEHMITVGFGRNALMAAAPAVINEVKAGNIKHFFLIGGCDGDKEERSYFTDIAVSAPEDSVILTLACGKYRFNKKEFGDINGIPRLLDVGQCNDTYSAIQLVLALAEEFDCGVNELPLSIVLSWFEQKAIVVLLTLFALGIKGIYTGPTAPAFLTDNLIKALQENFDMRSVGDVETDLATMLAGK

SEQ ID NO: 24080 - protein, 218 aa, Chimonocalamus fimbriatus
GMDVSEWDPSKDKYISVKYDKTTAMEAKALNKEALQAEVGLPVDGKIPLVAFVGRLEEQKGPDVMAAAIPQLMEENVQIILLGTGKKKFERMLKSAEEKYPGKVRAVVKFNAPLAHQIMAGADLLAVTSRFEPCGLIQLQGMRYGTPCVCASTGGLVDTIIEGKTGFHLGRLSVDCNVVEPGDVEKVATTLKRAIKLVGTPACQEMVRNCMAQDLSWK

SEQ ID NO: 24081 - protein, 332 aa, Coxiella burnetii
MEPFKHPIAILGAGSWGTALALVLARKGQKVRLWSYESDHVDEMQAEGVNNRYLPNYPFPETLKAYCDLKASLEGVTDILIVVPSFAFHEVITRMKPLIDAKTRIAWGTKGLAKGSRLLHEVVATELGQVPMAVISGPSLATEVAANLPTAVSLASNNSQFSKDLIERLHGQRFRVYKNDDMIGVELCGSVKNILAIATGISDGLKLGSNARAALITRGLTEMGRLVSVFGGKQETLTGLAGLGDLVLTCTDNQSRNRRFGLALGEGVDKKEAQQAIGQAIEGLYNTDQVHALAQKHAIEMPLTFQVHRILHEDLDPQQAVQELLERSPKAE

SEQ ID NO: 24082 - protein, 725 aa, Vibrio vulnificus
MRPNTNVRIYFRQQGITMFEKPVVKTFQYGNHTVTLETGVIARQATAAVMVTMDDTAVFVSVVGKKEAVPGQDFFPLTVNYQERTYAAGKIPGGFFKREGRPSEGETLTARLIDRPIRPLFPEGFNNEVQVIATVVSVNPDVQPDIPTMIGTSAALAISGIPFNGPIGAARVGHIDGQLVLNPSNTELNASRLDLVVAGTESAVLMVESEADNLTEEEMLSAVVFGHDQQQAVIKAINEFAAEVATPSWNWVAPEANTALNEKVADLAEAKLVEAYKITEKMARYDRIHEIAAEVNAVILAEDPEADAKEIHTIFHDLEKTVVRRSIIAGNPRIDGREKDMVRALDVRTGVLPRTHGSSLFTRGETQALVTATLGTQRDAQIIDELTGEKKDYFLLHYNFPPYCVGETGFVGSPKRREIGHGKLAKRGIAAVMPSIDEFPYTVRVVSEITESNGSSSMASVCGTSLALMDAGVPIKASVAGIAMGLVKEGDDFVVLSDILGDEDHLGDMDFKVAGTSTGITALQMDIKIEGITKEIMQIALNQAQGARKHILSVMDQAISGARDDISEFAPRIHTMKISADKIKDVIGKGGAVIRALTEETGTTIEIEDDGTIKIAATEGAAAKEAIRRIQEITAEVEVGVIYTGKVARLADFGAFVTILPGKDGLVHISQIADKRVEKVSDYLTEGQEVQVKVLEIDRQGRVRLSMKEAVEKPVEAEAPAAEEE

SEQ ID NO: 24083 - protein, 218 aa, Chimonocalamus pallens
GMDVSEWDPSKDKYISVKYDKTTAMEAKALNKEALQAEVGLPVDGKIPLVAFVGRLEEQKGPDVMAAAIPQLMEENVQIILLGTGKKKFERMLKSAEEKYPGKVRAVVKFNAPLAHQIMAGADLLAVTSRFEPCGLIQLQGMRYGTPCVCASTGGLVDTIIEGKTGFHLGRLSVDCNVVEPGDVEKVATTLKRAIKLVGTPAYQEMVRNCMAQDLSWK

SEQ ID NO: 24084 - protein, 600 aa, Cryptococcus neoformans
MSEQKPSVVEQAQDVASKLANAVTDTLKLSEDQKSDLPVVYIDEKAGSDTEGTGAELSPFASPLAAYQSFKPSPESDANPSSVATFMVRKVDSVERNDWIELSASAKKKLVKSIGGWRKAEAKLAAEGERLEKQKKEQAEKDRLRREEAKNVVLVDDPSKESKSAKIWAVPELVGKRVRLQGWVHRFRPQKTNFFVVLRDGSGFLQCILTGDCIRTVDALDLSLECTIEVVGIVEKVKEGQTAPGGVELAVDYWKIIGRAPTGAEALESRLQPDTEASIRADLRHLELRGEIASSVMRFRALLLRAFRESFNKRRITEVTPPCMVQTSVEGGSTLFEFDYYGSKAYLTQSSQLYLETVLPSLGDVYCIQESFRAEKSLTRRHLSEYTHLEAELVFIKFKDLLDHLEDMICEVIDVLLADPVASEIIKTLNPEFVPPQRPFVRLDYRDAITYLNEHGIKREDGEDHVVGDDIAEAAERKMTDQINKPIMLIHFPKSLKSFYMKSLDDAPDFTESVDVLVPGVGEVVGGSMRISDLEELMAGYKREGIPADPYYWFTDQRKYGTTEHGGYGLGVERLLAWILKRYTVRECSLYPRFMGRATP

SEQ ID NO: 24085 - protein, 285 aa, Yarrowia lipolytica
MAEGDYNAVREAIADILDNDDYDDGSIGPVLVRLAWHASGTYDKATGTGGSNGATMRYMKEAKDEANNGLENARQFLEPIKAKFPWITYADLWTLAGVVAIEEMDGPKVPWKPGRQDYVDETNVPPNGRLPDGAQGQDHLRDIFYRMGFNDQEIVALCGAHNMGRCHMDRSGFEGAWVPNPIRFANTYFKLLMNEEWKLTTLKNGVKQYFNEDEELMMLPADYSLMQDPEFHKWVEIYAADKEKFFEDFSKVFAKLIELGVRRGPDGKAKTNFIDRNNNDPNPRL

SEQ ID NO: 24086 - protein, 218 aa, Gaoligongshania megalothyrsa
GMDVGEWDPSKDKYISVKYDKTTAMEAKALNKEALQAEVGLPVDGKIPLVAFIGRLEEQKGPDVMAAAIPRLMEENVQIILLGTGKKKFERMLKSAEEKYPGKVRAVVKFNAPLAHQIMAGADLLAVTSRFEPCGLIQLQGMRYGTPCVCASTGGLVDTIIEGKTGFHLGRLSVDCNVVEPGDVQKVATTLKRAIKLVGTPAYQEMVRNCMAQDLSWK

SEQ ID NO: 24087 - protein, 373 aa, Desulfitobacterium hafniense
MEPIKGEQRDGQSEIRKLAILTGGGDCPGLNAVIRAAVKTACHRGIAVVGIQDGFRGAVEGDFRPLELKDVSGILPRGGTILGTTNRDNPFAYPTQVGEERQVQDRSAEVMDRFKAEGIDALIAIGGDGSLSIAWEFAKQGLKVVGVPKTIDNDLMCTDLTFGFQTAVATAQDALDRLHTTAESHHRIMILEVMGRYAGWIALYAGVAGGADVILIPEIPYQLESIAEAVQRRARLGKHFSIIVVAEGAKPLGGDMVVERTMSGRTDPIKLGGIGAKLAADLEKVTDMETRVTVLGHLQRGGSPIAVDRVLSTRYGVAAVEAALAGDFGMMVALQGQDIVRVPMAEAVHKLKQVEPDDPVLNAARSMGIEFGD

SEQ ID NO: 24088 - protein, 725 aa, Ralstonia metallidurans
MTMFNKIVKEFQWGQHTVRMETGEIARQASGAVIVDVEDTVVLATVVAAKSPKAGQDFFPLTVDYIEKTYAAGKIPGGFFKREGRPSENETLTSRLIDRPLRPLFPEGFYNDVQVVIHVLSINPEIPADIPALIASSAALAVSGIPFNGPVGAARVGYKDGQYLLNPTRAQIAASDLDLVVAGTERAVLMVESEAHQLSEDVMLGAVVYGHEQMQIAINAIHDLVREGGKPEWDWAPAPKNEALIAKVSEIGLPLLQQAYQLRQKSARSTKLKEIYATVQAQLAEAGVEADKVEVGNVLFDLEAKIVRGQILAGEPRIDGRDTRTVRPIEIRSSVLPRAHGSALFTRGETQALVVATLGTKSDEQIIDALAGEYRDRFMLHYNMPPFATGETGRVGSPKRREIGHGRLAKRALIPVLPKDDEFAYTIRLVSEITESNGSSSMASVCGGCLALMDAGVPVKAHVAGVAMGLILEGNKFAVLTDILGDEDHLGDMDFKVAGTDAGITALQMDIKVQGITKEIMQVALAQAREGRMHILGAMQGAMGHARTELSAHAPRMITMKIHPDKIREVIGKGGSTIQALTKETGTTIDIQEDGTITIASTSTDGMAEAKRRIEGITAEAEVGKIYAGTVLKLLDFGAIVNILPGKDGLLHISEIVNERVKDIKDWLKEGQQVRVKLIQADEKGRLRLSLKAALAEEGGSISPIAQGDAPAAAPAAPASPDQQQ

SEQ ID NO: 24089 - protein, 462 aa, Glycine max
MESFGVCIISLILLLMLTKNLSSNALGDSIKDEEGLKEDQNEMENSLSNNDEMRGMKDDDWQMVQKKGNQFVVNDKPFYVNGFNTYWLMVFAADESTRGKVTEVFKQASSVGMTVCRTWAFNDGQWRALQKSPSVYDEEVFKALDFVVSEAKKYKIRLILSLANNWEAYGGKAQYVKWGNAAGLNLTSDDDFYSHPTLRSYYKAHVKTVLNRVNTFTNITYKEDPTIFAWELMNEPRCTSDPTGDKLQDWIQEMAFHVKKIDPKHLVEVGVEGFYGPSTPQRTQLNPNTYATQVGTDFIRNHLVLGVDFASVHMYPDSWISQQIADTHIPFVKSWMEAHIEDAERYLGMPVVFAEFGVSSKDPGYNSSYRDTVISTVYSTILNSTKKGGSGAGSLLWQFFPDGTDNMDDGYAIVLSKSPSTSSIIQLQSTRLALFNSLCNTKCNWGCKKKKLLEEILYHDEL

SEQ ID NO: 24090 - protein, 1207 aa, Magnaporthe grisea
MDDLENLELLSLVSKVTSELKNHMGVDDKDLADYIIANRLECDGFEAFKKWMDSECEFPPSLIESIDRLVRSMHPKLRNSSQNADLSAPTTTGRTQEQKNELFKGLAVADTQPALADEGPDAIDDTLALLEGLAPKGKPEKKDTSRGANGHDDYRKEDRNGERTSYRKRSRSPEAGYGDSRHRRKEQYRSRSRSRSRGKDQYGRRSRRDKYDDYNDGYDQKPARQDLDDTPVLQKVYDGHVTGVKDFGAFVNLHGVKGKVDGLVHVSALTDGQRVSHPSDFVDKGQPVKVKVIKIEGSRIGLSMKEVDQQTGEDLAPEVGFHSGANSMALGSRHNLSNGLLEDKAPDLSAIKNTLPGRKHKKRMTSPERWEIRQMIASGVAKASDYPELEEDYNNALSGEGQMELEEDVDIEIRDEEPPFLAGQTKQSLELSPIRVVKAPDGSLNRAAMAGTSLVKERKEIRQQEAEAAAQAAATNGKVDLASQWEDPMADPDKRKFAADMRRTMQNRPSEAVPEWRQAIAPKNQSFGKRTNMTIKQQRESLPVFAFREQLIKAVKENQIMIVVGETGSGKTTQLTQYLAEAGFANEGVIGCTQPRRVAAMSVAKRVSEEVGCELGQEVGYTIRFEDCTSPATRIKYMTDGMLQREIVIDPDLKRYSVIMLDEAHERTIATDVLFALLKKATRRRPDLKIIVTSATLDADKFSAYFNECPIFTIPGRTFPVEILYSKDPESDYLDAALTTVMQIHIDEPPGDILLFLTGQEEIDTSCEILFERMKALGPSVPELIILPVYSALPNEMQSRIFDPAPPGSRKVVIATNIAETSITIDHIYYVVDPGFVKQNAYDPKLGMDSLVVTPISQAQANQRAGRAGRTGPGKCFRLYTEAAYQTEMLPTSIPEIQRQNLSNTILLLKAMGINDLLHFDFMDPPPINTMLTALEELYALSALDDEGLLTRLGRKMADFPMEPSLSKVLIASVEMRCSDEMLSIVAMLNLPNVFYRPKEKQTQADAKKAKFHDPNGDHLTLLNVYNAWKQSRYSKPWCAENFIQFRALTRARDVRNQIERIMQRFKYQVMSCGSDTNRVRQALCSGFFRNAARKDQQEGYRTLIEGTPVYLHPSSALFGKHAEWVIYHTLVLTTKEYMHCTTSIEPKWLVDAAPTFFKVSASDKLSKRRQQERIQPLYNKFEGENDWRLSAQRRAGRGGGGGGTWG

SEQ ID NO: 24091 - protein, 458 aa, Listeria monocytogenes
MEEQKEELQRGLKNRHIQLIAIGGAIGTGLFLGAGKSIHLAGPSIMLVYLIIGAILFFVMRALGELLIHNPTTGSFTEFAEQFIGPWAGFITGWTYWFCWIVTGIAEITAVGMYVKFWVPDLPQWIPALACVLILLLFNLATVKAFGEIEFWFAIIKVVVIIALIVIGFVLVFIGYKHGTSTASFSNLVDYGGFFPNGIAGFLLAFQMATFSFVGIELVGVTAGEADDPERTLPKAINNIPIRILIFYIGALLVLMSIYPWSNIDPNTSPFVSVFTMIGIPAAAGIINFVVLTAAMSSCNSGIFSTSRMLYTLSAEGKAPKKMHHLSSNGVPATALITSTACLLIGVFLNYFLPEQVFILVTSIATICFIWVWGVILVAHLRFRHKHPEIAEKSKFKMPLSPLMNWVSLIFFGGLLVILGFAADTRIALFVTPVWFLILGIAYQILKASNRKTKIRHN

SEQ ID NO: 24092 - protein, 415 aa, Bacillus clausii
MATAKLISQKAKAHAPSLSQATTAEKNSVLQAMAQQLKADADVLLQANQLDIANAKKNGLSDHLIDRLLLTKARIDAMATAIDHLIELPEPIGAVKEEIKRPNGLVIKEMVVPFGVVGMIYEARPNVTVDACTLAVKTGNAVVLRGSASALHSNKAIVHTLKKAFQNSPIHPDVIQLLEDTSKEEAANMMQLKSTIDVLIPRGGANLIQTVLQEATIPVIETGVGNCHVYVASSADPDMAFDIVVNAKTQRPSVCNACETLLVEQSFAKAHLPALVERLSAKGVSLVGNEGACTLDPRIAQANEDDWSTEYLDLRLAIRVVADTNEAIAHINQYGTKHSEAIITESLAERDTFFATVDAACVYHNASTRFTDGFEFGFGAEIGISTQKLHARGPMGLKALTTSKYGIYGEGQVKE

SEQ ID NO: 24093 - protein, 616 aa, Bacillus clausii
MCGITGWVDWQRNLRTETKQMKNMANTLNRRGPDALETWTSDHAAFGHARLVVVDPEGGKQPMTRTAKGNTCTIVYNGELYNTEELRKELLAHGHTFAGHSDTEVLLKAYMEWGAACLEKLNGIFAFAVWDEQEQTLFMARDRLGVKPLFYTEKDGMLLFGSELKALLAHSQIEAVVDRSGLADVMGLSPSRTPGHGIFKGIVELRPAHYLQFSKNGSAVKRYWQLQSNIHTETAHETAAHIRELLEDIVERQLFADVPVGMFLSGGVDSSALTAIAARIYEKQGNAPIFSYSIDYEENEKYFKASTFQPNADADWVEKVAAHCGTNHKNCIIGNDVLANLLKESVLVRDTPGMADVDSSLLWFCKQIKNDVTVGLSGECADEIFGGYPWFHKAEVMAIDGFPWMRSLDERIQLLQPDWQKRLNLQEYVYDRYKETIQETPRFDGDSPEEARRREISYLNMIWFMTNLLDRKDRMSMGASLEVRVPFSDHRLVEYVWNIPWEMKTYGGREKGILRKALQGLLPDDVLFRKKSPYPKTHHPLYTAAVTKAIQEVVRQKDAPLFTFINRDRLKEIADKGGFDTGKPYFGQLMAGPQLLAHFVQIDYWMKAYNIQIDES

SEQ ID NO: 24094 - protein, 511 aa, Arabidopsis thaliana
MEEMTPAVAMTLSLAANTMCESSPVEITQLKNVTDAADLLSDSENQSFCNGGTECTMEDVSELEEVGEQDLLKTLSDTRSGSSNVFDEDDVLSVVEDNSAVISEGLLVVDAGSELSLSNTAMEIDNGRVLATAIIVGESSIEQVPTAEVLIAGVNQDTNTSEVVIRLPDENSNHLVKGRSVYELDCIPLWGTVSIQGNRSEMEDAFAVSPHFLKLPIKMLMGDHEGMSPSLTHLTGHFFGVYDGHGGHKVADYCRDRLHFALAEEIERIKDELCKRNTGEGRQVQWDKVFTSCFLTVDGEIEGKIGRAVVGSSDKVLEAVASETVGSTAVVALVCSSHIVVSNCGDSRAVLFRGKEAMPLSVDHKPDREDEYARIENAGGKVIQWQGARVFGVLAMSRSIGDRYLKPYVIPEPEVTFMPRSREDECLILASDGLWDVMNNQEVCEIARRRILMWHKKNGAPPLAERGKGIDPACQAAADYLSMLALQKGSKDNISIIVIDLKAQRKFKTRT

SEQ ID NO: 24095 - protein, 409 aa, Unknown
  Candidatus Kuenenia stuttgartiensis
MVRDAKSASRRIATASTALKNTALDYIAEGINSSADFILTENKKDVLAAKQAGLSEAMIDRLSLTDKRINAMADGVRQIIHLADPVGEIIHGHTRPNGLQIKKIRTPIGVIVIIYESRPNVTADAAALCLKAGNAVILRGGKEAIHSNIALYKILTAALEKAGLDKNGIQLVEITEREAIDYLLTSDKYVDVVIPRGGEALIRTVVEKSTIPVIKHYKGVCHTYVDEFADLKIAEEVCFNAKVQRPATCNAMETMLVHENIAPVFLPKIAKRLVDSGVQLLGCKKTCTFLDTIKPATDEDYHNEYLDMVLNIKVVDSIDDAISHITKYGSGHSEAIITTNYSNALQFTGEVDAAAVYVNASTRFTDGYEFGMGAEIGISTDKLHARGPMGLAELTSYKFVVFGNGQLRE

SEQ ID NO: 24096 - protein, 330 aa, Kluyveromyces lactis
MWEEFDITKLPYYDPKVDNKVALVTGGNSGIGYYTVLHLYLHGFKVYLGGRNSSRVNHAIKEIKKEAEIRLRKGQDEKPHDGLMIRKTGKLEYLHIDLTDLNSVEKAATKFTVQEDHLDVLINNAGVMAIPYELTKDNFEIQMQTNYVSHFLLTMRLLPLIKARKGRVITVSSLGHNLIFFNCNPGAQFNYWPSMFFMWCRYALAKTASIQFTKMLAIKNPDILCMSLHPGLVMNTNLFSYCTRLPFVGIFFWILFQFVGYFFGVSNEQGAISTLKCALSSDLSAETDNGAYFTTGGYPSKPSRVANSLDNAASTWIWTVHELRDRGHEI

SEQ ID NO: 24097 - protein, 296 aa, Listeria monocytogenes
MTTIKIALIQQKAVPNNKEANLKLAIQYIKEAHEKGADLVLFPEMWSNGYAPPFEDAFNHPLATGFGAERFKWLDEAIAADSAYVSTLKKLAKELQIGICATYLSKTEQRTQNTAIIIDRKGEIILDYAKVHTCDFSLEILLQSGEEFKVCEFDGIKLGVMICYDREFPESARVLMLKGAEIILVPNACDMNPARLNQLNSRAFENMVGVAMANYPGEKWGRSTAFSPIVFDENGDYRDNTIIETDDVSEGIFIAEFNLDEIRTYRENETWGNAYRKPQTYTDLISLDVKAPFKRN

SEQ ID NO: 24098 - protein, 643 aa, Mycobacterium avium
MCGLLAFVAARAGAVGADDAIARASHLMRHRGPDEPGTWAGADGSVVFGFNRLSIIDIAHSHQPLRWGPPETPDRYELVFNGEIYNYLELRDELAARHGAVFATDGDGEAIVAGFHHWGTDVLTRLRGMFAFALWDTVTRELFCARDPFGIKPLFVATGTGGTAVASEKKCLLELAELIGFDTAIDERAVQHYTVLQYVPEPETLHRGVRRLESGCYARIRPGAAPDVTRYFVPRFAAVPITRDTEQARYDEITAVLEDSVAKHMRADVTVGAFLSGGIDSTAIAALAIRHNPRLITFTTGFEREGFSEIDVAVASAEAIGARHIAKVVHPDEFVAALPEIVWYLDEPVADPALVPLFFVAREARKHVKVVLSGEGADELFGGYTIYREPLSLRPFDYLPRPVRRSMGKVSRPLPDGMRGKSLLHRGSLTLEERYYGNARSFSDTQLRDVLPGFRAEWTHTDVTAALYAQSIGWDPVARMQHIDLFTWLRGDILVKADKMTMANSLELRVPFLDPEVFAVASRLPVEAKITRTTTKYALRRALEPIVPAHVLHRPKLGFPVPIRHWLRAGELQDWAYSMVASSQAGHLVDLGAVRRMLDEHRNGVSDHSRRLWTVLIFMLWHAIFVEHSVVPQISEPVYPVQL

SEQ ID NO: 24099 - protein, 500 aa, Bordetella parapertussis
MYPSLPDRLLPGLPAPLGATSDGLGVNFAVFSANAARIELCLFDARGRKELARLPMPECTDEVWHGYLPDAQPGLVYGYRAHGPYNPRAGHRFNPHKLLLDPYATALTGALRWSDALFGYRMQHPRADLSMDRRDSAAGVPKAVVTEPAFHWGATRRPAAAWAHTVIYEAHVRGVSMLRSDLREPIRGTCAALADPRFIDHLHRLGVTALELMPVHAFLQDRTLVERGLRNYWGYNTLAYFAPEPAYLADGQPHDLRRAIRRLHAAGIEVILDVVYNHTCEGNELGPTLSWRGLDNASYYRLVPGDERRYIDDTGTGNTLNLSHPRVLQMVMDSLRYWAVHYRVDGFRFDLGVTLGREGTGFDAGSGFFDALLQDPVLARVKLISEPWDVGPDGYQLGRHPPGMAEWNDQFRDTARRFWRGDPGMAGALATRLTASRDVFDHRHRRPWSSINFAAAHDGFTLQDVVSFAERHNEANGEDGADGHGENYSSNWGVEGAASS

SEQ ID NO: 24100 - protein, 702 aa, Unknown
  delta proteobacterium MLMS-1
MKTRKKTFRSGAGSPLPLGVSRTPAGYNFAIAARHAEAVSLVLYPPSRAEPVAELAFDPHLNRSGDVWHLLLADFEPTLRYGFRLRGPCRSAAAGYCYRDELVMLDPYAKALTGGSDWGKAYRRPGRSDPLASFQRRCLYLEDDFDWEGDRPLNIPLSETIIYELHVRGFTRHPSSAVEHPGTYRGIIEKIPYFKELGVTAIELLPVAEFNELENTRVNPFTGEQLKNFWGYSPLAFFAPKAAYAVNGRDGNQVREFKEMVKALHAAGLEVILDVVFNHTAEGGADGPVISFKGIDNPIYYLLDPATREYLNFSGCGNTVNCNHPWVRELIVDCLRYWVTEMHVDGFRFDLASIFGRGARGEILAEPPMVEKIAEDPVLAKTKIIAEAWDAAGLYQVGSFSPHQRWAEWNGRFRDDVRRFLCGHDDTVAALATRLAGSSDLYGQNGRRPFNSINFITSHDGFTLHDLVSYNHKHNEANGEDNRDGDNHNISWNSGVEGESDEPAILALRARRLRTAAVILLLSQGVPMLCAGDEFGRSQRGNNNAYCQDNEISWLDWRLVEQNAGLLRFFRLLISLRRRHPLFRRDHFFSTAPSARQPEISWQALEPGRQDWSAGCRVLAFRLHGRAGGSGQRRDRDFFVMLNSDAQPQRFTLPKPPARRPWRLLIDTAAASPRDIYQDEKAPKVGGGRQEVAPHGAVVLIA

SEQ ID NO: 24101 - protein, 204 aa, Bordetella parapertussis
MRETRARVQRALLATVMLADGTPMLLAGDEFGNSQGGNNNAYCQDGPMGWLDWAVAQSTPGRALTAYAVRLAALRRAHPSLRATRYGDPAHQWQEGLGAIDWFNARGAPMTSADWDAPEGRLLVLRRALPDPAQPGRVDVTLLLCNAAAEPRPCVLPAPTLAWTLALDSASPEAPAAPCGGPEAIVGARAVLLLTASVDGAHTP

SEQ ID NO: 24102 - protein, 215 aa, Euglena gracilis
MGRRPAKCYRYCKNKAYPKSRYCRGVPEAKIRIYDCGMRKLNADTFPLTYHLISMEREQIGSEALEAARINANKYMIKNAGKEAYHIRVRVHPFHVCRINKMLSCAGADRLQQGMRGAFGKPNGLAARVRIGQPLMSIRVKPQHEAVVVAALKRASYKFAGRQVIAKSTMWGFTEIRSENYVKWKEEGKFRVDGVSTKILRNRGRLHRAKRVRAA

SEQ ID NO: 24103 - protein, 278 aa, Picea abies
MASGVAVVCSSSSVAAAVAVAPSSSSQKTVFANNVGAAKASFLVGRAVSLRQSKAAMPRRAAVIVSEAVQTERPLWFPGTTPPPWLDGSLPADFGFDPLGLGSDPETLKWNVQSELVHCRWAMLGAAGIFIPELLTKLGILNTPSWYTAGELEYFTDKTTLFVVEMIFLGWAEGRRWADIIKPGSVNTDPIFPNNKLTGTDVGYPGGLWFDPLGWGSGSPEKIKELRTKEIKNGRLAMLAVMGAWFQAEYTGTGPIDNLLAHLADPGHATVFAAFSSK

SEQ ID NO: 24104 - protein, 536 aa, Thermus thermophilus
MEDKATQTPEQTFSMEAALQETEARLEKRVRPGQILTGKVVLVGSEGVAVDIGAKTEGIIPFNQLTTKPLSEEELRNLLSPGDEVKVQVLRVDPETGQILLSRKKIEAQEKWDRIQELYEKGEPVTVTIKERVKGGVVAELDGVQGFMPASQLDLRRVPNLDEFVGQQVLAKIIEFHRRKGRVILSRRAVLEEEQKKAREAFLKSLEPGQVVEGTVVEVTDFGVFVNLGPVDGLVHRSEITWGRFNHPREVIQKGQKVKAQVLSVDPEKERVNLSIKALIPDPWTTVAEKYPVGTRVRGKVVGLTQFGAFVEVEPGLEGLIHISELSWTKRPKHPSEVVKEGDEVEAVVLRLDPEERRLSLGLKQTQPDPWQQLTEKYPPGTVLKGKVTGVTDFGVFVEIEPGIEGLVHVSELDHKRVENPAALFKKGDEMEVVVLNIDPVEQRVSLSRKRLLPPPLPQEEERPRRARSGKERARRKGAPRREDRREYEYGAVAEYNLYDASSVPTTTATVKLGDLYGDLLASLGLEEEAEEKSRG

SEQ ID NO: 24105 - protein, 235 aa, Nepenthes hamata
  misc_feature (3)..(4): Xaa can be any naturally occurring amino acid
  misc_feature (6)..(7): Xaa can be any naturally occurring amino acid
  misc_feature (10)..(11): Xaa can be any naturally occurring amino acid
  misc_feature (15)..(17): Xaa can be any naturally occurring amino acid
  misc_feature (19)..(20): Xaa can be any naturally occurring amino acid
  misc_feature (22)..(24): Xaa can be any naturally occurring amino acid
  misc_feature (26)..(26): Xaa can be any naturally occurring amino acid
  misc_feature (28)..(31): Xaa can be any naturally occurring amino acid
  misc_feature (33)..(34): Xaa can be any naturally occurring amino acid
  misc_feature (37)..(39): Xaa can be any naturally occurring amino acid
  misc_feature (47)..(48): Xaa can be any naturally occurring amino acid
  misc_feature (55)..(55): Xaa can be any naturally occurring amino acid
  misc_feature (58)..(58): Xaa can be any naturally occurring amino acid
  misc_feature (69)..(69): Xaa can be any naturally occurring amino acid
LIXXVXXNLXXALGXXXPXXSXXXAXAXXXXGXXLYXXXRPGGSPLXXMCQVLVXSFXKSKLALPEDSXLLYETSDKNSAIEGSRKLEHTDELRCLDKAAVVSDKEIKCEDFSNPWRLCTVTQIEELKILIRMFPIWATGIVFSAIYAQMSTMFVEQGEVMDRTIGSFTIPAASLSMFDTISVIFWVPVYDKILVPLARKFTGKQRGFSELQRMGIGLFISILSMAAAALVEMKR

SEQ ID NO: 24106 - protein, 219 aa, Solanum melongena
MGRRPARCYRQIKNKPYPKSRFCRGVPDPKIRIYDVGMKRKGVDEFPFCVHLVSWEKENVSSEALEAARIACNKYMTKSAGKDAFHLRVRVHPFHVLRINKMLSCAGADRLQTGMRGAFGKPQGVCARVAIGQVLLSVRCKDGNSNHAQEALRRAKFKFPGRQKIIVSRKWGFTKFSRTDYLKYKSENRIVPDGVNAKLLGNHGPLAARQPGRAFLSSS

SEQ ID NO: 24107 - protein, 150 aa, Nicotiana tabacum
CGGCEAGSAGKDAFHLRVRVHPFHVLRINKMLSCAGADRLQTGMRGAFGKPQGVCARVAIGQVLLSVRCKDGNANHAQEALRRAKFKFPRRQKIIVSRKWGFTKFSRTDYLKYKSENRIVPDGVNAKLLGCHGRLAARQPGRAFLEAVGN

SEQ ID NO: 24108 - protein, 196 aa, Lactobacillus plantarum
MNMRQATIKRETKETQIEISLNLDEQSGIEIDTGIGFLNHMLNLFAKHGRFGLVVKCHGDLDVDPHHTTEDTGIVLGECFKQALGDKQGIERYGTEFVPMDETLGQVSVDLSGRSYLVFDAELTNPRLGGLDTETVEDFFQAVAFAAEMNLHARILYGRNTHHKVESLFKAFGRAMRAAVTINPDIQGVNSTKGVI

SEQ ID NO: 24109 - protein, 541 aa, Oryza sativa
MTTVASLSLLPHLLIKPSFRCCSRKGVGRYGGIKVYAVLGDDGADYAKNNAWEALFHVDDPGPRVPIAKGKFLDVNQALEVVRFDIQYCDWRARQDLLTIMVLHNKVVEVLNPLAREFKSIGTLRKELAELQEELAKAHNQVHLSETRVSSALDKLAQMETLVNDRLLQDGGSSASTAECTSLAPSTSSASRVVNKKPPRRSLNVSGPVQPYNPSLKNFWYPVAFSSDLKDDTMVPIDCFEEQWVIFRGKDGRPGCVMNTCAHRACPLHLGSVNEGRIQCPYHGWEYSTDGKCEKMPSTKMLNVRIRSLPCFEQEGMVWIWPGNDPPKSTIPSLLPPSGFTIHAEIVMELPVEHGLLLDNLLDLAHAPFTHTSTFAKGWSVPSLVKFLTPSSGLQGYWDPYPIDMEFRPPCMVLSTIGISKPGKLEGKSTKQCSTHLHQLHICLPSSRNKTRLLYRMSLDFAPWIKHVPFMHILWSHFAEKVLNEDLRLVLGQQERMINGANVWNWPVSYDKLGIRYRLWRDAIERGVDRLPFSNQSESGS

SEQ ID NO: 24110 - protein, 235 aa, Nepenthes glabrata
  misc_feature (138)..(138): Xaa can be any naturally occurring amino acid
LIVWVQENLGWALGFGIPAISMGIAIASFFSGTTLYRLQRPGGSPLTRMCQVLVASFRKSKLALPEDSSLLYETSDKNSAIEGSRKLEHTDELRCLDKAAVVSDKEIKCEDFSNPWRLCTVTQIEELKILIRMFPIWXTGIVFSAIYAQMSTMFVEQGEVMDRTIGSFTIPAASLSMFDTISVIFWVPVYDKILVPLARKFTGKQRGFSELQRMGIGLFISILSMAAAALVEMKR

SEQ ID NO: 24111 - protein, 448 aa, Lactobacillus sakei
MAHISFDASRLDKFVQSNELAEMQAMVNAADSQLREGTGAGNDFRGFLDLPVNYDKDEFARIKEAVAKIKSDSEIFVAIGIGGSYLGAKAAIDFLNNTFYNMLPAEQRDFPQVLFAGNSISSSYLSDLVNLIGDRDFSINVISKSGTTTEPSIAFRVLKDKLIKKYGKEEAKGRIYATTDRAKGALKTESDAEGYAEFVVPDDIGGRFSVLTAVGLLPIAVAGGDIDQLMKGAADARLEYTDTDVTKNDAYKYAALRNILYRKGYTTELLENYEPTLQYFSEWWKQLMGESEGKDQKGIYPSSANFSTDLHSLGQYIQEGRRNLMETVVNVEKPNSDIDIPADEQNLDGLGYLEGHTMDFVNKKAYQGVVLAHTDGGVPVMTVNIPDQTAYTLGYMIYFFEMAVSISGYLNGINPFNQPGVEAYKKNMFALLGKPGFEELGKELNERL

SEQ ID NO: 24112 - protein, 885 aa, Arabidopsis thaliana
MKMKLDWTRRYKIIGGIARGILYLHQDSRLTIIHRDLKAGNILLDDDMNPKIADFGMARIFGMDQTEAMTRRVVGTYGYMSPEYAMYGQFSMKSDVYSFGVLVLEIISGMKNSSLYQMDESVGNLVTYTWRLWSNGSPSELVDPSFGDNYQTSEITRCIHIALLCVQEDAEDRPTMSSIVQMLTTSLIALAEPRPPGFFFRSKQEQAGPSIDSSTHCSVDEASITRTIKIDSEQKFIFTASAQNPFYLYHNCSITTTYSSNSTYSTNLKTLLSSLSSRNASYSTGFQNATAGQAPDMVTGLFLCRGNVSPEVCRSCIALSVNESLSRCPNEREAVFYYEQCMLRYSNRNILSTLNTDGGVFMQNARNPISVKQDRFRDLVLNPMNLAAIEAARSIKRFAVTKFDLNALQSLYGMVQCTPDLTEQDCLDCLQQSINQVTYDKIGGRTFLPSCTSRYDNYEFYNEFNVGTPQDSSPRPGKGGNSSVIVIAVVVPITVLFLLFVAFFSVRRAKRKKTIGAIPLFKVKRKETEVTEPPAETTDGDDITTAGSLQFDFKAIVAATDIFLPINKLGQGGFGEVYKGTFPSGVQVAVKRLSKNSGQGEKEFENEVVVVAKLQHRNLVKLLGYCLEGEEKILVYEFVPNKSLDYFLFDPTMQGQLDWSRRYKIIGGIARGILYLHQDSRLTIIHRDLKAGNILLDADMNPKVADFGMARIFGMDQTEANTRRVVGTYGYMAPEYAMYGKFSMKSDVYSFGVLVLEIVSGMKNSSLDQMDGSISNLVTYTWRLWSNGSPSELVDPSFGDNYQTSEITRCIHIALLCVQEDANDRPTMSAIVQMLTTSSIALAVPRPPGFFLRSKQEQAERACPSMDTSDLFSIDEASITSVAPR

SEQ ID NO: 24113 - protein, 86 aa, Glycine max
MASSMISSPAVTTVNRAGAGMVAPFTGLKSMAGFPTRNTNSDITCVASNGGRVRWVRVWPPIGEREWESVCSLPNVPDRAVRGDVQ

SEQ ID NO: 24114 - protein, 459 aa, Synechococcus elongatus
MTGVENVVIIGSGPAGLTAAIYAARANLKPLMFEGYQLGGLPGGQLMTTTEVENFPGFPEGITGPELMERMRAQAVRWGAELYTEDVISADLSQRPFRIRSQEREVLAHSVIIATGATARRLSLPGEDRLWNNGISACAICDGAAPIFRDGELVVIGGGDTAAEEAVYLTKYAKHVHLLVRSDRMRASKAMQDRVLAHPNVTVHWHTEAIEAVGNTLLEAVRVRNNQTGEEKAIAAQGLFYAIGHTPNTKLFEGQIELDGTGYIRTKPDSVETSLEGVFAAGDVQDHEYRQAITAAGTGCAAALLAERYLSAHNLLQEYKQEAAAAEPETKAAATPAASQPEASEFDPTSVYHEGSYALRKLYHESDRLLAVLYTAPTCGPCRTLKPILRKVAEEFSDRLHYVLIDIDADPEIAQSAGVVGTPTLQLFKDKAKVDEIRGVKMKSDYRARFEQHLQPVSR

SEQ ID NO: 24115 - protein, 290 aa, Wolinella succinogenes
MRVALIQQAFHGSREATIQRSRELILEASKGGAELVVMQELHTSEYFCQSEETRFFDYASFYEEDVRIFSSIAKEGGVVLVGSFFERRSAGIYHNTAVVFEKDGSIAGRYRKMHIPDDPGFYEKFYFTPGDLGFEPISCSLGKLGVLVCWDQWYPEAARLMALKGADILLYPTAIGWFDADDLDEKERQKEAWIAIQRGHAVANGLPVVAVNRVGFEKDSSGVLEGIRFWGHSFAFGPQGEPLALGSMESEEVIWVDVDMKRSEEVRRIWPFLRDRRIECYDGLTKRFLD

SEQ ID NO: 24116 - protein, 553 aa, Clostridium cellulovorans
MHIFETRLILFNTVQNTNGMTRRWSFLVQCFTFKKKEGVRSRYMSDYNYVEVLQKSILFYEAQRSGKLPESNRLNWRGDSGLEDGKDVGHDLTGGWYDAGDHVKFGLPMAYSAAVLAWTVYEYREAYEEAELLDDMLDQIKWATDYFLKAHTGPNEFWAQVGDGNADHGWWGPAEVMPMNRPAFKIDEHCPGTEVAAQTAAALAAGSIIFKETDAPYAAKLLTHAKQLYAFADQYRGEYTDCVTNAQPFYNSWSGYIDELIWGGIWLYLATNDQTYLNKALKAVEEWPKDWDYTFTMSWDNTFFLSQILLARITKEKRFIESTERNLDYWSTGFVQNGKVERITYTPGGLAWLDQWGSLRYTANAAFLAFVYADWVSDQEKKNRYQTFAIRQTHYMLGDNPQNRSYVVGFGKNPPMHPHHRTAHGSWSNQLTTPSSHRHTLYGPLVGGPNRQDQYTDDISDYVSNEVATDYNAAFTGNGAAVWSGQSKLPNFPPKEKVEDEFFVEAAVMSNDTTSTQIKAILYNRSGWPARSSQSLSFRYYVNLSEIFCEGIH

SEQ ID NO: 24117 - protein, 218 aa, Ampelocalamus patellaris
GMDVSEWDPNKDKYISVKYDKTTAIEAKALNKEALQAEVGLPVDGKIPLVAFIGRLEEQKGPDVMAAAIPQLMEENVQIILLGTGKKKFERMLKSAEEKYPGKVRAVVKFNAPLAHQIMAGADLLAVTSRFEPCGLIQLQGMRYGTPCVCASTGGLVDTIIEGKTGFHLGRLSVDCNVVEPGDVQKVATTLKRAIKLVGTPAYQEMVRNCMARDLSWK

SEQ ID NO: 24118 - protein, 235 aa, Nepenthes albomarginata
  misc_feature (208)..(208): Xaa can be any naturally occurring amino acid
LIVWVQENLGWALGFGIPAISMGIAIASFFSGTALYRLQKPGGSPLTRMCQVLVASFRKSKLALPEDSNLLYETSDENSVIEGSRKLEHTNELKCLDKAAVVSDKEIKREDFSNPWRLCTVTQIEELKILIRMFPIWATGIVFSAIYAQMSTMFVEQGEVMDRTIGSFTIPAASLSMFDTISVIFWVPVYDKILVPLARKFTGKQRGXSELQRMGIGLFISILSMAAAGLVEMKR

SEQ ID NO: 24119 - protein, 218 aa, Ampelocalamus scandens
GMDVSEWDPNKDKYISVKYDKTTAIEAKALNKEALQAEVGLPVDGKIPLVAFIGRLEEQKGPDVMAAAIPQLMEENVQIILLGTGKKKFERMLKSAEEKYPGKVRAEVKFNAPLAHQIMAGADLLAVTSRFEPCGLIQPQGMRYGTPCVCASTGGLVDTIIEGKTGFHLGRLSVDCNVVEPGDVQKVATTLKRAIKLVGTPAYQEMVRNCMAQDLSWK

SEQ ID NO: 24120 - protein, 218 aa, Drepanostachyum hookerianum
GMDVSEWDPSKDKYISVKYDKTTAMEAKALNKEALQAEVGLPVDGKIPLVAFIGRLEEQKGPDVMAAAIPQLMEENVQIILLGTGKKKFERMLKSAEEKYPGKVRAVVKFNAPLAHQIMAGADLLAVTSRFEPCGLIQLQGMRYGTPCVCASTGGLVDTIIEGKTGFHLGRLSVDCNVVEPGDVQKVATTLKRAIKLVDTPAYQEMVRNCMVQDLSWK

SEQ ID NO: 24121 - protein, 163 aa, Acetabularia acetabulum
WFQGTADAVRQQIRYVEEDKGDEVLILSGDQLYRMDYVPMIQMHRETGADATIAVIPIPTEETYGLGLAVSMTMAGSKGLSKTQDRGRACPGEDVGRLAEKRGVKDTNRQFLGNMGIYLFKKDSLLELLNAPPKATDFGKEIFPRCVDTHKVMTYVFEDYWED

SEQ ID NO: 24122 - protein, 218 aa, Thamnocalamus spathiflorus
GMDVSEWDPSKDKYISVKYDKTTAMEAKALNKEALQAEVGLPVDGKIPLVAFIGRLEEQKGPDVMAAAIPQLMEENVQIILLGTGKKKFERMLKSAEEKYPGKVRAVVKFNAPLAHQIMAGADLLAVTSRFEPCGLIQLQGMRYGTPCVCASTGGLVDTIIEGKTGFHLGRLSVDCNVVEPGDVQKVATTLKRAIKLVGTPAYQEMVRNCMAQDLSWK

SEQ ID NO: 24123 - protein, 327 aa, Zea mays
  misc_feature (48)..(48): Xaa can be any naturally occurring amino acid
  misc_feature (89)..(89): Xaa can be any naturally occurring amino acid
GHCEGYNTLSLRVAQIPINTKTPIAVLNPKLVKEYELNPIVLEFRRVXKGARGTHLAKWHCSKVFVKILDKDSFSDAESINASTHAFTXLEKARHPNLVQFVGAVTQNVPMMIVSEYHQKGDLASYIEMKGRLKPHKAIRFALDIARGLNYLHECKPEPIIHGNLSPKNIIRDDEGQLKVAGFGSLSLSKVSEDKVQMAQPVTKFDNVYIAPEVYKNEPFDRSVDVFAFGLILYEMIEGAPAFHPKPQEEAAKMICLEGLRPPFKNKPKYYPSDVKELIQECWDPMPSVRPTFAEIIVRLNKIHASCAKQGSWRDTFKLPWKQTGER

SEQ ID NO: 24124 - protein, 175 aa, Triticum aestivum
MAPAVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 24125 - protein, 195 aa, Thellungiella halophila
MTKMGFKPDSNPSPNPNESNAKEIRYRGVRKRPWGRYAAEIRDPGKKTRVWLGTFDTAQQAARAYDAAAREFRGAKAKTNFPTFLELNAAKDGGFARSPSQSSTVDSVSPTSARLVTPPQLELSLGGGGGGACYQIPVARRPVYFYNMTTFPAAAAATCGVQSESDSSSVVDFECGAEKKYRPLDLDLNLAPPAE

SEQ ID NO: 24126 - protein, 218 aa, Thamnocalamus tessellatus
GMDVSEWDPSKDKYISVKYDKTTAMEAKALNKEALQAEVGLPVDGKIPLVAFIGRLEVQKGPDVMAAAIPQLMEENVQIILLGTGKKKFERMLKSAEEKYPGKVRAVVKFNAPLAHQIMAGADLLAVTSRFEPCGLIQLQGMRYGTPCVCASTGGLVDTIIEGKTGFHLGRLSVDCNVVEPGDVQKVATTLKRAIKLVGTPAYREMVRNCMAQDLSWK

SEQ ID NO: 24127 - protein, 317 aa, Zea mays
MSSSSSSSSSSAASAATVFPRSPQLPPPVLVENGLTPLHQLTPVAAAAPAAEQLCYVHCYFCDTVLVVSVPTSSLFKTVTVRCGHCSSLLTVDMRGLLFPGTPTDTVAGAAPPPAADTSTTTTTITTAPPPANSVNNGQFHLPHSLNHPHHQSLLVDEISSAANPSLQLQMEQHGGLGGLILGGSRNTAAPPPPQPPAAGKGAKEPSPRTNPAVNRPPEKRQRVPSAYNRFIKDEIQRIKAGNPNISHREAFSAAAKNWAHFPHIHFGLMPDHQGLKTTSLLPQGHQRKDGLLKEGLYAAAAAAAAHAAANMGIAPY

SEQ ID NO: 24128 - protein, 212 aa, Oryza sativa
MSSPATAAAAAASCGVLRHHHPPASPRPPPTTTTTTSRLLLASRSRGLQRPLRVNHAPPRRLPPTAARAQSAAAAGYQPESEFYKVEAILRPWRVPYVSSGLLQMGIRGVTVSDVRGFGAQGGSTERHEGSEFAEDTFIDKVKMEIVVSKDQVEAVVDKIIEKARTGEIGDGKIFLIPVSDVIRIRTGERGERAERMAGGLADKLSSAMPIS

SEQ ID NO: 24129 - protein, 142 aa, Thellungiella halophila
MQGAMSIKPTILLPLPSSQSSPKLTLLLPQSITTTKASRLSSLRPNASSSSSTSDSLTVDYNSLLSVFPAEACETISGYACSADIYPEVKLDTKPVSRPVATTEPVDREYLEYNNPKTVFCAEACDDLGGEFCEPDYQKDVY

SEQ ID NO: 24130 - protein, 361 aa, Bacteroides fragilis
MKKKFTIFVMLLAGIIYTGHAQDVQWIYQQKQEKKNMKNLSEIYFAGGCFWGTDHFLKQIRGVKSTQVGYANGNIANPTYQQVCTGKTNFAETVKVEYNPQEVPLKLLIDLFFKTIDPTSLNRQGNDKGSQYRTGIYYTDEADLPTIRTAIDELAKEYSKPIVIEVKPLSNFYKAEEYHQDYLDKNPGGYCHINPALFELAKKANAQAEQSQTNYKKTDDATLRSKLTPEQYAVTQKNATEPAFHNEYWDEKRDGIYVDITTGEPLFISTDKFDSGCGWPSFTKPIEKEVIKEKMDTSHGMIRTEVRSKTGDAHLGHVFTDGPKEKGGLRYCINSASLRFIPKEKMKEEGYGEYLKLLPQK

SEQ ID NO: 24131 - protein, 722 aa, Yarrowia lipolytica
MALLDSLDFIVLVLVGVATLAFFTKGKLWAKEPETDPYAGGLGSQGFGSTTSFGSFGGNSNKTRDITKKLEQTGKNVIIFYGSQTGTAEDYANRLSKEATQRYGLKSMTADLEDYDYENLNSLGDDIVVGFVMATYGEGEPTDNAVNFYEFINDDSSEWAESDEPSADPDSPLSSLNYVIFGLGNNTYEHYNEIGRNLDKRLKKLGAKRIGDYGEGDDGQGTMEEDYLAWKDDLFSAWKEAKGLDEHEAKYEPSVKISETGETASSEDSSSVAEPDAEAMSVYLGEPNKKILRGEIKGPYNAGNPFLANVSETRELFHDPKRSCIHVEFDVGTNVKYTTGDHLALHIQNSDEEVERFLKVIGLWDKRHNVIKAKPIDPTYKPSFPVPTTYDTVVRYYLEINGAVSRQLLAFIAPFAPTETAKKEALRLGSDKNAFADEVAKHYTNIAHVLSKLSGGEPWTNVPFSFLVESLPHLIPRYYSISSSSLVDKSKISITAVVESLEAPEYAIKGVATNLLLDMKIKKDGVDPSKSKDPQAVHYELSGPRGKFGGHKLPVHIRRSNFKLPSDPKKPIIMIGPGTGLAPFRAFVMERAKQAESGTDVGQQLLFFGCRNPNEDFIYKEQWAGIEKELGDKFTMVTAFSRVDPVQKVYVQHRMQEYAKQINDLMQQGAYFYVCGDASRMAREVQATLAKILSDQRGIPLSSAEQLVKSLKVQNVYQEDVW

SEQ ID NO: 24132 - protein, 339 aa, Rhizobium leguminosarum
MSLLEKFERYQLTFGPTPIEHLPRLTAALGGKVDIYAKRDDCNSGLAMGGNKLRKLEYIVPDAIASGADTLVSIGGVQSNHTRMVAATAAKIGMKCVVIQEKWVPHYDAVYDRVGNILMTKLMGADSRLVEDGFDIGIRKSWEDAIQSVEDAGGKPYAIPAGASVHKFGGLGYVGFAEEVAAQEKDLGFIFDYIIVCVVTGSTQGGMIVGFAALNRADRVIGIDASGTLQQTRDQVRKIVDATSELVNLGRSVREDEIVINPDYAYPAYGVPSEETNEAIRLAARTEAMITDPVYEGKSMQGMIDLARKGFFSEGSKVLYAHLGGAPALNGYSYYYKDG

SEQ ID NO: 24133 - protein, 284 aa, Picea glauca
MEHMNTTAQSSSSLYGVHMVEYGGDVGVGSMMALMTEHQPESESIMTSIPIPSSYSSYSHGHGHGHGHGHGHGQSECLLSAAAMFQTSRPCQGANKFEPANAHIGGGGAGHFVMEQFIPEQAVISDSSISSVKTEVCSGSGGTGVPGQFELIRRKEEGRCARAYAEPSFVVTPLVTSLPPQQQEARMVTSLAVDMDNSCSCKPIEADAMKAKIIAHVHYPRLVAAYIDCQKVGAPPDVVSELDELSQKCHAQQCVATISIGADPELDQFMEAYCEMFIKYQEEL

SEQ ID NO: 24134 - protein, 910 aa, Phaeodactylum tricornutum
MVPKPEDPTVKAENNAAMDQLSLLDKEDISSASRSCRELYGPYPKAIPVPFLNSRNEAREGDTPAASVIAQAKTIFDVPADYRDVGTPDEWVPRDGRLVRLTGKHPLNVEPPLAILKQHRFITPSSLHYVRNHGACPKLSWKQHTVCVGGKLVPNALELSMDEIVAMEPRELPVTLVCAGNRRKEQNMIRQTIGFNWGPSGVSTSVWKGVLLRDLLLRAGVSEKNMAGKHVEFIGVEDLPNKVGPGPFQEEPWGKLVKYGTSVPLARAMNPAYDILIAYEQNGEVLQPDHGYPVRLIIPGYIGGRMIKWLKYINVIPHEPKNHYHYHDNRILQGGWWYKPEYIFNELNINSAIAAPDHNETLSIAKNIAKTYDVTGYAYTGGGRLITRVEISVDGGIHWELAKRERKEQPTDYGMYWCWTWWNYEVKVADLVGAKEIICRAWDESNNPQPVVPTWNLMGMGNNQAFRVKVHMDKTASGEHVFRFEHPTQPGQQTGGWMTKVATKPESAGFGRLLEVQAESKEDAAPAPPPKENTKIFTMEEIEKHNTEEDCWIVVKDRVYDCTEYLELHPGGIDSIVINGGADSTEDFVAIHSTKATKMLEKYYIGQLDKSSVAEEKKQEDEPLVDADGNALALNPKKKTPFRLQNKITLSRDSYLLDFALPSPKHVLGLPTGKHMFISALINGEMVLRRYTPISSNYDIGCVKFVVKAYRPCERFPDGGKMSQYLDQINVGDYVDMRGPVGEFEYSANGSFTIDAEPCFATRFNMLAGGTGITPVMQIAAEILRNPQDPTQMSLIFACREEGDLLMRSTLDEWAANFPDKFKIHYILSDSWSSDWKYSTGFVDKALFSEYLYEAGDNVYSLMCGPPIMLEKGCRPNLGEPWSQKGQNFFLLKVLGLIVISILHFTIHFQ

SEQ ID NO: 24135 - protein, 366 aa, Mesorhizobium loti
MPACSIGWVFRTEISSNIRKALGKELDMPRIVPVLDLSRLEQGASERRTFLADLRSASRDIGFFYLAGHGISWAEISEVLTASRQFFALPEADKLAIEMVKSSQFRGYTRAGGELTKGREDWREQLDIGVERQAIAQGPGTPAWTRLQGPNQWPAALPDLKPALLAWQSKVTAVAIRLLKAFAQSLDQPEDAFDPIYSSEPNHRMKIVRYPGRDTTGGDQGVGAHKDGGFLTLLLQDDNKGLQVDYDGSWVDVDPIPGTLVVNIGELLELASNGYLRATVHRVVTPPAGVERISVPFFFSARLDATIPLLGLSEELAAQARGPASDPDNPLFRDVGTNVLKSRLRSHPDVARRHYADLLKGESRVG

SEQ ID NO: 24136 - protein, 317 aa, Actinidia deliciosa
TFPVIDMEKLTGKERSPTMEKINDACENWGFFELMNHGISHELMDTVERLTKEHYKKCMEQRFKEMVATKGLEAVQSEIDDLDWESTFFLRHLPVSNISEIPDLEQDHRKAMKEFAEKLEKLAEQLLDLLCENLGLEKGYLKKAFSGSKGPTFGTKVSNYPPCPLPELIKGLRAHTDAGGIILLFQDNKVSGLQLLKEGEWIDVPPMKHSIVINIGDQLEVITNGKYKSVMHRVIAQTDGNRMSIASFYNPGSDAVIYPAPALVDKEEDQQKQVYPKFVFEDYMKLYAGLKFQAKEPRFEAMKAMESAVKLGPISTI

SEQ ID NO: 24137 - protein, 246 aa, Asterionellopsis glacialis
GGWWYKPEYIFNELNINSAMTAPDHNETIDLARNIAGTYEVGGYAYTGGGRRISRVEVTTDGGKHWEVAKIHQIERPTDYGMYWCWIWWSFDLKVADLVGCKEIWCRAWDESNNCQPTEPTWNLMGMGNNQVFRVKVHLVQDANGNHVFKFEHPTQPGQQEGGWMTKLSEKPDSAGFGRLLEQGQAAPKDAAPVATGFRRSRKEAKLITMEEVRKHNKEEDVWIVVNNKVYDCTEYLDLHPGGADS

SEQ ID NO: 24138 - protein, 242 aa, Unknown
  Amphora sp. CCMP1405
GGWWYKPEYIFNELNINSAMSKPDHNETLSIAKNIDKTYELTGYAYTGGGRMISRVEISTDGGTHWELATLDRKEYPTPHGMYWCWVWWSYQVKVADLVGCKEIMCRAWDESNNCQPMNPTWNLMGMGNNQVFRIKVHLDKTAAGEHVFRFEHPTQPGQQTGGWMTRASDKPESAGFGKLLQIQGEAKEESAPAPAPSAGGKKFAWSEIQKHDKEDDVWIVVKDRVYDVTEYLELHPGGADS

SEQ ID NO: 24139 - protein, 247 aa, Chaetoceros muellerii
EGWWYKPEYIFNELNINSVMSAPDHNETLSIKDNIDKHYDVTGYAYSGGGRAVTRVEVSTDGGHHWELAQIDRKEKPNDYGMYWCWIWWTFKIKVADLVGCKEIMCRAWDEANNCQSIHPTWNLMGMGNNHAFRVKIHLDKTASGKHVFRFEHPTQPGQQKGGWMTKVSGKPESAGFGRLLEVEVDGEQDVVPANDPKPSKGAEGKKLYTMEEVEKHNTEKDAWIVVHNKVYDCTEYLELHPGGADS

SEQ ID NO: 24140 - protein, 181 aa, Pyrococcus furiosus
MALRPAKIDRYVDKPAYTRREYIRGAPGPKITIFDMGNPAGDFEFEVSLHTAEPVQIRQNALEAARQQVNRYLQKNVGRSNYHFKIRVYPFQVLRENPMATGRKADRYGNGMRRPFGKPIGLAARLKKDQKILSIRVNRQHLKFAIEGARRAAMKFPCKCYYRIYDKEGNDVTTKILSQSL

SEQ ID NO: 24141 - protein, 620 aa, Coccidioides immitis
MICSRAEGRSRRLKASEWEWEKREPPNTKPLKPSLGICHWPGDSQGLEHLPITETSFGSGYWTQTDNAGQSAVMTKESQIPVGEYLFRRLHQLGLRHILGVPGDFNLNLLDHIYNVPDMRWVGTCNELNAAYAADGYARTRGIPGAVITTYGVGELSAINGIAGAYSEYVPVIHIVGNTSRDMQRNHVKIHHTLWMDGWDHTTYQKMSEPVRKDSAFLMDPATAPEQIDRVIETCVKTRLPVYLFVPIDVPDLMTDSSRLSIPLDLEVRNDGREAHEDEVVSEIVRAIDQASSPGVLIDVLVQRHGLVGDAKELIEQINAPFYITPMGKSIVNESDPRFAGLYGGDKVIKLHPSYCSVGSKVWDGLDFRPVVKKLVQRLNKQPLTRKASSVPKSQPYKETAHVDDSCVDGLDHKRFWDRLSRYIQPNDFVIAEVGTSQFGSLDLKLPDNCQYFSQLYYSCIGFTVPALLGVLLARKETGAEGRVILLVGDGSLQMTVQEFGTIIREGLKPTIFVVNNAGYSIERLIHGPMQQYNDISTQWDYQKMLSFFGAPNAPTYVAKTYAELGKVLNDEAFKKGDRIQLLEVFFDMLDSPWNLTALLDLKEKRLRAAAAAAAAANGN

SEQ ID NO: 24142 - protein, 1292 aa, Oryza sativa
MSGLDLREMLSSAARRHTWRRSGWGAEWGGGDDARSAALPARCPPPPPPRRPAAAGGRGDEGSGGVRGRGEEGTSRGGSGARREDAAGTGRNAVAVVAGGSATSGAERVAARAEDGRRSMDGPTLELSEMMLHAAQPWRSRCTQRDVRPGAVPPRPVAADGRGEGTSTVRGRVLEGTTRGGGRGGGMEREREVVAPARNAVAVAGDLATHGGERVAGPLVAKEKRNGGGELGTKRGLEKRAPLPPPKRRVVSAKRQFPPDFGRDSAVPLGRGRGRGGGVRPSDGAPARAVLGEKVASAGNGDSMANVHHHAVMDTVLMKSSHASDENLVAFKVGSPENGAEGAARGKGAHNGELLGKREVLAQAVNLLPMRRTVSATHRFTAGCGRDAAAPLARREEGKVGSGLEVMPVDVGGGVSKEVMATDGSKHSVNQCTANIVGAVGVLDGTVQYQELEEGEVADEAYCDVESQKVVGCDSFDDSAGERHEGVVPVTFAVTEVLTSHAYDEMMQIKALQEGGSDAAQETEHDLPMGGKCETILPDASPKCSFGGPSNEIVHGKRVLGSHGMKGEVPSLAIEDHGGIAQIDQELEDVEMTTGEYRVQDAQIATHVIPHESTTGRHEGGLCASAAAEDVKVMNKYKGTLPKGAAKSSMNIATGVFGDGIMRSKILSTARKVVKPPVRASHKPPLNTLHRPFSTNSASFGHKKLKVKRPDQSKDIPMKIASTSGLAGKDNLIDEKALSLEDDDILKALVVHDGKLEVYLNVPSCVQLHRQHGSGNADDRSKIRMLCRRFQFICRALLHAVEQGSLKIRRVDLAADKIIRKLPGFTKPGPTVGNVNGVEVGDEFMYRVELALVGLHRPYQGGIDTTDYNGVLVAISIVCSGGYPDELSSSGELIYTGSGGKPAGKKKDEDQKLERGNLALKNCIETKTPVRVIHGFKGQNREDNSHSRAKQILTFTYDGLYLVVDCWTEGLKGSRIFKYKLQRIPGQPELPLHIAKGLRRSLSRPGLCIADISQGKEMDPICVINDVSNVHPTSFQYISRIKYPSWLTKRHPQHHGCDCSDGCIDSTKCFCAVKNGGKIPFNSNGAIVHDKPLIFECGPSCRCHSSCHNRVSQKGMKIHLEVFRTANKGWGVRSLRSISSGSFICEYVGILLTDKEADKRTNDEYLFDISHNCDDEDCSKGRPSTISSLNSSGGCSQTMEDVCFTIDASEYGNIGRFINHSCSPNLYAQNVLWDHDDQRVPHIMFFAAENIPPLQELTYDYNYKIGEVRDLNGRVKVKDCHCGSPQCCGRLY

SEQ ID NO: 24143 - protein, 1091 aa, Pseudomonas putida
MKRMLINATQPEELRVALVDGQRLYDLDIESGAREQKKANIYKGKITRIEPSLEAAFVDFGSERHGFLPLKEISREYFKKAPEGRVNIKEVLSEGQEVIVQVEKEERGNKGAALTTFISLAGRYLVLMPNNPRAGGISRRIEGEERNELREALNGLTVPGDMGLIVRTAGLGRSSEEMQWDLDYLLQLWTAIKEASLDRAAPFLIYQESNVIIRAIRDYLRQDIGEVLIDSIDAQEEALTFIRQVMPQYASKVKLYEDSVPLFNRFQIESQIETAFQRVVDLPSGGSIVIDPTEALVSIDINSARATKGSDIEETALQTNLEAAEEIARQLRLRDIGGLIVIDFIDMTPAKNQRAVEERVRECLEADRARVQVGRISRFGLLEMSRQRLRPSLGESSGIVCPRCSGTGIIRDVESLSLAILRLIEEEALKDRTAEVRAQVPIPVAAFLLNEKRNSITKIELRTRARIIILPNDHLETPHFEVQRLRDDNPEVLNNQSSYEIAAAEAEEAPQPTATRTLVRQEAAVKTAPARANAPVPAAAEEPQAAAPVAPAPSAPEPSLFKGLVKSLVSLFAGKDEPAAAPVAPAAEKPAAERSPRNEERRNGRQQSRNRNGRRDEERKPREERAERAPREERAPREERAPREERAPREERAPREERAPREERAPRQPREDRRGNRGEERVRELREPLDATPPAEREERQPREERVAREERAPREERAPREERAPREERAPREERAPREERAPREERAPREERAPREERAPREERAPREERAPRPPREERQPRAAEEATEQAAELAEEQLPGEELLQDEQEGTDGERPRRRSRGQRRRSNRRERQRNANGELIDGSEEEGSEEQPQQHQATELGAELAAGLAVTAAVASSNISSDAEAQANQQAERATAEVAAVAETDNSEAAQPVEQVEAATKAQEASVAPAVEQPVTEPVAAAEATAEPVVEVAPQPVAEDAPAVEPVVVAETAVTETPAEAPVVEAGEIEQAPAVVEVAPVAAQPAPVVEAQPEVVAEPAPAVVEPAPAVVEPATVMLANGRAPNDPREVRRRKREAEAAAKAAQEAAAASQEPALEAADEHKPHHG

SEQ ID NO: 24144 - protein, 541 aa, Hordeum vulgare
MGLGLGDPPADYGSIMAVGLFVALMCICIIVGHLLEENRWMNESTTALLLGLGAGTVILFASSGKNSRLMVFSEDLFFIYLLPPIIFNAGFQVKKKQFFRNFMTITLFAVVGTLISFSIISHGAMGLVSRLNIGALELGDYIALGAIFSATDSVCTLQVLSQDETPFLYSLVFGEGVVNDATSVVLFNAIQNFDLGNFSSLKFLQFIGKFPLSIWPQYLSWEVSSGLLSAYVIKKLYFGRHSTDREVALVMLMAYLSYMLAELLDLSGILTVFFCGIVMSHYTWHNVTESSRVTTKHAFATLSFISETFLFLYVGMDALDIEKWKIVSETYSPMKSIALSSIILALVLVARAAFVFPLSYLSNLTKKTPGEKISVRQQVIIWWAGLMRGAVSIALAYNKFAKSGHTQLPSNAIMITSTIIIVLFSTIVFGLLTKPLIRLLIPARHLTREVSALSEPSSPKSFLEQLTVNGPETDVENSVSIRRPTSLRMLLASPTRSVHHYWRKFDNAFMRPMFGGRGFVPFVPGSPTESSLPLLAHGSEN

SEQ ID NO: 24145 - protein, 636 aa, Vibrio cholerae
MCGVAGFISKRLSPVDCLTSMVGSIMHRGPNDSGLWVDDDFGVCLAHARLSIQDLSSAGHQPMHSKSERYVMIFNGEIYNHLTLREELIEIVPSYWNGHSDTETLLAGFEVWGIEQTIQKCVGMFAIVLWDKVLKQLILIRDRFGEKPLYYGWQRDTFLFASELKALKAHPSFEGSINRQALSHFFRLNYIPTPLSIYEGIFKLEPGVIAVFSHEGQLLSKQTFWDASHAVSLQNFSDHDAVDKLDDLIKQSIQDQALSDVPLGAFLSGGVDSSTVVGILQSLSTRPVKTFTIGFDHADFNEASEASDVAKHLGTDHVELIVSAEDALAIINQLPVMYDEPFADASQVPTFLVSKLAKKEVTVCLSGDGGDELFCGYNRYHYTAKVWSYLEKIPFPIRKMLSVFLLTLSPSSWDVLSKTLGLNTRLPNLGNKIQKGAQALKARDIEDLYTRVVSNWDLDEPLVKNTAVEKLPFLSDLTELSHLNDLEKMMLWDKQSYLMDDVLVKTDRATMACSLEGRVPLLDHRIAEFAASLPIHLKYRGGKGKWLLREVLYRYVPKKLIERPKKGFSLPIAEWLRGPLKDWANVLLDSDRIDKEGFLSSELVQKKWREHLAGKRDWSSQLWSVLMFQLWLEKNK

SEQ ID NO: 24146 - protein, 235 aa, Nepenthes boschiana
  misc_feature (7)..(7): Xaa can be any naturally occurring amino acid
  misc_feature (77)..(77): Xaa can be any naturally occurring amino acid
  misc_feature (109)..(109): Xaa can be any naturally occurring amino acid
  misc_feature (185)..(185): Xaa can be any naturally occurring amino acid
  misc_feature (208)..(208): Xaa can be any naturally occurring amino acid
  misc_feature (220)..(220): Xaa can be any naturally occurring amino acid
LIVWVQXNLGWALGFGIPAISMGIAIASFFSGTALYRLQKPGGSPLTRMCQVLVASFRKSKLALPEDSNLLYETSDXNSVIEGSRKLEHTNELKCLDKAAVVSDKEIKXEDFSNPWRLCTVTQIEELKILIRMFPIWATGIVFSAIYAQMSTMFVEQGEVMDRTIGSFTIPAASLSMFDTISVIXWVPVYDKILVPLARKFTGKQRGXSELQRMGIGLFXSILSMAAAALVEMKR

SEQ ID NO: 24147 - protein, 350 aa, Thermus thermophilus
MKDYYAILGVSREASQEEIKKAYRRLALKYHPDRNPGDKEAEERFKEINEAYAVLSDPKKRAAYDRGHLEAPEYRPEDLFDLFFQEVFGVRGHRRPPRGEDLEAEVEVELQDLLHGAEKEVRYTRLVPCEACGGEGGRRTPCPTCRGQGVVESYRQSFFGTVVTRTACPHCKGRGYLLAETCPACRGRGRVPREERVRVQVPPGMDEGHLLRVPGYGNLGPGGPGDLYLRIRVRPHPHLERQGPDLVYRLRLGLAQAALGARVEVPGLEGPIPLDIPPGTGHGEVFALEGGGLPLPGGRGRGTLRVVVELAVPKKLSPKAQKLLRAYAEEVGEEVAPEGFWERLKGFFRK

SEQ ID NO: 24148 - protein, 375 aa, Bacillus licheniformis
MSKRDYYEVLGVGKSASKDEIKKAYRKLSKKYHPDINKEAGAAEKFKEVKEAYETLSDDQKRAHYDQFGHTDPNQGFGGGGFGGGDFGGFGFDDIFSSIFGGGARRRDPNAPRQGADLQYTMTLSFEEAAFGKETTIEIPREETCETCSGSGAKPGTKPETCSHCGGSGQLNMEQSTPFGKVVNRRVCHYCNGTGKQIKHKCSTCGGTGKVKKRKKINVTIPAGVDDGQQLRVAGQGEPGINGGPSGDLFVVFRVQEHEFFERDGDDIYCEMPLTFAQAALGDEIEVPTLHGKVKLKVPAGTQTGTKFRLKGKGVANVRGYGQGDQHIVVRVVTPTNLTENQKNILREFAEVSGNMPDEQEMSFFDKVKRAFKGD

SEQ ID NO: 24149 - protein, 235 aa, Nepenthes burbidgeae
  misc_feature (39)..(39): Xaa can be any naturally occurring amino acid
  misc_feature (138)..(138): Xaa can be any naturally occurring amino acid
  misc_feature (211)..(211): Xaa can be any naturally occurring amino acid
LIVWVQENLGWALGFGIPAISMGIAIASFFSGTALYRLXKPGGSPLTRMCQVLVASFRKSKLALPEDSNLLYETSDENSVIEGSRKLEHTNELKCLDKAAVVSDKEIKREDFSNPWRLCTVTQIEELKILIRMFPIWXTGIVFSAIYAQMSTMFVEQGEVMDRTIGSFTIPAASLSMFDTISVIFWVPVYDKILVPLARKFTGKQRGFSEXQRMGIGLFIAILSMAAAALVEMKR

SEQ ID NO: 24150 - protein, 251 aa, Zea mays
MHDKRRMGTEADAAAVDLLRSQIPFQTDGEFVLPPRGVGLVLVDLCNGFCTVGAGNLAPVAPNKQISKMVEEAARLSKLFCDRNLPIFAFLDTHYPDKPEPPYPPHCIIGTGEEDFVPDLEWLEKEPNVTIKRKSCIDGYISCIEKDGSSVFADWIGKYQIKTVLVLGICTDICVLDFASSTLAARNIDRVPPLQDVVIYSGGCATYDLPVEIATNIKGALAHPQDLMHHIGLYMAKGRGAKIVDRVVIEP

SEQ ID NO: 24151 - protein, 346 aa, Brassica napus
SLSAGERKRVPEFVFLAHGVDVMSAMHAPFVFRSFASMPYTTRLFLLPMWPFTFMVMLGMWVWSKAFLFSFYTLRNNLCQTWGVPRFGFQYFLPFATQGINDQIEAAILRADKIGVKVISLAALNKNEALNGGGTLFVNKHPDLRVRVVHGNTLTAAVILNEIPKGVEEVFLTGATSKLGRAIALYLCRRGVRVLMLTMSIERFQKIQKEAPAEFQNYLVQVTKYNAAQNCKTWIVGKWLTPREQSWAPAGTHFHQFVVPPILKFRRNCTYGDLAAMRLPKDVQGLGTCEYTMERGVVHACHAGGVVHMLEGWKHHEVGAIDVDRIDLVWEAAMRHGLSSVSSLTN

SEQ ID NO: 24152 - protein, 730 aa, Unknown
  Synechococcus sp. RS9917
MSELQCPFSGHTGATTPAGGTRNSQWWPDQIDLGILHQHHPAANPLGVDFDYPAAFAQLDYAALKADLKALMTDSQPWWPADWGHYGGLFIRMAWHSAGTYRSADGRGGAGHGNQRFAPLNSWPDNTNLDKARRLLWPIKQRYGNAISWADLIILTGNVALESMGFRTLGFAGGRTDIWQPEEDVFWGKETRWLADERHSADGQLDNPLAAVEMGLIYVNPEGPEGHPDPLASGKEVRDTFARMGMTVEETVALVAGGHTFGKCHGAATADHLEAEPEGASLEEQGLGWRNRYGSGTAEHTITSGIEGAWKPHPTRWDQGYFEMMFTYEWELTKSPAGAWQWVAKDVKPEHMIPDAHVAGKSAAPIMTTADLSLRHDPIMAPIAHRFHQDQEAFADTFARAWFKLTHRDLGPRSLYLGPEQPAEVMIWQDPLPAVDQPLIDASDVAVLKREILEQGLSIGALAATAWGAASSFRNSDRRGGANGGRIRLLPQRTWEVNDPDQLNSVLGALEQVQQRFNANSSESRTVSMADLIVLAGCAAVEQAAAAGGHAISVPFRPGRTDAGPEHTDTASFNALKPLADGFRNWKRQGLPLRDEQLLVDRAQLLNLSAPEMTVLVAGLRVLGANTGGNRQGVFTDRIGVLSPDFCTNLLDMGTVWAPTSEAKDAYEGRDRTSGSLRWTASRVDLVFGSHSQLRAIMEVYAQSDGRERFARDFVNAWVKVMELDRFDLR

SEQ ID NO: 24153 - protein, 218 aa, Fargesia nitida
GMDVSEWDPSKDKYISVKYDKTTAMEAKALNKEALQAEVGLPVDGKIPLVAFIGRLEEQKGPDVMAAAIPQLMEENVQIILLGTGKKKFERMLKSAEEKYPGKVRAVVKFNAQLAHQIMAGADLLAVTSRFEPCGLIQLQGMRYGTPCVCASTGGLVDTIIEGKTGFHLGRLSVDCDVVEPGDVQKVATTLKRAIKLVGTPAYQEMVRNCMAQDLSWK

SEQ ID NO: 24154 - protein, 218 aa, Yushania alpina
GMDVSEWDPSKDKYISVKYDKTTAMEAKALNKEALQAEVGLPVDGKIPLVAFIGRLEEQKGPDVMAAAIPQLMEENVQIILLGTGKKKFERMLKSAEEKYPDKVRAVVKFNAPLAHQIMAGADLLAVTSRFEPCGLIQLQGMRYGTPCVCASTGGLVDTIIEGKTGFHLGRLSVDCNVVEPGDVQKVATTLKRAIKLVGTPAYQEMVRNCMTQDLSWK

SEQ ID NO: 24155 - protein, 700 aa, Xylella fastidiosa
MAKITKTFQYGKHTVTLETGEVARQASGAVIVKMDDTVLLVTVVAAKTAREGQDFFPLTVDYQEKFYAGGRIPGSFFKREGRATEKETLISRLIDRPIRPLFPEDYKNEVQIIAMVMSLDPEIDGDIPAMIGASAALSLAGIPFKGPIGAAKVGYNDGQYILNPTVSELKKSQLELVVAGTANAVLMVESEAALLSEEVMLGAVIFGHREMQKVIQVIDSLTAEAGTQPSDWVPPAKNDALVIALKGVIGGRLSDAFHIRDKLQRRDAIAAVKDDVIQQLAGRLEVEGWNLAELLKEFGELEYRTMRDALLDTEVRIDGRSLEAVRPITVKVGVLPRVHGSGLFTRGETQAIVVTTLGTARDGQVIDAVTGEYKENFLFHYNFPPYSVGECGRFGVPKRREIGHGRLARRGVLAVMPSLDEFPYTIRVVSEITESNGSSSMASVCGSSLALMDAGVPVKAPVAGIAMGLVKEGERFVVLSDILGDEDHLGDMDFKVAGTSEGVSALQMDIKIEGITEEIMRQALQQAKVGRLHILGEMDKALAAPRAELSDYAPRLLTIKIHPDKIRDVIGKGGSTIQAITKETGTQIDIQDDGTIVIASVNNAAAREAKRRIEQITSDVEPGRIYEGKVAKIMDFGAFVTILPGKDGLVHVSQISSERVERVGDKLKEGDVVRVKVLEVDKQGRIRLSIKAVEEEVASI

SEQ ID NO: 24156 - protein, 217 aa, Brassica napus
  misc_feature (192)..(192): Xaa can be any naturally occurring amino acid
MADRAKGPWSQEEDEQLRRMVEHYGPRNWSEVSKSVPGRSGKSCRLRWCNQLSPVVEHRPFSSDEDKTIVSARATFGNKWATIARLLNGRTDNAVKNHWNSTLKRKCLGGGGDGNLIVMTTEDQDRRKKRRSVSSESATPVDTGLYMSPESPTGIPPPPSPPSPVDAQLLKPMAMPSPAEMSSVEEDPTAVXSLSLSLPGADVRQGVKPHNSFAVSA

SEQ ID NO: 24157 - protein, 93 aa, Brassica napus
MSNRIRSRQSSSATRISDDQMIDLVGKLRQFLPEIRERRRSDKVSASKVLQDTCNYIRKLHREVDNLSDRLSLLLDSVDEDSQEAAVIRNLLM

SEQ ID NO: 24158 - protein, 218 aa, Fargesia communis
GMDVSEWDPSKDKYISVKYDKTTAMEAKALNKGALQAEVGLPVDGKIPLVAFIGRLEEQKGPDVTAAAIPQLMEENVQIILLGTGKKKFERMLKSAEEKYPGKVRAVVKFNAPLAHQIMAGADLLAVTSRFEPCGLIQLQGMRYGTPCVCASTGGLVDTIIEGKTGFHLGRLSVDCNVVEPGDVQKVATTLKRAIKLVGTPAYQEMVRNCMAQDLSWK

SEQ ID NO: 24159 - protein, 300 aa, Legionella pneumophila
MMWNLSSRVHALNHFPKQGIECYVKRDDELGCGISGTKIRKYSSLIPFLKIKGIRHLIIIAGAQSNNLLAALQVARECQLKVTAFLVKPKHLKIQGNFKLSLLFLHENEIIWINREEWYRVNEFAEQYLEGLRETAYILSEGASVKESMKGAMSLASDIKENEKILGFAFDHIFVDAGTGFSAIALIKGFYELQHKGFIHVLLLADSEEVFKKKLMHWAGVNPDNYACFYPTTAKSFGSVNQTIKQEIKRLAYEEGILADPIYSAKLFYEARRYIEKYELKGKVLIVHSGGILTMPGFAF

SEQ ID NO: 24160 - protein, 260 aa, Oenococcus oeni
MAAISMKELLEAGAHFGHQTRRWDPRMDEYIFTSRNGIHIIDLQKTLRMADDAYNWVKGEAADGANFLFVGTKKQATEAIEEEAKRAGVAYVNHRWLGGTLTNWNTIKTRINKLKELRAAEEDGSFDKLPKKEASQLGKQKAKLEKFLGGIADMEDIPDVMFVVDPKTEEIAVKEARSLNIPVVAMIDTNGNPDLVDVKIPANDDAIRAVKLITSKMADAIIEGRQGQDAGEDSAEKTFADTADGEGDFEESSNNENQEA

SEQ ID NO: 24161 - protein, 209 aa, Brassica napus
LGMTIFIPIYDRVLVPFLRKYTGRDGGITQLQIVGAGLSLCITSMLVSAAVEQHRRTVALTRPTLGVAPRKGAISSMSGMWLIPQLVLMGIGDALAGVGQMEFYYKQFPENMRSFAGSLYYCGIGLASYLSSFLLSAVHNITEGSSAGNWLPEDLNKGRLEYFYYFVAGMMTLPFAYFLLVSHWYRYKDVVAKDNDMDKSSNEVDKVSV

SEQ ID NO: 24162 - protein, 244 aa, Thalassiosira oceanica
GGWWYKPEYIFNELNINSAMTAPDHGETIDLAKNIGSTYEVGGYSYTGGGRRITRVEITTDGGKHWEVCKINQIEKPTDYGMYWCWIWWTYELNVADLVGCKEIWCRAWDEANNCQPNDPTWNLMGMGNNRVFRIKVHLDQIGNKHVFRFEHPTQPGQQEGGWMTKLRHNPDSAGFGRVLEQGQVSAPEEKAAPAANGTPAGGKLITMAEVRKHNKEEDVWIVVNNKVYDCTEYLDLHPGGADS

SEQ ID NO: 24163 - protein, 243 aa, Skeletonema costatum
GGWWYKPEYIFNELNINSAMTAPDHNETIDLASNIAGTYNVGGYAYTGGGRRITRAEISTDGGKHWEMAKINQIEKPTDYGMYWCWVWWNYDLKVADLVGCKEIWCRAWDEANNCQPNDPTWNLMGMGNNQVFRVKVHMAKDVNGKHVFQFEHPTRPGQQEGGWMTKLSEKPDSAGFGRLLEQGQTVKEEAAPAAAPAAKSDKRITAAEVRKHNKEEDVWIIVNNKVYDCTEYLDLHPGGAES

SEQ ID NO: 24164 - protein, 131 aa, Thalassiosira weissflogii
GGWWYKPEYIFNELNINSAMTAPDHNETIDLARNIAGTYEVGGYAYTGGGRRISRVEVTTDGGKHWEVSKIHQIERPTDYGMYWCWIWWSFDLKVADLVGCKEIWCRAWDESNNCQPTEPTWNLMGMGNNQ

SEQ ID NO: 24165 - protein, 185 aa, Candida albicans
MVSTISPTILKTSTSKLINLSAGCFWGVENVFRKQFTNKGLVDIKVGYANGKPSISNVTYEKVCTGTTDYAETVQISYEPSQLKLAEILDIFFKMHDPTTVNSQGPDVGTQYRSAIFTFDDEDKSLALKIRDQFQKEWYPNHKIATTIETIYNWYDAEDYHQNYLTKNSGGYECPTHFIRTKPKI

SEQ ID NO: 24166 - protein, 420 aa, Brassica rapa
MVEVEELEPLTPVEEEEEEVISYDDLKRRMWKDRNLMEKLKQQKRHSNDVVSLASHRAEASRRKKMARSQDSVLKYMMKIMEVCKAKGFVYGIVPDKGKPITGSSDSLRRWWKETVQFDQTAPNAVSDYLTIAAAAAAEMIEKEPSSLLHMLQELQDTTLGSLLSALMQHCVPPQRRFPLEKGIAPPWWPTGTELWWGEQGEAHEHGVPPYRKPHDLRKSWKVSVLAAVIKHMSPDLGRVRRLATQSKCLQDKMMAKETDTWSRVLNQEEALLNIKDRKISDQDQEASGSKTKRKCDFMEPSKRPRSDVTQEPRQITGDMISMLVTSPSIGTNTTSEDDYSVSSSAMGKPDDYDSNWMDYLWFERMQPEFNSSRRFDDDEDNPMVLNQSTESNQSDNVSQSIFSVWDMGCEDKDIYMFDY

SEQ ID NO: 24167 - protein, 439 aa, Aspergillus oryzae
MPSATGENWEKYKKNFADDEEPEKKITPLTESDIQVLKTYGAAPYANALKQLEKQIKDKQASVNEKIGVKESDTGLAPPHLWDVAADRQRMAEEQPLQVARCTKIIQDEKDSDKSKYVINVKQIAKFVVNLGERVSPTDIEEGMRVGVDRNKYQIMLPLPPKIDPSVTMMTVEDKPDVTYGDVGGCKEQIEKLREVVEMPLLSPERFVNLGIDPPKGALLYGPPGTGKTLCARAVANRTDATFIRVIGSELVQKYVGEGARMVRELFEMARTKKACIIFFDEIDAVGGARFDDGAGGDNEVQRTMLELITQLDGFDARGNIKVMFATNRPSTLDPALMRPGRIDRKIEFSLPDVEGRANILRIHAKSMSVERDIRWELISRLCPNATGAELRSVATEAGMFAIRARRKVATEKDFLAAVDKVIKGNLKFNSTATYMQYN

SEQ ID NO: 24168 - protein, 131 aa, Entomoneis cf.
GGWWYKPEYIFNELNINSAMSQPDHNEILSIASNLGKNYEVAGYAYTGGGRMITRVEASTDGGVHWNLATIDRKERPTEHGMYWCWIWWAFELPVVDLVGCQENWCRAFDESNNLQPDKQLGNLMGMGNNQ

SEQ ID NO: 24169 - protein, 580 aa, Brassica rapa
MCGILAVLGCVDNSQATRSRIIKLSRRLRHRGPDWSGLHCYEDCYLAHERLAIIDPISGDQPLYSEDKTVVVTVNGEIYNHKALRESESLKSHKYHTGSDCEVLAHLYEEHGEEFINMLDGMFAFVLLDTKDKSYIAVRDAIGVIPLYIGWGLDGSVWFASEMKALSDDCEQFMAFPPGHIYSSKQGGLRRWYNPPWFSELVPSTPYDPLVLRDTFEKAVIKRLMTDVPFGVLLSGGLDSSLVASVAIRHLEKSDARQWGSKLHTFCIGLKGSPDLKAGKEVADYLGTRHHELHFTVQEGIDAIEEVIYHVETYDVTTIRASTPMFLMSRKIKSLGVKMVLSGEGSDEIFGGYLYFHKAPNKKELHEETCRKIKALYQYDCLRANKSTSAWGVEARVPFLDKAFLDVAMGIDPEWKMIRPDLGRIEKWVLRNAFDDEKNPYLPKHILYRQKEQFSDGVGYSWIDGLKDHANKHVSDAMLTNANFVFPENTPLTKEAYYYRAIFEKFFPKSAARATVPGGPSVACSTAKAVEWDAAWKGNLDPSGRAALGVHVAAYEGDKAEAPRPEKVQKLAEKTAEAIV

SEQ ID NO: 24170 - protein, 201 aa, Unknown
  Erythrobacter sp. NAP1
MTDQPRTGKVERKTAETSIEIAVNLDGTGTYDVSTGIGFLDHMVEQFSKHSLIDVTMKVEGDLHVDQHHTTEDSAIALGQALTDALGDKAGIGRYGSAYSPMDETLSRVSLDISGRPYLVWKAQFSQEKLGEWDTELIEHWFHSVAQSAGLTLHCELLYGTNNHHICESLYKGFARAMRIAVERDPRKGGAIPSTKGQLGG

SEQ ID NO: 24171 - protein, 130 aa, Coscinodiscus granii
EGWWYKPEYIFNELNINSVMSAPDHNETLSIKDNIDKHYDVTGYAYSGGGRAVTRVEVSTDGGHHWELAQIDRKEKPNDYGMYWCWIWWTFKIKVADLVGCKEIMCRAWDEANNCQSIHPTWNLMGMGNN

SEQ ID NO: 24172 - protein, 369 aa, Ashbya gossypii
MSELVEKTSTLLKYLDLDQRGAVIAEYIWVDSAGHLRSKGRTLQRRVESVDELPEWNFDGSSTGQAPGHDSDVYLKPVAFYPDPFRRGDNIIVLAECWNNDGTPNKYNHRHEAAKLFEAHRAADIWFGLEQEYTLFDHNDNVYGWPKGGFPAPQGPYYCGVGAGKVYARDVVEAHYRACLYAGLRISGINAEVMPSQWEFQVGPCTGITMGDELWVGRYLLHRVAEEFGVKVSFHPKPLKGDWNGAGCHTNVSTREMRQPGGMRYIEEAIDKLSKRHKEHIKLYGSDNELRLTGRHETASMATFSSGVANRGASIRIPRSVSKEGFGYFEDRRPASNIDPYLVTGIICETICGAIENADMSKEFERESS

SEQ ID NO: 24173 - protein, 166 aa, Bordetella parapertussis
MNTMYDFSAPTITGAERALADFRGQVALVVNVASRCGFTPQYSGLEELYRSYRNEGFVVLGFPCNQFGRQEPGDEAAIAQFCETQYAISFPLFAKIDVNGAHAHPLYRWLKAHKPGLLGTRAIKWNFTKFLVGRDGLPLRRYAPAHTPESLRHDIARACAAPGPTP

SEQ ID NO: 24174 - protein, 415 aa, Tradescantia virginiana
TTPISIEDVRREVKILKALSGHKHLVKFYDACEESLNVYLIMELCEGGELLDRILSRGGKYTEEDAKAIVMQILNVVAYCHLQGVVHRDLKPENFLFINRDENAPMKLIDFGLSDFTRPDERLNDIVGSAYYVAPEVLHRSYSMEADIWSIGVITYILLCGSRPFWARTESGIFRSVLRADPNFDDSPWPTASPEAKDFVKRLLNKDYRKRMTAAQALSHPWLRDKEPQIPLDILIYKQTKLYLRATPLKRAALKALSKALTEDELVYLRLQFKLLEPNNDGRVSLENFHTALAQNATEAMKESRVLDILNSLESLAYRRMDFEEFCAAAISCYQLEALEHWEQIASTAFEYFEQDGNRVVSVEELAQDLNLPQNAYAILKDWIRQSDKKLSFLGYTRYTRYLHGVTPRPNTRQH

SEQ ID NO: 24175 - protein, 375 aa, Xanthomonas oryzae
MNAQASWTLQFPIPANCTTPPGPLYSARCFASSRIASFTSDVTDEFTPAAAIRAGVPSHRVRRGGNREAQPRNLCVCLCASLASPRVHVRTFQKSSPRTAIPLSGVPAMPQVTMRQMLEAGVHFGHQCRYWHPNMAQYIFGARGKIHIINLEKTVPLFNDAMNYLSSIAQKRGTILFLGTKRSARASIKEEAERCGMPFMTQRWLGGTLTNFRTVKQSVARLKELEAAETDGTFDKLVKHEVLSLRREREKLDASLGGIKEMNRLPDAIFVIDIGHEDIAIKEAKKLGIPVIAVVDTNYNPNLVDYAIPGNDDAIRAVQLYARAAADAVLEGKAAAPNSASVREEEFSAESADEGKGRRAPAKKGEKKADAPAAE

SEQ ID NO: 24176 - protein, 327 aa, Unknown
  Halobacterium sp. NRC-1
MKDSILDAIGTPLVRLTAPEGATIAAKLEGFNPAGSAKDRPAREMVLAAERAGEIQPGDQLVEATSGNTGIGLALTAAARGYDLTIVMPASMSTERKQLLRAYGADLELVDAGMETANQVADRVAADTGAFRVGQFENPANPRAHYRTTAEEILDQVEGREIDALVAGVGTGGTITGTATRLREAHPEMSVVAVEPEANAVLSTGESGDDDFQGMGPGFVSDNLDRELIDTVETVAVDAAEAETRRLAREEGVLVGQSSGAAALAATRTAERIADPSLDCPDVSFDADAVGDPDAIADGGDGPDDCPLVVTILPDTGERYLSAGVFD

SEQ ID NO: 24177 - protein, 324 aa, Triticum aestivum
SGALPSLYSAIQQCTSLNSLSGFWDSPRWITPIIHYICKTLTCLNLSYAPMFRTVDLIGTIHQCQNLRHLWVLDHIGDAGLKVVASSCLELQELRIFPANANVLASTGVTEEGLVAVSSGCRKLNSVLYSCSRMTNSALITVAKNCSRITSFRLHICLHGSVDAVTGQPLDEGFGAIVRSCKGLRRLSMSGLLTDSVFLYIGMYAERLETLSVAFAGDSDDGMIYVLNGCKNLRKLEIRNCPFGNTALLAGTHRYEAMRSLWMSSCDITLGGCRSLAAAMPGLNVEVISQADGGANDAKKVEKLYVYRTLAGPRDDAPGFVSAL

SEQ ID NO: 24178 - protein, 228 aa, Nepenthes stenophylla
  misc_feature (4)..(4): Xaa can be any naturally occurring amino acid
  misc_feature (6)..(6): Xaa can be any naturally occurring amino acid
  misc_feature (8)..(8): Xaa can be any naturally occurring amino acid
  misc_feature (14)..(14): Xaa can be any naturally occurring amino acid
  misc_feature (22)..(22): Xaa can be any naturally occurring amino acid
  misc_feature (30)..(33): Xaa can be any naturally occurring amino acid
  misc_feature (42)..(42): Xaa can be any naturally occurring amino acid
  misc_feature (106)..(106): Xaa can be any naturally occurring amino acid
  misc_feature (113)..(113): Xaa can be any naturally occurring amino acid
  misc_feature (131)..(131): Xaa can be any naturally occurring amino acid
  misc_feature (178)..(178): Xaa can be any naturally occurring amino acid
  misc_feature (181)..(181): Xaa can be any naturally occurring amino acid
  misc_feature (187)..(187): Xaa can be any naturally occurring amino acid
  misc_feature (190)..(190): Xaa can be any naturally occurring amino acid
  misc_feature (194)..(194): Xaa can be any naturally occurring amino acid
  misc_feature (196)..(203): Xaa can be any naturally occurring amino acid
  misc_feature (218)..(218): Xaa can be any naturally occurring amino acid
  misc_feature (220)..(220): Xaa can be any naturally occurring amino acid
  misc_feature (224)..(224): Xaa can be any naturally occurring amino acid
NVGXAXGXGIPAIXMGIAIASXFSGTALYXXXXPGGSPLTRXCQVLVASFRKSKLALPEDSNLLYETSDENSVIEGSRKLEHTNELKCLDKAGVVSDKEIKREDFXNPWRLCXVTQIEELKILIRMFPIWXTGIVFSAIYAQMSTMFVEQGEVMDRTIGSFTIPADSLSMFDTISVIXWVXVYDKIXVPXARKXTXXXXXXXXLQRMGIGLFISILSXAXAALXEMKR

SEQ ID NO: 24179 - protein, 235 aa, Nepenthes thorelii
  misc_feature (7)..(7): Xaa can be any naturally occurring amino acid
  misc_feature (39)..(39): Xaa can be any naturally occurring amino acid
LIVWVQXNLGWALGFGIPAISMGIAIASFFSGTALYRLXKPGGSPLTRMCQVLVASFRKSKLALPEDSNLLYETSDENSVIEGSRKLEHTNELKCLDKAAVVSDKEIKFEDFSNPWRLCTVTQIEELKILIRMFPIWATGIVFSAIYAQMSTMFVEQGEVMDRTIGSFTIPAASLSMFDTISVIFWVPVYDKILVPLARKFTGKQRGFSELQRMGIGLFISILSMAAAALVEMKR

SEQ ID NO: 24180 - protein, 234 aa, Nepenthes tobaica
  misc_feature (1)..(3): Xaa can be any naturally occurring amino acid
  misc_feature (16)..(16): Xaa can be any naturally occurring amino acid
  misc_feature (19)..(19): Xaa can be any naturally occurring amino acid
  misc_feature (25)..(27): Xaa can be any naturally occurring amino acid
  misc_feature (37)..(38): Xaa can be any naturally occurring amino acid
  misc_feature (53)..(53): Xaa can be any naturally occurring amino acid
  misc_feature (58)..(58): Xaa can be any naturally occurring amino acid
  misc_feature (65)..(66): Xaa can be any naturally occurring amino acid
  misc_feature (68)..(69): Xaa can be any naturally occurring amino acid
  misc_feature (76)..(77): Xaa can be any naturally occurring amino acid
  misc_feature (84)..(84): Xaa can be any naturally occurring amino acid
  misc_feature (135)..(135): Xaa can be any naturally occurring amino acid
  misc_feature (137)..(137): Xaa can be any naturally occurring amino acid
  misc_feature (193)..(193): Xaa can be any naturally occurring amino acid
  misc_feature (198)..(198): Xaa can be any naturally occurring amino acid
  misc_feature (201)..(201): Xaa can be any naturally occurring amino acid
  misc_feature (203)..(203): Xaa can be any naturally occurring amino acid
  misc_feature (207)..(207): Xaa can be any naturally occurring amino acid
  misc_feature (218)..(218): Xaa can be any naturally occurring amino acid
  misc_feature (220)..(220): Xaa can be any naturally occurring amino acid
  misc_feature (224)..(225): Xaa can be any naturally occurring amino acid
  misc_feature (233)..(233): Xaa can be any naturally occurring amino acid
XXXVQENLGWALGFGXPAXSMGIAXXXFFSGTALYTXXKPGGSPLTRMCQVLXASFRXSKLALPXXRXXLYETSDXXSVIEGSXKLEHTNELKCLDKAAVVSDKEIKCEDFSNPWRLCTVTQIEELKILIRMFPXWXTGIVFSAIYAQMSTMFVEQGEVMDRTIGSFTIPAGSLSMFDTISVIFWVPVYDKIXVPLAXKFXGXQRGXSELQRMGIGLXIXILSXXAAALVEMXR

SEQ ID NO: 24181 - protein, 235 aa, Nepenthes densiflora
  misc_feature (55)..(55): Xaa can be any naturally occurring amino acid
  misc_feature (138)..(138): Xaa can be any naturally occurring amino acid
  misc_feature (185)..(185): Xaa can be any naturally occurring amino acid
  misc_feature (220)..(220): Xaa can be any naturally occurring amino acid
LIVWVQENLGWALGFGIPAISMGIAIASFFSGTALYRLQKPGGSPLTRMCQVLVXSFRKSKLALPEDSNLLYETSDENSVIEGSRKLEHTNELKCLDKAAVVSDKEIKYEDFSNPWRLCTVTQIEELKILIRMFPIWXTGIVFSAIYAQMSTMFVEQGEVMDRTIGSFTIPAASLSMFDTISVIXWVPVYDKILVPLARKFTGKQRGFSELQRMGIGLFXSILSMAAAALVEMKR

SEQ ID NO: 24182 - protein, 218 aa, Fargesia fractiflexa
GMDVSEWDPSKDKYISAKYDKTTAMEAKALNKEALQAEVGLPVDGKIPLVAFIGRLEEQKGPDVMAAAIPQLMEENVQIILLGTGKKKFERMLKSAEEKYPGKVRAVVKFNAPLAHQIMAGADLLAVTNRFEPCGLIQLQGMRYGTPCVCASTGGLVDTIIEGKTGFHLGRLSVDCNVVEPGDVQKVATTLKRAIKLVGTPAYQEMIRNCMAQDLSWK

SEQ ID NO: 24183 - protein, 354 aa, Zea mays
MAAPATPRQSLILPRASSHSHSQPSAGGLTSYRVTASHRRRGDFVFVVNPLGANGRTGKQWKQLLPLLRTRLADQCNICECITSGPSHAIDVTREAIKDGVDAVIAVGGDGTLHEVVNGFFWEGSPVCALDRGPDHSTALGLIPLGTGSDFARTFGWTNDPHDAIDRIVRGVKSKLDVGVMEGPNREPHFFVNVADIHLSAKAGYFASMYKSFGNLCYVFGALRAFWGHNNQDMRIKVNGGEWRTVHNVTALCIGNAKYFGGGMKITPTADPFSGNLEVVILQDFKWYDFILKLHRLYGGTHLSVNGVSSMRVQSIEVAEVAASGGVFVQSDGEHFGFLPTKFSVLPRAVDFFC

SEQ ID NO: 24184 - protein, 235 aa, Nepenthes diatas
  misc_feature (7)..(7): Xaa can be any naturally occurring amino acid
  misc_feature (39)..(39): Xaa can be any naturally occurring amino acid
  misc_feature (55)..(55): Xaa can be any naturally occurring amino acid
  misc_feature (136)..(136): Xaa can be any naturally occurring amino acid
  misc_feature (138)..(138): Xaa can be any naturally occurring amino acid
  misc_feature (220)..(221): Xaa can be any naturally occurring amino acid
LIVWVQXNIGWALGFGIPAISMGIAIASFFSGTALYRLXKPGGSPLTRMCQVLVXSFRKSKLALPEDSNLLYETSDGNSVIEGSRKLEHTNELKCLDKAAVVSDKEIKCEDFSNPWRLCTVTQIEELKILIRMFPXWXTGMVFSAIYAQMSTMFVEQGEVMDRTIGSFTIPAASLSMFDTISVIFWVPVYDKILVPLARKFTGKQRGFSELQRMGIGLFXXILSMAAAALVEMKR

SEQ ID NO: 24185 - protein, 544 aa, Salinibacter ruber
MDGAHVRTAPYFVRHSFSPSPLRRMSDADSPAPMLSPDREDGTIEDFTRIEDLADHVDETVTLKGWLHNQRGSGGIKFLILRDGSGFVQCVVPQDAVDADSWAVADDVRQEAALEITGSVSADERAPGGYELQVDAVERIGESGDYPVTPKEHGIDFLMEHRHLWLRSESQWAVMRIRNRIETAIHEFFQERGFLQTDAPILTGNAVEGTSTLFDLDYFDDESAYLTQSGQLHGEAMAMAYGKVYTFGPTFRAEKSATRRHLTEFWMIEPEMAFYDLEMNAQLAEDFVAHIVQAVLEDCEEELEALDRDTSALEQVETPFPRISYDEAVELLRSDETAEMIDERIEALNEEKAELLEEKEENQTRRGQAKKHVKRKIDAREIEINKRVDEIEEALRNLPDWKESAQTFEWGSDFGGDDETVLTWHFDRPVIVHRFPAEIKAFYMKRDPDDDRLAMGIDVLAPEGYGEIIGGGERATDLDFLKEQIEAHDLPEDVFDWYLDLRKFGSVPHSGFGLGLERTVSWITGRDHVRETIPFPRTIARLHP

SEQ ID NO: 24186 - protein, 218 aa, Fargesia frigida
GMDVSEWDPSKDKYISVKYDKTTAMEAKALNKEALQAEVGLPVDGKIPLVAFIGRLEEQKGPDVMAAAIPQLMEENVQIILLGTGKKKFERMLKSAEEKYPGKVGAVVKFNAPLAHQIMAGADLLADTSRFEPCGLIQLQGMRYGTPCVCASTGGLVDTIIEGKTGFHLGRLSVDCNVVEPGDVQKVATTLKRAIKLVGTPAYQEMVRNCMAQDLSWK

SEQ ID NO: 24187 - protein, 325 aa, Solanum tuberosum
MAGEKIGIAKDVTELIGNTPLVYLNNVVDGCVARVAAKLESMEPCSSVKDRIGYSMITDAEEKGLIKPGESVLIEPTSGNTGVGLAFMAAAKGYKLIITMPSSMSLERRIILRGFRSELVLTDPAKGMKGAISKAEEIKAKTPNSYILQQFENPANPKIHYETTGPEIWKGSNGKVDALASGIGTGGTITGSGKYLREQNPNVKLYGVEPVESAILSGGKPGPHKIQGIGAGFIPGVLEVNLIDDVVQVSSEESIEMAKLLALKEGLLVGISSGAAAAAAIKVAKRPENAGKLIVVIFPSFGERYLSSVLFETVRREAENMTVEP

SEQ ID NO: 24188 - protein, 218 aa, Fargesia fungosa
GMDVSEWDPSKDKYISVKYDKTTAMEAKALNKEALQAEVGLPVDGKIPLVALIGRLEEQKGPDVMAAAIPQLMEENVQIILLGTGKKKFERMLKSAEEKYPGKVRAVVKFNSPLAHQIMAGADLLAVTSRFEPCGLIQLQGMRYGTPCVCASTGGLVDTIIEGKTGFHLGRLSVDCNVVEPGDVQKVATTLKRAIKLVGTPAYQEMVRNCMAQDLSWK

SEQ ID NO: 24189 - protein, 449 aa, Arabidopsis thaliana
MASWIFKLLLLLQCVLVLIQHADSSSIIRYLPGFEGPLPFELETGYIGVGQKEEDQLFYYFIKSENNPEEDPLLVWLTGGPGCSSFSGLVYENGPLAFKVETYNGSVPTLVSTTYSWTKVANIIYLDQPVGTGFSYSRNPFADIPSDTGSVKRVNEFVRKWLAKHPEYFSNPFYVTGNSYSGKVIPAIVQEISNGNYICCKPQINLQGYVIGNPVAYYDHDKDFRIPFAHGVALISDELFESLKASCGGSYSVVDPLNTECLKLIEDYDKCVSGIYEELILKSKCEHTSPDCYTYRYLLSEYWADNETVRRALKVVKGSKGTWERCDYRVLSNQDIKSSIPFHINNSIRGYRSLVISGDHDMTIPFLGTQAWIRSLNYSITEKWRPWMILDQVAGYTKTYANKMTLATVKVCSFIHIYMSNKNAKLVYTSLLIGLWVWFIIGRWAHIGI

SEQ ID NO: 24190 - protein, 469 aa, Saccharomyces cerevisiae
MPYTLSDAHHKLITSHLVDTDPEVDSIIKDEIERQKHSIDLIASENFTSTSVFDALGTPLSNKYSEGYPGARYYGGNEHIDRMEILCQQRALKAFHVTPDKWGVNVQTLSGSPANLQVYQAIMKPHERLMGLYLPDGGHLSHGYATENRKISAVSTYFESFPYRVNPETGIIDYDTLEKNAILYRPKVLVAGTSAYCRLIDYKRMREIADKCGAYLMVDMAHISGLIAAGVIPSPFEYADIVTTTTHKSLRGPRGAMIFFRRGVRSINPKTGKEVLYDLENPINFSVFPGHQGGPHNHTIAALATALKQAATPEFKEYQTQVLKNAKALESEFKNLGYRLVSNGTDSHMVLVSLREKGVDGARVEYICEKINIALNKNSIPGDKSALVPGGVRIGAPAMTTRGMGEEDFHRIVQYINKAVEFAQQVQQKLPKDACRLKDFKAKVDEGSDVLNTWKKEIYDWAGEYPLAV

SEQ ID NO: 24191 - protein, 954 aa, Pseudomonas syringae
MTDRIELTTANEFIARHIGPRAADEQAMLQTLGFDSIEALSESVIPESIKGTSVLNLPAGQSEADALASIKAIASKNQLFKTYIGQGYYNTHTPAPILRNLLENPAWYTAYTPYQPEISQGRLESLLNFQTLISDLTGLPIANASLLDEATAAAEAMTFCKRLSKNKGSQQFFASSHCHPQTLDVLRTRAEPLGITVVVADEAELGDVSDYFGALLQYPASNGDVFDYRELVERFHAANALVAVAADLLALTLLTPPGEFGADVAIGSAQRFGVPLGFGGPHAAYFSTRDAFKRDMPGRLVGVSVDRHGKQALRLAMQTREQHIRREKATSNICTAQVLLANIASMYAVYHGPRGLTQIAKRVHQLTAILAEGLSTLGLKAEQAFFFDSLTLNTGSRTAALHAAARARHINLREIDDQHLGLSLDETTSQSAVETLWEIFASDGQNLPDFTALAASVPSRLPATLLRQSAILSHPVFNRYHSETELMRYLRKLADKDLALDRTMIPLGSCTMKLNAASEMIPVTWAEFGNLHPFAPAEQSTGYQQLTDELEAMLCAATGYDAISLQPNAGSQGEYAGLLAIRAYHQSRGDEHRDICLIPSSAHGTNPATANMAGMRVVVTACDARGNVDIEDLRAKTVQHRDQLAAIMITYPSTHGVFEEGIREICGIVHDNGGQVYIDGANMNAMVGLCAPGKFGGDVSHLNLHKTFCIPHGGGGPGVGPIGVKSHLAPFMPGHARMERKEGAVCAAPFGSASILPITWMYIRMMGGEGLKRASQLAILNANYISRRLEEHYPVLYTGTNGLVAHECILDLRPIKDSSGISVDDVAKRLIDFGFHAPTMSFPVAGTLMIEPTESESREELDRFCDAMIKIREEIRAVENGTLDKDDNPLKNAPHTAAEIVGQWSHPYSREQAVYPVDSLIENKYWPPVGRVDNVFGDRNLVCACPSIESYQEA

SEQ ID NO: 24192 - protein, 203 aa, Helicobacter hepaticus
MQERMAKNVIEISRTTKETDISLKLLVYGNGNAQIQSGIGFFDHMLQSLTKHSLIDLELACKGDTFIDGHHSVEDCGIVLGQGLAQGIYPAAGIERFGNASIVMDEACVECDIDVSNRAFLVFETNAYKLPFKGRVGELDVELVEEFFRALCFNAHLSAHIVLKRGKNLHHIIEAMFKAFGVSLRRALTLNPRILTPSTKGVL

SEQ ID NO: 24193 - protein, 255 aa, Glycine max
MASMGSLKMISSLKLSRSSCSISPLQTQKQVGSSLFQSFPTKTLKFSATPQVSTSRRSTNKTTTTAFFFNNQKQHQDSSQPAKVQELFVYEINERDRGSPAYLRLSQKPVNSLGDLVPFSNKIYSGDLQKRLGITAGLCVLIQHEPEKKGDRYEAIYSFYFGNYGHISVQGAYLTFQDTYLAVTGGSGIFEGASGQVKLHQLVFPFKLFYTFYLKGVPDLPPELLGKPVEPSPSVEPSPAAMATEPHACLPNFTN

SEQ ID NO: 24194 - protein, 218 aa, Fargesia lushuiensis
GMDVSEWDPSKDKYISVKYDKTTAMEAKALNKEALQAEVGLPVDGKIPLVAFIGRLEEQKGPDVMAAAIPKLMEENVQIILLGTGKKKFERMLKSAEEKYPGKVRAVVKFNAPLAHQIMAGADLLAVTSRFEPCGLIQLQGMRYGTPCVCASTGGLVDTIIEGKTGFHLGRLSVDCNVVEPGDVQKVATTLKRAIKLVGTPAYQEMVRNCMAQDLSWK

SEQ ID NO: 24195 - protein, 144 aa, Triticum aestivum
  misc_feature (72)..(72): Xaa can be any naturally occurring amino acid
MALAEGNNGAVVFSEEQEALVLKSWAVMKKDSANLGLRFFLKVFEIAPSAKQMFSFLRDSDVPLEKNPKLKXHAMSVFVMTCEAAAQLRKAGKVTVRETTLKRLGATHLKYGVADGHFEVTGFALLETIKEALPADMWSLEMKK

SEQ ID NO: 24196 - protein, 367 aa, Salmonella enterica
MSDSQTLVVKLGTSVLTGGSRRLNRAHIVELVRQCAQLHAAGHRIVIVTSGAIAAGREHLGYPELPATIASKQLLAAVGQSRLIQLWEQLFSIYGIHIGQMLLTRADMEDRERFLNARDTLRALLDNHIVPVINENDAVATAEIKVGDNDNLSALAAILAGADKLLLLTDQQGLFTADPRSNPQAELIKDVYGVDDALRSIAGDSVSGLGTGGMSTKLQAADVACRAGIDTIIASGSKPGVIGDVMEGISVGTRFHAQASPLENRKRWIFGAPPAGEITVDEGATAAMLERGSSLLPKGIKSVTGNFSRGEVIRICNLQGRDIAHGVSRYNSDALRRIAGHHSQQIDAILGYEYGPVAVHRDDMITR

SEQ ID NO: 24197 - protein, 416 aa, Salmonella enterica
MLEQMGIAAKAASYKLALLSSCEKNRVLEKIADELEAQMESILSANVQDVEQARANGLSEAMLDRLALTPARLKAIADDVRQVCNLADPAGQVIDGGLLDSGLRLERRRVPLGVVGVIYEARPNVTVDVASLCLKTGNAVILRGGKETHRTNAATVLVIQKALKACDLPEAAVQAIDNPDRSLVSEMLRMDKYIDMLIPRGGAGLHKLCREQSTIPVITGGIGVCHIFVDSSADIAPALKIIVNAKTQRPSTCNTVETLLVHQDIAERFLPALSKQMAESGVTLHGDETVMQALHGPAKLVALKPEELDNEFLSLDLNVVVVENMDGAIAHIREHGTQHSDAILTCDMHNAARFVNEVDSAAVYVNASTRFTDGGQFGLGAEVAVSTQKLHARGPMGLEALTTYKWIGFGDGTIRA

SEQ ID NO: 24198 - protein, 354 aa, Brassica napus
  misc_feature (164)..(164): Xaa can be any naturally occurring amino acid
  misc_feature (280)..(280): Xaa can be any naturally occurring amino acid
MAAMTSTLSISSTKPQRLFDSSFHGSSISAAPVSVGLKPRSVSAVSVRASTAGYDLNAFTFAPIKESIVSREMTRRYMTDMITYAETDVVVVGAGSAGLSCAYEISKNPNVQVAIIEQSVSPGGGAWLGGQLFSAMIVRKPAHLFLDEIGVPYDEQDNYVVIKXHAALFTSTIMSKLLARPNVKLFNAVAAEDLIVKGNRVGGVVTNWALVSMNHDTQSCMDPNVMEAKIVVSSCGHDGPFGATGVKRLKSIGLIDHVPGMKALDMNTAEDAIVRLTREXVVPGMIVTGMEVAEIDGAPRMGPTFGAMMISGQKAAHLALKALGQPNVLDGSYVGNLSPELVLAAADSAETVDA

SEQ ID NO: 24199 - protein, 490 aa, Unknown
  Candidatus Kuenenia stuttgartiensis
MLLIYPEFPDTFWSFKHALKFIRKKASFPPLGLLTVAAMLPSEWSKRLIDVNVTKLTDDDLLWADYAFISGMVVQRTSAKHIIGRCSKAGVKVVAGGPLFTSEHEQFENVDHFVLNEAELTLSPFLEDLNNNCAKRVYISSNFADIQKTPTPLWELADLNQYASMSIQYSRGCPYHCEFCNVTSLFGRRTRTKTVEQIIAELDSFYNRGWRGPVFFVDDNLLGNKKTLKNELLPALIKWQGEHVPITFNTEISINIADDESLMQMMSEAGFITVFIGIETPDTDSLAECNKKQNKNRNLLEDVRRIQRAGLQVQAGFIVGFDSDTPSIFQRQIDFIQNSGIVSAMIGLLQAPTGTRLYERLMQEGRLLGQMSGDNVDGTTNIIPKMDIDTFREGYKKILKHIYTPKNHYQRIKTLFREYKTPKIKAQITFNDILALFRAIYYLGILGNERFHFWKLLLWTSFHHRELLPLSITLAVYGYHFRKVSKLHVL

SEQ ID NO: 24200 - protein, 329 aa, Synechococcus elongatus
MPKILNRLTEWIGNTPLVRLQETAQQYGAIAEVLLKLEYLNPLGSVKDRTALSLIQSARSQGLITAGTTLIEPTTGNTGIGLAFAAAAEQLRLILVMPDRVSAERIRLAKLLGAKVVLTPAAEAMLGCIAKAQALQQQIPDSVILQQFQNPANPSIHQATTGPEIWRDTDGEVDIVVAGVGTGGTLMGISRYLKPLRPRLQSIAVQPARSPVLSGGAAGSHQLTGMGPNFVSPLVDRSLIDEILSAYEEDAIAVIRTCAAREGIPLGVSSGAIVWAALQVAKRPENAGKRIVAVCPSGSERYLSSTLLADISLESDDVSDWVAIPQGQA

SEQ ID NO: 24201 - protein, 191 aa, Unknown
  marine gamma proteobacterium HTCC2207
MTLSLCSFVTLKSIAEEQVAVFAGGCFWCTESDFEKLDGVVSAESGYIGGHIKNPSYKQVSAGGSGHTEAVQVIFDDQKVSYSDLVEYFWKTIDPTDGGGQFCDRGQQYRSEIFYLSEEQHSIAKASKKALANSGLLKSEIATQLTPSSRFYLAEDYHQDYYLKNPVRYNYYRWGCGREKRLEALWGAVTK

SEQ ID NO: 24202 - protein, 542 aa, Prosthecochloris aestuarii
MGMYCDQCQESVKGTGCITRGVCGKSDVTAKLQDTLVYALEGVALCAEASGNKLDPDHGRFLSQALFITVTNTNFDDDAIVDKIFEALALRDELRSQLTDTLPYDAVNWLGESKEDFVRKAETAGIRALSHNDDLRALKSLALYGLKGLAAYADHAEVLGYVDHAIYDFYVTALAALAKDLDGDHLTALVMETGSIAVKAMALLDKANTETYGNPVVTTVKTGVGSRPGILISGHDLKDMDELLKQTEGSGVDVYTHCEMLPAHYYPAFQKYSHCIGNYGSSWWSQDKEFESFNGPILMTTNCIVPVRESYRNRMFTTGNAGYEGVQHISGGENGSVKDFSALVELAKTCQPPVELENGEIVGGFAHNQVVALADKVVDAVKSGAIKRFVVMAGCDGRHKSRQYYTDVAEALSEETVILTAGCAKYRYNKLQLGDIGGIPRVLDAGQCNDSYSLAVIALKLKEVFGLDDINDLPISYDIAWYEQKAVAVLLALLSLGVKGIRLGPTLPEFLTPAVVSVLVDKFDIKPIGTVQDDVLAMMAGQ

SEQ ID NO: 24203 - protein, 394 aa, Oryza sativa
MAAATTSRRGPGAMDDENLTFETSPGVEVISSFDQMGIREDLLRGIYAYGFEKPSAIQQRAVLPIISGRDVIAQAQSGTGKTSMISLSVCQIVDTAVREVQALILSPTRELAAQTERVMLAIGDYINIQVHACIGGKSIGEDIRKLEHGVHVVSGTPGRVCDMIKRRTLRTRAIKLLILDEADEMLGRGFKDQIYDVYRYLPPELQVCLISATLPHEILEMTSKFMTDPVRILVKRDELTLEGIKQFFVAVEKEEWKFDTLCDLYDTLTITQAVIFCNTKRKVDWLTERMRSNNFTVSAMHGDMPQKERDAIMGEFRSGATRVLITTDVSLVINYDLPNNRELYIHRIGRSGRFGRKGVAINFVKKEDIRILRDIEQYYSTQIDEMPMNVADLI

SEQ ID NO: 24204 - protein, 838 aa, Unknown
  Photobacterium sp. SKA34
MNNGIDKQHLIVIGNGMVGHHFIDQLVDKGGLAHYCITVIGEESIAAYDRVQLSAMFADKSQQDLMLGDVSWYQNQGIDLRLGQQVVEINRAQQTVNIRDVVTSESICLDYDKLVLATGSTPFVPPIKGNDRQNCFVYRTVDDLAAIKNACSQAKTGAVIGGGLLGLEAANALRLLGLETHVVEFAPRLMPVQLDDLAGDLLAKKITELGVHIHTDMRTEKITDGETATHRLWFENDTPLDVDVIVFSAGIRPQDTLARQCELEIGERGGIVIDDTCSTSDENIYAIGECALWQARIFGLVAPGYSMARTVASQLVSDTEAKFIGADMSTKLKLLGVEVASIGDAQMRTEGAKEVVLQDSAGGRYKKLVVNADSTQILGAILVGDSSDYDALLQCYLNQTILTEHPAQLLFDTSMLAPSTDENSVVCSCHNVTRGALISQVQQGCHELGEIKQVTKAGTGCGGCSSMVKQIVDEQLACMGMEVNNHVCQHFSYTRQELFHLCQVEKIQDFETLLSTHGKGLGCDICKPTAASIFASLWNEHVLESPYQPLQDSNDAFLANIQKDGSYSVVPRVPGGEITPDKLITLGEVAKKYDLYTKITGGQRVDLFGAQLSQLPDIWAELIEAGFETGHAYGKSLRTVKSCVGSTWCRYGVDDSMALSIELENRYKGLRSPHKLKFAVSGCTRECAEAQSKDIGIIATEQGWNLYVGGNGGMRPRHGDLFAVDLDKPTLIAYIDRILMFYVKTADRLQRTSVWLENLDGGLDYLKQVVIEDKLTINTSLEQQMEHVINSYQCEWKTTLSSEQKLNRFRQFVNLKDEEISLPYQRIRGQRIPIKEEL

SEQ ID NO: 24205 - protein, 360 aa, Pseudomonas putida
MAAEGELLDVIVIGGGQSALTVAYFLKRAKLSFLLLDAEEAAGGAWRHGWDSLTLFSPSAWSTIAGWPMPPFTEGNPDGDHVVSYLEQYEARYGFSIVRPVSVTSVERTGRGLRVRSKDRDWEARVVISATGTWSNPYVPAYSGIELFQGQQIHSAHYQSPEAFQGKRVLVVGGGNSGAQIYAELSEVADATWVTTEEPAFLPDDVDGRVLFERATERLKAQQEGRVIDAPVGGLGDIVMVPSVVRARERGALRAVRPFTSFTPDGVAWLNGEKTQVDAVVWCTGFLPALDHLKTLDVLDDNGRVEVDGGHSIREPRLWLVGYGDWTGLASATLIGVTRTARSTVNEVVEHLNSLEQPDA

SEQ ID NO: 24206 - protein, 295 aa, Unknown
  Photobacterium sp. SKA34
MDDFSTIKRTAKQVLKSRFQPHDDQGYKKVLRPLSPASRKPDSGFVSLVGAGPSDPDLLTIKALRALEQAEIVVYDRLVSQDIIALANPEAIHIYVGKRCGKPSLSQEEINQILISEALKGQYVVRIKGGDPLIFGRGGEEALALVDANINYEFIPGITAAIGCAASAGIPLTHREVSRSVTLVTGHVATGAFNAWSQLVENGQTLVFYMGLEKAQQIQNQLIKAKLSEETPVAVICHGCSVNQAVYIERLKGLASLAEDLKGESPALIIIGDVVALREQLQRTARQLTEQVCLL

SEQ ID NO: 24207 - protein, 360 aa, Escherichia coli
MTKKGAFTSAFFIYAFSACIMRKSQQHTSEAVMPLHNLTRFPRLEFIGAPTPLEYLPRFSDYLGREIFIKRDDVTPMAMGGNKLRKLEFLAADALREGADTLITAGAIQSNHVRQTAAVAAKLGLHCVALLENPIGTTAENYLTNGNRLLLDLFNTQIEMCDALTDPNAQLEELATRVEAQGFRPYVIPVGGSNALGALGYVESALEIAQQCEGAVNISSVVVASGSAGTHAGLAVGLEHLMPESELIGVTVSRSVADQLPKVVNLQQAIAKELELTASVEILLWDDYFAPGYGVPNDEGMEAVKLLARLEGILLDPVYTGKAMAGLIDGISQKRFKDEGPILFIHTGGAPALFAYHPHV

SEQ ID NO: 24208 - protein, 373 aa, Unknown
  marine gamma proteobacterium HTCC2207
MTRTITQDAQRLVVKIGSALLTNNGAGLDRDAIDGWVEQIAQLLAQGKEIVLVSSGSIAEGIVRLGWKTRPESIHELQAAAAVGQMGLIQTYESSFKRFDRLTAQILLDHDDLANRQRYLNARSALQTLIQLNVVPIVNENDTVVTDEIRFGDNDSLAALVANLIDADLLVILTDKDGLYSANPDLDPHAQLISEAMADDSALDALAGGSNSALGRGGMITKLQAARLAARSGCNTIIVGGRNSGILTAVSEGAEVGTLLTASQQPLAARKQWLAGQLQVKGQLVLDAGAIKVLQQQGRSLLAVGVTQVKGQFTRGELVSCMDANGQEIARGLVNYNSDEATRIQGQSTERIAEILGYREDDELIHRDNMVVS

SEQ ID NO: 24209 - protein, 235 aa, Nepenthes ephippiata
  misc_feature (7)..(7): Xaa can be any naturally occurring amino acid
  misc_feature (39)..(39): Xaa can be any naturally occurring amino acid
LIVWVQXNVGWALGFGIPAISMGIAIASFFSGTALYRLXKPGGSPLTRMCQVLVASFRKSKLALPEDSNLLYETSDENSVIEGSRKLEHTNELKCLDKAAVVSDKEIKREDFSNPWRLCTVTQIEELKILIRMFPIWATGIVFSAIYAQMSTMFVEQGEVMDRTIGSFTIPAASLSMFDTISVIFWVPVYDKILVPLARKFTGKQRGFSELQRMGIGLFISILSMAAAALVEMKR

SEQ ID NO: 24210 - protein, 235 aa, Nepenthes eustachya
  misc_feature (6)..(7): Xaa can be any naturally occurring amino acid
  misc_feature (13)..(13): Xaa can be any naturally occurring amino acid
  misc_feature (15)..(15): Xaa can be any naturally occurring amino acid
  misc_feature (17)..(17): Xaa can be any naturally occurring amino acid
  misc_feature (24)..(24): Xaa can be any naturally occurring amino acid
  misc_feature (34)..(34): Xaa can be any naturally occurring amino acid
  misc_feature (38)..(38): Xaa can be any naturally occurring amino acid
  misc_feature (66)..(66): Xaa can be any naturally occurring amino acid
  misc_feature (185)..(185): Xaa can be any naturally occurring amino acid
  misc_feature (230)..(230): Xaa can be any naturally occurring amino acid
LIVWVXXNLGWAXGXGXPAISMGXAIASFFSGTXLYRXQKPGGSPLTRMCQVLVASFRKSKLALPXDSNLLYETSDGNSVIEGSRKLEHTNELKCLDKAAVVSDKEIKCEDFSNPWRLCTVTQIEELKILIRMFPIWATGIVFSAIYAQMSTMFVEQGEVMDRTIGSFTIPAASLSMFDTISVIXWVPVYDKILVPLARKFTGKQRGFSELQRMGIGLFISILSMAAAAXVEMKR

SEQ ID NO: 24211 - protein, 754 aa, Solanum lycopersicum
MGSLLRMNRLLSSIVESCNCIIDPQLPADDLLMKYQYISDFFIALAYFSIPVELIYFVKKSAVFPYRWVLVQFGAFIVLCGATHLINLWTFNMHTRNVAIVMTTAKALTALVSCITALMLVHIIPDLLSVKTRELFLKKKAAQLDREMGIIRTQEETGRHVRMLTHEIRSTLDRHTILKTTLVELGRTLALEECALWMPTRTGLELQLSYTLRHQNPVGLTVPIQLPVINQVFGTNHVVKISPNSPVARLRPAGKYMPGEVVAVRVPLLHLSNFQINDWPELSTKRYALMVLMLPSDSARQWHVHELELVEVVADQVAVALSHAAILEESMRARDLLMEQNVALDLARREAEMAVRARNDFLAVMNHEMRTPMHAIIALSSLLQETDLTPEQRLMVETILKSSNLLATLINDVLDLSRLEDGSLQLDIGTFNLHALFREVHSLIKPIASVKKLFVTLSLSSDLPEYVIGDEKRLMQILLNVVGNAVKFSKEGNVSISAFVAKSDSLRDPRAPEFFAVPSENHFYLRVQIKDTGIGITPQDIPNLFSKFTQSQALATTNSGGTGLGLAICKRFVNLMEGHIWIESEGLGKGSTAIFIIKLGIPGRANESKLPFVTKLPANHTQMSFQGLKVLVMDENGVSRMVTKGLLTHLGCDVTTVGSRDECLRVVTHEHKVVIMDVSMQGIDCYEVAVVIHERFGKRHGRPLIVALTGNTDRVTKENCMRVGMDGVILKPVSVYKMRSVLSELLEHGVVLES

SEQ ID NO: 24212 - protein, 191 aa, Zea mays
  misc_feature (89)..(89): Xaa can be any naturally occurring amino acid
  misc_feature (183)..(183): Xaa can be any naturally occurring amino acid
MGRRPARCYRQIKNKPYPKSRYCRGVPDPKIRIYDVGMKRKGVDEFPYCVHLVSWEKENVSSEALEAARIACNKYMTKSAGKDAFHLRXFGKPQGTCARVDIGQVLLSVRCKDNNAAHASEALRRAKFKFPGRQKIIESRKWGFTKFSRADYLKYKSEGRIVPDGVNAKLLGNHGRLEKRAPXKAFLEAVA

SEQ ID NO: 24213 - protein, 214 aa, Nepenthes faizaliana
LGFGIPAISMGIAIASFFSGTALYRLQKPGGSPLTRMCQVLVASFRKSKLALPEDSNLLYETSDENSVIEGSRKLEHTNELKCLDKAAVVSDKEIKREDFSNPWRLCTVTQIEELKILIRMFPIWATGIVFSAIYAQMSTMFVEQGEVMDRTIGSFTIPAASLSMFDTISVIFWVPVYDKILVPLARKFTGKQRGFSELQRMGIGLFIAILSMA

SEQ ID NO: 24214 - protein, 139 aa, Saccharomyces cerevisiae
MSEITLGKYLFERLKQVNVNTVFGLPGDFNLSLLDKIYEVEGMRWAGNANELNAAYAADGYARIKGMSCIITTFGVGELSALNGIAGSYAEHVGVLHVVGVPSISAQAKQLLLHHTLGNGDFTVFHRMSANISETTAMI

SEQ ID NO: 24215 - protein, 277 aa, Thermoanaerobacter tengcongensis
MELWFTEHQDENLRFSIKVKETLVVEKTPYQHLAILDSYQFGRVLVLDGILQTTEKDEFVYHEMIVHVPLFTHKNPKDVLIIGGGDGGSVREVLKHSSVERVVLAEIDEAVIRNSKKYLPTISSALDDPRVEIMIGDGIKYVNEHKNEFDVVIVDSTDPIGPAVGLFTSDFYRAVYECLREDGIIVAQTESPFIYGKLINKISKMFKEIYPITKAYIATVPTYPGSLWTFTMGSKKYDPEEVDINSIPRIQTKYYTPEIHKAAFVLPKFVKDIFDEV

SEQ ID NO: 24216 - protein, 218 aa, Fargesia porphyrea
GMDVSEWDPSKDKYISVKYDKTTAMEAKALNKEALQAEVGLPVDGKIPLVAFIGRLEEQKGPDVMAAAIPQLIEENVQIILLGTGKKKFERMLKSAEEKYPGKVRAVEKFNAPLAHQIMAGADLLAVTSRFEPCCLIQLQGMRYGTPCVCASTGGLVDTIIEGKTGFHLGRLSVDCNVVEPGDVQKVATTLKRAIKLVGTPAYQEMVRNCMAQDLSWK

SEQ ID NO: 24217 - protein, 235 aa, Nepenthes fusca
  misc_feature (7)..(7): Xaa can be any naturally occurring amino acid
  misc_feature (39)..(39): Xaa can be any naturally occurring amino acid
  misc_feature (77)..(77): Xaa can be any naturally occurring amino acid
  misc_feature (185)..(185): Xaa can be any naturally occurring amino acid
LIVWVQXNVGWALGFGIPAISMGIAIASFFSGTALYRLXKPGGSPLTRMCQVLVASFRKSKLALPEDSNLLYETSDXNSVIEGSRKLEHTNELKCLDKAAVVSDKEIKREDFSNPWRLCTVTQIEELKILIRMFPIWATGIVFSAIYAQMSTMFVEQGEVMDRTIGSFTIPAASLSMFDTISVIXWVPVYDKILVPLARKFTGKQRGFSELQRMGIGLFISILSMAAAALVEMKR

SEQ ID NO: 24218 - protein, 287 aa, Unknown
  Synechococcus sp. RS9917
MTHNAAPTPGWVDEHHLGVRYGLEGRVLVEEQSPFQRITVIDSLRYGKGLLLDGCWMTAERQERHYHESLVHPALCSAAQIERVLVIGGGDGGTARECLRHPGVQHLDMVEIDGRVVKLSQQHLPSIGGGCWQDRRFHLTVGDGIAWAANAPTASYDVVLVDGSDPAGPAEGLFNRAFFEQCRRILKPGGVFATQSESPEAFRQVHIDTVTVIREVFGHADPMYGWVPMYPSGWWSWTFAATDSRRYLNPDPCRAAAVAEGCEIWSPRWQRGAFDAIPAAIERALNA

SEQ ID NO: 24219 - protein, 218 aa, Fargesia yuanjiangensis
GMDVSEWDPSKDKYISVKYDKITAMEAKALNKEALQAEVGLPVDGKIPLVAFIGRLEEQKGPDVMAAAIPQLMEENVQIILLGTGKKKFERMLKSAEEKYPGKVRAVVKFNALLAHQIMAGADLLAVASRFEPCGLIQLQGMRYGTPCVCASTGGLVDTIIEGKTGFHLGRLSVDCNVVEPGDVQKVATTLKRAIKLVGTPAYQEMVRNCMAQDLSWK

SEQ ID NO: 24220 - protein, 439 aa, Neurospora crassa
MVCLQGQNWEKYRKTFGDDEVEEKKITPLSDEDIQVLKTYGAAPYGAAIKKLEQQIKEKQQSVDEKIGVKESDTGLAPPHLWDVAADRQRMSEEQPLQVARCTKIIPDEKDESKSKYVINVKQIAKFVVQLGERVSPTDIEEGMRVGVDRNKYQILLPLPPKIDASVTMMTVEEKPDVTYGDVGGCKEQVEKLREVVEMPLLSPERFVNLGIDPPKGALLYGPPGTGKTLCARAVANRTDATFIRVIGSELVQKYVGEGARMVRELFEMARTKKACIIFFDEIDAIGGARFDDGAGGDNEVQRTMLELITQLDGFDARGNIKVMFATNRPSTLDPALMRPGRIDRKIEFSLPDLEGRANILRIHAKSMSVERDIRWELISRLCPNATGAELRSVCTEAGMFAIRARRKVASEKDFLSAVDKVIKGNLKFNSTAAYAQYN

SEQ ID NO: 24221 - protein, 603 aa, Yarrowia lipolytica
MMDVERVEHMPPKPMYSLMTQPVVLKEEPVAPSPPTTQAAQQQQQQAPTQTQTPAQPPQAQQPTHNQTHTQPPQQQPTSAQQPTSSNATASNSTDNKKPGTTPKVSQAAFIHKLYSMLEDSSIEHLISWSASNDSFIVSPGEEFSKVLRQYFKHTNVSSFVRQLNMYGFHKVNDTFTFHTGDSSQWEFKHGGGSFKRGDVESLRGIKRRASRQSASQRDSVPLRPVGLVSDYGVAPSGGAPPGMNGSVDVGTAAAAAAAQHGHMMLHPSQHPHHPHPADDAAAAAATAATWHLHDSVSRMAATQAALIDAVRSLQSDVISLLDVLPRITEGRAAVESAHTECQRVAHAMGHRNAFLASLDGRRESQPQPQQQQPYFYQQSAAASAASATAPGGSQWRQPEPQYPVPPTDPFHRGSRGRAVSVYFDPLAKEPAAGPDGQAPPTHTSAPPPPPQQQQQQQQQPPHSQGAAPPPPFGSSPGPTGPPGGVPRSQRPGSFPLLHRQDKTEFVGGGFAEALKYRTDAPARRHTASGAETMPLPQYTAPTSTPHPHEPSTPPPHSSPHTPYRSPHPSGGSTRSNSSSSTRGASVAALLNPEGGDKKRKIE

SEQ ID NO: 24222 - protein, 612 aa, Arabidopsis thaliana
MASLSGLYSSSPSLKPAKNHSFKGIAGAISRFLLFPTYLQTHQSTLTLSSARSVARDISHADSKKELLKDPDALWKRYLDWFYQQKELGLYLDISRVGFTDEFVAEMEPRFQAAFKAMEDLEKGSIANPDEGRMVGHYWLRNSKLAPKPTLKTLIENTLDSICAFSDDIISGKIKPPSSPEGRFTQILSVGIGGSALGPQLSLRLGPDNPPLKIRFIDNTDPAGIDHQIAQLGPELASTLVVVISKSGGTPETRNGLLEVQKAFREAGLNFAKQGVAITQENSLLDNTARIEGWLARFPMYDWVGGRTSIMSAVGLLPAHLQGINVREMLTGAALMDEATRTTSIKNNPAALLAMCWYWASNGVGSKDMVVLPYKDSLLLFSRYLQQLVMESLGKEFDLDGNTVNQGLTVYGNKGSTDQHPYIQQLRDGVHNFFATFIEVLRYRPPGHDWELEPGVTCGDYLFGMLQGTRSALYANGRESISVTIQEVTPTSVGAIIALYERAVGLYASIVNINAYHQPGVEAGKKAAAEVLALQKRVLSVLNEATCKDPVEPLTLEEIADRCHAPEEIEMIYKIIAHMSANDRVLIAEGNCGSPRSIKVYLGECNVDDLYA

SEQ ID NO: 24223 - protein, 146 aa, Rickettsia conorii
MVESGIHDTLCRAIIALFIPVNIKGEFNTSFKKLENLTRPFVNYFILPLFVFMNSGILLEYFAFKGICSNSILALIYGIIFGLFVGKQLGIMLFSYPFVKFKLCNLPSDTSWLKFYSIAILGGIGFTLSLFIGSILRLRAAALQTL

SEQ ID NO: 24224 - protein, 899 aa, Unknown
  Photobacterium sp. SKA34
MISQGIKSACPYCGVGCGVVTKQSEIIGDVSHPTNRGALCVKGSSLAASMSQPNRLLYPQIKGEVVEWAQATTQIAETISRVIAESGPEAIGMYLSGQLLTEDYYVANKLMKGFIGSSHVDTNSRLCMSSAVAAHNRAFGEDIVATNYSDLDSTDLIVLVGSNLAWTHPIVFKRIQQAKTQNPSLKIVVIDPRKTVTAEQADLHLALANDTDIHIYNGLIRYFIENNAVDSDFIVQVTEGFDALQQEVMKDKYTLLEVSKSSGIAIEQLATFYQWMKEAPRAVTVFCQGVNQASCGTDKANSIINSHLVSGKIAKQGCGPFSITGQPNAMGGREVGGLANQLAVHRGFDDNSISQVKAFWQAPNIATKAGHKAVDLFKSVESGDIRILWIMATNPMISMPDSEQIRRALEKCEYVIVSDITPESDTAAYADCLLPAAAWGEKSGMVTNSERMMSRQRAFTAMPGEVKADWQIICDVAKQLGFSKAFKYQSEADIFREHAALSGINNSTDLLFDISCLALLSDDDYQTWQPQQWPLNPNGNRVFEQHNNLPLFSTPTRKAQLVVTPSPSENTSSNVMLAQDGPQSIFWLNTGRQRDQWHTMTRTGHVPALAQSEAEPSLYIHPTSAKHVGLVDGDFVCIESLESYQDLNKHLARVVFDSTLSQQQVFMSMHWAGKYGAKSAINQSVIVACDPISGQPSFKSAQVKLTPISMEFYGVSLGDIPAQLDYEYASFQTYKNEHYQQKGIWRYAGKACLDKTALLRSLSESKQQYLLVEQKWGFALVQLAKVINPDVKLNTTALHLFSDQPINVDMTTLINCVNQPFVMTDVLEALGCQHSKQTLVCSCFQITDLMIEQAIVINNITSLSDLTKQLKCGTNCGTCLPQVERHFSESQQLIPTVQL

SEQ ID NO: 24225 - protein, 518 aa, Ustilago maydis
MNAALSSVRSRAFEAISQLSAGSRSSLPTSSSRSNDKPRRSLDRPRLFKRHGSNVDHIHTQLFDKAVAPPSRSTVLFVLGCLAWYISSSLSSNTSKALLSKGRNHVDSGLPQVRPPAFPYPVTLTLIHFGFVNVCCAICASRRMLGHRALTRLVPPSLSRVAEVGQLAFFNVVGQALSSLAIARVPVSTVHTIKALSPLFTVLSYTYLFNVSYSSKTYMSLFPLTAGVMMACTGFAFNADDMVGFAAALASTLVFVAQNIYSKKLLRKGERSEGEKMDKINILFYSSGCSIVLMIPMALYYDGSSLLFRPSWNASEAYPYDRRTFVLSWLLCNGLVHFAQNILAFNVLSMVSPVTYSIASLLKRVFVIVLAILWFRQSVTRLQWFGIGLTFYGLWMYNDSKTKDDVDKGDKKVERQQGVGNHAILPLTSASTASTASGASGWTDALHNRPHPFAPSTSAYAFAAQQPSAHAAPARLHQPVYPPAPTKGWNDIPDSTLTSYINDPTKSLPSPPDSDKEV

SEQ ID NO: 24226 - protein, 636 aa, Vibrio cholerae
MCGVAGFISKRLSPVDCLTSMVESIMHRGPNDSGLWVDDDFGVCLAHARLSIQDLSSAGHQPMHSKSERYVMIFNGEIYNHLTLREELIEIVPSYWNGHSDTETLLAGFEVWGIEQTIQKCVGMFAIVLWDKVLKQLILIRDRFGEKPLYYGWQRDTFLFASELKALKAHPSFEGSINRQALSHFFRLNYIPTPLSIYEGIFKLEPGVIAVFSHEGQLLSKQTFWDASHAVSLQNFSDHDAVDKLDDLIKQSIQDQALSDVPLGAFLSGGVDSSTVVGILQSLSTRPVKTFTIGFDHADFNEASEASDVAKHLGTDHVELIVSAEDALAIINQLPVMYDEPFADASQVPTFLVSKLAKKEVTVCLSGDGGDELFCGYNRYHYTAKVWSYLEKIPFPIRKMLSVFLLTLSPSSWDVLSKTLGLNTRLPNLGNKTQKGAQALKARDIEDLYTRVVSNWDLDEPLVKNTAVEKLPFLSDLTELSHLNDLEKMMLWDKQSYLMDDVLVKTDRATMACSLEGRVPLLDHRIAEFAASLPIHLKYRGGKGKWLLREVLYRYVPKKLIERPKKGFSLPIAEWLRGPLKDWANVLLDSDRFDKEGFLSSELVQKKWGEHLAGKRDWSSQLWSVLMFQLWLEKNK

SEQ ID NO: 24227 - protein, 89 aa, Zea mays
MMSSQGLTDASKIAILNANYMAQRLEKHYLVLFCGVNEIVAHEFIIDLRAFKATDGDNVVVYTKNCPEVVEDVERWLGYLLDTFEVVDQ

SEQ ID NO: 24228 - protein, 474 aa, Coccidioides immitis
MMEDTFGASFLQPLDPAARHSFKTPSKQINDHQDVTTFLSSLAYKDIITFVLQLNRAMVPSKVLENGMQKIQMWQLASDAIEFSEPVRRLQLLLTRLESIIDEVPPDTGPRRFGNVSFRKWYQEMEARAETIMDECLPSEVLESGGEDPEAVTAKMELMAYFTGSFGSSQRLDYGTGHELSFVAFLGCLWKLNAFAKSEPGVEERGIVVGVIEPYLKLVRRLITTYTLEPAGSHGVWGLDDHSFIPYILGSAQLAPAIAPSDRTPIEGSIDGAPKTSDVTKPSIVERERRTNLYFSAIGFIYDVKKGPFWEHSPMLYDISGIKDGWGKINKGMIKMYNAEVLSKFPVVQHFPFGSLFRWERDPNAAAPLPSPHLSSRPQPSQTMAPPLGGSRPVADASTRAPWATTSSSFPQGTAQSSLGPTGPGYGGLRNQAMPQDGSTHLPPPTQAPWAMKAQRSREKDPDITTTKAPWAKK

SEQ ID NO: 24229 - protein, 483 aa, Lactobacillus plantarum
MAEKQHQEVHRSLQTRHLSMIALGGSIGTGLFVASGSAISTAGPGGALLAYVGIGVMVYFLMTSLGEMATYLPVSGSFSTYATKFVDPALGFAMGWNYWFNWAITLAVDISTAAIVMQFWLPSVPGWVFSLIALVLIFTINALSVRSFGETEYWLSLIKVVTVLVFLVIGVLTIVGIMGGHATGLSNFTYKKAPFVGGIPTILSVFVVAGFSFQGTELIGITAGESATPEKSIPAAIKQVFWRILLFYILAIFVIAAIIPYTSKDLLGSSASDIAISPFTLVFKRAGLAAAASVMNAVILTSVLSAANSGMYASTRMLYSLSLQGYAPKTFGRVNRRGIPIMALLGTTVIGLLTFLSSLFGERIYIFLVSASGLTGFIAWLGIAISHLRFRRAFVKQGHQLSELRYHAKWFPFGPWFAFILCVVVIIGQDLHSFATLDWQAIGVTYMSIPLFIILYVYYKIRYHTKMIPLDKVDLTRKRHHQD

SEQ ID NO: 24230 - protein, 1342 aa, Salinibacter ruber
MSRLWWLLVVGLALLVAPPATGQVVETTPSPPRTDQSVTLYFNADEGNAGLEGYDGTIYAHTGISTDQNPEEQWKCVKNNWPTEEAFSGNRDDTQLTQVAGEPNRYRLEISDIRAYYQDTSTECGLGADEKIETMNMVFRNDDGSRSGRAAGGGDIFVDVFDVGDEPSLQATIQSPQSDPPLYPFVTQSTSVDVAVSADTANIASIASLQLFVDDTQVASTSEASLTYTLDTSSPGRFDVRVEAEATTDSTTLTDSTSTLFVRAPEVQDAPRPSSIQGAPGENDGITYNSDGSVTLSLYAPEKSFIYAIGDFSNWELDADYFMNRDGGHWWVTIPAADLRGQDEYDFQYFVDGTIRTSDPFAHKVRTPQDGGISEDIYSGLEPYPENQTENLVSVIRPDQESNSFDFSSFEPPEREDLVVYELLLRDFVEQGSFAVLSDTLDYLDRLGVNAVELMPVANFGGNNSWGYNPNSHLALDKSYGPPQGFKQFVEEAHQRGIAVIMDVVYNHITAQSPLSQLYASNTDNPFLEPQPGEDPNRDRGFCDDFFQELNHGSPFIKNYIDRANEYWLEEFNVDGFRFDLAKCVADDGVNVNDSGYQAAVTEGWKDVADHVWDTVDSDALMILEFFGSPGVENELGGYRDENTGSMITWYNMNSIYSQADMGYLGGDGGTSDFSSSYYENRSGYDQASFISYMESHDEQWLIRRKKAFGNSTDGYSTRNFETALNRQKLVGGFFFTTPGPRMMWQFGELGYGWGENECLKESDACTASDPGRTSPKPIRWEYRDPETSPDRVRLYKTWSALINLRQAHEVFRSPDTEVEMLVGDGERIRWIRLSHPTMDALVVGNFGLLQRNATVTFPQTGTWYNVFANREVNIQTATKTLPLRPGEFRVYTSGEPAVTPEEGLVPSTINPPSRIDVDVEQSFGPVTDPSNYRLVALPGSIDVPLTQAAFGTPGDTWRAFYETGAGSDYLVEYSNADERFELGNGMGLWLLSERTFAYEDSVASVSLRKNRAHIPLHEGWNIISNPFSLSVPWTRVQADNSVSAPLYRWKNGSFVEADTFRTAATGEAFYFKNATGKDSLAVPYPGSVADRQAAQAAMPEAVTTLRSASTFQLQAQANGTTTSVRLGYSEGTEPVHHAAPRASFSDVRLVAGGDGHALATQVVPTAADSVRTDRLSYPLRLSASKGQSVTLRPKGLDAFTNQPVTLVNRATGTTYEVGDGETVEFTPASSTTRLQLRVGSVPDNESELTPEQVRLYQNYPNPVHRSTTIKYDLPKQASVRLSVYDVLGRRVTTLVRGERTSGQHTVTWRPGQSGASLSSGVYFVRLEADDAVRSRRITVVR

SEQ ID NO: 24231 - protein, 334 aa, Arabidopsis thaliana
  misc_feature (26)..(26): Xaa can be any naturally occurring amino acid
  misc_feature (51)..(51): Xaa can be any naturally occurring amino acid
  misc_feature (54)..(54): Xaa can be any naturally occurring amino acid
  misc_feature (109)..(109): Xaa can be any naturally occurring amino acid
  misc_feature (149)..(149): Xaa can be any naturally occurring amino acid
  misc_feature (155)..(155): Xaa can be any naturally occurring amino acid
  misc_feature (242)..(242): Xaa can be any naturally occurring amino acid
  misc_feature (278)..(278): Xaa can be any naturally occurring amino acid
SDAKETSATDLKRPREEDDNGGAATXETENGDQKKEPACFSTVIPGWFSEXSPXWPGEAHSLKVEKVLFQGKSDYQDVIVFQSATYGKVLVLDGVIQLTERDECAYQEXITHLPLCSIPNPKKVLVIGGGDGGVLREVARHASIEQIDXCEIDKXVVDVSKQFFPDVAIGYEDPRVNLVIGDGVAFLKNAAEGSYDAVIVDSSDPIGPAKELFEKPFFQSVARALRPGGVVCTQAESLWLHXDIIEDIVSNCREIFKGSVNYAWTSVPTYPSGVIGFXLCSTEGPDVDFKHPLNPIDESSSKSNGPLKFYNAEIHSAAFCLPSFAKKVIESKAN

SEQ ID NO: 24232 - protein, 235 aa, Nepenthes gracilis
  misc_feature (50)..(50): Xaa can be any naturally occurring amino acid
  misc_feature (66)..(66): Xaa can be any naturally occurring amino acid
  misc_feature (80)..(80): Xaa can be any naturally occurring amino acid
  misc_feature (110)..(110): Xaa can be any naturally occurring amino acid
  misc_feature (124)..(124): Xaa can be any naturally occurring amino acid
  misc_feature (129)..(129): Xaa can be any naturally occurring amino acid
  misc_feature (136)..(136): Xaa can be any naturally occurring amino acid
  misc_feature (138)..(138): Xaa can be any naturally occurring amino acid
  misc_feature (167)..(167): Xaa can be any naturally occurring amino acid
  misc_feature (176)..(176): Xaa can be any naturally occurring amino acid
LIVWVQENLGWALGFGIPAISMGIAIASFFSGTALYRLQKPGGSPLTRMXQVLVASFRKSKLALPXDSNLLYETSDENSXIEGSRKLEHTNELKCLDKAAVVSDKEIKCXDFSNPWRLCTVTQXEELKXLICMFPXWXTGIVFSAIYAQMSTMFVEQGEVMDRTIGXFTIPAASLXMFDTISVIFWVPVYDKILVPLARKFTGKQRGFSELQRMGIGLFISILSMAAAALVEMKR

SEQ ID NO: 24233 - protein, 489 aa, Unknown
  Halobacterium sp. NRC-1
MPAAQPPGMQLFWHRRDLRTTDNRGLAAAAPGVTAVDGGHDQGPVAAVFCFDDEVLAHAAPPRVAFMLDALAALRERYRDLGSDLIVRHGDPAAVLPAVANDLDATRVVWNHDYSGLATDRDAGVRDALDAAGVAHAQFHDAVHHRPGEIRTNAGDPYSVYTYFWRKWQDREKNPPAPEPEPADLAADTALADTSPLPSVQELGFAEPEAAVPDAGTAAARSLLDAFRESGDIYRYEDRRDYPHEEPTSRLSPHLKFGTIGIRTVYEAARAAKSDADTDDERENVAAFIGQLAWREFYAQVLYFNQNVVSENFKAYEHPIEWRDDPAALQAWKDGETGYPIVDAGMRQLRAEAYMHNRVRMIVAAFLTKDLLVDWRAGYDWFREKLADHDTANDNGGWQWAASTGTDAQPYFRVFNPMTQGERYDPDADYITEFVPELRDVPADAIHSWHELSLSERRRHAPEYPDPIVDHSQRREDAIAMFERARGDE

SEQ ID NO: 24234 - protein, 417 aa, Oryza sativa
  misc_feature (97)..(97): Xaa can be any naturally occurring amino acid
  misc_feature (104)..(104): Xaa can be any naturally occurring amino acid
MEGGGAKDGSAAAAQTRGSGDDGSHKPLPPCCLKAKAAAAESEAKCHATVVSGWFTEPRSHSGKTSKVQYFNNPMWPGEAHSLKVENILYQGKSPYXEILVFEXSTYGNVLVLDGIVQLTEKDECAYQEMVTHLPLCSIPSPKSVLVVGGGDGGVLREIARHASVENIDICEIDQLVIDVCKDFFPQLSVGFKDPRVQLHVGDAVDFLRNAPEGKYDAIIVDSSDPIGEILLLLNHHMFQFCAPFVFVPHEDPSHIIGPAQELVEKPFFQTIARALKPGGVLCNQAESMWLHTHLIQDMLSICRETFKGAVHYAWTSVPTYPSGVIGFLLCAKEGPAVNFLSPVNPIEKLEGAMEAGREIRFYNSEVHRAAFVLPTFVRRELESHNTCAEKDKSETKPVAKPKKMKIMPNSAIPTAS

SEQ ID NO: 24235 - protein, 216 aa, Saccharomyces cerevisiae
MIQREEMNMPRQYSEQQQLQENEGEGENTRLPVSEEEFRMVQELQAIQAGHDQANLPPSGRGSLEGEDNGNSDGADGEMDEDDEEYDVFRNVGQGLVGHYKEIMIRYWQELINEIESTNEPGSEHQDDFKSHSLPFARIRKVMKTDEDVKMISAEAPIIFAKACEIFITELTMRAWCVAERNKRRTLQKADIAEALQKSDMFDFLIDVVPRRPLPQ

SEQ ID NO: 24236 - protein, 235 aa, Nepenthes hirsuta
  misc_feature (7)..(7): Xaa can be any naturally occurring amino acid
LIVWVQXNLGWALGFGIPAISMGIAIASFFSGTALYRLQKPGGSPLTRMCQVLVASFRKSKLALPEDSNLLYETSDGNSVIEGSRKLEHTNELKCLDKAAVVSDKEIKCEDFSNPWRLCTVTQIEELKILIRMFPIWATGIVFSAIYAQMSTMFVEQGEVMDRTIGSFTIPAASLSMFDTISVIFWVPVYDKILVPLARKFTGKQRGFSELQRMGIGLFISILSMAAAALVEMKR

SEQ ID NO: 24237 - protein, 132 aa, Bacillus subtilis
MGQSFNAPYEAIGEELLSQLVDTFYERVASHPLLKPIFPSDLTETARKQKQFLTQYLGGPPLYTEEHGHPMLRARHLPFPITNERADAWLSCMKDAMDHVGLEGEIREFLFGRLELTARHMVNQTEAEDRSS

SEQ ID NO: 24238 - protein, 235 aa, Nepenthes inermis
  misc_feature (39)..(39): Xaa can be any naturally occurring amino acid
LIVWVQENLGWALGFGIPAISMGIAIASFFSGTALYRLXKPGGSPLTRMCQVLVASFRKSKLALPEDSNLLYETSDENSVIEGSRKLEHTNELKCLDKAAVVSDKEIKCEDFSNPWRLCTVTQIEELKILIRMFPIWATGIVFSAIYAQMSTMFVEQGEVMDRTIGSFTIPAASLSMFDTISVIFWVPVYDKILVPLARKFTGKQRGFSELQRMGIGLFIAILSMAAAALVEMKR

SEQ ID NO: 24239 - protein, 416 aa, Haemophilus influenzae
MTIADYDPVLWQAIQDENRRQEEHIELIASENYASPRVMEAQGSQFTNKYAEGYPGKRYYGGCEYADIVEQLAIDRAKELFGADYVNVQPHSGSQANAAVYGALINAGDTILGMDLAHGGHLTHGAKVSFSGKIYNSVLYGITADGLIDYEDVRQKALECKPKLIVAGFSAYSQVVDWAKMREIADEVGAYLFVDMAHVAGLIAAGLYPNPLPHAHVVTTTTHKTLGGPRGGLILSSCGDEEIYKKLQSSVFPANQGGPLVHIIAAKAVCFKEALEPQYKAYQANVIKNAKAMVEVFKQRGYDVVSNGTENHLFLVSFIKQGLTGKAADAALGKANITVNKNAVPNDPQKPFVTSGIRVGTPSVTRRGFNENDVRELAGWMCDVLDALGKENEEQVIAETKEKVLAICKRLPVYPK

SEQ ID NO: 24240 - protein, 417 aa, Legionella pneumophila
MFDESYSIKNFDDVLFKAISDEKRRQEEHIELIASENYVSPRVLEAQGSVLTNKYAEGYPGKRYYGGCEFVDVAEELAISRAKLLFGAHYVNVQPHSGSQANAAVMMALLSPGDTFMGMALPHGGHLTHGSKVNFSGKLYHSVEYGVDSNTGLIDYDALEKLALQHKPKLIIAGFSAYSRILDWARFREIADKVGAYLMADIAHVAGLVAVGLYPSPVPYADVVTTTTHKTLRGPRGGLILCKENEEIEKKLNSSVFPGMQGGPLMHVIAAKAVAFAEALLPEFKTYQQQVLANARTMCSVLQSRGYDIVSGGTDNHLLLVDLINKGITGKEADAAVGRANITVNKNSVPNDPRSPFVTSGLRLGTPAATTRGFKEREITLLSNWVADVLDNVHDETNISRVKTQVLLLCREFPVYA

SEQ ID NO: 24241 - protein, 234 aa, Nepenthes maxima
  misc_feature (1)..(1): Xaa can be any naturally occurring amino acid
  misc_feature (228)..(228): Xaa can be any naturally occurring amino acid
XGWVQENLGWALGFGIPAISMGIAIASFFSGTALYRLQKPGGSPLTRMCQVLVASFRKSKLALPEDSNLLYETSDENSVIEGSRKLEHTNELKCLDKAAVVSDKEIKREDFSNPWRLCTVTQIEELKILIRMFPIWATGIVFSAIYAQMSTMFVEQGEVMDRTIGSFTIPAASLSMFDTISVIFWVPVYDKILVPLARKFTGKQRGFSELQRMGIGLFISILSMAAAXLVEMKR

SEQ ID NO: 24242 - protein, 309 aa, Unknown
  Synechococcus sp. RS9917
MGWSAADIPDQRGRLALVTGANSGLGLETTRALLAHGATVLMACRNRERGETARRSLSDQSASKGGSIELLDLDLADLESVDRCAQTVRQRFGRLDLLINNAGVMAPPRQCSRQGYELQFATNHLSHMALTRALLPLMEGQPDARVVTVTSGAQYFGRIAWEDPNGEQRYDRWQAYGQSKLANVMFALELDRKLRDRGSSIRSLAAHPGLARTNLQPASVSANGSRLEALAYRLMDPLFQSAAMGALPQLHAATAASAQSGEHYGPNRLGGLRGYPKRQRVAPAAEDPQQRERLWDLSLKLIEAGPALR

SEQ ID NO: 24243 - protein, 416 aa, Thermoanaerobacter tengcongensis
MSTESLNPLVIAQKQIKKACDILGVEESVYELLKEPMRVLEVSIPVQMDDGSIKVFKGYRSQHNDALGPTKGGIRFHPDVTLDEVKALSMWMTFKCGVVGLPYGGAKGGVVVNPKELSNDELQRLSRGYIRAIASIIGPEKDIPAPDVGTNAQIMAWMVDEYNKIVGYNSPAVITGKPLIYGGSKGRVAATGYGVALMAREAVKRLNMDFKDCTVAIQGFGNVGSHAGLSLQRLGAKIIAVSDVYGGIYNEKGIDAEKLVEHVNKTGTVCNFEGTTPITNEELLTMKVDILVLAALENQITSANANEVKAKIICEGANGPTTPEADKILSEKGVFVVPDILANSGGVIVSYFEWVQNLMNYYWTEKEVEERQEIMMVNAFNSIYDLAQQYKVDMRTAAYMISIKRVYEAMKVRGWL

SEQ ID NO: 24244 - protein, 218 aa, Yushania bojieiana
GMDVSEWDPSKDKYISVKYDKTTAMEAKALNKEALQAEVGLPVDGKIPLVAFIGRLEEQKGPDVMAAAIPQLIEENVQIILPGTGKKKFERMLKSAEEKYPGKVRAVVKFNAPLAHQIMAGADLLAVTSRFEPCGLIQLQGMRYGTPCVCASTGGLVDTIIEGKTGFHLGRLSVDCNVVEPGDVQKVATTLKRAIKLVGTPAYQEMVRNCMAQDLSWK

SEQ ID NO: 24245 - protein, 144 aa, Glycine max
MVAFTEKQDALVSSSFEAFKANIPQYSVVFYTSILEKAPAAKDLFSFLANGVDPTNPKLTGHAEKLFALVRDSAGQLKASGTVVADAALGSVHAQKAVTDPQFVVVKEALLKTIKAAVGDKWSDELSRAWEVAYDELAAAIKKA

SEQ ID NO: 24246 - protein, 218 aa, Yushania niitakayamensis
GMDVSEWDPSKDKYISVKYDKTTAMEAKALNKEALQAEVGLPVDGKTPLVAFIGRLEEQKGPDVMAAAIPQLMEENVQIILLGTGKKKFERMLRSAEEKYPGKVRAVVKFNAPLAHQIMAGADLHAVTSRFEPCGLIQLQGMRYGTPCVCASTGGLVDTIIEGKTGFHLGRLSVDCNVVEPGDVQKVATTLRRAIKLVGTPAYQEMVRNCMAQDLSWK

SEQ ID NO: 24247 - protein, 444 aa, Bacteroides fragilis
MNAAKVLEDLKRRFPNEPEYHQAVEEVLSTIEEEYNKHPEFDKANLIERLCIPDRVYQFRVTWVDDKGNVQTNMGYRVQHNNAIGPYKGGIRFHASVNLGILKFLAFEQTFKNSLTTLPMGGGKGGSDFSPRGKSNAEVMRFTQAFMLELWRHIGPETDVPAGDIGVGGREVGFMFGMYKKLSHEFTGTFTGKGREFGGSLIRPEATGYGNIYFLMEMLKTKGTDLKGKVCLISGSGNVAQYTAEKVLELGGKVVTMSDSDGYIYDPDGIDRAKLDYIMELKNLYRGRIREYAETYGCKYVEGARPWGEKGDIALPSATQNELNGDDARKLVANGVIAVSEGANMPSTPEAIKVFQDAKILYAPGKAANAGGVSVSGLEMTQNSIKLSWSSEEVDEKLKSIMKNIHEACVQYGTEPDGYVNYVKGANVAGFMKVAKAMMAQGIV

SEQ ID NO: 24248 - protein, 72 aa, Bacillus cereus
MAKDDVIEVEGTVLETLPNAMFKVELENGHVVLAHVSGKIRMNFIRILPGDKVTVELSPYDLNRGRITYRFK

SEQ ID NO: 24249 - protein, 218 aa, Yushania oblonga
GMDVSEWDPSKDKYISVKYDKTTAMEAKALNKEALQAEVGLPVDGKIPLVAFIGRLEEQKGPDVMAAAIPQLMEENVQIILLGTGKKKFERMLKSAEEKYPGKVRAVVKFNAPLAHQIMAGADLLAVTSRFEPCGLIQLQGMRYGTPCVCASTDGLVDTIIEGKTGFHLGRLSVDCNVVEPGDVQKVATTLKRAIKLVGTPAYQEMVRNCMAQDLSWK

SEQ ID NO: 24250 - protein, 590 aa, Coprinopsis cinerea
MPLVIEPSSPASDSGNATYISNVSSVDSEKTIREDDKTQLAALLNNMNALMSSDRLPVSASETSMAVNDLSSSDESDYEGSGGTWIKPYQDRPPSARPELTKLRTDLPSTPDPADKVREERPNPSASQSQGYQNGGPSSQYQLPPPQRFPPGNQQHRDHRVSGFADGDDDWAPRPPPEDVYDRLEEFFPEHDLDKLVIEANSGGNSPTNPEPTTAIPTPVSANATVIMPQHPHRRHKKSIRIVAQEQKRKMNDQTSRVDPAPYGQNAMLRKRNTKMWGSKLEEVTTMQVRTSSTIPESPSSAGSPPTFKWVRGELIGKGTYGRVYLALNATTGEMIAVKQVELPQTPSDRNDSRQNTVVQALKLESETLKDLDHPHIVQYLGFEETPANLSIFLEYVPGGSIGSCLHKHGKFSENVTKSFTGQILSGLEYLHSKGILHRDLKADNILVEMTGICKISDFGISKRTDDLHGGAFTAMQGTVFWMAPEVINTQKKGYNFKIDIWSVGCVVLEMWGGRRPWTGQEMVTVMFKLYEAKLPPPVPDDVVLSELGDDFRRKCFAINPDERPPAAELRLHPYLELPPGWTFTSFTSD

SEQ ID NO: 24251 - protein, 218 aa, Yushania polytricha
GMDVSEWDPSKDKYISVKYDKITAMEAKALNKEALQAEVGPPVDGKIPLVAFIGRLEEQEGPDVMAAAIPQLMEENVQIILLGTGKKKFERMLMSAEEKYPGKVRAVVKFNAPLAHQIMAGADLLAVTSRFEPCGLIQLQGMRYGTPCVCASTGGLVDTIIEGKTGFHLGRLSVDCNVVEPGDVQKVATTLKRAIKLVGTPAYQEMVRNCMAQDLSWK

SEQ ID NO: 24252 - protein, 191 aa, Aspergillus oryzae
MASATTFFDFEPVDKKGSPFPLTPLKGKTILVVNTASKCGFTPQFEGLEKLYQKLKSKYPEDFTILGFPCNQFGGQDPGSNDQIQDFCQLNYGVTFPVLGKLDVNGNEASPLWTWMKEQQPGLLGLKRVKWNFEKFLISPDGKVVGRWASTTKPESLEDTIVKEIEKAQKAGTAASVQAKEGESAEQAKLS

SEQ ID NO: 24253 - protein, 480 aa, Mycobacterium avium
MPSPAVTSPQVAVNDIGSSEDFLAAIDKTIKYFNDGDIVEGTIVKVDRDEVLLDIGYKTEGVIPARELSIKHDVDPNEVVSVGDEVEALVLTKEDKEGRLILSKKRAQYERAWGTIEALKEKDEAVKGTVIEVVKGGLILDIGLRGFLPASLVEMRRVRDLQPYIGKEIEAKIIELDKNRNNVVLSRRAWLEQTQSEVRSEFLNQLQKGAIRKGVVSSIVNFGAFVDLGGVDGLVHVSELSWKHIDHPSEVVQVGDEVTVEVLDVDMDRERVSLSLKATQEDPWRHFARTHAIGQIVPGKVTKLVPFGAFVRVEEGIEGLVHISELAERHVEVPDQVVAVGDDAMVKVIDIDLERRRISLSLKQANEDYTEEFDPAKYGMADSYDEQGNYIFPEGFDPETNEWLEGFEKQRAEWEARYAEAERRHKMHTAQMEKFAAAEAAGHAGGEQSPGNGAPAEKAGGSLASDAQLAALREKLAGNA

SEQ ID NO: 24254 - protein, 360 aa, Oryza sativa
  misc_feature (76)..(76): Xaa can be any naturally occurring amino acid
MASCGFEGFEKRLELVFELPASGGEVARHGLRLLPAEALREVLDAAQCAVVSAAGNAAADAYVLSESSMFVYPGRXVVLKTCGTTPLLRAVPVLLRAAAALRLRLRSCRYSRGEYLFPEAQPFPHAHFADEVAYLDAALPRELLRFRRSAVMPSSSSSSPGASHRWHVYSASSSASSSDADGAARLTAEVCMTELDRGMAARFYQRPGDGRTSHAIGDEMTAASGIGGVVDENDPRSLVCAYAFAPCGYSMNALDGARYATVHVTPEDGHCYASFECATDDAAAALAAIRRAVAAFRPATVSVSISHTSSAASSLCTPVAEALEPLGLACHCRAAEVFPGAGTVTYQTFTAPATKHEHDN

SEQ ID NO: 24255 - protein, 377 aa, Triticum aestivum
MDPFHGIVKEEEFDFAGAAADGYSPSSWGSSPSSWGSSQSSWAGGGALAELPRPMDGLGEAGPTPFLNKTYEVVDDHSTDTIVSWGVAGNSFVVWDAHAFSMVLLPRYFKHCNFSSFVRQLNTYGFRKVDPDRWEFAAEGFLRGQKELLKTIRRRRPQSSPSGTPALLQQQQQGQQGACLEVGHFGPEGEVQRLQRDKGTLIAEVVKLRQEQQATRAQMQEMEARLAATEQKQQQMTVFLARAMKSPSFLQMLVQRQDQSRRKELAEALLSKKRGRPIEYLLPRNGETSSAASYSAAARGYGPGLADGSDGRRADGEDTESFWKELLSLGLEERHREAGGGGGEASGAEVDDDVDDEVDELVQSLYHLSPNRPHSHQ

SEQ ID NO: 24256 - protein, 722 aa, Unknown
  Candidatus Kuenenia stuttgartiensis
MNEITHMTEWPGKAYPLGATWDGAGVNFSLFSENATGVELCLFDGQDGNHEVARIRMAHHTDQVWHTYLPTVRPGQLYGYRVYGPYEPKSGHRFNPAKLLLDPYAKAISGTICWSDALFGYTPGHKEADLSKDDGDSAPNIPRCVVVDPAFTWGDDVSPGTPWHKTLIYELHVKGFTKQHPGVPKELQGTYAGLTCHAVIDYLHSLKITAVELMPVHHFVDEKDLIGRGLSNYWGYNSIGFFAPAARYSGSGIMGEQVNEFKTMVKTFHREGIEVILDVVYNHTAEGNHLGPTLSFRGIDNANYYHLASDNKRYYVDYTGCGNMPNMIHPRVLQLIMDSLRYWVLEMHVDGFRFDMASALARELHEVDRLGAFFDIIHQDPVLSQVKLIAEPWDLGPGGYQVGNFPILWTEWNGKYRDTVRQFWHGDKGVAGNLAYRLTGSSDLYEHGGRRPYASINFITAHDGFCLHDLVSYNEKHNEANGEGNKDGTDYNLSWNCGIEGPTDNQEVAKLRERQKRNFIATLILSQGVPMLLAGDEIGRTQKGNNNAYCQDNEISWIDWDLDKPRQELLEFTRLLTQLRHQHPVMRRRHFFQGRKITGSEVKDLTWFRPDGKEMTDEDWNNPSTHSLALCLAGYAIEEVDERGKQIVDDTLLILMNVHHESISFVLPAHNPKIQWKTLIDTREATGKRSIQLMKGGELYSLEARSLVLLQLVEERRSSPLA

SEQ ID NO: 24257 - protein, 477 aa, Escherichia coli
MNKKSLWKLILILAIPCIIGFMPAPAGLSELAWVLFGIYLAAIVGLVIKPFPEPVVLLIAVAASMVVVGNLSGGEFKTTAVLSGYSSGTTWLVFSAFTLSAAFVTTGLGKRIAYLLIGKIGSTTLGLGYVTVFLDLVLAPATPSNTARAGGIVLPIINSVAVALGSEPEKSPRRVGHYLMMSIYMVTKTTSYMFFTAMAGNILALKMINDILHLQISWGGWALAAGLPGIIMLLVTPLVIYTMYPPEIKKVDNKTIAKAGLAELGPMKIREKMLLGVFVLALLGWIFSKSLGVDESTVAIVVMATMLLLGIVTWEDVVKNKGGWNTLIWYGGIIGLSSLLSKVKFFEWLAEVFKNNLAFDGHGNVAFFVIIFLSIIVRYFFASGSAYIVAMLPVFAMLANVSGAPLMLTALALLFSNSYGGMVTHYGGAAGPVIFGVGYNDIKSWWLVGAVLTILTFLVHITLGVWWWNMLIGWNML

SEQ ID NO: 24258 - protein, 226 aa, Arabidopsis thaliana
MRRPKSSHVRMEPVAPRSHNTMPMLDQFRSNHPETSKIEGVSSLDTALKVFWNNQREQLGNFAGQTHLPLSRVRKILKSDPEVKKISCDVPALFSKACEYFILEVTLRAWMHTQSCTRETIRRCDIFQAVKNSGTYDFLIDRVPFGPHCVTHQGVQPPAEMILPDMNVPIDMDQIEEENMMEERSVGEHEAALEDKNLKKRRNLKRNHPTTLCYVHLIIVYHKLIH

SEQ ID NO: 24259 - protein, 1338 aa, Yarrowia lipolytica
MSMPNVSAPTLAIPETNGARAIGAALAGATAAGRKRSGSLDAPSAATVTRGGTTSPLLCNSAYSPHPGSSSPGGYFDSNHNLSVRTLSTPASPNDNASVHPVTPQTVPATNNSNTVRPKSPSRQPSNTYAPARHPSQNNQRGTRKTSQGAVPSVSGSKPSSNAQYYAQERAYLQKMRNNLADDYYTKGIPASDLDRSSDEESLSEFEGDFVGLGGVGTFFDDSGAISYPFLEAKYNADDAEKSESIRERLQWQSMLTSVLTGEVVKNEKQRLRAPPEMDKKLVAEELWMGVRAKVCGRSMDEQRRIIEYSRNTKDGILLEVVNFRAKPADEAGGRSASDQVEDLLNRLDNFEQLWRSYSLIETDKPFYGSQEFQERLTALLTWSSLTWNIGTEIRLLQQWIGNEDIDLTRPAEGNDMMADKSPFIERLLKGQDLKNIFENRVLGPLSQLVDRARTSALEYHDTFQTLGLPVLYDHIGSLARFPSLLIMEVMRTRLNYARKLANPTMMMIDQTMVDIRGYIELSLKAKERYMFFVSPTQDGPWPLKDTIGDAFDETLIDCVSFYFDLLSRKFLESSNAVFRTFKEGEQLEFQYKFLSKIGEWISGGDYLVAEQFSYLTSKLMTKLLDYWQDSLKGPASDQANEIAAFYSETAEQIRSFERNLIRFYTSMCSSYENASEYAIQPSRLGAIVNSVRRANYFLVYTGVLERDGIYVFADPSLRERPHKLKEIIRGYSRYRRPEEDSVEYDHIAHVLILCSEEPFIWEGEILNIDMPSFDLEIKMGRMRIVSEGGTHMLQLAKTQFAEVCEREFLNTVVEAKSNQLRVDHEFGRLRKLFFRLSMSVIDNVATIRHTLKGLGCQDTVQNMFVFAREFGQRGLRSLEGPKRGYVTMKLINLCIEWVSFVVDDCTSTEYRTFRYTVTALEFASVMTSGVNILAVNEEAFLRLRVKVAGCMSLLISHFDIMGARSKAKAQQKVEVTSARRKKISHMSFKDDTELMEAFRNDAVKKLEDLERKRNDLEFEHHYVGRVLDDGSADDQFLMSLASAFSNVTMRWQLGRFIGSGTFGDVYSALNLDNGEMMAVKEIRLQDAQSIRTIVKAIKDEMTVLEMLHHPNIVQYFGVEVHRDRVYLFMEICQGGSIADLLSHGRIEDEQVIQVYTFQMLQGLAYLHHAGIVHRDLKPENILLDHNGLIKFVDFGAAKVIARNGRTRAAQTGTRSKINSLTGTPMYMSPEVITGSNPGRQGAIDIWSLGCVVLEMATGRRPWSNLDNEYAIMFHIASGHMPQLPSAEQLSPEGQAFLLKCLDRDPNKRESAIELSNDPWLARVKNDHLEQLTPMGEE

SEQ ID NO: 24260 - protein, 629 aa, Ashbya gossypii
MKPIGLTGMGLQSAGDSGEELKSGWMPAEMPLGEYMFRRLMSAGTKTVFGVPGDFNMGLLEHMYGEAVCAEGLQWIGTCNELNAAYAADGYSRYCNKIGCVVTTLGVGELSALNGVAGAFAEHVKVLHIVGVSMRAAQTHPELHGNVHHLVPRLRNSNFKAPNHKVYSEMVSGRVSCCCEFLEDLETACDQIDHVIREIWRHGKPGYLFVPADMPNMKVSSRNLVQAPTIMLESAVLERTNLAACDRIGIEILQHLYQSSTPAILCDGLCDRFGLTGDVRRLVELTGMWNFSTIMGKSILDETQPHYKGVYYGAGSKERNALLQECDLILYLGPVKDEVNTWKYTFQFNPQSMIIELHPEYVSLTRNGEQTILNSGHLLPVLRSILAHLNVANLSFNYPTAKKRVPREHQYAADEPITQGMLQHMIPECLNPGDVMVVDTGTFQFSVFDMKFPTDLKCISQSFYLSIGMALPAALGVACAMREFPRLHLGPKLANEGYTPRLVLCEGDGAAQMTIQELSTFIRYELPVEVLLWNNDGYTVERVIKGPTRSYNDIMSWDWTKLLRVFGDFDGTRSESVRVKDFNSLIEHLSSWKSDKKRSKIRLMEVILDKMDISATLKELAKQFQHNAA

SEQ ID NO: 24261 - protein, 306 aa, Moorella thermoacetica
MKIARDVTQLIGQTPILRLNRLVEDGMEVYLKIEFFNPGGSVKDRIALSMITAAEADGRLKPGDTIVEPTSGNTGIGLAMVAAVRGYRLILVMPETMSIERRKLLAAYGAEFVLTPGNLGMKGAVDKANELVRENPGYFMPQQFENPANPAIHRQTTAREILEQMDGKVDAFVAGVGTGGTLTGVGEVLKKEIPGVRIVAVEPAASPVLSGGQPGPHKIQGIGAGFVPPVLRREVVDEIITVTNEDAMETARRLAREEGLLVGISSGAAAFAALQVARRLGRGKRVLAIAPDTGERYLSTELFKIG

SEQ ID NO: 24262 - protein, 366 aa, Kineococcus radiotolerans
MTVADLFGTGALAVLLAVALVVTFTLLARERRATRALRAQQPAPPAVPGDPPRRRRAAIVVNPTKFSVLDEHALRRRQAYVAAVFRSHGWADPLWLPTTPTEHGGPQARQALAEGVDLVLAAGGDGTVRSVAEAMTGTSTPMALLPAGTGNLLARNLDVPHTDLAAALDLVFSEADHRVDVGWLEVDRSGHDAAPERHLFLVMAGLGFDAAMMAGVEDRLKRRLGYGAYVVSGARALWGPQTKVRVRVDDGDPVSVRTRAVIVGNCGKLTRQLVLMPDAEIDDGYLDAVVISPRGGIGWGEVAWAIATRDRRGQRRVQHLRGRRFEVSAGDPQEVELDGDPIGEARRITLSVEPGALLVRCPPLHP

SEQ ID NO: 24263 - protein, 363 aa, Unknown
  Shewanella sp. ANA-3
MNPVFTPNVAQKILFIDRDGTLIEEPITDKQVDSLAKLVFEPQVIPALLRLQKAGFRLVMVSNQDGLGTPSFPQEDFDAPHNMMMQILSSQGVKFEDVLICPHFNDENCSCRKPKLGLVKDFLTQGTIDFTQSAVIGDRHTDVELGNAMGIKSFQYQRGSLGWDAIADALLNKGRTATVVRTTKETDIRVTVDLDNPSKGAINTGIGFFDHMLDQIATHGNFKMEVNVDGDLEIDDHHSVEDTALAIGDALRQALGDKRGIARFGFSLPMDEAKGECLLDLSGRPFIKFAAQFEREKVGEMATEMVPHFFRSFADGLRCTLHVAAEGDNDHHKVEALFKVLGRALRQAVKVEGDVLPSSKGVL

SEQ ID NO: 24264 - protein, 466 aa, Streptomyces avermitilis
MAAPRTSTRKFLGRLSLPERNFVAEALRTETVGGVLLLLAAITALIWANVPALHHSYESVSHFHFGPAPLGLDLSVQHWAADGLLAVFFFVAGIELKRELVAGDLKDPKAAALPVAAALCGMAVPALVYTLTNLTGGGSLRGWAVPTATDIAFALAVLAVIGTSLPSALRAFLLTLAVVDDLFAILIIAVFFTADLNFAALAGAVIGLAVFWLLLRKGVRGWYVYVPLALVIWGLMYNSGIHATIAGVAMGLMLRCHRHQGEEHAPGEHIEHLVRPLSAGLAVPLFALFSAGVVISGGALGDVFTRPETLGVVLGLVVGKAIGIFGGTWLTARFTRASLSDDLAWPDVFAVASLAGIGFTVSLLIGELAFDGDPVLTDEVKAAVLTGSLLAALIATTLLKLRNAKYRALCEDEERDEDSDGIPDIYEQDNPAYHLRMAEIYERKAAEHRRLAEVTGGAGAENDGPA

SEQ ID NO: 24265 - protein, 304 aa, Glycine max; identical to SEQ ID NO: 528

SEQ ID NO: 24266 - protein, 315 aa, Staphylococcus aureus
MRKRARIIYNPTSGKEQFKRELPDALIKLEKAGYETSAYATEKIGDATLEAERAMHENYDVLIAAGGDGTLNEVVNGIAEKPNRPKLGVIPMGTVNDFGRALHIPNDIMGALDVIIEGHSTKVDIGKMNNRYFINLAAGGQLTQVSYETPSKLKSIVGPFAYYIKGFEMLPQMKAVDLRIEYDGNVFQGEALLFFLGLTNSMAGFEKLVPDAKLDDGYFTLIIVEKSNLAELGHIMTLASRGEHTKHPKVIYEKAKAINISSFTDLQLNVDGEYGGKLPANFLNLERHIDVFAPNDIVNEELINNDHVDDNLIEE

SEQ ID NO: 24267 - protein, 345 aa, Glycine max
MAATKPLLTDLASTIDRVPSNFIRPIGDRPKLHQLHSSLASIPIIDLQGLGGSNHSQIIQNIAHACQTYGFFQIVNHGIQEEVVSKMVNVSKEFFGLPESERLKNFSDDPSKTTRLSTSFNVKTEKVSNWRDFLRLHCHPLEDYIQEWPGNPPSFREDVAEYSRKMRGLSLKLLEAISESLGLERDYIDKALGKHGQHLAINYYPPCPEPELTYGLPAHADPNAITILLQNEVPGLQVLYDGKWLTVNPVPNTFIVNIGDQIQVISNDRYKSVLHRALVNCEKERMSIPTFYCPSPDALIKPAPKLVDNEHPAQYTNFTYREYYDKFWNRGLSKETCVDMFKAQD

SEQ ID NO: 24268 - protein, 125 aa, Arabidopsis thaliana
MANLMMRLPISLRSFSVSASSSNGSPPVIGGSSGGVGPMIVELPLEKIRRPLMRTRSNDQNKVKELMDSIRQIGLQVPIDVIEVDGTYYGFSGCHRYEAHQKLGLPTIRCKIRKGTKETLRHHLR

SEQ ID NO: 24269 - protein, 319 aa, Bacillus sphaericus
MKKIAVLTSGGDVPGMNAAIRAVVRKAAFHGINVVGIKHGYEGLVKGYLEELDLGSVGGIIQRGGTHLNSARCPEFKEDAVQQQGIENLRAAGIEGLVVIGGDGSYRGAMDLVKKGFPAVGVPGTIDNDVPGTEYTIGFDTALNTVVESIDKIRDTATSHENSFIVEVMGRDAGDIALWAGLAAGAETVLIPEEDYDLDDIVARLDRGAARGKKHSIIIVAEGVMSGNELAKLIKEKTGKETRVSVLGHIQRGGSPTARDRVLASQFGAHAVELLMEGKYGRAVGIRNHQVIDYDMPEAFEKNHEADVSLYTLMKELSI

SEQ ID NO: 24270 - protein, 240 aa, Haemophilus influenzae
MAQVSMRDMINAGVHFGHQTRYWNPQMKPFIFGARNGVHIINLEKTLPLFNEALAELTRIASNNGKVLFVGTKRAASEAVQVAALDCQQYYVNHRWLGGMLTNWKTVRQSIKRLKDLETQSQDGTFDKLTKKEALMRSREMEKLELSLGGIKDMGGLPDALFVIGADHEHIAVKEANNLGIPVFAIVDTNSTPAGVDFVIPGNDDATRAIQLYVSAAAAAVKEGRGNEAQVAEELAADAE

SEQ ID NO: 24271 - protein, 751 aa, Yersinia pestis
MLKNSCLLVKGDLYMLKKILPVLITLAIVHNTPTAWAAEAPKTDSFYLPKSLDLSPLRLHNIESNPYGKDFNYAQQFKTLDLEAVKKDIKTVLTTSQDWWPADYGNYGPFFIRMAWHGAGTYRIYDGRGGADGGQQRFEPLNSWPDNANLDKARRLLWPIKKKYGAKISWGDLMVLTGNVALESMGFKTLGFAGGREDDWQSDLVYWGAGNKMLSDNRDKNGKLPKPLAATQMGLIYVNPEGPNGKPDPVAAAKDIREAFARMAMNDEETVALIAGGHTFGKAHGAASPEKCLGAAPGEAGLEQQGLGWANKCGSGNGKDTITSGLEGAWTTDPTHFTMQYLSNLYKHEWVLTKSPAGAWQWKPKNAANVVPDATDPTKFHPLMMFTTDIALKVDPEYKKITTRFLENPEEFKMAFARAWFKLTHRDMGPAARYLGDEVPKETFIWQDPLPAANYKMIDSADISELKDKILKTGLSDTKLIKTAWASASTFRGTDFRGGDNGARIRLAPQKDWPVNDPAELHSVLAALMEVQNNFNKDRSDGKKVSLSDLIVLGGNAAIEDAAKKAGYSISIPFTPGRTDASQEETDVSSFAVLEPTADGFRNYYDAKRNTLSPIASLIDRANKLELTVPEMTVLIGGLRVLDVNSGGSKAGVLTNTPGQLNNNFFVNLLDMSTKWTKSPKAEGYFDGYDRKTGKLKWTASSVDLVFGSNPELRAVAEVYASDDAKEKFVHDFTKVWEKVMNLDRFDIKNN

SEQ ID NO: 24272 - protein, 374 aa, Magnetospirillum magnetotacticum
MLATPRREVNVAVPLRRDDGRTVLFHGYRVQHNVSRGPGKGGLRYAPSVDIDEVRALAMWMTWKCALVDLPYGGAKGGVAIDPRSYSDAELERVTRRYTSEIMPVIGPERDIMAPDMGTSERTMAWVMDTYSVNQGYTIPAVVTGKPITVGGSLGRTTATSAGVVHVTAAALEEAGVPLSDVRVAVQGFGKVGSHAAAIFAARGARVVAVSDQYGGVHAPDGLDVRALVEHVAATGSVVGFDRADPVDNDALLALDVDVLVPAAVEGVLDGDTARTVRARWVVEGANGPTTAEGDRVLAKNGVTVVPDVLANAGGVVVSYFEWVQANQAYWWTADEIGDKLEHRMLHAYEEVAVSRAARTSACATRRSSSASRT

SEQ ID NO: 24273 - protein, 416 aa, Vibrio cholerae [sequence omitted]

SEQ ID NO: 24274 - protein, 181 aa, Thermus thermophilus
MKGMFTPGNGPVQISAEAIKKRVEELGGEIARDYQGKTPHLICVLNGAFIFMADLVRAIPLPLTMDFIAISSYGNAFKSSGEVELLKDLRLPIHGRDVIVVEDIVDTGLTLSYLLDYLEARKPASVRVAALLSKPSRRQVEVPIHYLGFEIEDAYVYGYGLDRAQFDRNLPFITSIRPEEE

SEQ ID NO: 24275 - protein, 222 aa, Glycine max
MGRRPARCYRQIKNKPYPKSRFCRGVPDPKIRIYDVGMKKKGVDEFPFCVHLVSWEKENVSSEALEAARIACNKYMAKFAGKDAFHLRVRVHPFHVLRINKMLSCAGADRLQTGMRGAFGKPQGTCARVAIGQVLLSVRCKDSNSHHAQEALRRAKFKFPGRQKIIVSRKWGFTKFSRSDYLKFKSENRIVPDGVNAKLLGCHGPLANREPGRAFLDTATSS

SEQ ID NO: 24276 - protein, 230 aa, Aegilops tauschii
MAGGDDLKLLGAWPSPFVTRVKLALALKGLSYEDVEEDLYKKSELLLKSNPVHKKIPVLIHNGAPVCESMIIVQYIDEVFAGTGPSLLPADPYERAVARFWVPYVDDKLVAPWRQWLRGKTEEEKSEGKKQAFAAVEVLEGALRECSKGGGFFGGDSVGLVDVALGGVLSWMKVTEVLSGDKIFDAAKTPLLAAWVERFSGLDAAMAALPDVGRLLEFAKAREAAAAASN

SEQ ID NO: 24277 - protein, 717 aa, Actinidia chinensis [sequence omitted]

SEQ ID NO: 24278 - protein, 717 aa, Solanum lycopersicum
METVDSTRAFVKNVKRLIVKVGTAVVTRADGRLALGRLGALCEQLQELNSQGYEVILVTSGAVGVGRQRLRYRKLLNSSFLDLQKPQTELDGKACAAVGQNGLMALYDSLFSQLDVTSAQLLVTDNDFRDPDFRRQLNDTVNSLLSLKVIPIFNENDAISTRRAPYEDSSGIFWDNDSLAALLALELKADLLVLLSDVDGLYSGPPRDPDSKLIYTYIKEIHERVITFGDKSRVGRGGMTAKVKAAMYAAYAGIPVVITSGFATDNIIKVLHGERIGTLFHCDANKWASIGETDAREMAVAARACSRRLQALSSQERSKILQDIADALEANEKAILAENEADVVAAQQAGYEKSLISRLALNPGKISSLANSVRVLSNMDEPLGHTLKRTEIADGFILEKSSSPLGVVLIIFESRPDALVQIASLAVRSGNGLMLKGGKEAKRSNAILHKVITSAIPVSVGERLIGLVTSREEIPELLKLDDVIDLVIPRGSNKLVSQIKASTKIPVLGHADGICHVYVDKSADMDMAKRITVDAKIDYPAACNAMETLLVHKDLAQNGGLNDLIVELQTKGVSLYGGPKASSLLMIPEARTFRHEYSSLACTVEVVEDVYAAIDHIHQHGSAHTDSIITEDQEVAEVFLRQVDSAAVFHNASTRFSDGFRFGLGAEVGISTGRIHARGPVGVEGLLTTKWLARGSGQIVDGDKSIVYSHKDLTQQG

SEQ ID NO: 24279 - protein, 719 aa, Mesembryanthemum crystallinum [sequence omitted]

SEQ ID NO: 24280 - protein, 143 aa, Unknown
  Dehalococcoides sp. CBDB1
MEEPKITLGLIAHDNCKKDMVQLIHSYAHLMKGHHLIATRSTGELIQKHTGLPVILKESGPDGGELQLGGFVASRIIKAVIFLRDPLKRKSHEPDVTALMRICDAHNIPLATNRATAACVLHMALFHPEKLDDTPPGENRDNP

SEQ ID NO: 24281 - protein, 298 aa, Nicotiana tabacum
DQDVINLYDANGIRKMRIYNPDTNVFNALRGSNIEIILDVPLQDLQSLTDPSRANGWVQDNIINHFPDVKFKYIAVGNEVSPGNNGQYAPFVAPAMQNVYNALAAAGLQDQIKVSTATYSGILANTNPPKDSIFRGEFNSFINPIIQFLVQHNLPLLANVYPYFGHIFNTADVPLSYALFTQQEANPAGYQNLFDALLDSMYFAVEKAGGQNVEIIVSESGWPSEGNSAATIENAQTYYENLINHVKSGAGTPKKPGNAIETYLFAMFDENNKEGDITEKHFGLFSPDQRAKYQLNFN

SEQ ID NO: 24282 - protein, 525 aa, Aspergillus nidulans
MSNEETVASPPVAPTSDGQHTVSRRQSCSSENSQTAKEFIESQMRLEADAREVLPYSFDSCTQHLGPLRQTLYACLTCNPPPPTPDSPYTAAGVCYSCSISCHGEHTLVELFNKRNFVCDCGTTRITSSTPCTLRSDPNTGTKGVRSEKPHPGNRYNRNFQNKFCGCGEDYNAHEEKGTMFQCLGLGTTETGGCGEDWWHPECLIGLPRDWYKNSIRKEKLDNDDSNEQAEDEDEPPLPPQFPAEDDFETFICYKCVEANPWLKQYAGTPGFLPPVFKEGGLQKTVKKEDSPAPKSLHIQSDDQPSDNPNKRKAEDDAEDGDGSGPSSKRPREENQSQTTAPTSETKSEQEQQEQSQKPKHAFLPQTTPTATFSLFLKEDFRGHFCRCPTCYPNLAPHPQLREEEETYEPPLSEDGDGDRSTGTGSLLDRGEAALSNIDRVRAIEGAMVYNHLREKVKEFLKPFAESGTAVGADDIKAYFEKLRGDEQQIKDAAAAGKASADGGGNEDDKDESGDGVGRREQSGV

SEQ ID NO: 24283 - protein, 649 aa, Arabidopsis thaliana
MANKYVSSVLKSLLVLLHLVFLSKQHVDSASIVKSLPGFEGQLPFELETGYIGVGEEEEVQLFYYFIKSERNPKEDPLILWLTGGPGCSAISGLLFENGPLTMKLDVYNGTLPSLVSTTYSWTKTSSIIFLDQPVGTGFSYSRTQQFNKPSDSGEAKRIHEFLQKWLGKHQVFSSNPFYVAGDSYSGLVVPATVQEISKGNYECCNPPINLQGYVLGNPLTDYTTGSNSRIPFAHGMALISDELYESLKKTCKGEYTNVHPRNTQCLKFVEEFNKCTNRIFQQLILDPLCETETPDCYIYRYLLTTYWANDATVREALQINKESIGEWVRCYYSIPYNNDIKSSMPYHVNNSISGYRSLIYSGDHDFEVPYLGTQAWIRSLNYSIIDDWRPWMVKNQIAGYTRTYANKMTFATIKGGGHTAESKPEEASIMFQRSFVEAPLGQWLTKGSLMLLQQDVWGSSPNYCDLLVDLQINGGKCAGDLQRCTIMDLIRKKKTKRSFSSILDWIKGMANNYVSSVLKSLLLLLHLVFLILYIGANEEEEVQLFYYFIKSDRNPKEDPLILWLTGGPGCSAISGLLFENGPLAMKLDVYNGTLPFLVSTTYSWTKTSSIIFLDQPVGTDQPVSIPLERHAKVSKRDIPVGSEVKNLP

SEQ ID NO: 24284 - protein, 532 aa, Oryza sativa
MAFSRATAAAVVALVVLLPHLVAAVVLDVGGGVAARPCHSASVDGDAGCLSWRVMVEANNARGWRTVPAACVAYVRGYMTRGQYGRDLSSVMDQVAAYVDTVEADGDGLDAWILDIDDTCLSNLLYYEAKQFGAYDPSAFKTWASKGACPGIPAVLELFATLQAKGFKVFLLSGRDEETLATCTSENLESEGFLGYERLIMRSPEYRGQSSSVFKSAMRKRLVEEEGYRIRGNVGDQWSDLQGDYVGDRVFKIPNPMYYLYATEMVPLQSVYVIDEYSRSVLRMLRPFLACPRRVRLGESPTHALSAQLTGPVRCYRQIKNKPYPKSRYCRGVPDPKIRIFDVGQKKRSADDFPLCVHLVSWEKENVSSEALEAARIACNKYMAKHAGKDAFHLRVCAHPYHVLRINKMLSCAGADRLQTGMRGAFGKPTGTCARVRIGQVLLSVRCRDANAAHAQEALRRAKFKFPGRQRVIFSAKWGFTRFKRDEYLKLKSEGRIVPDGVNAKLLTRHGSVADRQPGRGVFPPSVAGSDA

SEQ ID NO: 24285 - protein, 341 aa, Pseudomonas syringae
MTTQQPVAVLGGGSFGTAIANLLAENGHQVRQWMRDPEQAEAIRVNRENPRYLKGIKVRPEVEPVTDLTAALEVSELIFVALPSSALRSVLSPHIERLSGKMLVSLTKGIEAQSFKLMSQILEEIVPQARIGVLSGPNLAREIAEHALTATVVASEDEDLCQQVQAALHGRTFRVYASNDRFGVELGGALKNVYAIIAGMAVALDMGENTKSMLITRALAEMTRFAVSQGANPMTFLGLAGVGDLIVTCSSPKSRNYQVGFALGQGLSLEEAVTRLGEVAEGVNTLKVLKVKAQEVQVYMPLVAGLHAILFEGRTLSQVIEALMRAEPKTDVDFISITGFN

SEQ ID NO: 24286 - protein, 77 aa, Haemophilus somnus
SSSVPALLAQDGLTLTDLVDDPTFTTKRPRKKIAPRKAKYQYTDQNGKVKTWTGQGRMPLSLQAELNTGKTLADFEI

SEQ ID NO: 24287 - protein, 739 aa, Burkholderia xenovorans
MSHAMPDRLLPGSPYPLGASWDGLGVNFAVFSANAQKIELCLFDPTGRKELRRFTLPECTDEVWHGYLPNAHPGTAYGFRAHGPYQPQHGHRFNPHKLLLDPYARKLVGQFRWSDALFGYRVHSNRADLSIDRRDSAPAMPKCVVIDEAFDWSHDKRPNVPWGETIVYETHVRGASMLRADLRQHERGTFAALASPEFIDHLLKLGVTAVELLPVHAFLNDRFLVERGLRNYWGYNSAAFFAPEPSYLSTHRLDEMRIAVRQLHAAGIEVILDVVYNHTCEGNEMGPTVSWRGLDNASYYRLIPGDERHHINDTGCGNTVNLPHPRVLQMVMDSLRYWSTAFNMDGFRFDLGVTLGREQHGFDPGSGFFDALRQDPILSQRKLISEPWDIGPGGYQLGNHPPGFGEWNDRFRDTVRRFWRGDAGLRPDLAARLTGSADLFNRRFRKPWASVNFVTSHDGFTLADVTAYEQKHNEANREDNNDGHNENCSRNWGVEGESDDPAILATRKRVARSLIATLLMALGTPMVLAGDESLRTQHGNNNAYCQDNELSWLDWARAESPDGRQMTAFVARVIALRKQHPLLRETRFLFGDREVLPGLFDVGWFDERGDPLTIEAWQDPEGRAFTLRRAGPGLNGETEVLLMMLNANEKTLRFTPPAPHLEWHVLLDTAEPENAPHRLAVPEIEVAAHGLVMLAAQPVGEADWQAGWKPGPQHGPRLLTALPPDPGAHAPTNDASPTT

SEQ ID NO: 24288 - protein, 1154 aa, Burkholderia xenovorans
MKRDDPAQTTSQAHSSAATGGVAKARTHRRGKPAALSDDPLWYKDAIIYQVHIKSFFDANNDGVGDFPGLIAKLDYIAELGVNAIWLLPFYPSPRRDDGYDIADYRNVHPDYGNLSDVKRFIQEAHARGIRVITELVINHTSDQHPWFQRARRAKPGSNHRNYYVWSNTDQKYLETRIIFIDSEPSNWTHDPVAGAYYWHRFYSHQPDLNFDNPAVLREVLQVMRFWLDMGIDGLRLDAVPYLVEREGTNNENLPETHAVLKKIRATIDAEYPNRMLLAEANQWPEDVKEYFGDEDECHMAFHFPLMPRIYMSIASEDRFPITDIMRQTPDLAETNQWAIFLRNHDELTLEMVTDSERDYLWNTYASDRRARLNLGIRRRLAPLMERDRRRIELINSLLLSMPGTPVIYYGDELGMGDNIHLGDRDGVRTPMQWSSDRNGGFSRADPEQLVLPPVMGSLYGFDAVNVEAQSRDPHSLLNWTRRMLATRRAKQTFGRGTIRFLKPENRKILAYLREMPGEPPILCVANLSRAPQAVELDLSEFDGSVPIEMTADSVFPPIGQLTYLLTFPPYGFLWFMLCPGGQRPTWAQAPSEPLPEFVTIVIREGQVGPTPENVRLLESEVLPSWLSRRRWFASKDQKLNAVRLAALTTIPNGGFAFTEIEADVGKHTERYVVPIAITWGGETTFPLFKQLALARVRRGRNVGHLTDAFALPIFAHGVMRKLRERAVVPTVQKSEIRFLPTERFAELEGLGERPEIRWLAAEQSNSSLIIADAAVLKLVRRLVSGIHPEAEISRYLTQLGYANTAPLYGEVVRVDPEGVPHTLCILQGYIDNQGDAWNWSLDYLRRSVDELAIAVDTETQSVPDRSNEAILVEGYSTLAGIIGRRLGELHVALASPTDDPAFAPEPASAEQVKAWVDGTQAMLASALDLLAPRIEQMSDTETRALAQSLIDRRAALVAAVDSLVSANAGALRIRIHGDFHLGQVLVAQGDAYLIDFEGEPARTLEQRRQKSSPLRDVAGLLRSLSYASAAAQSTTEAAPQQTADRKRALFDRFRAHAAEKFLNEYRAAAAEAATPLVAPEAEQALLDLFLIEKAAYEIRYEAANRPTWLSLPVRGLAALTSRLLGDTGAPGHDSSNQAPGAATPPNPAEGDYE

SEQ ID NO: 24289 - protein, 1129 aa, Pseudomonas syringae
MCAERRFRQPGNRRYYMKRMLINATQPEELRVALVDGQRLYDLDIESGAREQKKANIYKGRITRIEPSLEAAFVDFGSERHGFLPLKEISREYFKKAPEGRVNIKDVLSEGQEVIVQVEKEERGNKGAALTTFISLAGRYLVLMPNNPRAGGISRRIEGEERNELREALNGLIAPADMGLIVRTAGLGRSSEEMQWDLDYLLQLWTAIKEASLDRSAPFLIYQESNVIIRAIRDYLRQDIGEVLIDSVEAQEEALTFIRQVMPQYASKIKLYEDSVPLFNRFQIESQIETAFQRVVELPSGGSIVIDPTEALVSIDINSARATKGSDIEETALQTNLEAAEEIARQLRLRDIGGLIVIDFIDMTPAKNQRAVEEKVRESLEADRARVQIGRISRFGLLEMSRQRLRPSLGESSGIVCPRCNGTGIIRDVESLSLAILRLIEEEALKDRTAEVRAQVPIPVAAFLLNEKRNSITKIELRTRARIIILPNDQLETPHFEVQRLRDDSPEAHNSQTSYEIAAAAAEVEEIAPLAAATRTLVRQEAAVKTAPARANAPVPVEAVAPAPTPAPVAHEPSLFKGLVKSLVSLFATKEEPAAPVVVEKPAAEQRPARNEERRNGRQQSRGRNNRRDEERKPREERAPREERAERAPREERAPREERAPREERAPREERTVREPREAREDSAPREERPARTSRERKPREAREDRPVRELREPLDAAPAVNLAREERPERAPREERQPRAPREERQPRAEQAAAAVSEEEVLLNEEQINDENQEGNDGSEGDRPRRRSRGQRRRSNRRERQRDANGNVIEGSEENGSEENGSAENAEQGSSATDLSAGLGFTAAAAAGGVISATAEADAHQQAERANSTAVDAPAVEPAQQAPVAEANTAKAPEADAPAIEASTPETPAAAEPVVEVPAVEAPVADDAPVAKPAPEVEVQPAAIEAPAIAAQTELFEAPHAERVVPFTPTPEPALQAPVEAAAHEEVPATESSELPTPAATAAEPVVVKEEPAPYVAPKAVEEAAPAPAEQQPVIVETPVAPVSSTGRAPNDPREVRRRKREEEARRQQEAAAASTPVIAEAAPVAAEAESVQPSQAIEEKTEEAATEQPAVKPQHEAEKENEPKPLV

SEQ ID NO: 24290 - protein, 325 aa, Brassica rapa
MGRSPSSGDSRLKKGPWTPDEDEKLVKYVKKHGHSSWSALPKLAGLNRCGKSCRLRWTNYLRPDIKRGKSLRRREQTILNLHAVVGNKWSTIANNLPGRTDNEIKNFWNTHLKKKLIQMGVDPMTHRPRTDVLSSLSQLISLSSNLRGFVDQEQIMLKLQTEMAKLELFQYLLQPPSMYNNINPNDFDTRSLLSSIASTTNNNLNLGSYLQDFNSLPSLKTLNTNIGPSSVFPQNLDDNHFKFFNQRENLPVSPIWLSDPSSSNQSFLPSLDPSYSMADDLIRNQYVIEDVNSNLTSSSCQESGASVSAAWPDHLLDDSIFSHIP

SEQ ID NO: 24291 - protein, 359 aa, Synechococcus elongatus
MLARLGARLAIGVMVLGSPAIVSVSAQPAQAAVPNPELSRLLDAGSEAVKQRRWAEALGLYQQAQLIDGQDARIASAIGYLYTELGDFRQAALSFERAIAMDSQTAAFAFGAATAYANLGEYAAAERYYEQSLRLDNKRAEAYRGLATVQQRRGNLVGAINTYQRWQQLEPNNWQPRNEMGKIYLQQRQFTNALQVLQAATRLAPREADIYSNLAIAQLGLNNPRAALTSLQSSISLDPRNPRTLLKAGDIYLVLGDREAANRNYRRAFELNRNSAKTLDRYTQILLDQGDATLATVYLRDALRLEPRNPDFHLRLGLAYLARGLKPEARSSLNQAALLYQQRGDSNGQQQAAAALRQL

SEQ ID NO: 24292 - protein, 436 aa, Yarrowia lipolytica
MPPKSDWEKYKAPIDEDAAQEKIIPLSEGDIQVLKTYGTAPYGTALKNIEKDIKDMQARIQEKVGIKESDTGLAPHHLWDTQMDKQRMSEENPLQVARCTKIIETAEDPGKSKYVINVKQIAKFVVSLGERVSPTDIEEGMRVGVDRSKYQIQLPLPPRIDPSVTMMTVEEKPDVTYSDVGGSKEQLEKLREVVELPLLSPERFVNLGIDPPKGILLYGPPGTGKTLCARAVANRTDATFIRVIGSELVQKYVGEGARMVRELFEMARTKKACIIFFDEVDAIGGARFDDGAGGDNEVQRTMLELITQLDGFDPRGNIKVMFATNRPNTLDPALLRPGRIDRKVEFSLPDLEGRANIFRIHSKSMSVDRDIRWELISRLCPNSTGAELRSVCTEAGMFAIRARRKVATEKDFLAAVEKVIKGNLKFSSTSQYMQYN

SEQ ID NO: 24293 - protein, 190 aa, Arabidopsis thaliana
MFLQVTGTATPAMPAVVFLNSWRRPLSIPLRSVKTFKPLAFFDLKGGKGMSEFHEVELKVRDYELDQFGVVNNAVYANYCQHGRHEFLESIGINCDEVARSGEALAISELTMKFLSPLRSGDKFVVKARISGTSAARIYFDHFIFKLPNQEPILEAKGIAVWLDNKYRPVRIPSSIRSKFVHFLRQDDAV

SEQ ID NO: 24294 - protein, 269 aa, Archaeoglobus fulgidus
MVWFFEYYDGCGLAIKVKKKLYEAEGVQKVEIYETESMGKMLVIDGKIQLTELDEPFYHEMLVHVPMLSHENPRKVAVIGGGDGGALREVLKHNVERAVLVDIDRNVIDLSRKFLKIDHGAFEDERVEIAIMDGKEFLRDCEIFDVIIVDSTDPVGVSDTLFDREFFELARQKCDVISLQSQSPLIQKEYFRTLLVNSAPFERRDVYLSCVPTYPLALWSFIIGGEYDFSNLEERFERIKGKTVHYNPDVHRAAFALPEWLKKEVEACI

SEQ ID NO: 24295 - protein, 946 aa, Oryza sativa
  misc_feature (214)..(214): Xaa can be any naturally occurring amino acid
MVLWPWEKLLIPFLLGVSVVVLFLCSSSLFLLCETMQGIGRRYGRIKVYAVLGDDEAQHAKNNMRGALFHVDNPGPMAPIAKGNFLDVNQALEVVRFGIQYCDWRARQDLLTIMVVEVLKSLAIEFKSNGTLRKELAELQEELAKAHNQVHLSETRASSALDKLAQADNLVNDRLLQDGGSSASIDNYVSLASRTSSASRFVNKKTLRPSLDVXGPVQPYNPNLKNFWYPVVFSGDLKDDTMVPIDCFEEQWVIFRGKDGRPGCVQNTCAHRACPLPLGSVSEGRIRCPFHGWEYSTDGKCEKMPATKLLNVRIRSLPCFEQEGMVWIWPGDGTPESTIPSLQPPSGFTIHAEMVMELPVEHGLLLDNLLDIAHAPFAHTSTFAKGWSVPSLVKFLTPASGLQGYWDPYPIDMEFRPPCMVLNEDLRLVLGQQERMINGANVWNWPVSYDKLGIRYRLWRDAIERGANRLPFNNQSHSLGARSASILSRRSSRQGSRGSISLSREMGDSILSSMRHSLQSADQLLGDVDGSVLAQVIDSGDRGLAFENDVDEEEENNVEDHQAVPLPDDTSMRIHGRSSQGTSVVAPVSAMKPKDTNVNGPASSSIKVEPYKLSWMQDYASYLIHLAVFGFLGVFTRYGLQKLFGPSCLALTSDQSPLYLDLPSNMLGSFLMGWFGIIFKADIRHISDHLIVGITTGYMGSLTTFSGWNQKMVGLSSKGHWVYAVAGIVLGMFIVNESITVGAETGERLRGWILKCIIEKNSIGSKCGWEDWRVDTRTKHYALLGVMVILMSLIWILSIVLAIVKVHSLGHGAVLWLGCSVAPPGVWLRWYLARLNGGGIGIGKRRHLKWLPVGTLAANVLAAAIMAALAVTAKAENTRRLTTVLNGIQLGFLGCLSTVSTFAAEVYTMRRSGQIARAFVYAAATFVLSFVLGTLIYSVPVWVEHY

SEQ ID NO: 24296 - protein, 320 aa, Triticum aestivum
  misc_feature (149)..(149): Xaa can be any naturally occurring amino acid
  misc_feature (192)..(192): Xaa can be any naturally occurring amino acid
MGTLVGHVAPGAGFLLIGLWQLFNHIRLFVLRPGSYVAPLWFPARGVRHLELILIIAGTVASILMELVIGPAKHQPFDDDGTIPSDHLHNFEHASVSLALLAFAAVTIHMDRVRAPMRDAVSQLAAAAAFAQELLVFHLHSTDHMGVEXGQFHWLLQTVIVVTLATTLLGIPYPRSFVVSLVRSASLVLQGXVWLIVMGVMLWTPGLVPKGCFLNHEDGHHVVRCRTDEALHRAKALVNLQFSWYLTGTMVFVVVLYLQVSRLYPEEPQYLPLVKGGPAAGRFSIGDDREDDDDEEDLEAGESGYGHVVSGGTKPMEVER

SEQ ID NO: 24297 - protein, 388 aa, Nicotiana attenuata
MEVISTNTNGSTIFKNGAIPMNGYQNGTSKHQNGHQNGTSEHRNGHQNGISEHQNGHKNGTSEHQNGHQNGTSEQQNGTISHDNGNELQLLGSSNSIKPGWFSEFSALWPGEAFSLKVEKLLFQGKSDYQDVMLFESATYGKVLTLDGAIQHTENGGFPYTEMIVHLPLGSIPNPKKVLIIGGGIGFTLFEMLRYPSIEKIDIVEIDDVVVDVSRKFFPYLAANFNDPRVTLVLGDGAAFVKAAQAGYYDAIIVDSSDPIGPAKDLFERPFFEAVAKALRPGGVVCTQAESIWLHMHIIKQIIANCRQVFKGSVNYAWTTVPTYPTGVIGYMLCSTEGPEVDFKNPINPIDKETTQVKSKLAPLKFYNFDIHKAAFILPSFARSMIES

SEQ ID NO: 24298 - protein, 557 aa, Unknown
  marine gamma proteobacterium HTCC2207
MSENFADLFEESLLTVEMNPGAIITGVIIDIDKDWVTVHAGLKSEGVISIDQFYDEKGVLEVAIGDEVQVALEAVEDGFGATKLSREKARRAESWIELEAAHKADEVVIGVISGKVKGGFTVDVRGLRAFLPGSLVDVRPLREITHLENIELEFKVIKLDPKRNNVVVSRRAVMESANSVEREELLANLEEGASLKGVIKNLTDYGAFVDLGGIDGLLHITDMSWKRIKHPSEMINVGDEIDVKVLKFDRERNRVSLGMKQMGEDPWGDIKGRYPEGARAKAKITNLTDYGCFAELEDGVEGLVHVSEMDWTNKNVHPSKIVNLGDEVEVMVLDIDEERRRISLGIKQCHTNPWDDFATTMVKGDKISGKIKSITDFGIFIGLDGGIDGLVHLSDISWNETGEEAVRNFKKGEEVETVVLSIDAERERISLGIKQLSDDPFNNYVTENDKGAIVKGIVKEVDAKGATVDLGNDIEAYLKGSELSRDKVEDARHELQEGQEIEAKIINVDRKTRAISLSVKAKDVAEEKAVVKAHRKVEADTSSPATIGDLIKAQMDK

SEQ ID NO: 24299 - protein, 308 aa, Synechococcus elongatus
MQEAKVAAILGAGAWGTTLAQLLRSNGLEVRQWSRRSETSLAATLAEADLWIMAVSMAGLASVADQVAALQLGDRAIWVSATKGLADLGWRTPSQVLSDRFPLQPITVLSGPNLSKEISQGLPAATVIASRDRHAAAVVQQAFASDRFRVYTNRDPLGTELGGALKNVIAIAVGVCDGLCLGANARSALVTRALAEILRVGAYFGARTETFFGLSGLGDLLATCTSPLSRNYQVGFRLAHGESLAATLTAIAATAEGVSTARVLAQLASREGLELPIAACVAELLDNRISPTTAIERLMARDLKAELV

SEQ ID NO: 24300 - protein, 191 aa, Triticum aestivum
  misc_feature (158)..(159): Xaa can be any naturally occurring amino acid
  misc_feature (181)..(183): Xaa can be any naturally occurring amino acid
  misc_feature (188)..(190): Xaa can be any naturally occurring amino acid
METGIGSVDGPKGAPSGAVACPATFPASSPTFVGSPEATLGRHLAQRLVQVGVGDVFAVPGDFNLTLLDYLVAEPGLRLVGCCNELNAGYAADGYARAKGVGACAVTFTVGGLSVLNAIAGAYSENLPLICIVGGPNSNDYGTNRVLHHTIGLPDFSXXLRCFTPVTCYQAVVNNLDDAHXXXDKAIXXXL

SEQ ID NO: 24301 - protein, 415 aa, Xylella fastidiosa [sequence omitted]

SEQ ID NO: 24302 - protein, 171 aa, Lactobacillus plantarum
MTETAIFAGGCFWCMVKPFDQQPGIKSVISGYTGGTVANPTYEQVASHTTGHTEAVKITFDPDVISYADLVEIYWRQTDPTDASGQFQDRGDSYRPVIFVNSEAQRRTATASRDALAASGKFAEPIVTTIEDAKPFYPAEAEHQDFYRRNPFRYQIEEMGGREAFIKQHWQ

SEQ ID NO: 24303 - protein, 261 aa, Aegilops tauschii
MAEGGDELKLLGSWSSPFVTRAKLALAIKGLSYENVDEDVHNKSDLLLGSNPVHKKIPVLIHNGVPVCESMIIVQYIDEAFAGTGPPILPADPHERAVARFWAAYVDDKLVSQWTNSSRSKSRAGAEAMTEMLVAVEALEGALRECSKGKGFFGGDGVGLVDIALGSMHSWLMAIEAMSGAKVFDPARTPLLAAWMERFGSLDAARAVLPDVGRVVELAKIKHGQACRSFNFKQQVASRHGGMTYVCVCVNCEVEWPVFTF

SEQ ID NO: 24304 - protein, 292 aa, Desulfovibrio desulfuricans
MTAALYLLRSGVSVAWCEKLSPGGQMLMTEEIENYPGFPKGLKGYELVDLFAAHLDGWSFDKYTDEVAEIIPGNGVHRVRVGDEWVEGKTLIICSGARYKRLGLPNEERLTGKGISYCALCDGNFFRGQEVGVVGGGNSALEESLYLSKLVKKLHLIHRRDDFRAMKCYQDKVCIKPDIEVVRSTVVTEIHGENALEGVTLRNLKTGEEYFLKLDGLFVFIGFEPVTGFFPDQLGVDAQGFIITDVEMATNVPGIFAAGDVRSKLCRQVTTAVGDGATAANSAFLYLEQLDA

SEQ ID NO: 24305 - protein, 499 aa, Xanthomonas campestris
MSEEILVNVTPRETRVAVIENGMLQELHIERGWRRGVVGNIYKGKVQRVMPGMQAAFVEVGLERAAFLHANDVVRLAPAPASVVDTEETPIPPPPPASVPIVELLRDGQEIVVQVVKDPIGTKGARLTTQISIPSRYLVLLPQSKVVGVSARIEDEAERLRLKTIVSEVSAQHGGFGYIIRTNAEGQPAEALAEDIAYLSRVWNVVERRGREAPPCSIIYEDLSLPLRAVRDLIRRDVEKVKVDSNETFVQLQAFVAKYMPVLAERLELYTGDRPIFDLYGVEDEIGRALNKQVPLKSGGYLVIDQTEAMTTIDVNTGSFVGQRNLEETVFRTNLEAAQAVARQLRLRNLGGIIIIDFIDMDDAEHRRQVLRTLEKALARDHAKTTVYEFSPLGLVEMTRKRTVESLERQLSETCGQCGGRGTIKTAETVTYEIFREITRAVRQFDAARLLVIASSKVVARITEEESAAVAELEEFLGKSIRFQSDDQYLQEQFDVVLL

SEQ ID NO: 24306 - protein, 536 aa, Corynebacterium efficiens
MTTTVIVGGVAGGMSTAARLRRRDEEMEIIVLEASGYVSFANCGLPYHVSGVIPERDSLLLQTPESLAQRFNLDVRVNTRATSIDRENKTVTTENGEVISYDYLVLSPGAAPIMPPIPGIERALTLRTVEDVDTVIAALSEDVKTAAIIGGGFIGLEMAENLRHRGLEVTVIERAPQIMTPLDEEMALIVEKHLVDNGVTVITGGDTTDIAADHLTLSDGRTVPADVVIASIGVKPASDLAADAGLEVGERGGIKVDDQQRTSDPSIFALGDAAEKLDAVSGEDTLVPLAQTANRHGRLVADIITGRDVRRTPTLGTAIVGLFDMAAGSVGWNERRARAAGKNIRVIHTHPSDHAGYYPGAEMLHLKLVVDADTDAILGAQAVGGAGVDKRIDVIATAMRGGLTATDLADLELAYAPQFGSAKDPVNLLGYVNDNMVSGEKTVQWHELNDALSDGWTLVDVRTPGEFNAGTIPGAVNIPVDDIRDRIDELEGRKALAFCRVGQRGHVAASLLTHLGVESANLDGGFITWELSPANK

SEQ ID NO: 24307 - protein, 461 aa, Fusobacterium nucleatum
MITVRDIFRHGEDYLDKEIELFGWVRKIRDQKKFGFIELNDGSFFKGVQIVFEEGLENFDEVSRLSISSTIKVKGTLVKSQGSGQDLEVKADKIEIFQKADLEYPLQNKRHTFEYLRTKAHLRARTNTFSAVFRVRSVLAYAIHKFFQENNFVYVHTPIITGSDAEGAGEMFRVTTLDMNKLPKKENGEIDFTKDFFGKSTNLTVSGQLNVETFCAAFRNVYTFGPTFRAEYSNTARHASEFWMVEPEIAFGDLSANMELAEAMVKFVIKYVMDTCPEEMEFFNSFIEKGLFDKLNNVLNNDFGRVTYTEAIEILEKSGKKFEFPVKWGIDLQSEHERYLAEEYFKKPVFVTDYPKEIKAFYMKLNEDGKTVRAMDLLAPGIGEIIGGSQREDSYEILLNRMEELGLDKESYEFYLDLRRFGSFPHSGYGLGFERMMMYLTGMQNIRDVIPFPRTPNNAEF

SEQ ID NO: 24308 - protein, 258 aa, Oryza sativa
MPTVRFQKLQPAGFTSSPACLRGGKTGSGMLSVRPTISPTVVFANMYQRPDMITPGVDAQGQPIDPRQMQEHFEDFYEDIFEELSKFGEIENLNVCDNLADHMIGNVYVQFREEDQAAAAHTALQGRFYSGRPIIVDFSPVTDFREATCRQLGLGRDLRKKLFGHYRKPQRGRSRSPSPSPRHRRERHDRDDYRGRDDYSGGGGRRGGSSRHERHDDGGRRRHGGSPPRRARSPVRESSEERRAKIEQWNRERDEKQG

SEQ ID NO: 24309 - protein, 593 aa, Zea mays
MDTAIGSVPAASDAARHPAPSASAPRDATLGRHLARRLAEVGARDVFTVPGDFNLTLLDELEAEPGGVRLVGCCNELNAAYAADGYARARAGGVGACAVTFTVGGLSAINGVAGAFSENLPVVCIVGGPNSNDYGSNRILHHTIGLPDFTQELRCFQNVTCYQAVVNNLEDAHEQIDTAISTAIKESKPVYISISCNLPSIPHPTFSRHPVPFFLSPRLSNQMNLEAAVEAAAAFLNKAVKPVLVGGPKMRVSKAWEALAELADACGYPVAVMPSAKGLVPVHHSRFIGTYWGAVSTPFCAEIVESADAYLFAGPVFNDYSSVGYSLLLKKEKAIIVQPERVVVGHGPAFGCVLMKDFLHALATRLKKNTVAYENYRRIYVPPGEPLSSEPGEPLRVNVLFKHIQAMLSGDMAVIAETGDSWFNCQKLKLPEGCGYEFQMQYGSIGWSVGATLGYAQAAKDKRVIACIGDGSFQVTAQEVSTMLRWGQNSIIFLINNGGYTIEVEIHDGPYNVIKNWNYTGLVEAFHNGEGACYTAKVRTEEELTEALEAALGPKKDCLCFIEVIVHKDDTSKALLEWGSRVSAANSRPPNPQ

SEQ ID NO: 24310 - protein, 121 aa, Glycine max
MASSMLSSAAVGTSPAQATMVAPFTGLKTSAAFPATRKANNDITSIASNGGRVSCMKVCPPDGKKKFETLSYLPDLTEVELGKEVDYLLRNKCTPCAEFQLEHEFVYRDHRSKPGYYDARY

SEQ ID NO: 24311 - protein, 146 aa, Sinorhizobium meliloti
MRYLHTMVRVKDLDQALHFYCKLFGLQEIRRYENEKGRFTLVFLAAPGDVDRAKDEAAPCLELTYNWDPEEYAGGRNFGHLAYEVDDIYAFCKHLMDNGVTINRPPRDGHMAFVRSPDGISIEILQKGEHLAAQEPWASMANTGVW

SEQ ID NO: 24312 - protein, 352 aa, Glycine max
MVSSVSWVRGKCVGKGAFGVVNVAVSKRDNRVFAVKSVDCGRGLSGQVEALENEIGILKRVTSPHVVAYIGDDVTCEGTASFRNLHLEYMPGGTVADLDRADVDERLVRRYAWCLATALRDVHAQGFVHCDVKGRNVLLSGDGEMAKLADFGAAVEIESSPAMLLFPRGSPMWMAPEVVRRERQGPESDVWSLGCTVIEIAIGKPAWEDRGVDTLSRIGYSDELPEFPIQLSELGKDFLEKCLRREPSERWSCDQLLQHPYLLPYYALVESSPRCVLDRVDSELNSESDYNDRDHQEEVFSIFTNIEENSVIKNRISKLATESRVNWETHGWVVVREVESNGEPTTTGTEQK

SEQ ID NO: 24313 - protein, 269 aa, Medicago truncatula
MELLGVKYRQIGTWTREEASTRNLRYSVHTHNCRWLSEQSTSTTTRIRFISTTKRLLTAPLSSLLRFFSISTTLPNKPIIHKPLFTTLTPSLYFTLRRTDHTMASASNPQSIHDFTVKDAKGNDVNLGDYKGKVLIIVNVASQCGLTNSNYTELSQLYEKYKSKGLEILAFPCNQFGAQEPGSVEEIQNFVCTRFKAEFPVFDKVDVNGATAAPIYKYLKSSKGGLFGDGIKWNFSKFLVDKNGNVVDRYAPTTSPLSIEKDLLKLLDA

SEQ ID NO: 24314 - protein, 249 aa, Pseudomonas syringae
MTVYFIGAGPGDPELITVKGQRLIRTCPVIIYAGSLVPLAVLEGHQAVQVTNSAELHLEQIIELIKTAHAQGQDVARVHSGDPSLYGAIGEQIRHLRELGIPFEIIPGVTATAACAALLGVELTLPDVSQSVILTRYADKTSMPSGEELASLASHRATMAIHLGVNNLQRIVDELVPHYGADCPIAVVHRASWPDQDWAVGTLADIHDKVQAKGFRRTALILVGRVLADDTFSESSLYRAGHAHLFRPN

SEQ ID NO: 24315 - protein, 402 aa, Physcomitrella patens
MSTCAVAALSSPPTSFTSERVTSGITASVQPSAFLGTKISVCKGASVLSRAVSASISRQPLVAPIRAQGVAAPADTKAPTTTKKTDTKSTVIITGASSGLGLATAKVLADSGEWHVIMACRDFLKAERAARAVGMPKDSYTVIHCDLSSLNSVKQFVDNVRQSGRPLDVLVCNAAVYLPTAKEPRYTADGFELSVGTNHLGHFLLANMLMEDIQHKENDTNRRVIIVGSITGNTNTIAGNVPPKANLGDLRGLAGGLDGVRSSVMIVGGEFDGAKAYKDSKVCNMLTMQEMHRRFHEKTGVTFASLYPGCIATTGLFREHYQLFRTLFPPFQKYITKGYVSEEEAGKRLAQVVSDPTLNKSGVYWSWNNQSNSFENELSQEASDAEKAKKLWEISEKLVNLS

SEQ ID NO: 24316 - protein, 371 aa, Nicotiana attenuata
MEVISTNTNGSTIFKNGAIPMNGHQNGTSKHQNGTSEHPNGHQNGTSEHQNGHQNGTSEQQNGTISHDNGNKLVGNSNCIKPGWFSEFSALWPGEAFSLKVEKLLFQGKSDYQDVMLFESATYGKVLTLDGAIQHTENGGFPYTEMIVHLPLGSIPNPKKVLIIGGGIGFTLFEMLRYPSIEKIDIVEIDDVVVDVSRKFFPYLAANFNDPRVTLVLGDGAAFVKAAQAEYYDAIIVDSSDPIGPAKDLFERPFFEAVAKALRPGGVVCTQAESIWLHMHIIKQIIANCRQVFKGSVNYAWTTVPTYPTGVIGYMLCSTEGPEVDFKNPVNPIDKETTQVKPKLAPLKFYNSDIHKAAFILPSFARSMIES

SEQ ID NO: 24317 - protein, 264 aa, Pseudomonas syringae
MRVALYQCPPLPLDVSGNLTRLEQQAQAAAKQGAQVLICPEMFLSGYNIGAQAVGELAQAQDGPAATRIAAIAQASGIAILYGYPERAGDGQIYNAVQLIDSQGTRLCNYRKTHLFSELDKSMFVAGDDHYPVVELNGWRLGLLICYDVEFPENTRRLALAGAELILVPTANMLPYDFVCDVTVRARAFENHCYVVYANYCGSEGAIRYCGLSSICAPDGSRPLLAGQDEALLVGTLDKSLLAQARTANDYFVDRRPALYTSLT

SEQ ID NO: 24318 - protein, 460 aa, Nostoc punctiforme
MPTIAVNPYLDRNFAPIREEITTDKLPVIGELPLDLSGMFVRNGPNPQWTPIGQYHWFDGDGMLHGVQISNGVATYRNRYVQTSGWKKEREAGEALWSGLLEPPRMDNPHGPRKNTANTALVWHAGQMLALNESGKPHAIKLPELETIGEYSYNGKLISAFTAHPKVDPVTGEMIFFGYSVFTPPYLQYSVVSAQGELLRTVPIDLSIGVMMHDFAITENYTIFMDLPLTFSAERSQRGEPVMMFERDRPSRFGIVPRHGDNSNIRWFESPSCYVFHTLNAYEDGDEVVLIACRMSSTTVLISDDSQPDPEGNIPRLYRWRFNLSTGTVREEMLDDVTSEFPRINENLLGRQTRYGYTNKIANSPVPLFEGIIKYDFSSGKSQTHKFGQGRYGSEAVFAPRPGAIAEDDGWLVTFVHDENSNTSELVVVNAQDVTAEPVARVIIPQRVPYGFHGTWVAQE

SEQ ID NO: 24319 - protein, 260 aa, Oryza sativa
MVLGVVLPADKHEKVMTKAVTINSGLVTIGQGKDSDRTEFYGYIKEMFKLGFEVLHIYISTCSKLERYSFCYHLEEADLHQCHQILTCTINGSSLVMIWCCHLANNSANCYFLHFTIIRDGDKIEAESKMEVVLETEQGSAKVRICYDRDRQSPSWTRVVSRFQPILPDLALYLTCLIDMLDLPFMLRSYYNKVSRSSEQNLAFFAVYNMETTDIVSLYQQFVKKMMASLPYTCQSQSPSPYFDLSLFRYDKLISAIDRH

SEQ ID NO: 24320 - protein, 236 aa, Oryza nivara
MTRRYWNINLKEMIEAGVHFGHGIKKWNPKMAPYISAKRKGTHITNLARTTRFLSEACDLVFDAASQGKSFLIVGTKKRAADLVASAAIRARCHYVNKKWFSGMLTNWSITKTRLSQFRDLRAEEKMEKFHHLPKRDVAILKRKLSTLLRYLGGIKYMTRLPDIVIVLDQQKEYIALRECAILGIPTISLADTNCDPDLANISIPANDDTMTSIRLILNKLVFAICEGRSLYIRNH

SEQ ID NO: 24321 - protein, 107 aa, Desulfovibrio desulfuricans
MAVQVTDSNFEAEVIKSELPTLIDFWAPWCGPCRAMGPVIDELAAEFAGKVNIVKMNVDENPATPSKYGIRAIPTLILFKGGEVVEQITGAVSKSSIKDMITQKALG

SEQ ID NO: 24322 - protein, 485 aa, Pseudomonas aeruginosa
MSEEILINITPMESRVAVVENGVLQEVHVERTQRRGIVGNIYKGRVVRVLPGMQAAFVDIGLERAAFIHAAEISNREGSAVESISALVHEGQALVVQVTKDPIGTKGARLTTHLSIPSRYLVYMPRTSHVGISLRIEDEVERERLKKVVADCVAAEGIEGQGGFILRTAAEGAGEDEILADIRYLRRLWDQIAAQIQTVGAPSVIYEDLSLAIRTLRDLVNPRIEKIRIDSRENFQKITSFVEELMPEISDRLEHYPGERPIFDLYGVEDEIQKALERKVLLKSGGYLIVDPTEAMTTIDVNTGAFVGHRNLEETIFKTNLEAATAIARQLRLRNLGGIIIIDFIDMEDEEHRRQVLRTLEKQLERDHAKTNIIGITELGLVQMTRKRTRESLVQILCEPCPCCQGRGMLKTAETTCYEIFREILREARAYQADSYLVLANQKVVDRLLDEESGNVADLEAFIGRTIKFQVEAMYSQEQYDVVLL

SEQ ID NO: 24323 - protein, 418 aa, Triticum aestivum
RLASSASLLPSAASPSSSTRRAAVASGLRLRPSPSRFSQAARRVRGGAGAAGVVPRLRVVRCMAASEAAQLKSAREDIKEILKTTYCHPILVRLGWHDSGTYDKNIEEWPQRGGADGSLRFDPELSHGANAGLTNALKLIQPIKDKYPGITYADLFQLASATAIEEAGGPKLPMKYGRVDITAPEQCPPEGRLPDAGPRLPAEHLREEIVALSGAHTLGRSRPDRSGWGKPETKYTKDGPGEPGGQSWTAEWLKFDNSYFKDIKEQRDQELLVLPTDAALFDDPSFKVYAEKYAEDQEAFFKDYAEAHAKLSNLGAKFDPPEGFSLDADKGAVATEEKAVADPAPTSDTNGAGPQPEPFVAAKYSYKKRELSDTMKQKIRAEYEGLGGSPNKPMKSNYFLNIMIVIAGLAFLTSLVGN

SEQ ID NO: 24324 - protein, 147 aa, Yersinia enterocolitica
MSDIKYQDVYTYLSSGRNMKQFIKRCDYGLLIDLQNKLDIHISEWAAQQEKEQEAIQLRNEKRSELLALIVSEGFSPEELITVAAIKTRSRRRMKYQYRDGGAIKKWSGVGRVPRSIQERLNSGATLDDFLIAEEIKNENQNKTPHN

SEQ ID NO: 24325 - protein, 520 aa, Staphylococcus aureus
MAYFNQHQSMISKRYLTFFSKSKKKKPFSTGQLIGLILGPLLFLLTLLFFHPQDLPWKGVYVLAITLWIATWWITEAIPIAATSLLPIVLLPLGHILTPEQVSSEYGNDIIFLFLGGFILAIAMERWNLHTRVALTIINLIGASTSKILLGFMVATGFLSMFVSNTAAVMIMIPIGLAIIKEAHDLQEANTNQTSIQKFEKSLVLAIGYAGTIGGLGTLIGTPPLIILKGQYMQHFGHEISFAKWMIVGIPTVIVLLGITWLYLRYVAFRHDLKYLPGGQTLIKQKLDELGKMKYEEKVVQTIFVLASLLWITREFLLKKWEVTSSVADGTIAIFISILLFIIPAKNTEKHRRIIDWEVAKELPWGVLILFGGGLALAKGISESGLAKWLGEQLKSLNGVSPILIVIVITIFVLFLTEVTSNTATATMILPILATLSVAVGVHPLLLMAPAAMAANCAYMLPVGTPPNAIIFGSGKISIKQMASVGFWVNLISAIIIILVVYYIMPIVLGIDINQPLPLK

SEQ ID NO: 24326 - protein, 106 aa, Nicotiana tabacum
GIRGVTVSDVRGFGAQGGLTERQAGSEFSEDKFVAKVKMEIVVSKDQVEGVIAKIIEEARTGEIGDGKIFLIPISDVIRVRTGERGEKAERMVGGHADMSSALSTS

SEQ ID NO: 24327 - protein, 775 aa, Aspergillus oryzae
MTNTILDTYSSRRKPRRIGILTSGGDAPGMNGAIRAVVRTAIQNGCEAWAIHEGYEGLIQGGAMMHPLYWEDVRGFLSRGGTLIGSVRCDRFREREGRLQAARNMVLFGIDALVVCGGDGSLTGADLFRSEWPELLNELVSTGVLTVAQVAPHQNLNIVGLLGSIDNDFSGTDATIGCYSALTRICEAVDAVFDTASSHRRGFVVEVMGRHCGWLALMAAIATGADWLFIPERPPRDGWEDDMCSIITKNRNRGKRRTIVILAEGAQDSNLDRISSSAVKDVLSKRLGLDTRVTVLGHIQRGGSPCAYDRWLSTLQGIHAVKAVLSMTPESPSPVVIIQENRIRTSSLAETVALTKEANASMHAKEFEKAATLRDPEFMEYHSAYRHLNTSDHPKMVLPEDKRMRVAIIHVGAPAAGMNPATRAVVAYCLTRGHTPIAIHNGFPGLCRHHDDTPGSVREMHWLESGDWINDGGSDIGTNAGLPLDDIETTAQCFERYKFDALFVIGGFEAFTAVSQLRKARKQYLAFRIPLVLLPASMSNNVPGTEYSLGSDTSLNTLVYFCDVVRQSASSSGHSVFVVEAQGAEYQATAAALAAGAMTVYTPERGITLQSLSNDIEYLRQQFSKDHGANRSGKLIIRNDQTSTIYSTTEIANIIKHEAKNRFDAQGVVPGHFQQGGKVSPIDRIRAFRLAVKCMEHLETFAGQSPEEIMNDENSATVISIKQSRILLLPMGGPTGVEATDTDWKRQRPKTQNWLEIQEAVDSLSGRSSLYAIPN

SEQ ID NO: 24328 - protein, 563 aa, Rhodococcus rhodochrous
MTPPTDSGPTDSGPGARPDKDVNTVDTHTRDVDAVVIGAGISGLYAVYKLRARGMSVHGFESAAGVGGTWFHNRYPGARCDVESIDYSYSFDEDLQQEWTWSERFATQEEILAYLEHVADRHDLRSAFEFLTRVVSTVYDEDSGLWTVTTDTGRSVTARFCIMATGVLSATNRPDIPGRDSFTGESYHTGEWPHDPVDFAGKRVGVIGTGSSGIQSIPVIAQEAEQVVVFQRSPNYSIPAGNRPLSDDEQIAEVKATYPERRRLARLSGGGTPFTPYPKGAMEVDEAERRRVYDEWWQRGGYLFAKAFPDQTASIEANDSAREYVESKIRDMVNDPKIADQLIPTDHPIGTKRIVTDDGYFEAFNRDNVALVNLRRTPIAEITADGVRTSDSHYPLDMLIFATGFDAMTGALSRIDIRGRNGRTLREEWAAGPRTYLGLASHGFPNMFFMVGAGSPSVLANMVLMAEQQVDWISDCLDHLDEHNARSIEAGEQAVDEWGAECNEKAAGTLFPSANSWYMGANIPGKPRVFMPYIGGFANYGNICAEVAAAGYKGFDIVGVEGA

SEQ ID NO: 24329 - protein, 785 aa, Aspergillus oryzae
MATTHAPAEPPKRRRIGVLTSGGDAPGMNGAVRAVVRMAIYSGCEAYAVYEGYEGLVHGGDMIRQVHWEDVRGWLSRGGTLIGSARSMAFRERAGRLKAAKNMIVRGIDALVVCGGDGSLTGADLFRSEWPGLLEELVKTGELTEEQIVPYKVLNIVGLVGSIDNDMSGTDATIGCYSSLTRICDAVDDVFDTAYSHQRGFVIEVMGRHCGWLALMSAISTGADWLFIPEMPPREGWEDDMCDIITKNRQERGKRRTIVIVAEGAHDRQLNKITSSKIKDILTNRLDLDTRVTVLGHTQRGGAACAYDRTLSTLQGVEAVRAVLDMTPESPSPVITVRENKLLRTPLMDAVKATKEVADLIHERKFDEAMHLRDSEFKEYHFAYKNTATPDHPKLILPENKRMRIAIIHVGAPAGGMNQATRAAVAYCQTRGHTALAVHNGFPGLCRHHADTPVSSVREVSWEEQDTWVNEGGSDIGTNRSLPSEDFETTAKCFEKFKFDGLFVVGGFEAFTAVSQLRQAREKYPAFKIPMVVLPATISNNVPGTEYSLGSDTCLNTLIDFCDAIRQSASSSRRRVFVVETQGGKSGYVATTAGLAVGASAVYIPEEGIDIKMLARDIDFLRNNFAHDKGANRAGKIILRNETASSTYTTQVIADMIKEEAKGRFESRAAVPGHFQQGGKPSPMDRIRALRMAIRCMQHIETFSGKSADEIAADELSATVIGVKGSQVLFSQMGGPNGLEATETDWARRRPKDEFWLDLQSTVNILSGRASFGEGKTGWSCYENC

SEQ ID NO: 24330 - protein, 359 aa, Nicotiana tabacum
  misc_feature (181)..(181): Xaa can be any naturally occurring amino acid
  misc_feature (284)..(284): Xaa can be any naturally occurring amino acid
  misc_feature (287)..(287): Xaa can be any naturally occurring amino acid
  misc_feature (334)..(334): Xaa can be any naturally occurring amino acid
MAAITLLGLLLVASSIDIAGAQSIGVCYGMLGNNLPNHWEVIQLYKSRNIGRLRLYDPNHGALQALKGSNIEVMLGLPNSDVKHIASGMEHARWWVQKNVKDFWPDVKIKYIAVGNEISPVTGTSYLTSFLTPAMVNIYKAIGEAGLGNNIKVSTSVDMTLIGNSYPPSQGSFRNDARWFXDPIVGFLRDTRAPLLVNIYPYFSYSGNPGQISLPYSLFTAPNVVVQDGSRQYRNLFDAMLDSVYAALERSGGASVGIVVSESGWPSAGAFGATYDNAATYLRXLIXHAKEGSPRKPGPIETYIFAMFDENNKNPELEKHFGLFSPNKQPKYNXNFGVSGGVWDSSVETNATASLVSEM

SEQ ID NO: 24331 - protein, 176 aa, Musa acuminata
VYPEGQMSQHFATLQPGDVVEVKGPIEKLRYSPNMKKDIGMIAGGTGITPMLQVIKAILKNPDDNTQVSLIYANISPDDILLKGELDRLSTSYPNFKVFYTVDKPSKTWRGGTGYVSKDMVLKGLPSPGEETLILVCGPQVCSSIYLETRQKTGRKGELTGILKELGYSEETGLQS

SEQ ID NO: 24332 - protein, 987 aa, Unknown
  Synechococcus sp. RS9917
MTLLEQRCVASAEAIEQHRLSPFVERHLGPDPEQQQCMLQALGFASLEDFVRAVVPADILDAEPPLEAMPEGVAEAQALAELRKIAAANRLHRSLIGLGYHDTATPALIQRHVLENPAWYTAYTPYQAEIAQGRLEALLNFQTLISELTGLPIANASLLDESTACAEAMSLSLAVCKRPQACRFLVDAAVLPQTLAVLETRATPLGVSLEVGEPDAFRWDEDVFGVLLQLPGRNGHLWDPSALIAAAHAHGALATVAIDPLAQVLLAPVGSLGADIAVGSAQRFGVPMAGGGPHAAFFATREIYKRQVPGRIVGQSVDAEGRPALRLALQTREQHIRRDKATSNICTAQVLLAVMASFYAIHHGPDGLAVIARRLVGQRIALERGLVALGYPLPQAPRFDGFDVVTPLAPAVHQRASECGFNLRVLPDGAPVEQAEGFGLSLDELSDPGELQALLTVLAEVVDQPVPVLDPLAMAAETVDLEQALPALPLRRGRWLQQPVFQRYRSETELLRYIQRLVSRDLSLVHSMIPLGSCTMKLNAAAELVPVSWRSFSALHPFAPAEQCRGLQHLVHDLEGWLAALTGFAAVSLQPNAGSQGEYAGLLVIRAWHRSRQDAHRDVCLIPTSAHGTNPASAVMAGLRVVPVACDAQGNVDVEDLRAKAEQHSASLAALMVTYPSTHGVFETRIREICDLVHQHGGQVYLDGANLNAQVGLCRPGAYGADVCHLNLHKTFCIPHGGGGPGVGPIGVAAHLQPFLPGHPLVACGGDQGITPVSAAPWGSAGILPISWMYLRLMGPRGLRRASAVALLAANYLAHRLGDHYPVLFRGDAGLVAHECILDLRDLKRSAGLDVDDIAKRLMDYGFHAPTVSWPVAGTVMVEPTESESLPELDRFCDAMIAIRAEAAAIESGDVDRQNNPLKRAPHTLAAVTADHWDRPYSRREAAYPMADQREAKFWPHVARIDNAFGDRNLICTCPSVEELAAAQPAG

SEQ ID NO: 24333 - protein, 605 aa, Zea mays
MDTHIGSVNGAASNQTVGCPASAPGCPMASTPAQPAATLSAGEASLGRHLARRLVQVGVNDVFAVPGDFNLTLLDHLIAEPGLRLVGCCNELNAGYAADGYARARGVGACAVTFTVGGLSVLNAIAGAYSENLPVICIAGGPNSNDYGTNRILHHTIGLPDFSQELRCFQTVTCHQAVVNNLDDAHEQIDTAIATALRESKPVYLSISCNLPGLPHPTFSRDPVPFFLTPRSNKMGLEAAVEATVEFLNKAVKPVLVAGPKLRVAKAGKAFVDMVDASGYAYAVMPSAKGLVPETHPHFIGTYWGAVSTAFCAEIVESADAYLFAGPIFNDYSSVGYSFLLKKEKAIIVQPERVIVGNGPAFGCVMMKEFLSELAKRVNKNTTAYENYKRIFVPEGQPLESEPNEPLRVNVLFKHVQKMLTGDSAVIAETGDSWFNCQKLKLPEGCGYEFQMQYGSIGWSVGALLGYAQGANHKRVIAFIGDGSFQVTAQDVSTMLRCEQNSIIFLINNGGYTIEVEIHDGPYNVIKNWNYTGFVDAIHNGLGKCWTSKVKSEEELTAAIETALGEKKDCLCFIEVIAHKDDTSKELLEWGSRVSAANSRPPNPQ

SEQ ID NO: 24334 - protein, 1194 aa, Unknown
  Frankia sp. CcI3
MEPADTTEADAPSTTPVGEPGPVDKPATVESVTVVPARDDTARDDTVEATEPVPARRTRAARSRRAVREVTEVPVAPPAEDAPPAEDAPPAEDAPPTEDAPRDVVSPDVAAKPKRTRARRAISGLMTPAAAVPDPAGSGTAAAGPVAAGPGDATILGPAMPDVGATGSVGVPAGSTAAVASAPDTPGPTDTSGPTDTPGPTEPESAQPGTDEPGVAEPAARESTAESRSAEPSSAEPSSAEPEAGSTRSAATRARRATAPTWAGIHNEPVVETMIRPVLRRPAAMVTFQAPEPAVVEARWRRAAELGSAATAVDAVAGTAFPSAERRHAEAPAHPRDEADVATDPDTTDPDTMGDLTGGEEDSEFDDDPDGGGSASTRRRRRGRRGRGRARGDEDGVESGPEDGAAAADDTGREGVAQDTDGVDGSSVAGQGTGSVPAVASDEGAETTPGAAEESAERDGEDEDDRLGGARRRRRRRRRAGGDEPALADDPPNTVVHVRETRKDEDLVRGLSGSTRLEAKRQRRREGRDSGRRRPPIVTEAEFLARRESVERRMVVRHAGERTQIAVLEDGVLVEHFVTRASSSSYAGNVYLGRVQNVLASMEAAFVDIGKGRNAVLYAGEVNYDASGLDGRPRKIEQVLKSGQSVLVQVSKDPIGHKGARLTSQISLPGRYLVFVPDGQNAGISRKLPDTERARLKSILKKITPEDGGVIVRTAAEGASEAELERDIERLAAQWEDIERKAKKASAPSLLYGEPDLVVRVIRDIFNEDFTELVVQGSGEAITIEEYIDTVAPDLRSRIRRYTGTGDVFAEYRVDEQLAKALDRKVWLPSGGSLVIDRTEAMTVIDVNTGKFTGKGGNLEETVTKNNLEAAEEIVRQLRLRDIGGIIVIDFIDMVLESNRELVLRRLTECLGRDRTRHQVAEVTSLGLVQMTRKRVGQGLLEAYSEPCVHCNGRGVVIHLDGGSGAHAAAGVPSGTIVSGAGQPTPVAVPAPAEGSGSGRRVRSSSASAVSASAVSTSAVDGPAIIAAASAEPTSASESEASGGPGEPIGSAASSTPDAAENVAVTAGEGAIATAGVTAADTVPAPEPAHAADSAAGPAGGAAAAAAPGLGAAGSPAGSNGHVPAGGGSGAGGLEEALPPVYANSDDPDSLATADNALSTVGKPARGRRRRASRPVSKPAESLESVPSAEPPSA

SEQ ID NO: 24335 - protein, 291 aa, Zea mays
MASSVAAAASTFLGTRLADPAPQNGRIVARFGFGLGGKAKPAPKKVAKTSTSSDRPLWFPGAVAPDYLDGSLVGDYGFDPFGLGKPVEYLQFELDSLDQNLAKNEAGGIIGTRFESSEVKSTPLQPYSEVFGLQRFRECELIHGRWAMLATLGALSVEWLTGVTWQDAGKVELVDGSSYLGQPLPFSISTLIWIEVLVIGYIEFQRNAELDPEKRLYPGGSYFDPLGLAADPEKKERLQLAEIKHARLAMVAFLGFAVQAAATGKGPLNNWATHLSDPLHTTIFDTFGGSS

SEQ ID NO: 24336 - protein, 590 aa, Pseudomonas fluorescens
MCGLAGELRFDQQPADLAAIERITHHLAPRGPDAWGFHAQGPIALGHRRLKIMDLSDGSAQPMIDSQLGLSLAFNGAIYNFPELRAELEALGYAFYSGGDTEVLLKGYHAWGEALLPKLNGMFAFAIWERDAQRLFIARDRLGVKPLYLSRTGQRLRFASALPALLKGGDINPILDPVALNHYLNFHAVVPAPRTLLAGIEKLPPASWMRIEADGTTEQKTWWTLPYGPHADEKNLTLEDWRDRVLDSTREAVAIRQRAAVDVGVLLSGGVDSSMLVGLLREVGVENLSTFSIGFQDAGGERGDEFQYSDLIAKHYGTQHHQLRIDEKEIIEQLPAAFRAMSEPMVSHDCIAFYLLSREVAKHCKVVQSGQGADELFAGYHWYPQVDGAADPYAAYREAFFDRSYDDYAATVQPKWLTANDAAGDFVKEHFAQPGADAAVDKALRLDSTVMLVDDPVKRVDNMTMAWGLEARTPFLDYRLVELSARIPGQFKLPDGGKQVLKEAARRVIPSEVIDRKKGYFPVPGLKHLQGETLSWVRELLLDPSQDRGLFNPAMLDQLLTDPQGQLTPLRGSKLWQLAALNLWLSEQGI

SEQ ID NO: 24337 - protein, 700 aa, Arabidopsis thaliana
MGVVENRKILPEKKLGGWRAITFILGMFFLSISFLPIMFFSLKRIINLPFASNIHMITNSQSKLKIYTFHNYDSLNLNFIDNTYNDMPSLFSFLIGSCVQHHANIMTHEHTKLLLRVMQFNNLRKYIVAIEMESEIKLSDFKFIFSTVSSNETLEKLGSIGVSANFMLYLRNVFHMEPVEAFNVYYLWMGLTNFAPLLGALISDAYIGRFKTIAYASLFSILGLMTVTLTACLPQLHPPPCNNPHPDECDDPNKLQLGILFLGLGFLSIGSGGIRPCSIPFGVDQFDQRTEQGLKGVASFFNWYYLTLTMVLIFSHTVVVYLQTVSWVIGFSIPTSLMACAVVLFFVGMRFYVYVKPEGSVFSGIARVIVAARKKRDLKISLVDDGTEEYYEPPVKPGVLSKLPLTDQFKFLDKAAVILDGDLTSEGVPANKWRLCSIQEVEEVKCLIRVVPVWSAGIISIVAMTTQATFMVFQATKMDRHMGPHFEIPAASITVISYITIGIWVPIYEHLLVPFLWRMRKFRVTLLQRMGIGIVFAILSMFTAGFVEGVRRTRATEMTQMSVFWLALPLILMGLCESFNFIGLIEFFNSQFPEHMRSIANSLFPLSFAAANYLSSLLVTTVHKVSGTKDHPDWLNKDLDRGKLDYFYYLIAVLGVVNLVYFWYCAHRYQYKAGSQIEDFNEEKSLLDIEPNQRHDQSPS

SEQ ID NO: 24338 - protein, 402 aa, Physcomitrella patens
MATCVAAAVSSSLTALTSERATTGITASVQSSAFVGIKVSVCKDASALLKAVNAGTSRQPLVEPVRAQSVAAPASTNASTSSKKTDTKSTVIITGASSGLGLATAKVLADSGEWHVIMACRDFLKAERAAKSVGMPKENYTVMHCDLSSLNSVKQFVDNFRRSGRPLDVLVCNAAVYLPTAKEPRYTADGFELSVGTNHLGHFLLANLLMEDIQHKENNNSRRVIIVGSITGNTNTVAGNVPPKANLGDLRGLAGGLDGVRSSVMIDGGEFDGAKAYKDSKVCNMLTMQEMHRRFHEKTGVTFASLYPGCIATTGLFREHYSLFRTLFPPFQKYITKGYVSEEESGRRLAQVVSDPSMNKSGVYWSWNNQSGSFENELSQEASDAEKAKKLWEVSEKLVGLA

SEQ ID NO: 24339 - protein, 711 aa, Salmonella typhimurium
MLNPIVRKFQYGQHTVTLETGMMARQATAAVMVSMDDTAVFVTVVGQKKAKPGQDFFPLTVNYQERTYAAGRIPGSFFRREGRPSEGETLIARLIDRPVRPLFPEGFVNEVQVIATVVSVNPQVNPDIVAMIGASAALSLSGIPFNGPIGAARVGYINDQYVLNPTQDELKESKLDLVVAGTEAAVLMVESEAELLSEDTMLGAVVFGHEQQQVVIQAINDLVKEAGKPRWDWQPEAVNDALNARVAALAESRLSDAYRITDKQERYAQVDVIKSETIEQLIAEDETLDANELGEILHAIEKNVVRSRVLAGEPRIDGREKDMIRGLDVRTGVLPRTHGSALFTRGETQALVTATLGTARDAQVLDELMGERTDSFLFHYNFPPYSVGETGMVGSPKRREIGHGRLAKRGVLAVMPDMDKFPYTVRVVSEITESNGSSSMASVCGASLALMDAGVPIKAAVAGIAMGLVKEGDNYVVLSDILGDEDHLGDMDFKVAGSRDGISALQMDIKIEGITKEIMQVALNQAKGARLHILGVMEQAINAPRGDISEFAPRIHTIKISTDKIKDVIGKGGSVIRALTEETGTTIEIEDDGTVKIAATDGEKAKYAIRRIEEITAEIEVGRIYNGKVTRIVDFGAFVAIGGGKEGLVHISQIADKRVEKVTDYLQMGQEVPVKVLEVDRQGRVRLSIKEATEQSQPAAAPEAPASEQAE

SEQ ID NO: 24340 - protein, 499 aa, Burkholderia xenovorans
MTRVRRLNDTFDTGLVWLRRDLRNTDNAALYYALKHCERVWCVFVFDTTILQPLVDAWHARHPDTQPQDRRIEFILAALGELDEALRADGGGLIVLYGNPAELVPKLADELGVDAVFANHDYEPVAIERDGTVRERLAEAGRQWLTFKDQVIFERDEVLTGQSKPFTVFTPYRNAWLRQLSAFDLKPYPVETYAKRLAALPSKFDRQLPTLEQLGFAPSNLGELNLPAGMSGAQRLLDDFMTRIDSYADRRDFPAAKGPSYLSIHLRFGTVSIRTLARLAHEMSLQPDGQGSATWLSELIWRDFYFMILAHHPRLARGASFREEYDRLRWEQGLQADEAFAAWCNGRTGYPLVDAAMLQLNRTGYMHNRLRMVTASFLVKDLGVDWRLGERYFAEQLNDFDFSANNGGWQWAASTGCDAQPYFRIFNPVTQSEKFDAEGRFIKRYLPQLAKLPSKWIHAPWLAGAERLADCGVVLGKDYPAPIVDHAEARARTLARFGK

SEQ ID NO: 24341 - protein, 496 aa, Burkholderia xenovorans
MTPASSAPPAAPRIAIVGSGFAGIGMAIRLQRMGITSFTIYEAAGDIGGTWRDNTYPGAACDVPSHLYSFSFEPNPAWSRAFGGQAEIFAYLKHCARKYGVERYVRCNARVSAARFDEAHQLWRVELDVNGVRESIEADVVIAASGPLSRPAMPRIAGLDRFEGKLFHSARWDHAYPLDGKRVAVIGTGASAIQFVPQIQPRVAQLDLFQRTAPWVMPKPDKPVGARAQWLFRHLPFTQRFVRSAIYWQLESRAIAFVVNPKLMKMPMKFGLSYLERRVKDPALRARLTPNYRLGCKRVLLSSDYYPALSQPNVDVVTSGIREIVADGIVTEDGAHHRADAIICGTGFQVNDVGAPFDVTGLDGADLGALWLRDGPEAYLGVSIANFPNFFMIVGPNTGLGHNSMIYMIESQVQYIADCLRVLRRRKARTMNLRPDVQRDFNARLQEEMQRSVWVSGCHSWYQTRSGKVTALWPGFTFSFRKRTRRVRPHDYRFTP

SEQ ID NO: 24342 - protein, 165 aa, Sorghum bicolor
MGDGYETVRFFHCYKRGVDRVFIDHPLFLERVWGKTEEKIYGPDAGTDYKDNQLRFSLLCQAALEAPRILSLNNNPYFSGPYGEDVLFVCNDWHTFPLSCYLKSNYQSNGIYKDAKTAFCIHNISYQGRFAFSDFPELNLPERFKSSFDFIDGYEKPVEGRKIEL

SEQ ID NO: 24343 - protein, 476 aa, Trichodesmium erythraeum
MKKTLFLNPPSFDGFDGGAGARYQAKREITSFWYPTWLAQPAALVPGSKLVDAPAHYQTVEDVLKIAKDYELVIMHTSTPSLPNDIKCAEAIKNQNPETKIGFVGAHVAVLPEKTLKDHPIIDFVCRNEFDYTCKELSQGKPFAKIKGLSYYDTQGNIHHTPERELIHDWDAMPSVFPVYAEHLNIRNYLIGYLLNPYISLYTGRGCPAKCTFCLWPQTIGGHQYRAKSPEAVGREMAEAKAIWGSSVREYFFDDDTFTIDKKRAIAISEHLQRLKLTWSCNARGNLDYNTLKELKKNGLRLLLVGFESGNQKILDGVNKGIKLEVARKFMENCHKLGIKVHGAFILGLPNESQETIEETIRFACEVNPHTIQVSIASPYPGTELYTQAEKNGWFTGDSLVASSGIQMSALQYPHLSGSEIEDGVEQMYRRFYFRPKSIIPIVGEMLADPQMLVRRLREGKEFLSYLRERHQRALT

SEQ ID NO: 24344 - protein, 309 aa, Unknown
  Frankia sp. CcI3
MRIAEDITQLIGNTPLVRLRRVTDGVGAQVVAKLESFNPAHSVKDRLGVALIDAVERAGLIGPDTVILEPTSGNTGIALAMVCAARGYRCVLTMPETMSTERRMLLRALGAELVLTPGAEGMPGAIAKAEELAKNDERYLIPQQFENPANPAIHRATTAEEIWRDTDGQIDVLVAGVGTGGTITGVAQVIKERRPEARFVAVEPSASPVLSGGVKGPHPIQGIGAGFVPPVLETGLVDEIIQVDGEDAFDLARRLAQEEGLLVGISSGAAVSAALQVARRPENAGKLVVVVLPDFGERYLSTPLFAGLG

SEQ ID NO: 24345 - protein, 254 aa, Catharanthus roseus
MASQCCSSGSAKELHVLAVDDSLVDRKVIERLLKISCCKVTAVESGRRALQYLGLDGEKSTVGFDGLKVNLILTDYSMPGMTGYELLKKIKGSSTLKEIPVVIMSSENILTRIDRCLEEGAEEFLVKPVKLSDVKRIKDFVLKGGDEDGEKKTLGASKVGDENRPKETRKRNLDQSSSMSLSSTLVYSPLVLNKSSSSSLEEPHSPRTLLDNGIDQSAARDSSTLLRSSSAAVLASESEESHSKRSRLDSGAES

SEQ ID NO: 24346 - protein, 1031 aa, Oenococcus oeni
MTNKISFRDIINRKDWENPVITNWHRLPIHTEMNYSKSLNEDKQKTIQSLNGNWCFSYFSKVTDVPENWADRDLTKSNIMPVPSNWQLHGYDQPIYSNVAYPFPANPPYLPEENPTACYSRIFQLNDDWLQSGQNHVIFNGVGSAFHLWLNGQWIGYSEDSRLPAEFDLTKYLKSGKNRISVMVLRWSKGSYFEDQDMWRMSGIFRDVEVKHLPATYLQDYQLQTDLDDDLDQAKITIKAQVAGKNFSQNKLRTRLYFANEKVADQSSRLSTRAVDERGPLDNQFIAELNLKDPYLWSAELPYLYQLVIELLTDDGDILQVEKVNIGVRKVEIKNGLLKLNGKPLLIRGTNKHEFDSKKGYAVDEETMIQDIKAMKRNNFNAVRCSHYPNNRRWYELCDQYGLYVVDEANIETHGMVPMNRLTNDPVYLPLMSDRVTRMVTRDRNHPSIIIWSLGNESGYGRNHAALYNWIKQSDLSRPVQYEGGGANTAVTDIIVPMYARVEQDQIESVNSKWSLKKWIGLPGETRPLILCEYAHDMGNSLGGFGKYWQAFHKYPRLQGGFIWDWVDQGLLKKDVNGNDFYAYGGDFKDQPNDRQFCLDGLLFPDRTPKPAMHEVKYWQQYYLFNLQRNPLGQAESFTVTNDYSFKKSSNERLHYQIKSENEIVIDKYIDLVLNPGESLLIKLPKGRSSTSSLLDIDISLIKGNSWAPSGFKIASEQYVLAKKFGPTNAVTAATNKISLIENKDTNTFEIKLDDQKWQFAKNSGLLVSWSKSGNENLLDALRDQFTRAPLDNDIGVSKVDHIDPNAWYERWKSAGMYNLKTNLVSIDAEQLERAVLIRTEHSYSNHFQILFKSSKIYRIDANGTMTVTVDVSLAQGIPFPARIGLTCHLADQITDVSYTGLGPFENYPDRQSAAQYGHWQMELDDLYTPYIFPSENGSRGQVSQLEFGKQKISAYHEQNFSFNLSRFSKQQLARISHRNLLQAENGVWLSIDGYRMGVGGDDSWSPSVAPEYLLSNNYYHYAFQWCRKDI

SEQ ID NO: 24347 - protein, 294 aa, Nostoc punctiforme
MSSRALLLINRHARQGKKSLSEAIEYLKTLGFDLIEESTEDPKHLTEVISRYQHQVDLVIIGGGDGTLNAAVDALVDTQLPLGILPLGTANDLARTLEIPNSLSEACQIIANGNLRHIDLGWVNGKHFFNVASLGLSVKITQRLTKEVKRRWGIFAYAATALQVIWEARPFTAEIVINGESVHVKTVQIAVGNGRYYGGGMAVADDATIDDQRLDLYSLEIKHWWQIILLLPAMREGRHIHWESVRSLQGQEIKVYTRKPRPINTDGEITTYTPAHFRVIPKAIAVLAPPEIRS

SEQ ID NO: 24348 - protein, 207 aa, Candida glabrata
MSTSDESINELLEELEQEDERNDDFIDRYRAQRMQEMHDYFGSIQRKKEEGFGKVNYMDNESQVMKITTSTARVVIHFELETFKKCQYMDEKLEEIARNYLSTKFISISVENAPFLVEKLGIKVLPFVICYLNGNECERIIGFNKMGNDPNGFRTSKLEGVLMRAGILERRPQDADRISNLRIANKNTDLVSKLREKNDSDTSDLDI

SEQ ID NO: 24349 - protein, 154 aa, Catharanthus roseus
MADDDRKELHVLAVDDNIIDRKIVEKLLISSSCKVTTAENGIRALEYLGNLGVHSESQTPALHQDDAIPTAAGDLKVNLIITDYCKPEMTGYELLKKIKESSILKDIPVIVMSSENIPTRIHKCLEEGAQMFMLKPLKHSDVTRLRCQLMQCRS

SEQ ID NO: 24350 - protein, 473 aa, Unknown
  marine gamma proteobacterium HTCC2207
MDYLPLFHNLKGRNILVIGGGEIALRKVRLVQEASAIITIVAKDFCPDLLEMNARDKEHGCNGLNLITASYEHQHMLDLPNIVMVIAATNDRDLNRLVSEHAQNANILSNVVDDPKFSTVIFPSIVDRSPIQIAISSGGDAPVLVRLLRTRFEALLPAGMSKLGSLAGSFRERVKAKFSNGADRKAFWEEVFYGPIAEQAYANNLDEAERLLAHKLESTDEFKTGEVYLVGGGPGDPDLLTFKALRLMQQADIVLYDRLVSPEVLNLVRRDATRIYVGKTAGDHPVTQDNINQKLVDYALEGNRVVRLKGGDPFIFGRGGEEIETLAEHGIPFQVVPGITAASGCASYAGIPLTHRDHAQSVRFIAGHLRSGKMDLNWPELVQPNQTLVFYMGLNGMETICEQLKQHGLDAQTPAALIEKGTTDRQQVFIGDLNSLPEIVRSAGAKAPTLIIVGHVVSLHDKLAWFNVTETTQ

SEQ ID NO: 24351 - protein, 188 aa, Catharanthus roseus
MAAQVLDVGFHVLAVDDSLVDRKLIERLLKTSAYQVTVVDSGIKALEFLGLLDEEKEISGSNHQQVVEVNLIITDYSMPGMTGYDLLRKVKESSYLKDIPVVIMSSENIPSRINRCLEEGADDFFLKPVKQSDVNKLIPLVPNSFTGKPIKNHEQQQIFSSSTCKRKQHTDEYLSPTLRRKRYNQIFS

SEQ ID NO: 24352 - protein, 91 aa, Oryza sativa
  misc_feature (39)..(39): Xaa can be any naturally occurring amino acid
SANSLDIVGTVYCRFNCQKLKLPEGCGHEYQMHYGSIGXGGATLGYAQAGKDKRGIACIGNGSFHVTAQEVSTMLYWGQKSIIFSHQPMKG

SEQ ID NO: 24353 - protein, 137 aa, Unknown
  Azoarcus sp. BH72
MQKDASPTLPVVSPYTQIGGEEGVRALVRRFYALMDSLPEVSGIRRMHPDLAVAEDKLFCYLSGWLGGPNLYVERFGQPFLRARHLPFSIGVSERDQWMACMNQALDEHVADAALRERLREAFAGLANHMRNRAEPA

SEQ ID NO: 24354 - protein, 72 aa, Lactobacillus plantarum
MAKEDVIEIQGTIKETLPNAMFKVELENGAEILAHVSGKIRMHYIRILPGDKVTVEMSPYDLTKGRITYRFK

SEQ ID NO: 24355 - protein, 373 aa, Candida albicans
MTTSLTEQTAILAKYLELSQNGKILAEYVWIDAEGSTRSKCRTLSKKPTSVDDLPEWNYDGSSTGQAPGHDSDVYLRPVAFYPDPFRKGDNIIVLNECWNNDGTPNKFNHRHECAKLMKAHASEEVWFGLEQEYTLFDQYDYPYGWPKGGFPAPQGPFYCGVGTGKVVARDVIEAHYRACLYAGINISGINAEVMPSQWEFQVGPCEGIEMGDQLWIARYLLQRVAEEFAVKISFHPKPLKGDWNGAGCHTNVSTKSMRVPGGMKVIESALSKLAKRHKEHMLLYGADNDQRLTGRHETGHMDTFSSGVANRGASIRIPRQVAKEGYGYFEDRRPASNIDPYLVTGIMVETICGSIPDADMAKEFLRESSDDN

SEQ ID NO: 24356 - protein, 90 aa, Glycine max
  misc_feature (86)..(86): Xaa can be any naturally occurring amino acid
WFCLQEEYDTHDPKGPSSMVLQFLRKRSKIIEIVAARDIVFALAQSGVCAAFSRENNQRICFLNVSADEVIRSLFYNKNNDSLITXSVYA

SEQ ID NO: 24357 - protein, 360 aa, Moorella thermoacetica
MRKRLGILTGGGDCPGLNAVIRAATKTAMSHGYEMIGFLDGYTGVVEGRYIRLDPAAISGLLHRGGTILGTNNRSNPFYFPIQENGETIYRDMSDLAIERLKEMNIEVLLVVGGDGTLAGARDFKAKGARVIGIPKTIDNDLAATDQTFGFDTAVRTATDALDKLHTTAESHHRVMVLELMGRYAGWIALYSGLAGGADVILIPEIPWNIESVLAKIEARRAEGKPFSIVVVAEGVKSPEGELVVQRRVEGSVERVRLGGIGQLVGKLIEEKSGIETRVTVLGHIQRGGSPSSYDRVLATRFGVAAAELAVRGVHGVMVCLRGSDISHVPLEEAVGKPRTIPRDHQLLAAARAIGISFGE

SEQ ID NO: 24358 - protein, 471 aa, Synechococcus elongatus
MALQQFGLIGLAVMGENLALNIERNGFSLTVYNRTAEKTEAFMADRAQGKNIVPAYSLEDFVASLERPRRILVMVKAGGPVDAVVEQLKPLLDPGDLIIDGGNSLFTDTERRVKDLEALGLGFMGMGVSGGEEGALNGPSLMPGGTQAAYEAVEPIVRSIAAQVDDGPCVTYIGPGGSGHYVKMVHNGIEYGDMQLIAEAYDLLKSVAGLNASELHDVFAAWNKTPELDSFLIEITADIFTKVDDLGTGQPLVELILDAAGQKGTGRWTVETALEIGVAIPTIIAAVNARILSSIKAERQAASEILSGPITEPFSGDRQAFIDSVRDALYCSKICSYAQGMALLAKASQVYNYGLNLGELARIWKGGCIIRAGFLNKIKQAYDADPTLANLLLAPEFRQTILDRQLAWRRVIAIAAERGIPVPAFSASLDYFDSYRRDRLPQNLTQAQRDYFGAHTYERTDRSGSFHAQWF

SEQ ID NO: 24359 - protein, 567 aa, Aspergillus nidulans
MRQKRKLSNGADERYHPNAQQTADFGIVLRDFYPPEMSNARCEAYNSGILERPIESWQKAYTETSAQQNAMTANAAVVHWFKSDLRLHDNRALQMAYRVAREHKIPLIGLYILSPEDLTAHLSSPARVDLTLRTLEQLKRDLGELDVPLYMETQACRKDIPRRIINLCQEWGANHLFANLEYEVDELRREAKLIRLCAENGIRFETAHDMCVVPPGVLSSQQGRQYAVYSPWFRSWLAFLNENPEYLEVSEDPTSNPGDARRYFKELFECPVPATPENKRFDDVEKADRVRRAFPAGEHEGLRRLEEFLEKATAYDDERNFLSGETTSKLSPYFASGSLSARTAVAKAREANAGKISRGEAGYISWISEVAWRDFYKHVLVHWPFICMNKCFKFEFTNIDWSYNNTHFEAWAAGKTGYPLVDAAMRQLHATAWMHNRCRMVVSSFLCKDLLIDWRRGERYFMEHLIDGDFASNHGGWGFGSSTGVDPQPYFRIFNPIRQSERFDPDGEFIRRWVPELRGVEGNAIHAPYERGAGDIARANGYPEPIVDHARQRGVALRKYKDAARGA

SEQ ID NO: 24360 - protein, 371 aa, Unknown
  Frankia sp. CcI3
MRPFVTDARRVVVKVGSSSLTTAAGGLDVDRLEALVAAVLPRAGQQLVLVSSGAIAAGLAPLGLARRPRDLATQQAAASVGQSSLVHSYAAAFGRAGHQVGQVLLTATDVIRRTHYRNARTALDRLLELDVIPIINENDAVATQEIRVGDNDRLAAIVAHLVSADLLVLLSDVDGLYDANPRLGPATMVREVRSDTDLDGLTARGTGTAGVGVGGMATKIEAARMAASGGVTAIITSAANAAPVLRGEEVGTVFHPTGSRRASRLLWLAHATAPEGRLHLDSGAVAAVVRRRASLLPAGITGVEGDFAAGDPVDLVDPDGRSVARGLVAFDAAELPVMLGRSTADLAMELGPSYEREIVHRDDLVLLLPAR

SEQ ID NO: 24361 - protein, 618 aa, Unknown
  Synechococcus sp. RS9917
MPTASASLQDSSGREVIDLPLDRGLITLRGLSPQRLRFELEYSLERGSTANSFLYAAGTDADGQPCPAVLVHPPGVAYAEVFLPALARHLSTTTTPGEAQALQVVVGHVNPNRVALLHKLAEHYPGLELISSNPGAKLLEELWHQRKPLPPGEDDHRPPLPALPTLRVIRQETTLPLAEGRRLLLLPAPTPRWPGGLLAFEESDGLLMSDKFFAAHLCTSTWAEASRNDTEEERRHFYDCLMASMATQVDSVVERLEELDIRTIAPGHGPAIEASWRSLLSDYRRWGERQHKAALTVVLLFASAYGNTAAIADALARGIGRTGVRVSSLNCEFTPADDLVQAIRKADAILIGSPTLGGHAPTPIVSALGTVLAEGDRSKPVGVFGSFGWSGEALDLLESKLRDGGFSFGFEPIRIKFSPDAGTVRTLEETGTRFARQLQQERRKQQRRSAGGLSESRSDPAVLALGRVVGSLCVLTARKGTAESSQTGAMVASWVSQASFTPPGITVAVAKDRAVEALLHKGDRFALNVLAEGRESGPMKQFLRPFAPGDDRFAGLEVSRSPADQPLLPDALAWLEAEVKQRMECGDHWLIYAEVREGGVLDSDGQTAVHHRRSGANY

SEQ ID NO: 24362 - protein, 580 aa, Unknown
  Synechococcus sp. RS9917
MAAATGRLSLQCEVIGADTTTIRSLDWDRSRFDIEFGLRNGTTYNSFLVRGERTALIDSSHLKFKSTWLPLLQEQIDPKAIDHLIVSHTEPDHSGLIGHLIDLNPEIEIVASKVAIQFLENQVHRPFRSRAVKSGEELDLGTNPASGVQHRFEFLSAPNLHWPDTIFSFDHGTGILFTCDAFGLHYCSDEVFDLDPGAIAPDFRFYYDCLMGPNARSVLQALKRMDGLPEIHTIAVGHGPLLRHHLSHWISDYREWSSVRSQGESYAAVCYLSQYGFCDRLSQAIAHGIGKAEAQVQLVDLRATDAQELTALIGDAKAVVVPTWPAEADSDFQASIGTLLAALHPKQLVGVYDAFGGNDEPIDAVASQLRSQGQKEAFAPLRIRQLPDGEDYQRCEEAGTDLGQLLTRDKAIAAMKSLDGDLDKALGRLSGGLYVVTASQGENGSRRRSAMVASWVSQASFSPPGLTIAVAKDRAIETLMQVGDRFVLNVLRDDNHQPLLRHFLKRFPPGADRFAGINTLEGVAAGGPVLGDALAYLSCRVDQRMEGPDHWIIYAVVEQGNVADADARTAVHHRKVGNHY

SEQ ID NO: 24363 - protein, 419 aa, Unknown
  Frankia sp. CcI3
MSTSAEDVRGSAVRAKAAAALLAPRSRAEKDRALLAMADALIARSAEILAANAEDLAAARAAGTAGAMVDRLTLTPARLAGMADGLRQVAALEDPVGEVVRGRVLPNGMELRQIRVPLGVVGIIYEARPNVTVDAAGLCLKSGNAALLRGSASAVRSNTALVAVLRGAAVASGLPADAVQLVPGMDHDAVKHLMRLRGLVDVLIPRGGAGLIRAVVEESTVPVIETGVGNCHVYVDAEADLDQALAITVNAKTQRVSVCNSAETLLVHAGVAGEFLPRVLAALHDAGVTVHGDETVCAVDPRVLPATDDDWAAEYLSLDMAVAVVDSLDDAVAHIRRWGSGHTEAIVTRSLPASRRFITTCDSAAVMVNASTRFTDGERFGMGAEIGISTQKLHARGPMGLPELTSTTWVGVGDGHLVT

SEQ ID NO: 24364 - protein, 427 aa, Magnaporthe grisea
MPTSWITHSNNGINKITSAVKFDEAGKYQQAFENYMSGCDDLMLAVKKNDAPEETRVALRRKMAEYLLRAEKLDAHLKAEKSKKEATNGESNGAIASNGQDDDSKKLRNALEGVVLQERPNVKWEDVAGLEGAKESLKEAVLLPIKFPHFFSGKRKPWKGILLYGPPGTGKSFLAKAVATEAKSTFFSVSSSDLVSKWMGESERLVKQLFAMARENKPSIIFIDEVDALCGARGEGESEASRRIKTEMLVQMDGVGKDSEGVLVLGATNIPWQLDSAIRRRFQRRVHISLPDVAARTTMFKLAVGDTPSSLTNEDYRELAKMAEGYSGSDISNVVNDALMQPVRKMQMATHFKKIIHEGAEKYTACSPGDPAAVEMTLWQLEGKDLVEPLVTKKDMERAINSTRPTVSQDDLKKNAEWTEEFGSEGA

SEQ ID NO: 24365 - protein, 244 aa, Arabidopsis thaliana
  misc_feature (163)..(163): Xaa can be any naturally occurring amino acid
MMKQARSLLSRSLCDQSKSLFEASTLRGFASWSNSSTPGRGFPGKDAAKPSGRLFAPYSIFKGKAALSVEPVLPSFTEIDSGNLRIDRRGSLMMTFMPAIGERKYDWEKKQKFALSPTEVGSLISMGSKDSSEFFHDPSMKSSNAGQVRKSLSVKPHGQKRGXKIGSGYFISLSVNNSILKTNDYFVVPVTKAEFAVMKTAFSFALPHIMGWNRLTGHVNTEALPSRNVSHLKTEPQLELEWDK

SEQ ID NO: 24366 - protein, 950 aa, Methylobacterium extorquens
MTLIKEIDYGTPIRLNEQTVTLTIDGESVTVPAGTSVMAAAMHMGTKIPKLCATDSLEPFGSCRMCLVEIDGRRGAPASCTTPAENGMVVHTQTDKLHRLRKGVMELYISDHPFDCLTCAANGDCELQDTAGQVGLREVRYGYDGDNHVKPASDRYLPKDESNPYFTYDPSKCIVCNRCVRACEETQGTFALTIEGRGFDSRVAAGPTNFMQSECVSCGACVQALPTATLQEKTIHQYGQPDHSEVTTCAYCGVGCAFKAEMQGDKVVRMVPYKGGKANEGHSCVKGRFAYGYATHKDRITKPMIREKITDPWREVSWEEAINHAASEFKRIQATYGRDSVGGITSSRCTNEEAYLVQKLVRAAFGNNNVDTCARVCHSPTGYGLMSTLGTSAGTQDFKSVEESDVILVIGANPTDGHPVFGSRMKKRLREGARLIVADPRKIDLVKSPHIRADHHLPLKPGSNVAFINAFAHVIVTEGLIAEDYVRERCDLAEFESWARFIAEERNSPEAAQAITGVDPQEIRAAARLYATGGKAAIYYGLGVTEHSQGSTMVMGMANIAMATGNIGMVGAGVNPLRGQNNVQGSCDMGSFPHELPGYRHVSDDATRESFEAIWGAKLDNAPGLRITNMLDEAVGGSFKGMYIQGEDIAQSDPDTHHVTSGLKAMECIVIQDLFLNETAKYAHVFLPGASFLEKDGTFTNAERRISRVRKVMAPMGGYGDWEGTVLLANALGYKMEYTHPSEIMDEIAALTPSFAGVSYDKLEELGSIQWPCNEKAPLGTPMMHVDRFVRGKGRFMITEYVPTDERTTGKFPLILTTGRILSQYNVGAQTRRTENSRWHEEDVLEIHPFDAEMRGIVDGDLVALESRSGDIALKAKVTERMQPGIVYTTFHHAKTGANVITTDYSDWATNCPEYKVTAVQVRRTNRPSDWQAKFYEEDFSLTRIAEAAE

SEQ ID NO: 24367 - protein, 928 aa, Alteromonadales bacterium
MTKLGLRDSVLTLTLIPTVIIGLLLGGYFTVNRYIELDEILYQQGATISEPLAIALEQPLLDKNKVLLNRLISFTHNRHSPSIKSIAIFDTNNELLMTSNYHRSFDELINQASLASLKATKIESSKGIITFYTPIVGHSSPNTQWDASAFQTSLGTVILQLNKDKAVIGQQRALLISGIVIILSLVLAAIMAFKLSRMFMTPLNKLVLATDKLVEGKRSTGLTDTMLGEFDILREGLNTIADTMVMQKDEMQKNIDQATSDYRETLEQYETQNIQLTMAKKEAQDANRVKSDFLAKMSHELRTPLNGVMGFTRQLYKTPLNKHQKDYLDTIMLSANSLMTIISDILDFSKLEAGAMELESIQFQLRDAVNEVMTLLAPSAHEKQLELSIYINPQVPDDLTGDPTRFKQVLINLLSNAIKFTEQGSIKVDISYRLLDEESASVLVSVTDTGVGIPMDKQDSLFTPFGQADSSITRKFGGTGLGLIITKHIVEAMNGRISLNSAPGNGTCFTFNSVFRLPNHVFTNDLPSKSLIGKRILYLEPHEHTHHAVLSLLTEWQANVTPCFNEASFLSAVENTQTKFDICLIGHMASVDHMQLLKGYVKTVRDSTDYLYLMLNTVSHNMREAFIGSGADACLSKPLNHRKLCEVLAAPYRLDHPVHNIEQSEQKLLPLKVLVVDDNDANLKLICTLLDEQVEVIDTAHNGSQAYSLSKSHKYDVIFMDIQMPIMDGITACKLIQESSLNEDTPIIAVTAHALHSEKEQLLKDGFKGYLTKPIDEDTLKQIISDHSPQTPINREKSKNEIPQSPAPFESSRIDWPLALQRAGGKNELALEMLNMLLLSVPETLNLLTKAIDDEACEQVLSIVHKFHGACCYTGVPKLKSLAETIETSLKNECVLENIEPELFELQDELENLLVDAKMDSKNKKDVL

SEQ ID NO: 24368 - protein, 327 aa, Oryza sativa
  misc_feature (48)..(48): Xaa can be any naturally occurring amino acid
MDLVAGGVIRGLPSSWERIRSPRTPLFLSSWASRRRVAFAACSSCPLXVCRNASAVVPFAKKKRKGGSEEPPDEEEGDDFVDEMEGEDDDDEEEEDVDDDDLLDDNEDDDDDYSFEDDFESDDEQDLYVGDGGAGGGISLAGTWWDKEALALAEEVSNSFDGDLKIYAFKTAANLTIRVRIEKMSTRYGSPTIDDIEAFTIAYRAKIDDAESAGRIPQNISLEVSSPGVERVIRIPDDLERFKERAMYVRYTITSDGGEGMTPQEGDGVFRLISYDMDLCECTWGIADVKINRQQAGKGRPLSKKQREWRLQTPFESLKLVRVHSDC

SEQ ID NO: 24369 - protein, 103 aa, Fusobacterium nucleatum
MAIIKGTKENFEAEVLNANGVVVVDFGANWCGPCKSLVPILDEVVEEDPSKKIVKVDIDEQEELAAKYKIMSVPTLLVFRNGEIIDKSIGLIQKHEVKALFAK

SEQ ID NO: 24370 - protein, 643 aa, Catharanthus roseus
MNLGGGQLVKSMAVPSSSASWKSGGDGVSDQFPAGLRVLVVDDDPTCLRILEKMLKNCLYEVTKCNRAEIALKLLRDNRNGYDIVISDVHMPDMDGFKLLEQVGLEMDLPVIMMSADDSKNVVMKGVTHGACDYLIKPVRIEALKNIWQHVVRKGKHEWKEKDYEQSGSVEDGERQQKPNEDVDYSSSANEGNWKNSKKRKDDEEDQEEKDDSSTLKKPRVVWSVELHQQFVAAVNQLGIDKAVPKKILELMNVPGLTRENVASHLQKYRLYLRRVSGVSQHQNGLNNSFMGTPDATFGSMSSINGLDFQALAATGQIPAQSLASLQAAAIGRPTSKPTISMPVVDQRNLFSFEPHKLRFGEGQQQLNGSTKQISLLHGIPTNMEPKQLASLNQSAQTFGGINMQVSSQASQGNTLLMQMTQPMSRAPMLNENNASQISRLPSSVGQAILSNGIPSGVLGRNGIVDSVRGPVYTPVSQTSSLVDFSVSNSAELPGSTFPHASNSGISSLTPKGMMQEEVNSEGKGSRGFPSSYDIFSELQQHKTQDWGLQNVGSTFDGTQHSSIQGSLEGGRNNPPNFGQQFSSYMVDNSLRIKSERHPDANCQTNLFPQLFGQDDLMSALLKQEGIGSVESDFGFDGYALDL

SEQ ID NO: 24371 - protein, 831 aa, Rhodobacter sphaeroides
MTLTRRDLIKAQAAATAAAAAGLPVSALAQPVTGGAEALRIRWSKAPCRFCGTGCGVMVGTRDGQVVATHGDTQAEVNRGLNCVKGYFLSKIMYGEDRLTTPLLRMKDGVYHKEGEFAPVSWDEAFDVMAAQAKLVLKEKAPEAVGMFGSGQWTIWEGYAASKLMRAGFRSNNLDPNARHCMASAATAFMRTFGMDEPMGCYDDFEAADAFVLWGSNMAEMHPILWSRLTDRRLSHEHVRVAVLSTFTHRSSDLSDTPIIFRPGTDRAILNYIAHHIISTGRVNRDFVDRHTNFALGATDIGYGLRPEHQLQLAAKGAADAGAMTPTDFETFAALVSEYTLEKAAEISGVEPALLEELAELYADPDRKWMSLWTMGFNQHVRGVWANHMVYNLHLLTGKISEPGNSPFSLTGQPFACGTAREVGTFAHRLPADMVVTNPEHRAHAEEIWKLPAGLLPDWVGAHAVEQDRKLHDGEINFYWVQVNNNMQAAPNIDQETYPGYRNPENFIVVSDAYPTVTGRAADLVLPAAMWVEKEGAYGNAERRTHFWHQLVEAPGEARSDLWQLMEFSKRFTTDEVWPEEILSAAPAYRGKTLFEVLFANGSVDRFPASDVNPDHANHEAALFGFYPQKGLFEEYAAFGRGHGHDLAPFDTYHEVRGLHWPVVEGEETRWRYREGFDPYVKPGEGLRFYGKPDGRAVILGVPYEPPAESPDEEFGFWLVTGRVLEHWHSGSMTLRWPELYKAFPGAVCFMHPEDARSRGLNRGSEVRVISRRGEIRTRLETRGRNRMPRGVVFVPWFDASQLINKVTLDANDPISRQTDFKKCAVKIEAV

SEQ ID NO: 24372 - protein, 740 aa, Catharanthus roseus
MESCNCIEPQWPADELLMRYQYISDFFIALAYFSIPLELIYFVKKSAVFPYRWVLVQFGAFIVLCGATHLINLWTFTMHSRTVAVVMTTAKVLTAVVSCATALMLVHIIPDSLSVKTRELFLKNKAAELDREMGLIRTQEETGRHVRMLTHEIRSTLDRHTILKTTLAELSRTLALEECALWMPTRSGVELQLSYTLRLPNPVGFTVPILLPVINQVFSTNRAVKISPNSPVARLRPTGKYMPGEVVAVRVPLLHLSNFQINDWPELSTKRYALMVLMLPSDSARQRHVHELELVEVVADQVAVALSHAAILEESMRARDLLMDQNVALDLARREAETAIRARNDFLAVMNHEMRTPTHAIIALSSLLQETELTPEQRLMVETILKSSNLLATLINDVLDLSRLEDGSLQLDIATFNLHSLFREVLNLIKPITSVKRLFATLSLAPDIPEYAISDEKRLMQIMLNVVGNAVKFTKEGGISITAFVAKSDSLRDPRAPEFFPVPSDSHFYLRVQVKDSGSGINPQDIPQLFTKFAQSQTLATRNSGGGGLGLAICKRFVNLMEGQIWLESDGLGKGCTAIFMIKLGIPGRSSEAKLPLVSRVPADHVQTTFPGLKVLLMDDNGVSRMVTKGLLLQLGCEVTTVSAGDECLRVISNEHRVAFMDVSIPGKDIYEVAVRIHEKFSKRLDRPLIIALTANADRVMKENCLRVGMDGVVQKPISVDKMRSVLSELLDHGVLLEAQ

SEQ ID NO: 24373 - protein, 208 aa, Salmonella typhimurium
MTGKKRSASSSRWLQEHFSDKYVQQAQKKGLRSRAWFKLDEIQQSDKLFKPGMTVVDLGAAPGGWSQYVVTQIGGKGRIIACDLLPMDPIVGVDFLQGDFRDELVMKALLERVGDSKVQVVMSDMAPNMSGTPAVDIPRAMYLVELALEMCRDVLAPGGSFVVKVFQGEGFDEYLREIRSLFTKVKVRKPDSSRARSREVYIVATGRK

SEQ ID NO: 24374 - protein, 113 aa, Sorghum bicolor
LALEAKNSARGQVVLMGFVEGYRVGGGPLGEGLDKVYPGGAFDPLGLADDPDTAAELKVKELKNGRLAMFSMFGFFVQAIVTGKGPIENLFDHVADPVANNAWAYATNFVPGN

SEQ ID NO: 24375 - protein, 403 aa, Synechococcus elongatus
MLNASVAGGAATTTYGNRLFIYEVIGLRQAEGEPSDSSIRRSGSTFFKVPYSRMNQEMQRILRLGGKIVSIRPAEEAAANNGAAPLQAAAEEPAAAPTPAPAAKKHSAEDVPVNIYRPNKPFVGKVLSNEPLVQEGGIGVVQHLTFDISEGDLRYIEGQSIGIIPDGTDDKGKPHKLRLYSIASTRHGDHVDDKTVSLCVRQLQYQNEAGETINGVCSTFLCGLKPGDDVKITGPVGKEMLLPADTDANVIMMGTGTGIAPFRAYLWRMFKDNERAINSEYQFNGKAWLIFGIPTTANILYKEELEALQAQYPDNFRLTYAISREQKNEAGGRMYIQDRVAEHADEIWNLLKDEKTHVYICGLRGMEDGIDQAMTVAAAKEDVVWSDYQRTLKKAGRWHVETY

SEQ ID NO: 24376 - protein, 451 aa, Coprinopsis cinerea
MQVQQPIQQPSVPMNPPKAPLPTVPQALQSTYASRMKTGVSLLVQPIFQSTTLALLSGTGRPSRRGAVINYADPGSGDDLPDAGELDSDDSEFQANGGGRSSSRQQQGRGYASPAPQANARPENEELDQSYLGMQPPARFIKAKPIPIGLGGPTMHEYPPPDRVIAQAQKRASLVPIRVEFETETHRIRDCFAWNINEDLIKPETFARIFCNDLDLPLIPWAETVANQIKAQIEEYQDVASMEIGMDSALSPEEMAEPGDELPECRVIVSIDVQIANHHLLDHIEWDLLSPLTPEEFARGLCADLGLTGEAAPLIAHAVHEELVKHKRDAVEWGVIGGPTAHDGKEATPALGEPAQPEKRDRSGYSLLKDKTGLGLGWGRAPRDGRGPKVLRSVWRDWQEAEEFSTSFDLLTAEDLEKREIERERASRRLRRETSKFQSIATGRMRNLRYR

SEQ ID NO: 24377 - protein, 529 aa, Arabidopsis thaliana
LFYEMSPLNDLKINLNGQYTFFLNQNVISKYSGSLRKMIKQSKKKRNKKKRIITIEINDFPGGPDGFELVSRFCYHNGEILIDVSNVSTLYCCSVFLGMSEKFCFSNLFLQTEKFLEEVFYGSWSDIVSCLKNCEQVFFQADSYGLVDKLIFAALNKISQNSDDFSSSSLSSFASSLSPEMAKNTSESDGRYISRSVACGRSNEWWFEDMTNLSPKIILKLVMIIGAYKTNIKSLVLTRFLLHYLKTKLQTKSRTTTELMRNKLEYSDLADTAVRGVISAGTRTFSCRKLFWILRVLSSFSLSRESRIGLETLIGEMLEQATLDDLLISARGSRESGFYNVDLVIRLLKVFVKNREEEEEESRERNMKEIGKLIDKYLREISPDQNLKVPKFLGVAESLPDSARDCFDGVYRAIDIYLQSHPNLTPQDRTEICRCLNYKKLTMETCKQLARNPKIPPEIAIEALKSRCGNQEHTTSDVKVANKSFSCRYSEEKKKPVVLHLEITEKLAERLKTKGGYNLKVMDSFREGL

SEQ ID NO: 24378 - protein, 413 aa, Listeria monocytogenes
MVYLQKQDKEVFDAIKLELGRQRANIELIASENFVSEQVMEAMGSVLTNKYAEGYPGKRYYGGCEFVDIVEDLARDRAKKLFGAEYANVQPHSGAQANMAVYHTVLEPGDTVLGMNLSHGGHLTHGSPVNFSGVLYNFVEYGVREDTKEIDYDIVREAALKHKPKMIVAGASAYPRKIDFAKFREIADEVGAYLMVDMAHIAGLVAAGLHQNPVPYADFTTTTTHKTLRGPRGGMILAKAEWEQKLNKSIFPGIQGGPLMHVIAAKAVAFGEALQPEFTAYCEQIIRNSKKLAETLQANDVAVLTGGSDNHLLLIDLKPLGLTGKAAEKVLDEVGITVNKNTIPFETESPFVTSGIRVGVAAVTTRGFDEVAIEKVGVLISEVLHNLENEEVLADVKARVATLTNEYPLYPSL

SEQ ID NO: 24379 - protein, 357 aa, Buchnera aphidicola
MSEKVLFIDRDGTLISEPLDNFQVDSFDKLEFKQDVISSLITLKKFNYKFVMVTNQDGLGSKNFPYKSFIRPHEFMIDVFLSQGIKFEEVLICPHELKSGCQCRKPNLGMVQHWLLNDMLDKQHSCVIGDRKTDMILANNMGILGIRYGTKQGNSWSDIVFKLTKKHDRHAKVVRNTKETNVSIEVWLDKQGGSLINTGLNMFNHMLDQIAVHSCIRMKIISSGDICVDDHHTVEDVGIVLGKAILKALGNKLGINRFGFALPMDDSSSYCLLDISGRPFLKFRSYFKHQYIGDMSSEMVRHFFQSLAFAMKCTLHLRSMGINDHHRLESLFKVFGKTLKQAIVVSGKNLPSSKGLL

SEQ ID NO: 24380 - protein, 1209 aa, Oryza sativa
MWAEPEIAVNYGPRRGGCESSSSRPTLQPAPILRHPFAGGFSPPLPPPLHRRPRNLDTSPLAGDHHHGASRFASTSVVKQSSGGLLGWFLGGNSSQLPPLDVPLPGVIISPPLPDFVEPSKTKITTLPNGIKIASETSPIPAVSVGLYIDCGSVYETSSSSGTSHLLERMAFKSTTNRSHLRLVREVEAIGGNVFASASREQMSYTYDALKCYAPEMVEVLIDSVRNPAFLEWEVKEQLQKIKSEISEVSGDPHGLLMEALHSAGYSGALAKPLMASESAVNRLDVATLEEFVSENYTAPRMVLAASGIEHDELVSVAEPLLSDLPSVKRPEEPKSVYVGGDYHCQADSTSTHIALAFEVPGGWRQEKTAMIVTVLQVLMGGGGSFSTGGPGKGMHSWLYLRVLNNYGQIESFSAFSSIYNNSGLFGIHATTNPDFVSSAVDLAARELHEVATPGKVTQEQLDRAKEATKSSVLMDLESRIVASEDIGRQVLTYGERKPIEYFLKTVEEITLNDISSTAKKIISSPLTLASWGDVACCVFVQTHANIVLPVLHFNIESDVMASWLSHLPIHRCQLSFPAAQASYATPGIDSALLLDVDDMAGGDAGLNEGLKKQAKPRLRLPKPAAKRSESEFLRSRPLALLMASSHIILPPDDDDEEQRRLEEEEDEDPWARSGPPPAAPEHAMKAALPFSATCVRISRDSYPNLRALRNASSVSLADAAYVKISEGDFGYVLDDVPHLVDHLPDAPTYPNPLQDHPAYSTVKQYFVNEDDTVPQKVVVQKNSRRGVHFRRAGPRQKVYFESDEVKACIVTCGGLCPGLNTVIRELVCGLAHMYNVSKIYGIQNGYKGFYSSNYLTLTPKSVDDIHKRGGTVLGTSRGGHDTKKIVDNIQDRGINQVYIIGGDGTQKGAYEIFKEIRKRGLKVSVAGIPKTIDNDIAIIDKSFGFDTAVEEAQRAIDSAHVEACSAENGIGLVKLMGRYSGLIAIYATLEIRDVDCCLIPESPFYMDGEGGLLQYVERRLKENKHMVIVVAEGAGQDLIAKSLSTSEQQDASGNKLLLDIGLWLTHKIKDHFKSKKMEMTIKYIDPTYMIRAIPSNASDNVYCTLLAHSAIHGAMAGYSFTVGNVNGRHAYIPFYRVTSTRNKVKITDRMWARLLSSTNQPSFLSQKDIDEAKENDRTANKPPLPTGLSHHVANSFDQSASSSSNSQI

SEQ ID NO: 24381 - protein, 729 aa, Zea mays
  misc_feature (456)..(456): Xaa can be any naturally occurring amino acid
MDFGDDVMDGGSDAQRRKKRYHRHTPRQIQQLEAYVHPAGRQACADFPFPSVLIYWATGWMFKECPHPDENQRMQLSRELGLEPRQIKFWFQNRRTQMKAQHERQDNCFLRAENDKIRCENIAMQEALRNVICPTCGGPPVADDHFDEQKLRMENARLKEEASRFAFTIALAPGPASLDGPAILPRSSFTFTSGDLDRVSSLTSKYLGRPITQLPSAQALSMSSLDLSVGGLGGPSLDLDLLSGGSSGMAQAGEHLWVKTGGREVLNVDTYDSIFAKPDGSFRGPDVHVEGSRETGLVFMSAIGLVDMFMDSSKWTELFPAIVSKARTVDVLVNGMGGRSESLLLMYEELHVMSPVVPTREFCFLRYCRQIEHGLWAIADISVDQQQRDARFGAPPSRSCRLPSGCLIADMADGSSKVTWVEHMEIEDRVPIHLLYRDLVLSGAAFGAHRWLAALXRACERCACLATAGIMPHRDIAAAGDISHRELLAVTPEGKRSMMKLSQRMVNSFCASLSASQLHRWTTLSGPNDVGVRVMVHRSTDPGQPSGVVLSAATSIWLPVPCDRAFAFVRDEHTRSQWDVLSHGNPVQEVSRIPNGSHPGNCISLLRGLNASQNSMLILQESCTDASGSLVVYAPIDIPAANVVMSGEDPSAIPLLPSGFSILPDGRPGASSSRAGQAPSAGSLVTVAFQILVSSLPSAKLNAESVATVNSLISTTVEQIKAALNCASH

SEQ ID NO: 24382 - protein, 505 aa, Burkholderia vietnamiensis
MRRVRCSRAHCAHAVKRETGGGASPGLCCPRNGTPPARRGCSARAQAALDATAPAGGKAAARQAASPDTGRRKGRARCSPNARSARDGPERRLPAPTRFARSAHALPVCRPPCRSPFRFPCHAAVRAVARPMSRAWLVGAGPGDADLLTLKAVRAIAAADVLLVDDLVNPDVLRHARADARIEHVGKRGGHASTPQHEIVAAMLAHLRAGRSVARLKGGDPFVFGRGGEELLALGAAGFPVEVVNGITAGIAAPAALGIPVTHRGDAQGVIFVTGHGAGADEPDWRALAATRMTLVIYMGIRRLAAIVAALGRGRAARRHAVRGHRERDARRAAARARDARDGRRTRERGRHRLAGDRRDRARGRARRRSGGARRTRQRRMMRVALGVGFRAHVTAAQLDAAIRAALARHPGAEPAVVATLADKARARPLRTLCARRGWPLVGFDAAALKSCTAPPLSAPSPAALARFGVAGVAEPCARLAAPDGRLLGPKLIRDGVTVALAGPL

SEQ ID NO: 24383 - protein, 314 aa, Unknown
  marine gamma proteobacterium HTCC2207
MSETQHYPLIILGSGPAGWTAAVYAARANLSPVVITGIQQGGQLTTTTDVDNWPGDADGVQGPELMERMQKHAERFDTKTIFDHIDEVVLDERPFRLKGSSNYSCDSLIIATGASAQYLGLPSEEAFMGKGVSACATCDGFFYRNKPVAVLGGGNTAVEEALYLSNICSEVTLIHRRDELRAEKMLQDKLFEREKTGNITIEWSHNLDEVLGDDAGVTGVRIKSTADGATKDLSVDGVFIAIGHKPNTDIFADKLAMKDGYLTIAGGMAGNATETSVPGVFAAGDVADHVYRQAVTSAGSGCMAALDAERFLDQ

SEQ ID NO: 24384 - protein, 578 aa, Unknown
  marine gamma proteobacterium HTCC2207
MELLSGGEILIRALKDAGIKHVWGYPGGAALHIYDALYRQEDVQHLLVRHEQAAVHAADGYSRSTGEVGTALVTSGPGATNAITGIATAYMDSIPMVVISGQVPLTKIGQDAFQETDMVGVSRPIVKHSFLVTRAEDIAETIAKAYYIAATGRPGPVVVDIPKDVTDPSYQIPYEYPAEVKMRSYQPSDKGHRGQIRRAVRTLIGAKRPVLYTGGGVVLDNASEHLIALAKKLNYPVTNTLMGLGGYPGTDPQYLGMLGMHGTYEANTAMHHADVIFAIGARFDDRVTNDLEKFCPHATIIHIDVDPTSVSKNIEAHIPIVGTCNSVLPEMLSLIDQSETTPDSDAIAEWWQQIDQWRADKGIYTASRYEESSGNCIKPQDVIKMLYKVTEGKAIVTSDVGQHQMFAAQYYLFDKPRTWINSGGLGTMGFGLPAAMGCKLAFPDCDVACVSGEGSIQMNIQELSTCSQHNLPVKIINLNNAALGMVRQWQDMNYSSRYSESVYEESLPDFIRLAEAYGHVGMKITHIDQLEEKMREAFAMKDRVVFLDIDVDRSEHVYPMQMPGGSMRDLWLNKTERT

SEQ ID NO: 24385 - protein, 468 aa, Buchnera aphidicola
MAKQQIGVIGMAVMGRNLALNMERNQYTVSIFNRSLDITEKIILNNPNKNLFPFFSIKDFVLSLIVPRCIVLMIKSGVATDDTIKSLIPYLSKGDIIIDGGNTFYKDTIQRGYELLKIGVNLIGAGFSGGEKGALYGPSIMPGGRQEAYNYVSPILKKIASNSEGIPCVTYIGPDGSGHYVKMVHNGIEYGDMQLIAESYFILKTLLRLDNQSISKIFDIWNQGELNSYLIDITKDILIKKDDQNNYLIDCILDEGSSKGTGTWTTKSALDLNEPLTLITESVFFRYLSSLKSQRLLASKILCGPKDFFIVLNRDDFIEKIRQALYLGKIISYAQGFSQLNSASQKYNWNLKLGEISRIFQSGCIIRAKLLKNITQEYSSNNNFVNLLLTPYFREIANTYHSSLREIVSISVKYGIPIPALSSAISYFDSYRSAFLPSNLIQAQRDFFGAHTYKRIDKSGIFHTNWYS

SEQ ID NO: 24386 - protein, 70 aa, Haemophilus somnus
MSDLLKTLTSIRALRVATKEFTLQELESILEKFQLITNERRQLIEENQRKEQERLERIAKYKALLAQEGI

SEQ ID NO: 24387 - protein, 328 aa, Zea mays
  misc_feature (36)..(36): Xaa can be any naturally occurring amino acid
IPGSTHASGDAGGLYQVGQFPHWNVWSEWNGKANTXGYRDTVRQFIKGTDGFAGAFAECLCGSPQLYQAGGRKPWHSINFVCAHDGFTLADLVTYNSKYNLSNGEDNRDGENHNLSWNCGEEGEFASLSVRRLRKRQMRNFFVCLMVSQGVPMFYMGDEYGHTKGGNNNTYCHDHYVNYFRWDKKEEQSSDLYRFCRLMTEFRKECESLGLEDFPTSERLKWHGHQPGKPDWSEASRFVAFTMKDETKGEIYVAFNTSHLPVVVGLPERSGFRWEPVVDTGKEAPYDFLTDGLPDRAVTVYQFSHFLNSNLYPMLSYSSIILVLRPDV

SEQ ID NO: 24388 - protein, 74 aa, Ureaplasma parvum
MADTEKLKMLGKIVEVLQGGNFRVQLENGITIMSHVSGKMRVNKINILPGDTVDVELSPYDLTRGRITYRHRDN

SEQ ID NO: 24389 - protein, 231 aa, Thermus thermophilus
VKELLEAGVHFGHERKRWNPKFARYIYAERNGIHIIDLQKTMEELERTFRFIEDLAMRGGTILFVGTKKQAQDIVRMEAERAGMPYVNQRWLGGMLTNFKTIQRVHRLEELEALFASPEIEERPKKEQRLHELERLQKYLSGFRLLKRLPDAIFVVDPTKEAIAVREARKLFIPVIALADTDSDPDLVDYIIPGNDDAIRSIQLILSRAVDLIIQARGGVVEPSPSYALVQ

SEQ ID NO: 24390 - protein, 365 aa, Thermoplasma volcanium
MAKDYYKILGVDRNASEEDIKKAFRELAKKWHPDLHPDNKAEAEEKFKEISEAYEVLSDPEKRRIYDQTGSVDFGGGGSNFNWDNFTHFSDINDIFNEIFGGNFGSDFFSGFGNRQSTRNIDLDMYTNLDISLEEAYYGTEKRIKFRRNAICPDCKGTGAKNGKLITCPTCHGTGQQRVVRGQGFFRMVTVTTCNTCGGKGRIPEEKCPRCNGTGTIVVDEDITVKIPRGATDNLRLRVSGKGQSYDGRTGDLYVILRIKQDKNLQRINDDLLLDQKINFGQAALGADIPIQIFNEKYNLKIPEGTQPGDVIKIKGAGMPHLNGHGSGDLLVRINVEVPKRLTAKQRELIRELFDIKENHKSWFH

SEQ ID NO: 24391 - protein, 175 aa, Pseudomonas putida
MSLHDLQTLPGVTAQPDAATAQFVFNHTMLRVKDIEKSLDFYTRVLGFRLVDKRDFPEAAFSLYFLALVDPAQIPADDTARHQWMKSIPGVLELTHNHGTENDAEFAYHNGNTDPRGFGHICISVPDVRAACARFEALDVPFQKRLQDGRMNHLAFVKDPDGYWVEVIQPTELKG

SEQ ID NO: 24392 - protein, 342 aa, Lactococcus lactis
MMKARLIYNPTSGQEIIKKYIADILDKLEQYGYEASAYQTTAEQDSAKKEAARATEAGFDLIIAAGGDGTINEVVAGISPFEKRPQLAIVPTGTTNDFARALKIPRGKPLEAIEIIGKNQILNIDVGHAVIRETQDEQYFINIAAGGGLTELTYSVPSHLKTAFGYLAYLAKGAELLPRVRKAPVRVVHDEGVFEGDISMFFAALTNSVGGFEKIAPDAKLDDGLFTLILVKTDNLFELIALLAIVANGKHLDDVNLEYIKTSKIEIEALGGQKILLNLDGEYGGDAPVQFDNLKGHLDMYVNLDEINDDHYLGDEETLALEAVAQKFAEEANKIKDEDEED

SEQ ID NO: 24393 - protein, 697 aa, Desulfovibrio vulgaris
MCGIAGIVSPGAPVASATLAAMTESLAHRGPDACGLFIRPSGAGSPHVGLGHRRLSILDLSDAGAQPMQSEDGAFTLVFNGEIYNYPDLRRDLEAAGHIFRSTSDTEAILRGYMAWGEGVVARLKGMFAFALWDERKRSLLLARDRFGKKPLHYAVTRQGTLLFASEPKALLAHPEFRPEPDAASLLHFLRYDYVPAPRSIYAGAAKLPPSHLMVWRDGRLEVRRYASLAFSGATGDRGVPLREAEAAVDALLDAAVQRRLASDVPLGVFLSGGLDSSTVLAYMTRHIPAHDIRTFAIGFDEASYDESAHAEAMARHAGSHHTMMRLPAARMLDLLDMVWTTQDEPMADASIIPTLLLCRFAREHITVALGGDGGDELFAGYDPVLADLPARCLDWLPPAALRLLQGIALRLPTGDANMSLGFKVQRFLSGLGAREVAARHQTWLGAFDDEGARAMLHPDLRAATRDVSPLDALDMLREECRDASRFDAMLHFYQRFYMCGSILTKVDSASMAVSLEVRSPFLDQDLADYVNRLPREHKLRGLTRKVLLRRLMRSRMPDALLKRPKKGFGLPLARWFRHELRPLVTAMLDPGRVAQGGLLDPVTVERMVRDHLSGRRDHRKEIWSALCVEAWRERYLHHSRATASDTIEFGTTPHGDGHLITAQAVPARSSAAINDSTNDSPSWAASPSRHRCNDSI

SEQ ID NO: 24394 - protein, 160 aa, Physcomitrella patens
MSSRGGSDDEDEGTTRKKLRLSKEQSALLEESFKEHSTLNPKQKNALAKQLGLRPRQVEVWFQNRRARTKLKQTEVDCELLKRCYESLKEENRRLQKELLELRAIKVAPPCVISHDYYMPLPAATLTMCPSCERVATVDNRSLTFAKPGFSHLSQSSAAC

SEQ ID NO: 24395 - protein, 481 aa, Desulfovibrio vulgaris
MRFMFLHPRLSLEGDPLGLMQLSASLKQRGHIVGLTLLTEDYIEAIRSFQPDMLGVSLMSSDAVMMHQVLNKVRMVFPDLFIIVGGPHPTFDPSCLMVLPVNAICVGEGDEALVEALEQYGREGHVEGIRNVGTVTTPVTLRPLVSDLDDLPFIDRDIVYAKNHIVRDFPLKTFAASRGCHFKCTYCFNHAYNAMYAGLGHVVRRRSVDHLIAEMRDVIARYPTSYIKISDDSFTYRVDSWLEEFAEKYPRLIGLPFYCLLRADVVTRDMVRLLREAGCRSVCMSIEAGAETVRRDVLNRRVSNEKIIESFDLFNEAGIAIYTNSMLAMPRATLADDIATLDLNIRCRPTLGHFTIMAPFPGTRIHDMCEKDGILPERCGGDGDIPTSTGELSKLTTYTDEEKNIQKNIVLLGPLVIRFPVLRGVFLRCLAKLPSNNILFKCIYTVTKNLLFKRIVPVRMSPLLMLRIAIAQVKAARTQVG

SEQ ID NO: 24396 - protein, 341 aa, Amycolatopsis mediterranei
MRVGVLTGGGDCPGLNAVIRAVVRKGIEVHGWDFVGFRNGWNGPLTGDSRPLGLNDVEDILTRGGTILRSSRTNPYKVEGGVDKIKQVLADQGVDALIAIGGEDTLGVAKRLTDDGIGVVGVPKTIDNDLGATDYTFGFDTAVSIATEAIDRLHTTAESHHRALVVEVMGRHAGWIALHSGLAGGASVILVPERHFNVDQVVSWVERRFEKEFAPIIVVAEGALPEGGEEKLLTGEKDAFGHVRLGGIGTWLADEIAHRTGKESRAVVLGHVQRGGTPTAYDRVLATRFGLNAVDAVADGDFGVMVALKGTDIVRVKLSEATAELKTVPVERYQEAEVFFG

SEQ ID NO: 24397 - protein, 326 aa, Brucella melitensis
MSTKIAVLGGGAWGTALAAMAAKGGHESWLYARDAETVVAINKDRRNPRYLGDITLADGIRASTDAAAVVTGADAVLAVIPAQAMRNGLSELGTLIPQASPIVLCAKGIEQNTGRLMSEVVAEILPDHRIAALSGPSFASDVARGLPTAVTVACEDANTADRLAALLSGPAFRCYSTTDLKGVETGGALKNVLAIAAGAAIGRGYGASAQAALVTRGFAELRRIGQAMSARPETIMGLSGLGDLMLTCSSSQSRNYSYGLALGRGEDLTSRPLAEGVATAPIAAELCRKHNISAPIIDAVGALLDGKITIDEAVTALLNRPLKTED

SEQ ID NO: 24398 - protein, 467 aa, Escherichia coli
MQTTQQNAPLKRTMKTRHLIMLSLGGVIGTGLFFNTGYIISTTGAAGTLLAYLIGALVVWLVMQCLGELSVAMPETGAFHVYAARYLGPATGYTVAWLYWLTWTVALGSSFTAAGFCMQYWFPQVPVWVWCVVFCAIIFGLNVISTRFFAEGEFWFSLVKVVTIIAFIILGGAAIFGFIPMQDGSPAPGLSNITAEGWFPHGGLPILMTMVAVNFAFSGTELIGIAAGETENPRKVIPVAIRTTIARLIIFFIGTVFVLAALIPMQQVGVEKSPFVLVFEKVGIPYAADIFNFVILTAILSAANSGLYASGRMLWSLSNERTLPACFARVTKNGVPLTALSVSMLGGVLALFSSVVAPDTVFVALSAISGFAVVAVWLSICASHFVFRRRHLQQGKALSELHYRAPWYPLVPVLGFVLCLVACVGLAFDPAQRIALWCGLPFVALCYGAYFLTQPRNAKQEPEHVAE

SEQ ID NO: 24399 - protein, 303 aa, Unknown
  Nostoc sp. PCC 7119
TQAKAKHADVPVNLYRPNAPFIGKVISNEPLVKEGGIGIVQHIKFDLTGGNLKYIEGQSIGIIPPGVDKNGKPEKLRLYSIASTRHGDDVDDKTISLCVRQLEYKHPESGETVYGVCSTYLTHIEPGSEVKITGPVGKEMLLPDDPEANVIMLATGTGIAPMRTYLWRMFKDAERAANPEYQFKGFSWLVFGVPTTPNILYKEELEEIQQKYPDNFRLTYAISREQKNPQGGRMYIQDRVAEHADELWQLIKNQKTHTYICGLRGMEEGIDAALSAAAAKEGVTWSDYQKDLKKAGRWHVETY

SEQ ID NO: 24400 - protein, 346 aa, Dictyoglomus thermophilum
MSKMRIGVLTGGGDCPGLNPAIRGIVMRALDYGDEVIGLKYGWAGLLKADTMPLSLEMVEDILEIGGTILGSSRTNPFKKEEDVQKCVENFKKLNLDALIAIGGEDTLGVASKFSKLGLPMIGVPKTIDKDLEETDYTLGFDTAVEVVVDAIKRLRDTARSHARVIVVEIMGRHAGWLALYGGLAGGADYILIPEVEPNLEDLYNHIRKLYARGRNHAVVAIAEGVQLPGFTYQKGQEGMVDAFGHIRLGGVGNVLAEEIQKNLGIETRAVILSHLQRGGSPSIRDRIMGLLLGKKAVDLVHEGKSGLFVAVKGNELVPVDITLIEGKTKNVDPAFYESVKTFFNK

SEQ ID NO: 24401 - protein, 568 aa, Rickettsia conorii
MSIKLKQRFVPQLAAMNHEFAEDFSKMLETVDTSHIKEKTVVKGQVIEIKNDIIIVDVGLKNEGRIPKSEFLALPEVGDVVEVFIEKIEGRNGRTILSREKAVKEELWGQLEIMCSKGEFVDGTIFGRVKGGFTVDLSGVVAFLPGSQVDVRPIKDPTSIMNIKQPFKILSMDKKLGNIVVSRRAILEESRSEARDEMLSKIKEGMVLEGTVKNITDYGAFIDLGSVDGLLHLTDISWGRVNHPSEVLDFNQKVKVMVIKFDEKNKRISLGIKQLDSNPWEAIKEEFPVGKQMTGKVTNFADYGVFIELKDGLEGLVHSSEISWLKSNQNPRKTLTIGQEVEFVVLEVDTEKHRVSLSIKQCQENPLTKFAENNPVGTIIKAPIRNITDFGIFVALGNNMDGMIHEGDISWEDKGTDLLKSYKKGDEIECKVLAINIEKEQVSLGIKQLSPNPYQEISDEYKKGTIVKALITEVKDEGLEVLLNDKVAGFIKRTELSDEKDEQKPEMFQIDKEIEAKVVSIEKSTGRILLSVKAHKIAERQKALKEYGSSDNTTNMGDILANALEDKK

SEQ ID NO: 24402 - protein, 159 aa, Lactococcus lactis
MAEGYVMDLRKKIGHVPMVIACASLIIYDENRGILLQKRADNGKWCYHGGSVEPNEKVEEAAKRELYEEVGLKAGKINLYTVASGTEQHFFYPNGDEVHIVDTVFTCNDFSGEILLEESEVLDCQWFAFDNLPEDILIATRGPILSFCKEMLQKKADRK

SEQ ID NO: 24403 - protein, 615 aa, Aspergillus nidulans
MASVDPAHSRLHTVEEHVIIHDDPIDDDEEHEEDDAEMDPSVRACLEHQRKVDEFLSPLCLDEAVLYKLARRLSSVYRKLALESDQQFLPTPVSKLPSGLETGRYLAIDVGGSNLRVAFIELLGDTADPDMARTSASERPLKKAQTQRVKRTLEKAWPIQEHLKMDKAEDLFAWIGDCIAEVVAESLSSDATKNAVPEELEMGITFSFPMMQESLAEATLMPMGKGFAITSDLNLRNILLSGYERHTRRPDDEDQPSTKRRKLYALPKLKISAITNDAVATLASLAYAVKSLPNSRVAMGLIVGTGCNATIPMKLSALHEDKVKHVRRSDPETSGIIVNTEWTIYGVLPPLKELNIITKWDAELDASSARPGFQPFEYMTGGRYIGELIRLIFTDYLINVAGVSTAALPATLTQGYALTTSYISDKVARARSDEELTDELAHSLPPPSDTWQWDATSAGVLRTVARTVQRRSAGLVAAAVVGLLACAGEIELRLDSPQGSPQDSHAASPERDSITTLSAQLKSEGSASNGFRGPIVPIISPTPADWQSGPEELVVACTGGIIQHYPNFKEMCQQTIDRLIMRTGPQKSGKSVFLREASDGGVIGAGVLAGMVGNR

SEQ ID NO: 24404 - protein, 578 aa, Zea mays
QSLIPGVQTLVIGQEFADVDTCRRAVKDMAIALHYELRVVKSDRSRFIAKCSKEGCPWRVHIAKCPGVPTFTVRTLHGDHKCEGVLNLHHQQATVGWVARSVEARLRDNPQIKPKEILQDIREQHGVAVSYMQAWRGKERSMAAVNGTLEDGYRLLPAYCEQIVKTNPGSVATYGGIGPGNAFQRLFVSFHASIYGFLNGCRPLLEIDKADLKGKYLGTLLCASAIDADHMMFPLAFGVVDSESDDNWNWFISELRKMLGVNTDKMPVLTILSERKRQVVKAVGSNFPTAFHGFCLRYVSESFLDEFKNTKLLNLFWSAVYALTASEFDAKGIRYGHFSLGITEILYNLSLDCHELPIVQAIEHIRHQLTCWFAERQNLAQSYNSVLVPSAEKVILEAIHDSQCYQVLRANKVEFEIVSSERTNIVDTQARFCSCRRWQIYGIPCAHAAAALLSCGEDPRLYADDCFSVMKYRETYSQPIYPIPDRSHWNDSSPWSQGAVSKADVVLGPPNIRRPPGRPKMKILKIESMKRPKRIVQCGRCHLLGHSQKNSLLLGKRVDFGHRLSIALKSVFYAVSEQ

SEQ ID NO: 24405 - protein, 332 aa, Staphylococcus epidermidis
MRKITVFGMGSFGTALANVLAQNGHDVLMWGKNVENVDELNTHHMNKNYLKDAKLDSSIKATVDLNKAVQFSDIYLMALPTKAIREVSKDIDQLLTSKKTFIHVAKGIENDTFKRVSEMIEDSISSEHNGGIGVLSGPSHAEEVVIKQPTTVAASSKDNNVSKLIQDLFMNDYLRVYTNNDLVGVELGGALKNIIAIASGIVAGMGYGDNAKAALMTRGLAEISRLGEKLGADPMTFLGLGGIGDLIVTCTSTHSRNYTLGFKLGQGKTAEEALKEMKMVVEGIYTTKSVYHLAQQEGVEMPITNALYEVLFEDVPVSKSVRTLMERDKKAE

SEQ ID NO: 24406 - protein, 193 aa, Vibrio angustum
MQVVSSNHFILRLILLVSSIFFTSLVTTSANASSCPTLYQAPLKKLNSDEYYDICQQLTGKVVLVVNTASQCGFTPQFKQLEELYKTYKDSGLVVIGFPSNDFKQDRGSEQQTANICYSNYGVTFPMMTKTSVKGSRANSLYKHLIAQSGKSVGWNFQKYLLNKQGQVVGVFPSSLSPTSNEMVAAIKQQLKM

SEQ ID NO: 24407 - protein, 404 aa, Unknown
  Frankia sp. CcI3
MTAPVRAAVLQLGCPDEENAADRVRRVLGEIRQTQADLVVLPELWVTGYFHFDRYEAEAEALTGPTVTALREAARERGCHLVAGSIVERSADGRLFNTTVLIGPDGMIRHAYRKVHLFGYGSAEARLLTPGATVGTVPTELGIVGLATCYDLRFPELFRLLAEGGAEIVVVVSAWPLARLDHWRVLTRTRAIENQVYLVACNAAGRQAGREMAGASVVVDPWGEVLAEAGPRPTTVRAELDPSRPAAVRAEFPVLTHRRLGVDHQNRLDPAHLLDLAGRGKAFLDFWRERHLCSLTTVRPDGSPHVVAVGATLDPAAGIARVITSARSRKARLIAAGPAHGTPVGLCQIDGRRWSTLEGLAVLRDDPASVADAEFRYAQRYRAPRANPRRVVVEVRITRVLGSV

SEQ ID NO: 24408 - protein, 761 aa, Candida albicans
MIMNMTTDYRDPLLDLFGTESNSGNETSSPSDIPVINRSGTFNQQQFSPLLTQQSLYNTPNSGSTPNIFDPNYTQMQEEQTSPSSNKLQPEDPPRKKRNTRSQTKIHQQSEGDEYNSNDYKDSIDLDKPPVVEPSPPFFVESDTTPEFVIPTPTSEQQQQQHHELIAQDYQRSNNSNQFGNLTHYEPNLPPLPPLSESILPQTNTFHPLVLPHDPRHAITAGPANNSQQQQQRQQQDSSIPSDGISSKIQQLHAPSLSNNQSASQRKKKESSGPKTRPAFVMKIWSMVNDPANHEYIRWNDDGKTFQVFHREDFMKVILPKYFKHNNFASFVRQLNMYGWHKVQDVANGTLNQNSDKNGQDEIWQFENPNFIKDREDLLDKIVRNKSSSNQDDVSGVSFNGINNSANLSLILQELETIKMNQYVISEDLRRVRQDNKMLWQENYLNRERNQVQGRTLDKILKFLSVVYGNNANKILNGHGFADFSDSNNIMTQYRPSPMGSPLLSRPQTQPPPSNSRFARDNNQTAQPTYESPLSTSDTNNNNNNSTFEYQQAVNRPRLMLTNRAHSRRPSMSRTKSTPEGSIEEIIRSYSNDKAAESNVNRMYEQLVGHQPGATTNNNNHSSSTAISAPSPRHSFLQELNLPGTPRNLDDLEKHINNEGQSIQQVQDWIDKLAQEQHEKQQQQQGNEDDDDFDVNEFLKDATTTPGSNVPNGGHYNNGNINFVDSPIAMTPGSNVSSNINDSNGNEKKSKKRSIEEVSDH

SEQ ID NO: 24409 - protein, 377 aa, Cryptococcus neoformans
MSFRAPNLIRSAAGRRASQTLNLRSQVIRRRFATEGGPEITKPSSPRSSNTRYLLAGVGIAAVGAAYYFYGTGRTAHDSANKADTVVRGAVATVEAKTGLRRGKDEYQKVYNRIAETLEKEGYDDGSLAPVLLRLAWHSSGTYNKEDGTGGSNFATMRFKPEAEHSANNGLHVAREHMEKIKQEFPWISYGDLWTLGGVCAVQESGGPTIPWRPGRIDGFEAQVTPDGRLPDASQAQDHLRFIFNRMGFNDQEIVALSGAHAMGRCHTNRSGFEGPWTFSPVTFSNQYFALLRDEPWQWKKWTGPAQYEDKNTKTLMMLPTDMALLKDKSFKKYVDIYADNEEKFFSDFAKAFSKLIELGVPERQWAGEPWTLGTSD

SEQ ID NO: 24410 - protein, 72 aa, Unknown
  marine gamma proteobacterium HTCC2207
MAKEDHIEFEGEVIDTLPNTTFRVKLENDHVIIAHISGKMRKHYIRILTGDKVKVEMTPYDLTKGRITFRER

SEQ ID NO: 24411 - protein, 73 aa, Chlamydophila abortus
MAKKEDTIVLEGRVKELLPGMHFKILLENGMPVTAHLCGKMRMSNIRLLVGDRVTVEMSAYDLTKARVVYRHR

SEQ ID NO: 24412 - protein, 185 aa, Geobacter sulfurreducens
MSVTLDEIKQVYQEADCLFSEAEVEAAIGRLATAVTERLAEANPLVFCVMNGGLIVTGKLLPRLGFPLEIEYLHATRYGHHIFGKSLDWRVRPTVDLRGRTVLIVDDILDEGATLDAITEWCLQEGAAKVFTAVLVDKEHDRKARPGLKADFTGLVSPDRFLFGYGMDYKGYWRNAPGIYAVKGY

SEQ ID NO: 24413 - protein, 72 aa, Helicobacter hepaticus
MAKDDVIEVDGKVIEALPNATFRVQLENGHIVLCHIAGKMRMHYIKILPGDMVKIELTPYSLDKGRITYRHK

SEQ ID NO: 24414 - protein, 213 aa, Myxococcus xanthus
MLGSPPDMGKPYRPKDHYFQKAKQEGLRARSAFKVDELIKRFPMVKKGHVVLDLGAAPGGFLQILADAVGPKGRVIGVDIVAIRPFSQPFVQTAVLDVLADDFDAKLTELHAGPFDAVISDMAPKTSGIKATDEARSLRLAGKALELAAARGRPGSSFVAKVFMGRDFEDFRNQIRALFEEVKVVRPEATRGASMEVYLVGLRRRAPEAPEAN

SEQ ID NO: 24415 - protein, 347 aa, Arabidopsis thaliana
MAVSGFEGFEKRLELRFFDDDKPITKNPMGLRLIDFESLDQVLNEVQCTVVSAVANRSFDAYVLSESSLFVYPTKIIIKTCGTTQLLKSIRPLIHLARNLGLTLRACRYSRGSFIFPKAQPFPYTSFKDEVIVVEESLPKSLCYRKASVMTPSNNPSRAWHVFTASADVESDEHVVVVEVCMTELDRVNARSFFKRKGDEKNNSDSAGKEMTRLSGIDNINANAYICDFAFDPCGYSMNGVDGDRYSTIHVTPEDGFSYASFECGLSLYDNGHEDISEVLSRAIDVFRPSDVSIATTYGGEDYNHEVTKRVERVLAKKLDLKCRSRLMDEFPGSGTVVYQSFTPRRK

SEQ ID NO: 24416 - protein, 524 aa, Caulobacter crescentus
MNNVGRPTRPEAANDAANGHETLTGARGLLQDEALIFELDGWNKTGVDLPPVTAAPSSDLNGLLRDAPIGLPGLSEPETVRHYVRLSQKNHAIDLALYPLGSCTMKHNPRLNEKMARLPGFSDIHPLQPQSTVQGALELMDRLAHWLKTLTGMPAVALTPKAGAHGELCGLLAIRAAHEAAGNGHRKTVLAPTSAHGTNPATAAFVGYTVVEIAQTEDGRVDLADLESKLGDHVAAIMVTNPNTCGLFERDVVEIARLTHAAGAYFYCDGANFNAIVGRVRPGDLGVDAMHINLHKTFSTPHGGGGPGAGPVVLSEALAPFAPTPWLTHGDNGFELAEHAGDDDAKTAFGRMSAFHGQMGMYVRAYAYMLSHGADGLRQVAEDAVLNANYIKAQLKDVMSPAFPEGPCMHEALFDDSWLEGTGVTTLDFAKAMIDEGFHPMTMYFPLVVHGAMLIEPTETESKHELDRFIAALRALAGAAKAGDTERFKGAPFHAPLRRLDETQAARKPRLRWKPVAAAPLAAE

SEQ ID NO: 24417 - protein, 607 aa, Bacillus cereus
MCGITGWVDWKEDLSNQHVILEKMANRIQHRGPDAEGFWFSPRAAFAHRRLIVIDPEGGTQPKTFRAGDYTYALTYNGEIYNFRELREQLRKCGHAFETHSDTEVLLHAYLEWKEDCVQHLNGIFAFALWDDQKQQLFLARDHLGVKPLFYTERNDSIIFGSEIKALLAHPSVPAEIDADGINEIFGLGLFRTPGCGVFKHIQEVRAGHSITFTRDKKVVQKYWNLESKVHTDSIEDTSSHILSILQDTVKRQLIADVPLVCMLSGGLDSSGITALAGKEFAAENKTLHTYSVDFVNSAKDFELTFARTGLDAPWVKRVSEHVGTSHHDIIVNAEELANHLFVPLHAKDLPSAGEMETSLYLLFCEMKKDATVALSGESADEVFGGYPWFHQEELLYVDKFPWLTNWKNTSPLLLNEVSNQCNLENYIDTRFQEAILEVPTLEGESKKSAKQRQMFYLFLTRFLPFLLDRKDRMSMAVGFEVRVPFCDYRLVEYLWNVPFNIKSIDNIEKGILRRALKPALPDDIRNRRKSAYPTSQDPHYLQTIRHLSLDMCSNKNNPIFSLINHSTLLAIANQSNKEINNFEARSAMEYMLQVNEWLKTYHIHIA

SEQ ID NO: 24418 - protein, 448 aa, Caulobacter crescentus
MRYLPLTPEDRVEMLGAIGVKSIDDLFVDVPVSARRDAPVDLPHHAGELDVEREMAGLARRNRAAGEGPFFCGAGAYRHHVPATVDHIIQRSEFLTSYTPYQPEIAQGTLQVLFEFQTQVAALTGMEVANASLYDGSTGAAEAVMMAQRVTRRNKAVMSGGVHPHYVGAIETLAHAAGVATQALPAAVDAEDAVIAAIDQDTACVVVQTPNVFGTVTDVSKIAEAAHAAGALLIVVTTEAVSFGLLKSPGEMGADIAVAEGQSIGNGLNFGGPYVGLFACKEKFVRQMPGRLCGETVDADGKRGFVLTLSTREQHIRRDKATSNICTNSGLCALAFSIHMSLLGETGLRQLAAVNHQKALALRDALKAVPGVEILTPRFFNEFAIRVPGKAAEVVEILAAHGVIAGVPFSRLDAKAGLDDVLLVAATETTLDIDIPVFAKALTKVFAQ

SEQ ID NO: 24419 - protein, 995 aa, Listeria monocytogenes
MGAKVSVQINGVARDVVEGTRILDYLNAEGIQHPHICYSEQIGPIQSCDTCMCEVDGELVRACSTNLTDGMEIKTNSELAKDAQLEAMDRILENHLLYCTVCDNNNGNCKVHNTTELLGVEKQERPYREKGYLNDFSHPFYRYDPDQCILCGRCVEACQQVQVNETLSIDWERSQPRVIWDDDRPANLSSCVSCGLCATVCPCNALMEKSMLGQAGFMTGLDEDMLEPMIDMVKKVEPNYQTVFAVSEMEAAMRETRTKKTKTVCTFCGVGCTFEVWTKDRKILKVEPTGEGPVNKFATCVKGKFGWDFVNSEKRITTPLIREGNEFVPASWEDAIHLVATKLREIQAKYGNDSIGFISSSKTTNEENYLMQKLARQVFETNNIDNCSRYCQAPASDGLTRTVGIGADSGTVEDIETAGLVIIVGASPADGHPVLASRIKRAQKTRGQKLIVSDLRKHEMAERSDLFIHPKQGTDFVWLTAVAKYMIDQGWHDEVFMENRISNVRDYLAFLEPFTLDYAEKETGLSAETLKLVAQMVHEADGTAVCWGMGVTQNIAGSHTSSAIANLLLVTGNFGRHGAGAYPLRGHNNVQGACDMGSLPNVLPGIQPLGNDEVRARFEEAYGVSISPEPGLKNNEMLDAIEAGTLHSMYVIGEEMAWVDSNSNHVQEILASLDFFVVQDVFLSKTAQFADVVFPAAPSLEKEGTFTNTERRVQRLYEVLEPLGDSKPDWWIIQEVARACGRTDWNYDHPSEIMDEIASLAPFFAGVRYDRMQGFNSLLWPVSADGKDMPLLYEERFNFPDGKAQFSTLPYIAPITFPEEYNLTLNNGRLLEQFHEGNLTDKSKGLDYKLPEVFVEVSHELAKERDIESGSLVRLSSPYGRIKLRAVVTERMKGYEVYVPMHSVSSETAVNLLTSSAGDVRTKTPAYKQTKVNLTVLEKTGKNPLPDHNPRNRKRFPQNGAEVARKWSREDYQPISKVNCACGGNCGCGGKGRNH

SEQ ID NO: 24420 - protein, 473 aa, Bacillus cereus
MMDQNKGLKRELKSRHIFMIALGGVIGTGLFLGSGYTIHEAGPGGAIVAYLVGGFVMYLTMLCLGELAVAMPDAGSYQTYATKHISPAAGYVVGWMSWLNWSATIGIELIAVSILMKRWFPDVPSWIWCVVFAVLLFAINALSSRSFAEVEFWFASIKVITIIAFIILGGAAMFGFLDMKGNEPAPMFSSFTDYGGLFPNGLSAILITMIAVNFSFQGTELVGIAAGESENPEKTIPKAINNTVWRILVFFVLSIFILAGLFPWQQAGVIESPFVVVFDKIGIPYAADIINFVIITAVLSVANSGLYATSRMLWSMSNQGMISPIFGKLSKNGVPIYALIVSTIVGCLSLLSGIYAEDTVYLWLLSIAGFGAILVWASIALSNLLARRSYIKRGGDVKDLKFKTPLYPFVPLLALVLNVTVIVGMAFIPEQRMALYCGIPFMIVCLLFYRATRNKAHKVEHIEKTDTTEVESL

SEQ ID NO: 24421 - protein, 565 aa, Ostreococcus tauri
MASMAARTTTRTGARVGVGRTGERLGDGRSRARAPVRWTAARASMETSDWNAGCDVGRAVTAARGKTTRRGDRARAESSASPVARATGSDVLANWKGAKLKPLGYSVLAGLLIYLIPTPAGVTVKAWNLLAVFVATIVGIITNPLPLGAVAMIGLGVSMTAGILPFSAAFSAFSSEIPWLIALAFFLARGFIKTGLGNRIAYQIVSLFGKSTLGLTYSLVFSEALLAPAIPSLAARAGGIFLPLAKALCVACGSDPANGTEKKMGAYVMTTMFQTSTISSGMFITAMAANPLSVNLAASITGITISWAQWAIGALVPGLVCLILTPLILYVLYPPEVKESPEAPAKAKEELAALGPMSLDEKIMAGALTLTVGLWVFGSKFGIGSVAAALCGLTILLVSGVITWKECLAEGPAWDTLVWFAALIAMAGYLNTFGLIPAFSAGVVNVVSGLGLAWQPAFVIITLVYFYSHYMFASGAAHIGAMYSAFLSVLIACGAPPLVSALVLGILSNVMGCTTHYGIGSAPPFFGAGYVPLATWWKIGFGMSIVYITCFLGIGFPWWKILGYW

SEQ ID NO: 24422 - protein, 306 aa, Listeria monocytogenes
MQKKAMIIYNPAAGKNKFRKLLPDAEKILTEADFEVTLVPSTPAPKSTTFIAKQAAEAGFDVVIAAGGDGTVNEVVNGLMQVDTPPKLGVLPVGTTNDYARALNFAKNPLEALRIIAKQETIRVDIGKANETEFFINNAAGGKITEITYAVKESMKSKWGRLAYLFSGLTVLPKLSPVYVEIAYNDKIFKGEILLFFVNKSNSVGGMETLCPPAELNSGMFELLILKKVSPKTLFQLFASIKKGTHLSSPHVIHARTNKVTINSEADLNVSYDGVYGGKAPYTLEVIPEALEVFADTNRISSRLRG

SEQ ID NO: 24423 - protein, 198 aa, Triticum aestivum
MGWGEVKRVTKETNVHVKINLDGTGVANSSTGIPFLDHMLDQLASHGLFDVYVKATGDTHIDDHHSNEDIALAIGTALLQALGDRKGINRFGHFTAPLDEAAVEVILDLSGRPHLSCGLSIPTERVGTYDTQLVEHFFQSLVNTSGMTLHIRQLAGNNSHHIIEATFKAFARALRQATEYDLRRQGTIPSSKGVLSRS

SEQ ID NO: 24424 - protein, 134 aa, Methylococcus capsulatus
MTEKKLADWWNESHGSLYEKLGGEAAVNAAVDIFYRKVLADPRINRFFEGVDMEKQAAKQKAFLTMAFGGPHNYTGMDMRRGHAHLVKQGLNDAHFDAVMEHLGATMKELNVPDELIAQAAAIAESTRNDVLGR

SEQ ID NO: 24425 - protein, 484 aa, Staphylococcus aureus
MEDNKMNRSLNSRHISMIAIGGAIGTGLFVATGNIISQAGPGGAILAYLVIGVMLYFLMASIGELATFYPVSGSFSSYSTRFIDSSLGFTMGWLYWALWSLVTSVDVIVASNVLYFWDTFKFFHPITWSLIFITILLLLNIFSVKSFGETEFWLSLIKVLTIIVFVIFGFLMIFGILGGHAYGFENYTKGQAPFVGGISGFLGVLLVAGFSVGGTEVVAVTAGESDDPKKSMPKAIKQVFWRILLFYVLSIAVIGAIIPYTDPSLLRASSSISQSPFTIVFDRVGIAFAASVINAVILTSLLSAANSGVYTTGRMLYSLSSDKKAPKFLSKLNKTTKLPLRALLTTYAVVVIVIIYANFNSNAVFNLLEIIGSMIIVVWGSSIWSQIRLRQAIKKQGQDPNKVLPYKAPFYPLGPIIVIATLLFLLFGGSVEYILKDQWLNAFKNFLPLIILALIYFIHKIIHKTKFVKLETINLKPHDYDNQK

SEQ ID NO: 24426 - protein, 709 aa, Cenarchaeum symbiosum
MEGIELRVEEIPRQHVGAGRVIADPVVMEQAGWSTGQILELSYNRRTHAKLWPGGPEDRGTGVVRIDGLTRQNIGAGIGDRIKLSAASASDAVQVVLSPAEKINVGGLQEYMAQNFLNHVFTAGDTVTLGTQMGGRVQFAVASTSPGGPVIVVEGTKFKLGAPSRATDASHPRVTYDDLGGLTSEVQKIREMVELPMRHPELFEKIGVDAPRGVLLYGPPGTGKTLLAKAVAGETNANFSYIGGPEIMGKYYGESEERLREMFREAEENAPSIIFIDEIDSIAPKRDEVSGELEKRIVSQLLSLMDGMTRRGKVVVIAATNRPDSIDPALRRPGRFDREIEIGIPGREGREQILGIHTRGMPLDGDVNLEKIAGVTHGFVGADLEVLTKEAAMGSLRRVLPEIDLDQERISGDILQKINVTAGDFREALREVRPSALREVLVQVPDVSWDDVGGLDGLKEELRMAIEWPVKHKEAVKYAGVSPPKGLMLHGPPGTGKTLIAKAVARMTESNFISVKGPELLSKWVGESEKGVREIFRKARQAAPCIIFFDEVDALVPRRGGGSTSHVTENVVSQILTEIDGLEELHGVLIIGATNRLDIVDPALLRPGRFDRVVEVPRPDAGAREKIFAIHTKNKPLDGTVDLAALASSSEGLTGAEIESAANRAATEALRRHVESGSDDVKGIKITQEDLLGAVRSMLPQHAGAATAT

SEQ ID NO: 24427 - protein, 496 aa, Ceratopteris thalictroides
  misc_feature (294)..(294): Xaa can be any naturally occurring amino acid
VYLGGFDTAHAAARAYDRAAIKFRGPEADINFNLSDYEDDMKQMASLSKDEFVHILRRQGTGFSRGSSKFRGVTLHKCGRWEARMGQFLGKKYIYLGLFNSEIEAAKAYDRAAIRCNGREAVTNFDPNSYEEDLFAEASNGLDQTLELSLRTTLQPEEVSSRFDFPPYYGITGFHDHVPRREGFHGMSVGNSGYLPTSLSAAARDNWRMAGLSGHIVHDQLDGLLSRPLAPAPFLSTKVPMLGDRDGNGSYLGFARDPSTVLHGLPQMDDPCHQRHAALLKHMSSPFLHTTKLXPIVDDGGPRLPLPSPHEHAVPGLVPGSSVEGATTTNYGWPWQANHNLVPKGAAAATAAMKLPTAASSGFSHISKEPPLSEPALAPHLPCPSLSVKVSASTGMQVPLANPPSSTKSSSPQLAGAASAFCGWLTGNSSSVPSLVNSNVVSNMAASSSSGSKSTMSTAMMIGNVVVTEDKNASHALSPIPKEHNFLGLSLGLERS

SEQ ID NO: 24428 - protein, 485 aa, Desulfovibrio vulgaris
MKVLCINPPDDLAALLGDGASFVSTMEPLGLLYVAAACREAGHEVAFIDAYAENLDEETLMRRIRDAAPQVVSFTSFTSNGGFLYTFGRRLRQEMPGVHVLLGNVHATIYARQYLASGCCDVVVRGEGEEVMPALLRVLEEGGDLATVPSIAYVRDGVVAETGGHAFVRDLSTLPLPARDLTRKELYSFARTPNFSLYRTPEGKTEKHLFSSRGCVNRCTFCVAHKNIGIRVRPIDSVIGEVDLLLREYDAGYIFFCDSLFTSRKKRIIELSDALRHHFPGLRWGCEAHVNTIDEDSVRAMAAGGCVDMNFGIESGVDRLLTAVNKRQTTAQIADAIRMVKRVSRINAIGLFILGLPGERPEDSDATIDFACSLPLDMAQFSILTPYPGSPIFEQLRAEGIIDDGVRPGDTLDPEVWRRYSSYASFSDNKPIWVTPEHSVEGLLAAQKRALRRFYLRPRPFLIQLRRLRPADLLDTARTFFKTFF

SEQ ID NO: 24429 - protein, 228 aa, Zea mays
MAANGGDELKLLGVWDSPYVNRVQIVLNLKGLSYEYVEEDLLSKSELLLNSNPVHKKVPVLIHAGKPVAESQAIVQYLDEAFPSGTFPSVLPAEPYARATARFWAAFVDDKVGSPWHTVLFAREHGKKADAASRIVAALETLEGAFEDCSGGRDYFGGDAIGFVDVVLGSYLGWFKVFEKMVGVRVLDVARTPLLAAWGERFAAAEAAKDVLPDDVDKVLEFLQKFLD

SEQ ID NO: 24430 - protein, 851 aa, Xanthomonas axonopodis
MRPQVVRSDDGKVADAQPEQAQLTDASAVRVLKPWILPTANGLIADPAQRHTRPPGNPGSTVAYVQPHFDDSAWETVDLPHDWAIAGPFLANGPYGGMGRLPSWGIGWYRKSLDIPASDRGRALFLDLDGAMSYATVWLNGTLVGGWPYGYSSWRVDLTPYVIAGKRNQLVIRLDNPPESARWYPGGGLYRNVWLTKTAPLHIAHWGTQLTTPHVSADAAQVQLTVTLDNAARSATQAQVSTAIYLLDDASDRPSGEAVARIPAQPIAVPAGGTAHVQGSTRIDAPRLWGPPPTQQPHRYVAITEVGQQGHVVDRYETRFGIRSIVFDADRGLLVNGEHVPIRGVNNHHDLGALGAAFNRRAAERQLQLLQQMGANAIRMSHNPPAPELLELTDRMGLLVVDEVFDSWEMKKTPLDFHLVFPQWHATDLRAMLRRDRNHPSVMLWSVGNEVGEQYTGEQGAAIARALRAIVHAEDPTRPAAVAMNYASPEMPLSAALDVVSLNYQGEGIRDAAEFEGTQRIRKPPQYPAFHARFPHKAIVSSETASALSSRGVYLFPVTPDNSAPVRDGRGGDSAAHQVSAYELHAVDFGSSADKVFAALDRHPYVAGEFVWTGFDYLGEPTPYYSSRSSYSGIFDLAGFPKDRYWLYQSRWRPELPVAHLLPHWSWPGREGQVTPVHVFTSGDEAELFVNGVSQGRKRKAPLQYRLRWDAVVYQPGELQMQAYKDGKPWASERVQTAGRAARMQLMPDRGSIRGDGQDLSFITVRLLDRDGRPAPTAGDRLRFRIEGPGELVATDNGDPTNLETFASSQRHAFNGLCLAIVRAKAGARGTITVHVESDTLQAAQTQVAVQ

SEQ ID NO: 24431 - protein, 319 aa, Xanthomonas campestris
MTMATHHQLIILGSGPAGWTAAVYAARANLKPLVLTGLQMGGQLMTTTEVDNWPGDAHGLMGPDLMTRMQAHAERFETEVVFDHIHTADLSKRPFTLTGDSAQYTCDALIIATGATAKYLGIPSEEAFKGRGVSACATCDGFFYKDQDVIVVGGGNTAVEEALYLSNIARKVYLVHRRDTLRAEKIMQDKLFAKVAAGKVETVWHHEVDEVLGNDMGVTGVRVKSTLDGSTRDIDAHGFFVAIGHSPNTELFKGQLAMNNGYLEIRSGLGGNATQTSVEGVFAAGDVADQHYRQAITSAGFGCMAALDAERFLDSAVVR

SEQ ID NO: 24432 - protein, 128 aa, Desulfitobacterium hafniense
MAIAVGTIVEGVVTGITNFGAFVELPEKVTGLVHISEVADAYVKDVRDYLKEQDRVKVKVIHVDEKGKIGLSIKQANPSPKNTTRERRQPTVSFEDKLAKFIKDSDERQLEFRRATESKRGGRGSSRY

SEQ ID NO: 24433 - protein, 985 aa, Bacillus subtilis
MAGKKTITINGVEMEASEEQTVLQLLNNSSIEVPQVCYHPSLGPIETCDTCIVSINGELKRSCSAELKDGDVIDTLSPDVKKAQVIGMDKILYNHELYCTVCDYNNGGCEIHNTVKEMKINHQSIPFDHKPYHKDESHPFYRYDPDQCILCGRCVEACQDVQVTETLTIDWERKRPRVIWDNDVPINESSCVSCGHCSTVCPCNAMMEKGMEGEAGYLTGINNETLRPMIEITKGVETGYGSILAISDMESAMRDERIKKTKTVCTYCGVGCSFDVWTKGRDILKVEPQEEAPANGISTCVKGKFGWDFVNSEERLTKPLIREGDHFREAEWEEALLLIASKFTELKEAFGPDSLAFITSSKCTNEESYLMQKLARGVIGTNNVDNCSRYCQSPATAGLFRTVGYGGDSGSITDIAQADLVLIIGSNTSESHPVLSTRIKRAHKLRGQKVIVADIRKHEMAERSDLFVQPRAGSDIVWLNAIAKYLIENGKADERFLRERVNGRDEYVKSLAPYTLEYAEEKTGIDQETLIQMAEMIGQADSVCALWAMGVTQHIGGSDTSTAISNLLLVTGNYGKPGAGSYPLRGHNNVQGASDFGSMPDRLPGYEKVTDEQVRQKYERVWGVPLPKEPGMTNHEMIEKIHSGQLKAMYVKGEEMGLVDSNINHVHAAYEKLDFFVVQDIFLSRTAEFADVVLPASPSLEKEGTFTNTERRIQRLYQVFEPLGESKPDWQIIMEVANKLGAGWLYEHPADIMEEAAKLSPIYAGVTYERLEGYNSLQWPVNADGKDSPLLFTERFPFPDGKAILYPVQWTEPKEFGEEYDIHVNNGRLLEHFHEGNLTYKSKGISEKTPEVFLEISPELAAERGIQDGTLVRLTSPFGNVKVKCLITDRVKGKEVYLPMNDSGEAAINLLTGSHADKDTDTPAYKETSAKMEILKHDGISPLPKINHRNGNPQPQIGVQVHKKWARKDYIFPGDAVKRGMGHNG

SEQ ID NO: 24434 - protein, 497 aa, Aspergillus nidulans
MKPTQVLRLAVAAPDVNPQTRKARSIPVLNPFDLYGRVFFFSWIGFLVAFLSWYAFPPLLSVTIKKDLHMSQDDVANSNIVALLGTFVMRFIAGPLCDRFGPRLVFVGLLICGAVPTAMAGLVTTPQGLIALRFFVGILGATFVPCQVWCTGFFDKNIVGTANSLAGGFGNAGGGITYFVMPAIYDSFVHDRGLTPHKAWRVSYIVPFIIIVSIALAMLFTCPDTPTGKWADREKTSGQSIVDLSSTPNASSANSINISSDEKKAVHPEVTDSEAQVHVRAGQIESSDAVIEAPTIKRYLSIALDPSALAVAVPYACSFGAELAINSILGAYYLLNFPLLGQTQSGRWASMFGLVNVVFRPMGGFIADLIYARTNSVWAKKMWLVVLGLAMSGMAILIGFLDPHRESVMFGLVVLMAFFIAASNGANFAIVPHVHPSANGIVSGIVGGMGNFGGIIFAIVFRYNGTQYHRSLWIIGFIILGCTLFFSWVRPVPKQNH

SEQ ID NO: 24435 - protein, 720 aa, Unknown
  Dehalococcoides sp. CBDB1
MITANSFERTIGGRKLVIESGKLARLADAAITIRYADTELLVTLCSAKKPREGVDFLPLTIDYEERMYAAGKIPGGFIRREGRPSEQAILAGRLTDRPLRPLLPKEWRNDLQIIITVIASDKENDADIWGVVGASTVLAMSEIPYEGPVGASRIGYINGEFVLNPTFAQLESSQLDLVVVSTRKAVVMIEAGSKEIPEDIMINAIEFAHKANQELIDLQDEIRAKLGKEKLPVPVLEIPEEVKTAVAAFVKGRVNEALSHQDKTARENAVEGLQAELVAALSETFAEGDILAAYDKEIKKAIRSTILEKDIRVNGRGIKQLRQLDAETGLLPRVHGSALFTRGDTQVMAITTLGSLQESQQLDGLSAEDTKRFMLHYNFAPFSTGEVKRSGSPGRREIGHGALAERALVPVLPTPEEFPYTIRLVADVVGSSGSTSMGSVCSSSLSLMDAGVPVKKAVAGISIGLITGENDTYCTITDIEGIEDNYGDMDFKVAGTRDGITAIQVDMKVKGISFDIIRDAIYQAKEARYNILDVMDKALAQPKTELSPYAPRMYKINIDPSKIGSVIGSGGKTIRSIIEQTNTTVDIENDGTVVIGATDEASAKKAIKIIEDLTKDIEAGSIYTGKVTRIMTFGAFVEILPGKEGMVHISELADHRVEKVEDIVKVGDDITVKVIEIDNQGRVNLSHRVILNPNAVPISRNRDSQPRRPGPFRPSDRSNS

SEQ ID NO: 24436 - protein, 739 aa, Nicotiana tabacum
MSSKNLFSFLFLLVLPFSSSSDATAWIKSGFWYAGSEFPVPEIPSTMFTHIHFAFAYINASSFELYVSHSDEPYISTFSNTVKQKNPSVITLLSIWGGRDESPNFFAMTSQFSRRKSFITTSIKTARQYGFQGLDLIGVNPNTDANMTNMRSFIEEWRTAINSESKSSGTRTLILTMGAYYSPMLDSMSYPIDTIIRNFDWVHLKAYAALYDPTSKLNTDYGIKEWIKRGLPANKIVLGLAYHGYAWTLVNPKHNTVRTPARGLAITQDGSISYRYIKQYMKSYGVTPVYNSTFVVNYVTIGSFWIGYDDVEAIRTKVSYAKDKGLLGFAAFQIPSDDVNWELSKTAQDEEEEDQSGSNRRLLAILLPTLTLTILLLSTIVFILKKKTLRSEGIRELNERAIGHNLKVFKFDKIKAATDNFSIKNKLGEGGFGPVYKGRLSDGQEIAIKRLSAYSKQGVEEFQNEVTLASKLQHVNVLQLQGCCTEREEKILIYEYMPNKSLDFYLYDPVQSLQLDWETRVRIIEGVTQGLLYLQEYSAFTVIHRDLKASNILLDDEMKPKISDFGIAKLFQKDEKEANTGRIVGTYGCVPPEYVKRGLYSRKYDVYSFGVLLLQILGEKKNSSEYGIKNDLNLLEYAYELWEKGNGVDFLDLSLQDDSRIGKQLRYMQAALLCVQEKWEDRPSMLEVYSMLKNETEVLPNPKVPAFSKNKDNDTQETLVTPDLTCSDNSLTISQLIAR

SEQ ID NO: 24437 - protein, 458 aa, Bacillus subtilis
MTDDMTKDNINQQTLQRGLKNRHIQLIAIGGAIGTGLFLGSGKSIHFAGPSILFAYMITGIICFLIMRSLGELLLSNLNYHSFVDFVQDYLGDMAAFITGWTYWFCWISIAMADLTAVGLYTQYWLPGVPQWVPGLIALIILLIMNLATVKLFGELEFWFALIKVIAILALIVIGLVMIFKGFSTSSGVSSFTNLWSHGGLFPNGMHGFILSFQMVVFAFVGIELVGLTAGETENPEKVIPKAINNIPVRVLLFYIGALLVIMSIYPWDIINPSESPFVQVFVAVGIVGAASIINFVVLTSAASACNSAVFSTSRMVYSLAKDHNAPESMAKLTQRKVPRNALFFSAIVILIGVTLNYIMPEGVFTLITSISTVCFIYIWGITVICHMKYRKTRPELAKTNKFKLPLYPFTNYLILAFLAFVLVVLALAQDTRVSLFVTPVWFILLIVIYKVRKAKHQ

SEQ ID NO: 24438 - protein, 344 aa, Nocardia farcinica
MRIGVLTGGGDCPGLNAVIRAVVRTANGRYGDAIVGFQDGWRGLLEDRKINILNDDRTDRLLNKGGTMLGTARTNPDVLRAGLGKIKQTLDDNGIEALIPIGGEGTLTAASWLSDEGVPVVGVPKTIDNDIDCTDVTFGHDTALSIATEAIDRLHTTAESHQRVMLVEVMGRHAGWIAVNSGMAAGAHLTLVPEEPFDVDEVCTMIKRRFQRGDKHFICVVAEGSHPAPDSGFTLREGGVDEFGHERFTGVAQQLGTEIERRIGKEVRTTVLGHVQRGGSPTPYDRVLATRFGLHAAEAVHAGHFGQMVALHGTAIELVPLAEATKQLKRVPTERYREAQAFFG

SEQ ID NO: 24439 - protein, 386 aa, Prunus mume
MPIVAAAVVVPLGLLFFISGLVVNLIQAICFILIRPVSKNLYRRINRVVAELLWLELVWLIDWWAGVKIQVYTDHETFNLMGKEHALVISNHRSDIDWLVGWVLAQRSGCLGSTLAVMKKSSKFLPVIGWSMWFSEYLFLERSWAKDEGTLKSGVQRLKDFPQPFWLALFVEGTRFTQAKLLAAQEYAAATGLPVPRNVLIPRTKGFVTAVSQMRSFAPAIYDVTVAIPKSSPAPTMLRLFEGRPSVVHVHIKRHVMRDLPETDEAVAQWCKDIFVAKDALLDKHTVEQTFGDQQLKVTGRPLKSLLVVTAWACLLILGALKFLYWSSLLSSWKGIAFSALGLGVVTVLMQILIRFSQSERSTPASVAPANNNNKGESSGKPEKQQ

SEQ ID NO: 24440 - protein, 236 aa, Oryza sativa
  misc_feature (214)..(214): Xaa can be any naturally occurring amino acid
MAGAGDELKLLGMWTSPFALRVKLALSFKGLSYEYAEEDLSNKSELLLSSNPVHKKVPVLIHNGKPICESQVIVQYIDEAFPGAGVPLLPSDPYERAVARFWAAYIDDKLLKSWLQASMGKTEEEKAEALKETFTAVANLEAAFEECSKGKPFFGGDAVGYLDVTLGALVSWVHAGEALYGMRLFDATRSPLLDAWVDRFAALDAAMAVLPDAXGTLAEYAKKRQAERAAAAAANN

SEQ ID NO: 24441 - protein, 747 aa, Rhizobium leguminosarum
MRSVVSFNEGWSFHEGFGQRLLETFDTAKSVSLPHTAVELPFSYFDETSYQRAFTYQKVLRWLPEFEGREVSLVFDAAMADSVVYLNGEEIIAHKDGYTPFEARLTGKLVKGENLVTVKIDGSENPDIPPFGGRIDYLTYAGIYRDVWLKVTDPVSIRNLKIETTDVLRPEKSATIRVDIANPEGRSFSATVTATLKQADGTVVATAATETIGSRTTLSFGGLTGIALWDITDPKLYDVTVELRTEHGSDRISTRFGFRTAEFTPEGFLLNGKPLKLRGLNRHQAFPYVGYAAGRSAQERDADIMKTVLKCNIVRTSHYPQSKWFLDRCDAIGLLVFEEIPGWQHIGDADWQQESIKNVRRMIERDWNHPSIIIWGVRINESQDDHDFYAETNRLARELDSTRQTGGVRYLTESELLEDVYTMNDFILGNEELPGANRPRTALRAQQENTGLSHKVPYLITEFNGHMHPTKIYDQEQRQAEHVRRHLEVLNAAYGDPDISGAIGWCMFDYNTHKDFGSGDRICYHGVMDMFREPKFAAYAYISQCDPSEEIVMKPVTFWARGERNIGGVLPLIILTNCDEVELQYGALSKRIGPDRENYPHLPHPPVVLDHRHFTADELGTWGLEWIDGTFTGYIGGEPVASLTLAADPLPTTLEVVADSSTLRARERDSTRVIIRALDQRGQRLPFMNDSISLKVHGPARIVGPTNVPLQGGTAGFWLEATGFTGEITVEAISTRFAPVTLGVTAA

SEQ ID NO: 24442 - protein, 294 aa, Geobacter sulfurreducens
MSKLSVALVQQSCTADKDLNLAKSIENIRKASVLGAKLVVLQELHTGPYFCQNEDTAHFDLAEPIPGPTTELLGGVAKEFGVVLVSSLFERRAPGLYHNTAVVFEKDGSMAGTYRKMHIPDDPGYYEKFYFTPGDLGFEPIRTSVGKLGVLVCWDQWYPEAARLMALAGADLLIYPTAIGWDPRDDDDEKIRQKEAWITIQRGHAVANGIPVVSVNRVGHESDPSGVLPGSQFWGSSFVAGPQGEILAQASNDGEELLITELDLARSEAVRRIWPFLRDRRIDAYGDLLRRYRD

SEQ ID NO: 24443 - protein, 112 aa, Shewanella oneidensis
MKKVEAIIKPFKLDDVRESLAEIGITGMTVLEVKGFGRQKGHTELYRGAEYMVDFLPKVKIELVIQDDLVDQAIDVIVETARTGKIGDGKIFVTDVERVIRIRTGEENEEAV

SEQ ID NO: 24444 - protein, 498 aa, Glycine max
MGKVAVGAAVVCAAAVCAAAALVVRHRMISSRKWSRAMAILKEFEEKCGTPIVKLRQVADAMDVEMHAGLASEGGSKLNMLISFVDNLPTGDEEGLYYALDLGGTNFRVLRVHLGGKDKGVIGQEFEEVSIPPNLMTGSSDALFDFIAAALAKFVGSEPEGFHPPPGRQRELGFTFSFPVRQTSIASGTLIKWTKGFNIEDAVGEDVVGELTKSMEKIGLDMRVAALVNDTIGTLAGGRFYNQDVIAAVILGTGTNAAYVERAHAIPKWHGLIPKSGDMVINMEWGNFRSSHLPLTEYDLALDAQSLNPGEQIFEKLISGMYLGEVVRRALLKMAEEADFFGDTVPPKLKVPFILRTPDMSAMHHDTSSDLKVVGNKLKDILEISNTSLKMRKIVVELCDIVATRGARLAAAGILGILKKIGRDTVKVGEKQKSVIALDGGLFEHYTKFRECLESALKELLGDEAAETIVIEHANDGSGIGAALLAASHSQYLGVEES

SEQ ID NO: 24445 - protein, 473 aa, Lactobacillus plantarum
MTKLQSVNYQQLTWPLIIGLIIWLSAPFRPAGLSLLAWHMLALFVGTIIGCITQPLPIAGVAIIGLTLGVLLGVTSMTDAMAGFGDNTVWMIAMAYFLSRGFVKTGLGRRVALVFVKLFGKKTLGLAYALIGVDLVTSPATPSNTARAGGIVFPIIESLAKAYGSDPQNGTQRKVGSFLIMSAFHGNIATSGLFMTAMAPNLVAVALAQAMQIHITWMDWLLAALLPGLICLISVPAIIYWLYPPEIKDTPNAHAWAANELEQMGAMTLAEKLMGGIFMLALFLWISASLTGLDATLVAFIAVTLLLLTGVLSVDDLLHENGAWNTLVWFSILIFMAGKLNSLGFIPWLSQTMGQALQGISWLWVLAALMLVYFYSHYLFAGATAHVSAMYGAFLGVAISAGAPPMLAALLLGFDGAIFSSTTHYANGPASIMFGSGYITQSEWWRLNLCLGGFYLLVWGVGGTLWMKLLGYW

SEQ ID NO: 24446 - protein, 304 aa, Prunus domestica
METFPVVDLSQINGEKRGAAMEKINDACENWGFFELVNHGISHELMDTVEKLTKEHYKKCMEQRFKEMVANKGLEAVQSEIHDLDWESTFFLRHLPVSNISQIPDLDEDYRKVMKEFAVELEKLAEQLLDLLCENLGLEKGYLKKAFYGSKGPNFGTKVSNYPPCPKPDLIKGLRAHTDAGGIILLFQDDKVSGLQLLKDGQWIDVPPMRHSIVINLGDQLEVITNGKYKSVMHRVLAQPDGTRMSIASFYNPGDDAFICPAPALLEKETEKISVYPKFVFDDYMKLYSGLKFQAKEPRFEAMK

SEQ ID NO: 24447 - protein, 541 aa, Streptococcus agalactiae
MTIDKRKVVYQIYPKSYKDTTGNGVGDLRGIIEKLPYLAELGIDMVWLNPFYPSPQRDNGYDISDYTAINPDFGTMDDFEEMIEVGRQYRIDFMLDMVLNHCSIEHEWFKKALAGDRYYQDFFILRDNPTDWVSKFGGNAWAPFGDTGKYYLHLFDITQADLNWRNADVRKELFKVVNFWRDKGVKGFRFDVINLIGKDEILENCPINDGKPAYTDRPITHDYLKMLNNASFGQDDSFMTVGEMSSTTIANCILYTAPEREELSMAFNFHHLKVDYKDGQKWTIMAFDFPALRDLFHSWGEGMSEGNGWNALFYNNHDQPRALNRFVDVKRFRNEGATMLAASIHLSRGTPYIYMGEEIGMLDPDYSSMDDYVDIESLNAYQIMLDEGKSQEEAFSIIRAKSRDNSRVPMQWDDSTNAGFSEGAPWLKVGKSYKEINVAKEKTGLIFTFYQELIRLRKQLPIIADGNYKAAFKDNEKVYAFERHLDKEKLLVLNNFFAEKVKIKLPENYLQGQVLLSNYKDVTLDETVTLQPYQTLAILVS

SEQ ID NO: 24448 - protein, 371 aa, Neurospora crassa
MADLLLPEPFASIPREPLTFGPSPIQPLPRISQALGGKVNVFAKREDLNSGLAFGGNKTRKLDSLTNKSGPSAPRYLVPDAISRGCDTLVSIGGIQSNHTRQVAAAASKLGLHAALVQEHWVPDWTDPGYDKVGNIQLSRLMGADVRLEPLAGFGIEHKQTLAKLKDDLEKEGRKPYYIPAGASDHPLGGLGFARWAFEVVAQEEELGIHFDTVVVCAVTGSTMAGMVAGFKLVEMLERHSERLGKVNKRRVIGIDASAKVEQTRAQVLRIAKQTAAKIGLKEEDITESDIVLDDRYHAGVYGVPDEKTIEAIKFGARTEAFITDPVYEGKSLAGMMDMIKNGEIEAGSNVLYAHLGGQLALNAYSALGLE

SEQ ID NO: 24449 - protein, 432 aa, Triticum aestivum
  misc_feature (345)..(345): Xaa can be any naturally occurring amino acid
MAERLAASASLLPSAASPSSSTRRATVASGLRLRPSPSRFSQAASRGRGVAGAAGVVPRLRVVRCMAASEAAQLKSAREDIKEILKTTYCHPILVRLGWHDSGTYDKNIEEWPQRGGADGSLRFDPELSHGANAGLTSALKLIQPIKDKYPGITYADLFQLASATAIEEAGGPKLPMKYGRVDITAPEQCPPEGRLPDAGPRLPAEHLREVFYRMGLDDKEIVALSGAHTLGRSRPDRSGWGKPETKYTKDGPGEPGGQSWTAEWLKFDNSYFKDIKEQRDQELLVLPTDAALFDDPSFKVYAEKYAEDQEAFFKDYAEAHAKLSNLGAKFDPPEGFSLDDDKGXAVATEEKVVADPAPASDTNSTGPQPEPFVSAKYSYKKRELSDTMKQKIRAEYEGLGGSPNKPMKSNYFLNIMIVIAGLAFLTSLTGN

SEQ ID NO: 24450 - protein, 178 aa, Glycine max
MASSMISSPAVTTVNRAGAGMVAPFTGLKSMAGFPTRKTNNDITSIASNGGRVQCMQVWPPVGKKKFETLSYLPDLDDAQLAKEVEYLLRKGWIPCLEFELEHGFVYREHNRSPGYYDGRYWTMWKLPMFGCTDASQVLKELQEAKTAYPNGFIRIIGFDNVRQVQCISFIAYKPPGF

SEQ ID NO: 24451 - protein, 315 aa, Rhodopirellula baltica
MPTEKHFGPQGWTPDRIGSLQGKTYVITGANAGAGFEATRALLSKGAKVVMMNRNADKSAAAIETLKREFGRDADVTFVRLDLAVLDSVREAASELLDTVPQIDALICNAAIAQVAKQEITVDGFESQLGVNHFGHFLLCGLLFDWIEQSHGRIVVVGSNAYKMGLKKIQFEDLNFDKNYTAWNAYAQSKLAQMMFAYELQRRVEASSKHVQVRVCHPGASRTNLLNDTASLPMKMLWKVISPFIAQSAERGSWPEVMCATEDGLKPQALYGPTKRAETVGPVGECPLEPLALNQEAATQLWSVSEQKVALTWSP

SEQ ID NO: 24452 - protein, 81 aa, Arabidopsis thaliana
MGRRPARCYRQIKGKPYPKSRYCRGCARSKIRIYDVGYERGRGVDEFPFLVFIWVVMGKREKGVKVKPTLESWPGNCLATK

SEQ ID NO: 24453 - protein, 176 aa, Desulfovibrio desulfuricans
MTVTGMDVVYTAEQVQERVRELAVQINAEYEDKPLVVVCVLKGAFMFFSDLLKHLTVRPEIDFVRVASYGNSTTRSRNISFTKDLEVSIDGKHVLVVEDIVDTGHTVDFLYRQLAARGAASIRLCAIVDKAERREVDVTVDFPGFALDKGYIIGYGMDYAEQYRELDAIYDAHVAN

SEQ ID NO: 24454 - protein, 220 aa, Zea mays
MGRRPARCYRQIKNKPCPKSRYCRGVPDPKIRIYDVGMKRKGVDEFPYCVHLVSWERENVSSEALEAARIVCNKYMTKSAGKDAFHLRVRVHPFHVLRINKMLSCAGADRLQTGMRGAFGKPQGTCARVDIGQVLLSVRCKDNNAAHASEALRRAKFKFPARQKIIESRKWGFTKFSRADYLKYKSEGRIVPDGVNAKLLANHGRLEKRAPGKAFLDAVA

SEQ ID NO: 24455 - protein, 232 aa, Arabidopsis thaliana
MAEASDLLEWPKKDNRRFLHVVYRVGDLDRTIEFYTEVFGMKLLRKRDIPEEKYSNAFLGFGPETSNFVVELTYNYGVSSYDIGTGFGHFAISTQDVSKLVENVRAKGGNVTREPGPVKGGGSVIAFVKDPDGYTFELIQRGPTPEPFCQVMLRVGDLDRAIKFYEKALGMRLLRKIERPEYKYTIGMMGYAEEYESIVLELTYNYDVTEYTKGNAYAQAQMMCTKAVKLLR

SEQ ID NO: 24456 - protein, 466 aa, Photorhabdus luminescens
MSVAPVVDVLQGRVAVDSEVTVRGWIRTRRDSKAGISFLAVYDGSCFNPLQAVVNNNLPNYQDEVLHLTTGCSVEVTGTVVASLGQGQNFELQATKIVVIGLVEDPDTYPMAAKRHSIEYLREVAHLRPRTNLIGAVARMRHTLAQALHRFFHENGYFWVSTPLITAADTEGAGEMFRVSTLDLQNLPLTDKGEVDFNQDFFGREAFLTVSGQLNGEAYACALSKVYTFGPTFRAENSNTSRHLAEFWMLEPEIAFANLNDAATLAENMLKYVFKAALAERADDLQFFAERVDKDVITRLEKFINSDFAQIDYTSAIEILQNCGQKFENPVFWGVDLSSEHERYLAEKHFQAPVVVKNYPKDIKAFYMRMNDDGKTVAALDVLAPGIGEIIGGSQREERLDMLDKRLEEMGLNKEDYWWYRDLRRYGTVPHSGFGLGFERLVAYVTGVPNVRDVIPFPRTPRSANF

SEQ ID NO: 24457 - protein, 1002 aa, Arabidopsis thaliana
MKLLLLLLLLLLLHISHSFTVAKPITELHALLSLKSSFTIDEHSPLLTSWNLSTTFCSWTGVTCDVSLRHVTSLDLSGLNLSGTLSSDVAHLPLLQNLSLAANQISGPIPPQISNLYELRHLNLSNNVFNGSFPDELSSGLVNLRVLDLYNNNLTGDLPVSLTNLTQLRHLHLGGNYFSGKIPATYGTWPVLEYLAVSGNELTGKIPPEIGNLTTLRELYIGYYNAFENGLPPEIGNLSELVRFDAANCGLTGEIPPEIGKLQKLDTLFLQVNAFTGTITQELGLISSLKSMDLSNNMFTGEIPTSFSQLKNLTLLNLFRNKLYGAIPEFIGEMPELEVLQLWENNFTGSIPQKLGENGRLVILDLSSNKLTGTLPPNMCSGNRLMTLITLGNFLFGSIPDSLGKCESLTRIRMGENFLNGSIPKELFGLPKLSQVELQDNYLTGELPISGGGVSGDLGQISLSNNQLSGSLPAAIGNLSGVQKLLLDGNKFSGSIPPEIGRLQQLSKLDFSHNLFSGRIAPEISRCKLLTFVDLSRNELSGDIPNELTGMKILNYLNLSRNHLVGSIPVTIASMQSLTSVDFSYNNLSGLVPSTGQFSYFNYTSFVGNSHLCGPYLGPCGKGTHQSHVKPLSATTKLLLVLGLLFCSMVFAIVAIIKARSLRNASEAKAWRLTAFQRLDFTCDDVLDSLKEDNIIGKGGAGIVYKGTMPKGDLVAVKRLATMSHGSSHDHGFNAEIQTLGRIRHRHIVRLLGFCSNHETNLLVYEYMPNGSLGEVLHGKKGGHLHWNTRYKIALEAAKGLCYLHHDCSPLIVHRDVKSNNILLDSNFEAHVADFGLAKFLQDSGTSECMSAIAGSYGYIAPEYAYTLKVDEKSDVYSFGVVLLELITGKKPVGEFGDGVDIVQWVRSMTDSNKDCVLKVIDLRLSSVPVHEVTHVFYVALLCVEEQAVERPTMREVVQILTEIPKIPLSKQQAAESDVTEKAPAINESSPDSGSPPDLLSN

SEQ ID NO: 24458 - protein, 1563 aa, Arabidopsis thaliana
MAKSSADDEELRRACEAAIEGTKQSIVMSIRVAKSRGVWGKSGKLGRQMAKPRVLALSVKSKGPRKKAILRVMKYSSGGVLEPAKMYDLKHLSKVEVITSDPSGCTFTLGFDNLRSQSVAPPQWTMRNTDDRNRLLVCILNICKDVLGRLPKVVGIDIVEMALWAKDNTPVVTTQRSTEDGEPVAESVTESALKVTVEKELVSQAEEEDMEALLGTYVIGIGEAEAFSERLKRELQALEAANVHAILESEPLVDEVLNGLEAATNIVDDMDEWLGIFNIKLRHMREDIESIEIRNNKLEMQSVNNKALIEELDKVIERLRVPSEYAASLTGGSFDEADMLQNIEACEWLAKALRGLEVPNLDPIYANMRAVKEKRAELEKLKATFVRRASEFLRDYFASLVDFKFSDKSYFSQRGQLKRPDHADLRYKCRTYARLMQHLKGLNKNCLGPLRKAYCSSLNLLLRREAREFAKELRASTKVSRNPTVWLEGSTGSSQNANTDTSAVSDAYAKMLTIFIPLLVDEVIVNRMSSFFAHFMCFEVPALAPPGGAGNDKKSQSNNDDGNDNDDLGIMDIDEADKKPGKNSPDLTALNESLQDLLDGIQEDFYAVVDWAYKIDPLRSISMHGITERYLSGQKADAAGFVRLLLGDLESRISMQFSHFVDEACHQIEKNERNVRQMGVLPYIPRFAALATRMEQYIQGQSRNLVDQAYTKFVSILFVTLEKIAQQDPKYADILLLENYAAFQTCLFDLANVVPTLAKFYDQAMEAYEQACTRHISMIIYYQFERLFLFDKKIKDLMYTITPEEIPFQLGLSKVELRKMLKSSLSGVDKSIAAMYKKLQKNLASEELLPSLWDKCKKEFLDKYESFVQLVAKVYPSENVPGKQILVFLYQRYQSEDDSRSSTMETRAQARKEKEVMEDPLGLRMEKLENKIAEQNQKLDKSFAQLIDTIRLISVKVNNASSSGHLQQQRSRETVYPSSEVFHVRRTGTNSNYSAVTRSSKLDFHRFSGDRVRDWLFKLEQFFSLDFTPEELKVSIASTLCDGAAAKWYKSLFESDFGVKLLSNWNMYKLLLEEHFAEVLDDPISELKQLKETNGIEEYHKKFELLRARVNLSEDYLVRVYLDGLHPDTQMNVNMFQPQTVCQCLLVGRLYEQVHQKILIIRKVGEDSEKGAPTLNVPNEVAGPSLSNIHVHDALHKDRECFEGKHSIQGTTAGMENFMQQEELNCDRDCVFERDHWCAPYVNLETKLVNQEKSELCTGNEGEVKGCLEVSRQKVSSTFADLDKDDATTSQLRSPFGFVVDDLPSGCGSDNIRFRNSASPLVVGDSQKTPWILNEESNDIQNFQIAIDGSSNFYAGQESNGMRLRSHILTQQKRPSKSPKSWKFKFKISNDSKLRYIKFWCEKVSSKKKLKCAKATQWDSPMQCYSRLAQKELRTSMVELTETMKNVCGLKVVYVLHWIDINNWLTNSWCRKSSKDWCFKYKTEMEMKGKLWGIFILSTMGSWLFGREGFDMGRRMKFLGFEYYDSSSVKNIVLASVRASKVLILSMLDLKRCQNSKNTMLKP

SEQ ID NO: 24459 - protein, 306 aa, Triticum aestivum
HRCFTNPVLSTFFRSVKVLPVNRGEGIYQKGMDMALSKLNNGGWVHIFPEGSRSRDGGKTIAPAKRGVGRLIMDADSLPVVVPFVHTGMQDIMPVGKRIPRTGQRVIVVVGDPINFDDLMAENSNDSQHISRGDLYDKVTERIGQRLQQLKVEVDRLAAEQKAELQNRHTDNTVNDGYKVWQQVDWESFGIGNMLSSAEHSSAQEPPKQIQHEVLLAEQSVSPAKQAEPEPRLEEEQSVFSPISRVPHWFSRHMDASELMGFAARGLVRNGRSMQEGYRQFQEPSAFNAWWEAQTSSAMMPRWSTA

SEQ ID NO: 24460 - protein, 417 aa, Meiothermus ruber [sequence omitted]

SEQ ID NO: 24461 - protein, 160 aa, Bacillus anthracis
MTVYDFSAKTITGEEKSLKDYEGKVLLIVNVASKCGFTPQYKGLQEVYDKYKEQGLEILGFPCNQFGGQEPGTEADITSFCELNYGVNFPMFAKIDVKGDKAHPLYTYMTEQAPGLLGMKAVKWNFTKFLIGKDGKVVGRFAPQTKPVDLEVEIEKVLGE

SEQ ID NO: 24462 - protein, 416 aa, Streptococcus thermophilus [sequence omitted]

SEQ ID NO: 24463 - protein, 375 aa, Candida albicans
MASTDTNNSKTVSSSTSSPSTPTKTATTKTTATPPIQSSLEVPSLANNSNGSSSTSTSSTNASSTGANDSNYDPFAGLSFRVGVAENKNTTFRNKMEDVHTYIANFAERVDWGYFAIFDGHAGKDTARWCGNNLHTLLEEEIDRNSDEGSPPPTPITGKDDLREDLYKCFVKADELIEKSGQGKSGCTAAVAVLRWESDNEEPVSHTKSQDGGKFDFKPTKNHKRLLYTSNVGDSRIVLCRAGQAYRLSYDHKATDTHEINRIEDNGGLVLKNRVNGVLAVTRSLGDTYMKSLVIGVPFTTATEITADDEFIIIACDGLWDVVSDKHACKLAAESFKQGYSPSQVAKKLCQFAIELSTTDNVTVMVVQLDNDVFS

SEQ ID NO: 24464 - protein, 514 aa, Unknown
  Rhodococcus sp. RHA1
MVRSAIPVELPVDSVDHPPEVVDVLVVGAGFGGLGTAIRLKQAGIDDFVVLDRAEDIGGTWRVNTYPGAQCDIPSILYSFSFAPNPNWTRLYPLQQEIHDYLRSCAENFGIVPHLRMGHDVQDAAWDDDSQVWHVTTSRGTWEARILVGAMGPFSEPAVPNLPALESFRGAVFHSAAWDHEHDLAGERVAVIGTGASAVQIIPRIQPIVGSMTVFQRTPTWILPHPDQPMTGWPRKLFARVPVAQRLARSGLDLVQEAMVPGFVYKPALLKGLAALGRAHLRRQVHDPELRTKLTPTYAFGCKRPTFSNSFYPALAQPNVDVITDGIREVRSNGIVTEDGVLHEVDTIVMGTGFRLTDNPAFDVVRGRDGRTLAEAWNGNARAYLGTTISGFPNFFMLLGPNSVVYTSQVVTIEAQIAYILSCLQEMNAQGAASIDVRPEIQQAFVDEVDERLQTSVWNTGGCNSYYLSGEGRNFTFYPGFNRRFRARTRRVDLHHYIISGAGASAKSIVRTAG

SEQ ID NO: 24465 - protein, 220 aa, Prunus domestica
GRPAGGREFTSDWHGSEVAVKILMEQDFHAERFKEFLREVTIMKRLRHPNIVLFMGAVTKPPNLSIVTEYLSRGSLYRLLHKPGAMEALDERRRLNMAYDVAKGMNYLHRRNPPIVHRDSKSPNLLVDKKYTVKVCDFGLSRLKANTFLSSKSAAGTPEWMAPEVLRDEPSNEKSDVYSFGVILWELATLQQPWGNLNPAQVVAAVGFKNKRLEIPRDLN

SEQ ID NO: 24466 - protein, 358 aa, Pseudomonas syringae
MPAPLTDTPEDGTREQWYVACTQKQLRQGKPYRATILGLNIVLFRQRSGQAAALLDQCVHRGTRLSAGKITDDCLVCPYHGWRYDANGHVVHIPSVDAGQGEPKSPGYRYRQRHFAVCEQDGLVWVYTGAGDAHDTPIFRLPAYGERPWQSYFMINTFDADVGSLVQNFLDVPHTVFVHEGIFRSSSGRAMEATLACKAQSIEVVYHDEVDEIGLMQWLTNPDGEPLVHTDRFLAPNVTFCDYLWGARSGFLIVSQITPVNARQSRVYTYIAYRFPMPRWVLRMLRPFIHLYTHIVIQQDVKIIRAHREGLDNVANFKPCNVPADAIHVGVEQLLAAVRHGEALPEAQRRERRIRFEL

SEQ ID NO: 24467 - protein, 139 aa, Salmonella typhimurium
MNTVCTHCQAINRIPDDRLQDAAKCGRCGHELFDGEVINATGETLDKLLKDDLPVVIDFWAPWCGPCRNFAPIFEDVAEERSGKVRFVKVNTEAERELSARFGIRSIPTIMIFKHGQVVDMLNGAVPKAPFDSWLNEAL

SEQ ID NO: 24468 - protein, 227 aa, Triticum aestivum
VAAALELVGPPGCRRRPARCYRCCRGKPYPKSRYNRGVPDPKIRIYDIGRKKAPVNQLPYSVHIVSDEVEQISSEALEAARIACNKYLTKHVGKDNFHLRCRVHPWHVIRINKMLSCAGADRLQTGMRQAFGKSYGKVARVKIGSILYSVRLDKQHVKPALEAFRRAKNKFPGRQKIIVSNKWGFTQLTRLDFQKRWAEGTIKSDGCSVRLVRPKGPLALNPLFQTA

SEQ ID NO: 24469 - protein, 349 aa, Gibberella zeae
MSPLWVRRLCIRVVDSLYGSFLYLPLAILFLKRSVTGFGTGEWDESQIPKLDGKVAVVTGGNAGIGYYTVKHLASRGAKVYLGARSESRAKAAIKRLLEENPLIPQENVVWLRLDLANQSQVVDAAVELQSKEQRLDILVNNAGIDPYDYIRTADGFEMTMAVKYTNPAAAAQEESDVRVITVSSSGEAYSSPTNQFTSPKDLDDPCASPGWENSCLGQAMRYGTTKLANVLFASELQRRMDEEDANIISLSLNPGTVRTDGAANVMPFMVRPLVRFLFTAPERGADTSLFAATAEEIKENSERWKGRYLDGPGRIKVPSLRARDAVAGRNLWNITEAAVRGTGALDRL

SEQ ID NO: 24470 - protein, 127 aa, Bdellovibrio bacteriovorus
MKKQKKKTLALIAHDGKKALMVSFVRDHLETFKNFTLVGTGNTGRLIQAAGLKVTRRLSGPLGGDAQIAAEVATGKCQGVIFFRDPLGMHPHDPDISMLMRICDVHNVPLATNPATAELLITGLSHD

SEQ ID NO: 24471 - protein, 440 aa, Rhodopirellula baltica
MNHIETRLPLPIQPIDRWLRPFARFLHIEATSGLVLILCTVVALVAANSSWADSYLAFWHTDLTIAVGDIVFHHSLHHVINDGLMAVFFFVIGLEVKRELAHGSLSDLKQATLPIAAAIGGMIVPATLYLSMQYGQPGVQGWGIPMATDIAFVVGCLAILGSRVPHSLRVLLLSLAIVDDIGAILVIAIGYTESLDGRYLFLAAVAVGAVHFLSRIGVRRFPPYVIVGVLAWIALHESGIHATLIGVILGLMTPATPTLVPERFREYLHEKEHEFQPKEWSRRLHRAEVVREVQQLTRETVSPLEYLEVTLHPWTAYVIMPVFALANAGVLIEPANLSDSVAIAVVIGLVVGKPLGIALFSWLVIRLGVARLPSGLNWPILMSGSFLAGIGFTMALFIDGLAFGADGLDTAKTGVLVGSAISAIAGMGLLLWTLPKPTRQ

SEQ ID NO: 24472 - protein, 472 aa, Lactobacillus plantarum
MTLNKVKYRDFIAPLLVGLIIWLSSPIKPASVSMNAWHILAIFVATIIGCITRPLPIAGVAIIGLTLTVLLGIVPMDTAVAGFGSSTVWMIAMAYFMSRGFINTGLGRRVALVFVRLFGKRTLGLAYALIGVDLVTAPATPSNTARAGGIVYPIIQSLAETFGSDPKDGTQSKIGSFLVFAEFHGDLITSTMFMTAMAPNLVAVTLAKSLHITLSWMQWFLAGIVPGLICLLVVPYLIYKMYPPEIKDTPNAKQWADDELAKMGKMSLPEKIMGGVFLLALVLWMLSSFIGLEASLVAFMAVSLLLVAGVLSVDDVLHETGAWNTLVWFSILIFMANELNKLGFIPWLSGAIGGALKGFSWGIVLAALVLFYFYSHYLFASGTAHVSAMYGALLGVAVSAGAPATFAALILGFTGSIFASTTHYANGPASVLFGSGYVTQGKWWQLNFILGLFYLVVWGGIGALWMKVIGIW

SEQ ID NO: 24473 - protein, 389 aa, Methanosarcina mazei
MATKRDYYEILGLSKDSSVEDIKKTYRKLALQYHPDRNKEPGAEEKFKEISEAYAVLSDAEKRAQYDRFGHAGIDNQYSAEDIFRGADFGGFGDIFEMFFGGGRRGGPMGPRRGSDLQYDLYVTFEEAAFGVRKDIDIPRTERCSTCSGTGAKPGTSPKRCPNCGGTGQVRTTRSTLGMQFVSTTTCSACHGRGQVVESPCPTCSGAGRVRSRRKMSVNVPAGADSGMTLRLSGEGDAGEPGAPSGDLYIIVHVMEHKYFKRVDYDVISELPISFTQAALGADIMVDTLYGKVKMNIPSGTQTHSVFRLKDKGIQRLQGHGKGDQLVRVIIRTPTKLTQEQKDLLHQFEYLSNGKKPEAEERSRSDKQKSEKPRKSKGLFEKVKDAFES

SEQ ID NO: 24474 - protein, 389 aa, Zygosaccharomyces rouxii
MSAAADRLNQTSDILSHSMKKTDTSMSIVTAENPYKVAVVGPGNWGTTIAKVVAENTKEKPELFQGRVDMWVFEEQIDGTPLTQIINTKHQNVKYLPNIDLPENLVANPDLISTTKDADVIVFNVPHQFLGRIVSQMKGQIKPDARAISCLKGFEVGPKGVQLLSDYVTQELGIQCGALSGANLAPEVAKEHWSETTVAYQVPDDFKGEGKDIDHRVLKQLFHRPYFHVNVIDDVAGISIAGALKNVVALGCGFVTGLGWGNNAAAAIQRVGLGEIIKFGRMFFPESKVETYYQESAGVADLITTCSGGRNVRVATEMAKTGKSGEQVEKDILNGQSAQGLITAKEVHQWLESSGHTEEYPLFEAVYQITYENVPMKELPSMIEELDLH

SEQ ID NO: 24475 - protein, 87 aa, Arabidopsis thaliana
  misc_feature (21)..(21): Xaa can be any naturally occurring amino acid
AVVTSPDQATRGAPFSGLKSXSAAFPVTRKASKDITSITSNRGRVSCMNVWAPIGKKKFETRSKLPDLTDVELAKGVDYLLRNMWIP

SEQ ID NO: 24476 - protein, 584 aa, Cucumis melo
MRKPVGALLHDRRAVRVPISGRNHLYKVSISLVFILWGLIFLFSLWISRGDGCQEGSILLPDGVSTTNESKLENNKDSDVLCEPPNGESHCTIHLNNSCSINASSPGSDNEILSSEESSSHIQATTRLPEDESSSTRVKPESKPPKGDISSDTVLLGLEEFKSRAFVSRGKSETGQAGNTIHRLEPGGAEYNYASASKGAKVLAFNKEAKGASNILGKDKDKYLRNPCSAEEKFVVIELSEETLVVTIEIANFEHHSSNLKEFEVHGSLVYPTDVWFKLGNFTAPNAKHAHRFVLKDPKWVRYLKLNFLTHYGSEFYCTLSTVEVYGMDAVEMMLEDLISAQHKPSISDEATPDKRVIPSQPGPIDEVSHGRELQSLANEEGGDGVDLELSKSNTPDPVEESHHQQPGRMPGDTVLKILTQKVRSLDLSLSVLERYLEDLTSKYGNIFKEFDKDIGNNNLLIEKTQEDIRNILKIQDNTDKDLRDLISWKSMVSLQLDGLQRHNSILRSEIERVQKNQTSLENKGIVVFLVCLIFSSFAIFRLFLHIVLRVYERTNNSRKFCCISPSWYLLLLSCCIILFVQSL

SEQ ID NO: 24477 - protein, 295 aa, Vibrio cholerae
APANRDILLALFHADGSYETHQLEHEYAGVKHTHISGIHAGQKYGYLIQLNDELHYISDPYARALEGPLHYAPPFDSHKSFDLPKCVVTDTHFDWQNVAKPRIARDEMVLFETHVKGLTQLNPDVEKALRGKYLGLVSQPMLDFYRQQNINTLQLLPIAACMHEPHLLESGKVNYWGYNPYVFMAPDPRYASKDAVNELKTTIRELHRNGIQVILDVVYNHTAEGGTNGPVFNLKALDPNYYLHHGDHYANYTGCGNTVDLSNQAALNLVMDTLRCWVTEYQIDGFRFDLAATLG

SEQ ID NO: 24478 - protein, 243 aa, Brassica napus
  misc_feature (217)..(217): Xaa can be any naturally occurring amino acid
MVSHQMEKASNGTSALETQTAELDQPAALRKIISVSSIAAGVQFGWALQLSLLTPYVQLLGIQHKWASLIWLCGPISGMLVQPIVGYHSDRCTSRFGRRRPFIVAGAGLVTVAVFLIGYAADLGHSMGDQINKPPRTRAIAIFALGFWILDVANNTLQGPCRAFLADLSAGNAKKTRTANAFFSFSMAVGNVLGYAAGSYRDLYKMVPFTMTESCDXLYCANLKTCFFLSITLLVLVRFGSLW

SEQ ID NO: 24479 - protein, 154 aa, Zea mays
MAAATALVSSSSLRAPAAFSVVVRAASRPAPVVAVVTPLPAAKAAAARGARLRAQATHNVKLITPDGEVQLKMPGDVYILDYAEEQGLDLPYSCRAGACSSCVGKIVSGSVNQFDQSFLDDDQVAEGFVLTCIAYPTSDLVIQTHKEDALVESY

SEQ ID NO: 24480 - protein, 165 aa, Ureaplasma parvum
MIKSIWIAGGCFWGIQKYFDSIIGVNHTVVGYSQGNVINPSYEQVCTQTTNHTETVQIDYDDRFVSLISILEHLYQIIDPFSLNKQGDDVGSQYRSGIYYVDHDDEFIIKDFLLKKQNQTPKKIMIEVERLRNFNIAEEYHQKYLDKNPNSYCHVDLSLSKKEFR

SEQ ID NO: 24481 - protein, 466 aa, Zea mays
MSDIKVLNASLADSDPELYDLIKKEKKRQLSGLEMIASENFTTMPVLQCLSTCLHNKYSEGLPGQRYYGGNEFIDEIEVLAQKRALQTYKLDADKWGVNVQPYSGSPGNFAVYTGIVEPHGRIMGLDLPDGGHLTHGFFTPTKKISATSIFFESMPYKVNPDTGLIDYDQLAKSARLFRPKVIIAGVSCYSRPLDYKRFREICDEVGAYLVSDMAHISGLVAAGVTPSPFEYSDVVTTTTHKSLRGPRAGVIFFRKGVRSVNAKGDKIMYDLESRINQAVFPGLQGGPHNNTIAAIATAMKQAATPQFVEYAKQIVANAQRLSDRLQEAGYKVVTGGTEVHMLLVDLRSKGLTGAKGEFILEEINIACNKNTVPGDKSALNPSGIRLGTPALTTRGLKEADIDQVVKLMDDALKLGKEISDKSGPKLVDFKKLCHEDATFSKKIRELKERVAQFSTKFPLPGYDEC

SEQ ID NO: 24482 - protein, 645 aa, Fusobacterium nucleatum
MYYNFNHYINLGANLEKDGCSFAIYAKNVNSLSLNIFHSSEDTVPYEKHILSPSEHKLGDIWSIFLENIKEGTLYNWEINGMAILDPYALAYTGNETIENKKSIVLARVGTETKHILIPKKDMIIYESHIGLFTKSSSSNTLNGATYSAFEEKIPYLKNLGINVVEFLPIFEWDDFTGNLDRESFFLKNVWGYNPINFFALTKKYSSSKDENSANEINEFKKLIFSLHKNGIEVILDVVYNHTAEGGTGGKVYNFKAMGENIFYTKDRENYFTNFSGCGNTLNCNHKVVKDMIIQSLLYWYLEVGVDGFRFDLAPVLGRDSNNQWARHSLLHELIEHPILSHAKLIAESWDLGGYFVGAMPSGWCEWNGAYRDTVRQFIRGDFGQVPELIKRIFGSVDIFHANKNGYQSSINFICCHDGFTMWDLVSYNLKHNILNGENNQDGENNNHSYNHGEEGFTENPHIISLRKQQIKNMILILYISQGIPMLLMGDEMGRTQLGNNNAYCQDNPTTWVDWDRKKDFEDVFLFTKNMINLRKSYSIFKKETPLIEGEEVILHGIKLYQPDLSFHSLSIAFQLKDIKSNTDFYIAFNSYTEQLCFELPILENKSWYILTDTSKVDTCNFQETKCQDTHCCVLPKSSVILISK

SEQ ID NO: 24483 - protein, 73 aa, Chlamydia trachomatis
MAKKEDTIVLEGRVEELLPGMHFRVMLENGVPITAHLCGKMRMSNIRLLVGDRVTVEMSTYDLTKARVVYRHR

SEQ ID NO: 24484 - protein, 267 aa, Streptococcus thermophilus
MKRNFDSVKRLVIKIGTSSLVLPSGKINLEKIDQLAFVISSLHNKGIEVVLVSSGAMGFGLNVLDLEKRPAEVGKQQAVSSVGQVAMMSLYSQVFSHYQTKVSQLLLTRDVVEYSESLANAINAFESLFELGVVPIVNENDAVSVDEMDHATKFGDNDRLSAIVAKVVGADLLIMLSDIDGLFDKNPNVYEDATLRSYVPEITEEILASAGGAGSKFGTGGMMSKIKSAQMVFENQSQMVLMNGENPRDILRVLEGAKIGTLFKQED

SEQ ID NO: 24485 - protein, 379 aa, Unknown
  Frankia sp. CcI3
MAVDYYAVLGVRREASNDEIKRAYRKLARELHPDVNPDPDAQQRFRGVTAAYEVLSDPEKRQIVDLGGDPLAPGGSGGGGSPFGAGFGGLGDIMDAFFGGGSSRGPRSRVRRGNDALLRIELDLSETAFGATREITVDTAAVCSTCTGAGAAPGTHPSTCGTCGGRGEVQQVTRSFLGQMVTSRPCPRCSGTGTVIEHPCRDCGGDGRVRKRRTLTVKIPSGVEDGMRIRLSGEGEVGPGGGPPGDLYVEVSEKQHPVFTREGDDLHCELPLPMTSAALGTSATLETLDGTETIAVKPGTQPGEVIKLAGRGVPHLRAAGRGHLHIHINVETPTKLDGEQERLLRELAKLRDEEAPAVVGGSAGGAAGLFRRRGTRRGR

SEQ ID NO: 24486 - protein, 473 aa, Fusobacterium nucleatum
MLSNNLKKETEKEKDLLENIQLIDMNGNDYTFSRDKNIYIKFWASWCPTCLAGLEELDRLAGETNNFEVVTVVFPGINGEKNPAKFKEWYDTLDYKNIKVLYDTDGKLLQIFKIKALPTSAIIYKDLIIDNIIVGHISNGQIKNYYEEKGENITMENNTKNIKEIYLAGGCFWGVEEYFARIDGVIDSVSGYANGSFDNPSYENVCNNSGHAETVHITYDSTKVSLDTLLKYYFRIIDPTSVNKQGNDKGVQYRTGIYYQNEEDKQIALNAIKEEQKKYSKPIVVEIEKLKRFDKAEEYHQDYLKKNPNGYCHINLNKASEAIIDEKKYQKPSDEVLKEKLSTLEYQITQEAATERAFTHEYYKNQEDGIYVDITTGEPLFSSKDKYDAGCGWPSFTKPIATEVVNYKKDSSHGMNRVEVRSRAGEAHLGHVFEDGPRDRGGLRYCINGASLRFIPYDKMDEEGYGEFKKYVK

SEQ ID NO: 24487 - protein, 555 aa, Alteromonadales bacterium
MSENFAQLFEESLKGFEAEQGSIVKGTVISIENNIVLVDAGLKSESAIPAEQFKNAAGELEVAVGDEVDVALDAIEDGFGETILSREKAKRHEAWIRLEKACEEQETVTGVINGKVKGGFTVEVDSIRAFLPGSLVDVRPVRDTTHLEGKELEFKVIKLDQKRNNVVVSRRAVIESENSQEREELLANLVEGQEVKGIVKNLTDYGAFVDLGGVDGLLHITDMAWKRVKHPSEIVNVGDEIAVKVLKFDKDKTRVSLGLKQLGEDPWAAIAGRYPEGSKLSGRVTNLTDYGCFVEIEEGVEGLVHVSEMDWTNKNIHPSKVVSLGDTVEVMVLEIDEERRRISLGLKQCIANPWQEFARLQNKGDQVTGKIKSITDFGIFIGLDGGIDGLVHLSDISWNTPGEEAVREFKKGDEITAIVLQVDPERERISLGVKQIEADPFNNYLDANKKGAIVKGKVTEVDAKGATVELIEGVEGYIRVADIAQERVEDATTVVSVGDEVEVKYVGVDRKNRTLSLSVKALFEAEEKEVLEKLKKEEPVFENAMAAAFANAQKD

SEQ ID NO: 24488 - protein, 307 aa, Unknown
  Oceanospirillum sp. MED92
MFNPVSLPISRISDPVLSANGISLDMLRLDLTDEVISGNKWFKLKYNLMDAKSRGCKAVLSFGGAYSNHIHALAKAGLDLGIRTIGVIRGEPEYAKNPTLSDAIDWGMELHFVNRKDYRLRSDPGFLSHLREQYDCPYIVPEGGSNALALKGAMEILPSELIEFVCPDHVILPCGTGGTLSGIALSCRDTPVLGIPVLKNAGFLYDDISALMGLVTDNVPDNWSLDLEGHFGGYGKVSDQLLQFMQSFEVNNQIQLDPIYTAKMMLRIFQRIELGEYSRGSRLLAIHTGGLQGRRGAGCSAVPANCT

SEQ ID NO: 24489 - protein, 447 aa, Escherichia coli
MDQTYSLESFLNHVQKRDPNQTEFAQAVREVMTTLWPFLEQNPKYRQMSLLERLVEPERVIQFRVVWVDDRNQIQVNRAWRVQFSSAIGPYKGGMRFHPSVNLSILKFLGFEQTFKNALTTLPMGGGKGGSDFDPKGKSEGEVMRFCQALMTELYRHLGADTDVPAGDIGVGGREVGFMAGMMKKLSNNTACVFTGKGLSFGGSLIRPEATGYGLVYFTEAMLKRHGMGFEGMRVSVSGSGNVAQYAIEKAMEFGARVITASDSSGTVVDESGFTKEKLARLIEIKASRDGRVADYAKEFGLVYLEGQQPWSLPVDIALPCATQNELDVDAAHQLIANGVKAVAEGANMPTTIEATELFQQAGVLFAPGKAANAGGVATSGLEMPQNAARLGWKAEKVDARLHHIMLDIHHACVEHGGEGEQTNYVQGANIAGFVKVADAMLAQGVI

SEQ ID NO: 24490 - protein, 122 aa, Zinnia elegans
DKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGF

SEQ ID NO: 24491 - protein, 194 aa, Oceanobacillus iheyensis
MRKASLSRKTNETSVHLTLELDGEGTSTIETGIGFFDHMLTLLAKHGGINLDLSCDGDLEVDQHHTVEDIGIVLGQTLREALGNKEGITRYANVMSPMDEALSSIAFDISGRSYLVYNVEGLKEKVGTFDTELVQEFFQAFASNAQVTLHINLLYGVNSHHIIESIFKGFGRVIRQGCSIDLNQKGIPSTKGSL

SEQ ID NO: 24492 - protein, 464 aa, Xanthomonas oryzae
MTVVSVEHALAGKLPEGGEVTVRGWVRTLRGSAGLAFINVTDGSCFAPIQVVANDTLPNFDEIKRLTSGCSLIAKGVLVKSQGKGQSFEIQASGVEIVGWVEDPLTYPIQPKPMTPEFLREVAHLRPRTNLFGAVTRIRNCLAQAVHRFFHQNGFNWISTPIITTSDAEGAGQMFRVSTLDMVNLPRDATGNVDFSRDFFGKETFLTVSGQLNVEAYCLALSKVYTFGPTFRAENSHTTRHLAEFWMIEPEIAFADLAEDARLAEQFLKYVFRAVLDERGDDLAFLAERVDKNAISKLEAFINAPFEQIDYTDAVKLLQHAGKTFDFPVEWGLDLQTEHERWLTEEHIGRPVVVTNYPEHIKAFYMRLNDDGKTVAAMDVLAPGIGEIIGGSQREERLDVLDARMAQFGLDKEHYSWYRDFRRYGSVPHAGFGLGFERLVVYVCGLSNIRDAIPYPRAPGSAEF

SEQ ID NO: 24493 - protein, 334 aa, Unknown
  Sulfitobacter sp. EE-36
MAETRETKLLIIGSGPAGYTAGVYASRAMLNPILVQGIEPGGQLTTTTEVENWPGDSEVQGPDLMIRMQDHAKAMGTEIIGDIITDLDLSSRPFHAKGDSGTTYVADAVILATGARAKWLGLETEEKFKGFGVSACATCDGFFYRNQEIVVIGGGNTAVEEALFLTNFASKVTLIHRRDELRAEKILIDRLMKNPKIEPLWFHQLDEVYGTDAPLGVEGVKVKHVETGEITDIPCKGVFVAIGHAPANELVKDTLETHMGGYVVTKPDSTETSVPGVFAAGDLTDHKYRQAVTSAGMGCMAALEAERFLAEVGDDEGKDTSLPLGYGAEVKDDA

SEQ ID NO: 24494 - protein, 259 aa, Oryza sativa; identical to SEQ ID NO: 357

SEQ ID NO: 24495 - protein, 69 aa, Phaseolus vulgaris
KNYTYSLEVGGNGRKMIWQGVPRSIRDSHRKVRDSFDGLIIQRSMALFFSGGDKKELKLRVTGRIWKEQ

SEQ ID NO: 24496 - protein, 715 aa, Unknown
  Rhodococcus sp. RHA1
MSPHIDSHPGKMSSLPPSLRLPGSPFPLGAKVRGTGTQFAVHAPDAELVQVCLISGDGDEMRIDLVQRTYGIWHGIVEGVGAGQRYGYRTHGRWDPARGVRLNPAKLLLDPWATRITGKLGDHDALVSHDGDPFGGPSRVDSLGHTPLSVVTADHARTSGPRIERPWEETVVYELHVGSFTARHPDVPPQYRGTYLGLAEPAVVGHLVRLGVTAVELLPVQAYVSEATVRSRGMRNHWGYSTAAFFAPHPGYAVVPGEEITEFHTMVDALHAAGIEVILDVVYNHTCEQGVDGISLSWRGLDAPGYYLLDSDGRDIDITGCGNTVDAQSPVVVRMIGDSLRYWAHEMGVDGFRFDLASALGRPGGGRFDSRASIFSAITADPVLSRCKLIAEPWDATSDGYRVGHFGVQWSEWNDKYRNTVRRFWNGGTGVRDLASRVAGSEDLFGNRRPWASVNFVTAHDGFTAADLVSYVRKHNEANGEDNRDGADHNDSVDHGVEGPTDDPSIIETRSRHVRALLATLALSTGTPMFTAGDEFGHTLGGNNNAYCVPEDTPREDSWPLDWSTGDTTLTAFVTRALDLRRASPALRQPEFFEGRRTPTGHPDLVWFGADGAEMDDPAWYDDSRRTLQAWIDGSDIRSHTEDGRQLTDDSWLLVFHSGGPAVITLGCPEWFYGTVLAEFDSTSPDGAPAPGGPISGDSTIALSGPTLLVFRAVG

SEQ ID NO: 24497 - protein, 479 aa, Alkalilimnicola ehrlichei
MGDATLVWLRRDLRLTDNPALDQAARRGGPVIAVYLHAPEETPQYPPGAASHWYLHHSLKALGPALAQAGIPLVLRRGPALATLRALIRATGAGAVYWNRLYEPDAVARDRTVKQALRTEGLDCRSFPTALLHEPWAVRNQADRPYRAFTPFWRACRRQPPPAAPLPAPDLRDRPVPAVEGLDLAALGLLPRTPWDTGLRNTWQAGESAALARLEAFAADRLARYAQDRDRPAEPGTSGLSPALHFGELSPRQVWWQVMAAREAGVPEDACETFLSELGWREFAHHLLWSHPDLGDAPVDDRFGAFPWRPDPGDGWLHAWQAGRTGIPLVDAGMHELWQTGWMHNRVRMVTGSFLVKHLRLPWQRGERWFRDTLVDWDAASNAMGWQWVAGCGADAAPYFRIFNPVRQGERFDPQGRYVRRWLPALANLPDKYIHAPWTAPEAVLRRAGVTLGSDYPCPLIDLRLGREQALSAFQAIKG

SEQ ID NO: 24498 - protein, 158 aa, Arabidopsis thaliana
TNQTRQSQQSKASNFSLSRILKMARTKQTARKSTGGKAPRKQLATKAARKSAPATGGVKKPHRFRPGTVALREIRKYQKSTELLIRKLPFQRLVREIAQDFKTDLRFQSSAVAALQEAAEAYLVGLFEDTNLCAIHAKRVTIMPKDIQLARRIRGERA

SEQ ID NO: 24499 - protein, 628 aa, Unknown
  Petunia x hybrida
MAMGCKDHNGVPDNLREQLAFAVRGIQWSYAILWSTTVSQPGELEWSDSNYNGDIKTRKTVQAGEVDEDQLGLQRTEQLRDLYSSLLIGEGEEDLQPQAKRPSAALSPEDLTDTVWYFLVCMSFVFNVGQGLPGKSLARHETIWLCNAHQAESSVFSRSLIAKSASIQTVVCFPYLGGVIELGVTELVVEDPNLIQQIKISILKVDHSIIPKRPNYVSSDAKNDAIGLCPKPDHNVLENDAYTVEINNSSPHDSSNGFGANQEVEVSLMVVGVIGETSQAQSWKFTDDNMSNGVHNSLNSSDCTSQNYANCEKLSPLSSGEKETKPAPLDHQEHNQRKLHLLDHQGDETQYQSVLSTLLKSSDQLTLGPYFRNTNKRSCFSGWKNDAHIPSRGTAQKLLKKVLVEVPRMHGSVIHKFSRENRKRNGLWRPEVDDTDRSRVISERRRREKINERFMLLASMLPAGGKVDKISLLDETIEYLKELERRVQDLEAKSGRRPNDVAEQTSDNCGTSKFNAIEESLPNKRKACEIVDLEPESRNGLLKGSSTDSIVINMIDKEVSIKMRCLSSEGLLFKIMEALTGLQMDCHTVQSSNIDGILSISIESKTNVSKTVSVGTIREALQRVVWKS

SEQ ID NO: 24500 - protein, 238 aa, Arabidopsis thaliana
MMKQARSLLSRSLCDQSKSLFEASTLRGFASWSNSSTPGRGFPGKDAAKPSGRLFAPYSIFKGKAALSVEPVLPSFTEIDSGNLRIDRRGSLMMTFMPAIGERKYDWEKKQKFALSPTEVGSLISMGSKDSSEFFHDPSMKSSNAGQVRKSLSVKPHADGSGYFISLSVNNSILKTNDYFVVPVTKAEFAVMKTAFSFALPHIMGWNRLTGHVNTEALPSRNVSHLKTEPQLELEWDK

SEQ ID NO: 24501 - protein, 484 aa, Staphylococcus aureus
MEDNKMNRSLNSRHISMIAIGGAIGTGLFVATGNIISQAGPGGAILAYLVIGVMLYFLMSSIGELATFYPVSGSFSSYSTRFIDSSLGFTMGWLYWALWSLVTSVDVIVASNVLYFWDTFKFFHPITWSLIFITILLLLNIFSVKSFGETEFWLSLIKVLTIIVFVIFGFLMIFGILGGHTYGFENYTKGQAPFVGGISGFLGVLLVAGFSVGGTEVVAVTAGESDDPKKSMPKAIKQVFWRILLFYVLSIAVIGAIIPYTDPSLLRASSSISQSPFTIVFDRVGIAFAASVINAVILTSLLSAANSGVYTTGRMLYSLSSDKKAPQFLSKLNKTTKLPLRALLTTYAVVVIVIIYANFNSNAVFNLLEIIGSMIIVVWGSSIWSQIRLRQAIKKQGQDPNKVLPYKAPFYPLGPIIVITTLLFLLFGGSVEYILKDQWLNAFKNFLPLIILALIYFIHKIIHKTKFVKLETINLKPHDYDNQK

SEQ ID NO: 24502 - protein, 136 aa, Ustilago maydis
MARTKQTARKSTGGKAPRKQLATKAARKSAPSAGGVKKPHRYRPGTVALREIRRYQKSTELLIRKLPFQRLVREIAQDFKTDLRFQSSAVMALQESAEAYLVSLFEDTNLAAIHAKRVTIQPKDIALARRLRGERT

SEQ ID NO: 24503 - protein, 383 aa, Buchnera aphidicola
MSKQDYYKTLGVTQSSDEREIKRAYKKLAMKYHPDRNPGNKNSEEKFKTIKEAYEILIDPKKRTAYDQYGHSAFEQGNSTGNNNTFTHSFSSNSDFSDIFGDVFGDIFGGTRKQKSERQGSDLRYDMTLTLEEAVRGTIKEIKIPTLQKCPTCYGYGTKTGTKPQFCPTCRGNGQIQMRKGFFTVQQTCPQCHGEGNFIRDPCRRCHGNGRIEISKTLSVKVPPGVDTNDKIRLNNEGEAGENGAMAGNLYVQINVKKHPIFEREENNLYCEVPISFSMAALGGEIEVPTLDGKVKLKIPCETQSGKLLRIRGRGVKSIRNNNRQGDLLCRIIVETPVNLNDLQKDLLYKLGESFNGFKGEKNSPKSKRFFEGVKRFFDDLTR

SEQ ID NO: 24504 - protein, 196 aa, Desulfovibrio desulfuricans
MTRRAATVTRTTTETAISLSLTVDGKGEVSVTTGHGFTDHMLTLLGFWAGFDLTLTCNGDTHVDAHHTVEDAGLCLGQAFAQALGDRKGIARVGNARVPMDEALTEVDLDISGRPYLVYRGDELLPPVIAGDEADLWREFFKSFANGARINLHISLLYGKNGHHLLESAFKGLGLALRRAAACEREALLSTKGSLD

SEQ ID NO: 24505 - protein, 995 aa, Listeria monocytogenes
MGAKVSVQINGVARDVVEGTRILDYLNAEGIQHPHICYSEQIGPIQSCDTCMCEVDGELVRACSTNLTDGMEIKTNSELAKDAQLEAMDRILENHLLYCTVCDNNNGNCKVHNTTELLGVEKQERPYREKGYLNDFSHPFYRYDPDQCILCGRCVEACQQVQVNETLSIDWERSQPRVIWDDDRPANLSSCVSCGLCATVCPCNALMEKSMLGQAGFMTGLDEDMLEPMIDMVKKVEPNYQTVFAVSEMEAAMRETRTKKTKTVCTFCGVGCTFEVWTKDRKILKVEPTGEGPVNKFATCVKGKFGWDFVNSEKRITTPLIREGNEFVPASWEDAIHLVATKLREIQAKYGNDSIGFISSSKTTNEENYLMQKLARQVFETNNIDNCSRYCQAPASDGLTRTVGIGADSGTVEDIETAGLVIIVGASPADGHPVLASRIKRAQKTRGQKLIVSDLRKHEMAERSDLFMHPKQGTDFVWLTAVAKYMIDQGWHDEAFMENRISNVADYLSFLEPFTLEYAEKETGLSVEILKKVAQMVYEADGTAVCWGMGVTQNIAGSHTSSAIANLLLVTGNFGRHGAGAYPLRGHNNVQGACDMGSLPNVLPGIQPLGNDEVRARFEEAYGVSISPEPGLKNNEMLDAIEAGTLHSMYVIGEEMAWVDSNSNHVQEILASLDFFVVQDVFLSKTAQFADVVFPAAPSLEKEGTFTNTERRVQRLYEVLEPLGDSKPDWWIIQEVAKACGRTDWNYDHPSEIMDEIASLAPFFAGVRYDRMQGFNSLVWPVSADGKDMPLLYEERFNFPDGKAQFSTLPYIAPITFPEEYNLTLNNGRLLEQFHEGNLTDKSKGLDYKLPEVFVEVSHELAKERDLESGSLVRLSSPYGRIKLRAVVTERMKGNEVYVPMHSVSSETAVNLLTSSAGDVRTKTPAYKQTKVNLTVLEKTGKNPLPDHNPRNRKRFPQNGAEVARKWSREDYQPISKVNCACGGNCGCGGKRRNH

SEQ ID NO: 24506 - protein, 162 aa, Ureaplasma parvum
MERLNMKLSDYPVLDIDKKLFNWSKVKNKLVLIVNVASKCGYAKQYEQLEYLYKKYKNKGFIIVAFPCRQFMFQEFDDNNKIKEFCSTKYNVTFPIMDLTNVVGSNISPLYKQLITEYPWSPKAKAVKWNFEKFFVKNDEIIGRFESKCEPNDLEEFIKNNL

SEQ ID NO: 24507 - protein, 226 aa, Glycine max
MVQCLDGLKHLCAALVNCCDADSSKQPTGLENPEVLARETVFSVSEIEALYELFKKISSAVIDDGLINKEEFQLALFKTNKKESLFADRVFDLFDTKHNGILDFEEFARALSVFHPNAPIDDKIEFSFQLYDLKQQGFIERQEVKQMVVATLAESGMNLSDDVIESIIDKTFEEADTKHDGKIDKEEWRNLVLRHPSLLKNMTLQYLKDITTTFPSFVFHSQVDDT

SEQ ID NO: 24508 - protein, 170 aa, Elaeis oleifera
ILVKRDELTLEGIKQFYVNIEREEWKLETLCDLYETLAITQSVIFVNTRRKVDWLTDKLRSRDHTVSATHGDMDQNARDIIMREFRSGSSRVLITTDLLARGIDVQQVSLVINYDLPTQPENYLHRIGRSGRFGRKGVAINFVTRDDERMLFDIQRFYNVVIEELPSNVA

SEQ ID NO: 24509 - protein, 295 aa, Vibrio cholerae
APANRDILLALFHADGSYETHQLEHEYAGVKHTHISGIHAGQKYGYLIQLNDELHYISDPYARALEGPLHYAPPFDSHKSFDLPKCVVADTHFDWQNVAKPRIARDEMVLFETHVKGLTQLNPDVEKALRGKYLGLVSQPMLDFYRQQNINTLQLLPIAACMHEPHLLESGKVNYWGYNPYVFMAPDPRYASKDAVNELKTTIRELHRNGIQVILDVVYNHTAEGGTNGPVFNLKALDPNYYLHHGDHYANYTGCGNTVDLSNQAALNLVMDTLRCWVTEYQIDGFRFDLAATLG

SEQ ID NO: 24510 - protein, 482 aa, Cylindrotheca fusiformis
MSGTDVATGAPAEWKKYQEYSLDVDPDQDDRATEIKLCNFSRPHMRAFHFSWIGFFIAFFIWFAIAPLLSEIQDTLDLDKKEVWTSSIVGVGGTIFMRFLLGPFCDKIGPRVLFTFVLCFASIPTVCTGFVNSATSLAVLRLFIGTAGGTFVMCQYWTSRMFTKQVVGTANALVGGWGNLGGGVTQLVMGSALFPLFKEIFKNEPDPAETAWRWVSIVPAVVAFAIGLLIFFYSDDAPKGNYNEMKKNGAMSDVSAAASFRTGALNLNTWFLFKQYACCFGVELTMNNTAALYFKEKFSLTTEEAAAIASIFGWMNLFARGAGGFLSDKANARMGMRGRLWTQTILLACEGALVLVFANTGSLTGAIVVMVFFSLFVQAAEGSSYGIVPYVDPPATGAIAGIIGAGGNTGAVAFGMGFRQLDYKDAFIIMGAVICASSVLSVFICIPGSSRMIGGEADDVGAKDPTLSVPQPDTEKTQDVNA

SEQ ID NO: 24511 - protein, 295 aa, Vibrio cholerae
APANRDILLALFHADGSYETHQLEHEYAGVKHTHISGIHAGQKYGYLIQLNDELHYISDPYARALEGPLHYTPPFDSHKSFDLPKCVVTDTHFDWQNVAKPRIARDEMVLFETHVKGLTQLNPDVEKALRGKYLGLVSQPMLDFYRQQNINTLQLLPIAACMHEPHLLESGKVNYWGYNPYVFMAPDPRYASKDAVNELKTTIRELHRNGIQVILDVVYNHTAEGGTNGPVFNLKALDPNYYLHHGDHYANYTGCGNTVDLSNQAALNLVMDTLRCWVTEYQIDGFRFDLAATLG

SEQ ID NO: 24512 - protein, 968 aa, Saccharophagus degradans
MKRMLINATQPEELRVALVDGQWLYDLDIENRLREQKKANIYKGRITRVEPSLEAAFVDYGSERHGFLPLKEISREYFAKQPKDIDGRIRIQDVVKEGMEVIVQVDKEERGNKGAALTTFISLAGRYLVLMPNNPRAGGISRRIDGDDRTELKDALSQIDVPAGMGIIVRTAGVGRRAEELQWDMNYLAQLWASIKTAAEEKTAPEFLFQESNVIIRAIRDYLRPDIGEVIVDNQDAYNLATAFVEQVMPNYRSKVKLYEEPLPLFNRFQIESQIETAFEREVKLPSGGSIVIDVTEALISIDINSSRATKGGDIEETALQTNLEAADEIARQLRLRDMGGLVVIDFIDMQPVRNQREVENRMRDALEMDRARVQVGRISRFGLLEMSRQRLRPSLGETTSKVCPRCSGQGTIRGTKSIALSILRLVEEEAQKERSAEIRAVVPVAVATYLLNEKRKVISGIEERQKTRIVIIPSEKMTTPHFDVQRLRDDDVVSSEISYKIEVPQGEDEEKIQDDAAALAKLPRPAVQAIPPAQPAPEAPKPDSLLTKILKKLKELFKTDDKKRKNTSKNSRGQQRRRGNNSQNNRNRNRNRNGRGNDNRNKNRDDEITDNLSSRTKSDQSQQGQGPSSDDNRPDRGNRKRGNRRRNNNRRNDQDRNDSPESNNDEQQNNNQPQEQNNAPKEQGPNRRPNGRRGRGGRERKREPVPQAAEESVTKDDSALAAEVTSAIDTAEKAFATNSPAELKQAKSEAKEQAKSEAKEQAKSEAKEQAKQERAPQEAAITAETPSEAKQPEATATAAEAKPEPSEKAKASQAPQAAEASDTTETVAETKVEAPSAEAAPAKEAPVETAAETASEAETAEPVAAAETAEVAEVAVAEATEEASEAKEELAPAQAVRKQYSRATNDPRATPKPVANTLVSNVVTQIRMSRPLDTTQPANILRNPRDLSRPANDPRLKRNIEEVASDA

SEQ ID NO: 24513 - protein, 482 aa, Cylindrotheca fusiformis
MSGTDVATGAPAEWKKYQEYSLDVDPDQDDRATEIKLCNFSRPHMRAFHFSWIGFFIAFFIWFAIAPLLSEIQDTLDLDKKEVWTSSIVGVGGTIFMRFLLGPFCDKIGPRVLFTFVLCFASIPTACTGFVNSATSLAVLRLFIGTAGGTFVMCQYWTSRMFTKQVVGTANALVGGWGNLGGGVTQLVMGSALFPLFKEIFKNEPDPAETAWRWVSIVPAVVAFAIGLLIFFYSDDAPKGNYNEMKKNGAMADVSAAASFRTGALNLNTWFLFIQYACCFGVELTMNNAAALYFKEKFSLTTEEAAAIASIFGWMNLFARGAGGFLSDKANARMGMRGRLWTHTILLACEGALVLVFANTGSLTGAIVVMVFFSLFVQAAEGSSYGIVPYVDPPATGAIAGIIGAGGNTGAVAFGMGFRQLDYKDAFIIMGAVICASSVLSVFICIPGSSRMIGGEADDVGAKDPTLSVPQPDTEKTQDVNA

SEQ ID NO: 24514 - protein, 426 aa, Brucella melitensis
MVKADMTKDIAQVMAEVGRKAKAAAAPLSIATNEQKNKALNAAADAILEARADILEANRLDLANAEKNGMAASFVDRLTLNEARIDAIAEGIRAIATLPDPVGEVIAEWDRPNGLHIERVRTPLGVIGVIYESRPNVTADAGALCLKAGNAVILRGGSDSAHSSAAIYKALVKGLEAANLPADAIQIVPVTDRAAVGEMLKGLGGAIDVIVPRGGKSLVARVQSEARVPVFAHLEGICHLYIDKSADLDMARRIALDAKMRRTGICGAAETLLVDRAVASTHLAPILGDLAAGGCEIRGSAEVLALYPAAKPATEEDWSTEYLDAIISVALVDGISGAIDHINRYSSHHTEAIVAEDAQTVARFFNEIDSAILLHNASTQFADGGEFGMGAEIGIATGKMHARGPVGVEQLTSFKYRVRGSGQVRG

SEQ ID NO: 24515 - protein, 295 aa, Vibrio cholerae
APANRDILLALFHADGSYETHQLEHEYAGVKHTHISGIHAGQKYGYLIQLNDELHYISDPYARALEGPLHYAPPFDSHKSFDLPKCVVTDTHFDWQNVAKPRIARDEMMLFETHVKGLTQLNPDVEKALRGKYLGLVSQPMLDFYRQQNINTLQLLPIAACMHEPHLLESGKVNYWGYNPYVFMAPDPRYASKDAVNELKTTIRELHRNGIQVILDVVYNHTAEGGTNGPLFNLKALDPNYYLHHGDHYANYTGCGNTVDLSNQAALNLVMDTLRCWVEEYQIDGFRFDLAATLG

SEQ ID NO: 24516 - protein, 482 aa, Cylindrotheca fusiformis
MSGTDVATGAPAEWKKYQEYSLDVDPDQDDRATEIKLCNFSRPHMRAFHFSWIGFFIAFFIWFAIAPLLSEIQDTLDLDKKEVWTSSIVGVGGTIFMRFLLGPFCDKIGPRVLFTFVLCFASIPTACTGFVNSATSLAVLRLFIGTAGGTFVMCQYWTSRMFTKQVVGTANALVGGWGNLGGGVTQLVMGSALFPLFKEIFKNEPDPAETAWRWVSIVPAVVAFAIGLLIFFYSDDAPKGNYHEMKKNGAMADVSAAASFRTGALNLNTWFLFIQYACCFGVELTMNNAAVLYFKEKFSLTTEEAAAIASIFGWMNLFARGAGGFLSDKANARMGMRGRLWTQTILLACEGALVLVFANTGSLTGAIVVMVFFSLFVQAAEGSSYGIVPYVDPPATGAIAGIIGAGGNTGAVAFGMGFRQLDYKDAFIIMGAVICASSVLSVFICIPGSSRMIGGEADDVGAKDPTLSVPEPDTQKTQDVNA

SEQ ID NO: 24517 - protein, 295 aa, Vibrio cholerae
APANRDILLALFHADGSYETHQLEHEYAGVKHTHISGIHAGQKYGYLIQLNDELHYISDPYARALEGPLHYAPPFDSHKSFDLPKCVVTDTHFDWQNVAKPRIARDEMVLFETHVKGLTQLNPDVEKALRGKYLGLVSQPMLDFYRQQNINTLQLLPIAACMHEPHLLESDKVNYWGYNPYVFMAPDPRYASKDAVNELKTTIRELHRNGIQVILDVVYNHTAEGGTNGPVFNLKALDPNYYLHHGDHYANYTGCGNTVDLSNQAALNLVMDTLRCWVEEYQVDGFRFDLAATLG

SEQ ID NO: 24518 - protein, 489 aa, Desulfovibrio vulgaris
MTTAKKGKRKMYISVLPGEQVEVALSEDGAVTEYYVEMLHQAKTKGNIYKGVINNIDTNLQAAFVNYGAEKNGFLQIDEVHPEYYISPHDPTKGKKYPLMQKVLKAGQEVLVQVVKEPTGNKGAFLTSYLSLPGRFLVLTPGREQIGVSRKVEDDEERSRLREMLEGLSAGPGLGVIVRTVSAGTSKTTLQRDLQFLKRLWKDVRKKGTTEQTPCQIYQEPDLATRSVRDYLTDDVSEVWVDDAATAELIREFVTLVFPRKASLVKLHTDPERTLWERFGIRKQLDQIYSREVILPSGGRLVFDQTEALMAIDINSGKIAGKTNFESMALKTNTEAAESIAQQLRLRDIGGQVVIDFIEMRDHNHWREVEKTLRNAMKGDRARHDVGKMSRFGLLQVVRQRTGSSALSITMEACPCCRGSGLRRNMEWQSLQALRELHRQLRALPQGQCVHVFETSPELAFYLLNHKRERLLELERRFNLRLEVRPTGK

SEQ ID NO: 24519 - protein, 356 aa, Zea mays
MATAAASSLLKSSFAGSRLPAATRTTPASLVVATGPRGAGAGPICASMSMCMSSSNPPYDLTSFRFSPIKESIVSREMTRRYMTDMITYADTDVVIVGAGSAGLSCAYELSKDPAVSIAIVEQSVSPGGGAWLGGQLFSAMVVRKPAHLFLDELGVAYDEAEDYVVIKHAALFTSTVMSLLLARPNVKLFNAVAVEDLIVRGGRVGGVVTNWALVSMNHDTQSCMDPNVMEAKVVVSSCGHDGPFGATGVKRLQDIGMISAVPGMKALDMNTAEDEIVRLTREVVPGMIVTGMEVAEIDGAPRMGPTFGAMMISGQKAAHLALKALGRPNAVDGTMSPPLREELMIAYKDDEVVDA

SEQ ID NO: 24520 - protein, 507 aa, Escherichia coli
MTQLAIGKPAPLGAHYDGQGVNFTLFSAHAERVELCVFDANGQEHRYDLPGHSGDIWHGYLPDARPGLRYGYRVHGPWQPAEGHRFNPAKLLIDPCARQIDGEFKDNPLLHAGHNEPDYRDNAAIAPKCVVVVDHYDWEDDAPPRTPWGSTIIYEAHVKGLTYLHPEIPVEIRGTYKALGHPVMINYLKQLGITALELLPVAQFASEPRLQRMGLSNYWGYNPVAMFALHPAYACSPETALDEFRDAIKALHKAGIEVILDIVLNHSAELDLDGPLFSLRGIDNRSYYYWIREDGDYHNWTGCGNTLNLSHPAVVDYASACLRYWVETCHVDGFRFDLAAVMGRTPEFRQDAPLFTAIQNCPVLSQVKLIAEPWDIAPGGYQVGNFPPLFAEWNDHFRDAARRFWLHYDLPLGAFAGRFAASSDVFKRNGRLPSAAINLVTAHDGFTLRDCVCFNHKHNEANGEENRDGTNNNYSNNHGKEGLGGSLDLVERRRDSIHALLTTLLLS

SEQ ID NO: 24521 - protein, 288 aa, Triticum aestivum
  misc_feature (22)..(22): Xaa can be any naturally occurring amino acid
  misc_feature (152)..(152): Xaa can be any naturally occurring amino acid
MSEELERDYEIGEEIGRGRFGXVRRCASRSTGDLYAVKSVDRSLLADDLDRGLAELEPKLAQLAAAGNPGVVQVHAVYEDDAWTHVVMDLCAGPDLLDWVRLRHGAPVPEPEAAAVAAQLAEALAICHRRGVAHRDVKPDNVLLDAPDGGGXGPVRARLADFGSAALVGGGEGARGLVGTPHYVAPEVVAGGEYGEKADVWSAGVVLYVLLTGGALPFSGETASDVFAAVLRGSPRFPPRLFAGVSPLAKDLMRRMMCRDVSRRFSAEQVLRKRPPARPYTTSDSFFL

SEQ ID NO: 24522 - protein, 239 aa, Psilotum nudum
MQQTNWNIELIEMLKAGVHFGHQTRKWNPKMAPHIFMERKGVHILNLIQTARFISEACDLVYNAASEGKQFLLVGTKPRIAHLISSAAIKARCHYVNYKWIGGMLTNWSTIEKRLQKLRSLEIRKRMGGLDNLSKEEAAILRGQLSKLHKYLGGILYMKNLPDIVIIVDQHKELTAIRECMILDIPTICVVDTDCDPDLTNIPIPANDDAQSSIRWILNQLTLAIREGRCHSMSPKNSK

SEQ ID NO: 24523 - protein, 557 aa, Alteromonadales bacterium
MCSIFGVLDIKSDPAQLRTQAIEMSKLLRHRGPDWSGVYASEKAILVHERLAIVGVSSGAQPLYNPEKTHILAVNGEIYNHKELAANLDTDFTFQTQSDCEVILALYKQKGPEFLDDLNGIFAFCLYDEENDAYLIGRDHIGIIPLYTGHDEHGNFYVASELKALSPICKHIEEFPPGHYLYSKDGKLKPYYKRDWQTFDAVEDNSAESSDVKDALEAAVKRQLMCDVPYGVLLSGGLDSSVISAITQRFAAKRIEDNDESDAWWPKLHSFSVGLEGSPDLAAAQKVADMIGTVHHPIIFTIQEGIDALREVIYHIETYDVTTIRASTPMYLMARQIKAMGIKMVLSGEGADELFGGYLYFHKAPNAQEFHEELNRKVSKLHMFDCLRANKSMAAWGVEARVPFLDKEFVDVAMRINPEAKMCKDGKIEKHILREGFGGYLPDEVLWRQKEQFSDGVGYSWIDTLKEYVEEQVSDQDLANAKFKYPINTPDSKEAYYYRAIFESHFPGDASAKCVPHGKSVACSTPEALAWDESFQNNADPSGRSAGVHNDAYTGKK

SEQ ID NO: 24524 - protein, 194 aa, Bacillus anthracis
MRESSQIRETTETKIKLSLQLDEGKNVSVQTGVGFFDHMLTLFARHGRFGLQVEAEGDVFVDAHHTVEDVGIVLGNCLKEALQNKEGINRYGSAYVPMDESLGFVAIDISGRSYIVFQGELTNPKLGDFDTELTEEFFRAVAHAANITLHARILYGSNTHHKIEALFKAFGRALREAVERNAHITGVNSTKGML

SEQ ID NO: 24525 - protein, 189 aa, Coprinopsis cinerea
MSTESSSGFYSLKAELPNGQTYDFEQLRGKVVLIDLLTDFKVDLLLNTKACSHFNGVLLLGVTFLPSGLQQLYEKYKDRGFTILGFPCNQFGGQEPADDAGIQEFCTVNHGVTFPLMKKSEVNGDNTNEVYQWLKSKKAGFLGLTRIKWNFEKFLVDKEGNVVNRWASTTSPSSIASEIEKLLTEEPRL

SEQ ID NO: 24526 - protein, 566 aa, Novosphingobium aromaticivorans
MASNPSRDDFAALLDESLGGAANGGFEGRVVKGTITAIENDKAVIDVGLKSEGRVALREFAAPGQPHGLKVGDEVEVYVDRVENADGEAMLSRDRARREAAWDKLESEFGEGKRVEGVIFGRVKGGFTVDLDGAVAFLPGSQVDIRPVRDVTPLMDMPQPFQILKMDRRRGNIVVSRRAVLEETRAEQRSGLIQNLKEGQIIDGVVKNITDYGAFVDLGGIDGLLHVTDMSYKRVNHPSEVIAIGDTVRVQIIRINQDTQRISLGMKQLESDPWDGVAAKYPVGAKLRGTVTNITEYGAFVELEAGIEGLVHVSEMSWTKKNVHPGKIVSTSQEVDVMVLEVDSDKRRISLGLKQAQQNPWEAFAEKHPVGSTVEGEVKNATEFGLFIGLDGDVDGMVHMSDIAWGISGEDALALHRKGEQVSAVVLDVDVEKERISLGMKQLEKGAPAAGGVASSGSLRRGEVVTVTVLEVRDGGLEVQAGEDGATGFIKRSDLGRDRDEQRPDRFQVGQKIDAMVTGFDRSKKPNFSVKARQLAEEKEAVEQYGSSDAGASLGDILGAALKAKQ

SEQ ID NO: 24527 - protein, 474 aa, Bacillus anthracis
MNGYVYLVGAGPGDEGLITKKAIECLKRADIVLYDRLLNPFFLSYTKQTCELMYCGKMPKNHIMRQEMINAHLLQFAQEGKIVVRLKGGDPSIFGRVGEEAETLAAANIPYEIVPGITSSTAASSYAGIPLTHRNYSNSVTLLTGHAKGSLTDHGKYNSSHNSDTIAYYMGIKNLPTICKNLRQAGKKEDTPVAVIEWGTTGKQRVVTGTLSTIVSIVKNENISNPSMTIVGDVVSLRDQIAWKEHKPLHGKKVLFTSATNKTSVMKQKLQEAGAEIYQIPTFKKEEYTLTLEQIIEIFNVNRLVFCSAESVEILMQSCSKYKKDIRSLQAELQHMNVATQEKLMQYGLLSKEAKFSSDTTVYLGRNINRIAFIQEKIGAGSYMMTHKYTIDHRFDEVHSRMLSEFLWDSIVFEGRASIDTFLAEVKRLGFLDIVTLPFSYTDVPTLRYANKVGFHNIDHQLQETLMQKDMVRQ

SEQ ID NO: 24528 - protein, 590 aa, Pseudomonas syringae
MCGLAGELRFDHQPADLAAVERITHELAPRGPDAWGFHSQGPIALGHRRLKIMDLSDGSAQPMIDSNLGLSMAFNGAIYNFPELRAELESLGYQFHSGGDTEVLLKGYHAWGAEMLPKLNGMFAFAIWERDSKQLFIARDRLGVKPLYLSKTDKRLRFASSLPALLKGGDISGMLDPVALNHYLNFHAVVPAPRTLLAGVEKLPPASWMRIDASGKVEQKVWWTLPYGPHEDEKNLTLEDWRDRVLDSTREAVAIRQRAAVDVGVLLSGGVDSSMLVGLLREVGVEDLSTFSIGFQDAGGERGDEFQYSDLIAKHYGTRHHQLRIQESEIIEQLPAAFRAMSEPMVSHDCIAFYLLSREVAKHCKVVQSGQGADELFAGYHWYPQVDGASDPVAAYRYAFVDRSYAEYADTVQPKWRTANDAAGDFVRDHFAQPGASAAVDKALRLDSTVMLVDDPVKRVDNMTMAWGLEARTPFLDYRLVELSARIPGKFKLPDGGKQVLKEAARLVIPSEVIDRKKGYFPVPGLKHLQGDTLNWVRELLTDPSQDRGLFNPTMVDKLLTNPEGQLTPLRGSKLWQLAALNLWLSEQGL

SEQ ID NO: 24529 - protein, 1082 aa, Pseudomonas fluorescens
MKRMLINATQPEELRVALVDGQRLYDLDIESGAREQKKANIYKGRITRIEPSLEAAFVDFGSERHGFLPLKEISREYFKKAPEGRVNIKDVLSEGQEVIVQVEKEERGNKGAALTTFISLAGRYLVLMPNNPRAGGISRRIEGEERNELREALNGLVAPADMGLIVRTAGLGRSSEEMQWDLDYLLQLWTAIKEASLDRSAPFLIYQESNVIIRAIRDYLRQDIGEVLIDSVEAQDEALTFIRQVMPQYASKIKLYEDSVPLFNRFQIESQIETAFQRVVELPSGGSIVIDPTEALVSIDINSARATKGSDIEETALQTNLEAAEEIARQLRLRDIGGLIVIDFIDMTPAKNQRAVEEKVRECLEADRARVQIGRISRFGLLEMSRQRLRPSLGESSGIVCPRCSGTGIIRDVESLSLAILRLIEEEALKDRTAEVRAQVPIPVAAFLLNEKRNSITKIELRTRARIVILPNDHLETPHFEVQRLRDDSPEAATNQSSYEIAAAAADVEDVQPAAATRTLVRQEAAVKTAPARANAPVPTEVAAPAPAPAPVAAPEPSLFKGLVKSLVSLFATKEEPVAPVVVEKPATERPARNEERRNGRQQSRNRNGRRDEERKPREERAPREERAPREPREERQPREPREVREPREVREPRESRDEAPVAREERAPRAPREERAPRAPREDRKPRGEREERVRELREPLDAAPAVAAAATAEERPARQPREERAPRPPREERQPRAEQAAAAVAEEEITTNEEQLPEDGSENAEGDRPRRRSRGQRRRSNRRERQRDANGNVIEGSEESESGENAQAPSTADLAAGLAVTAAVASTVISAPAEAQAHEQAERATAATLETAPVEAPVVEATTPVEAAAAPEVEVAPVREAQPQVEAAAEPAVTFEAPAVVEESVVETGAETVTETVREVREEQTAFNWVAEPAVTETPAPVVEAPVVEEAKAAEPVVVAEPTPVAEAPVIEAPVVAEAPAPVVEAAPVSALTPSGRAPNDPREVRRRKREEERLQKEAELAAAAAAAAPAAEVVEAAPAPVAEEVAVEAVIAEAPRSVQEAVEQHAEAQEKEHEPKPLV

SEQ ID NO: 24530 - protein, 339 aa, Triticum aestivum
MPNLECRMYEPRFPEVDAAVMIQVKHIADMGAYVSLLEYNNVEGMILFSELSRRRIRSISSLIKVGRQEPAIVLRVDRDKGYIDLSKRRVSEEEARSCEDRYNKSKLVHSIMRHVAETLEIDLEPIYQRIGWPLYRKYGHAFEAFKLIVADPDAILDVLTYEEKETGPDCQEVTKVVPAVTPEIKETLVQNIRRRMTPQPLKIRADVEMKCFQFDGVLHIKQAMRKAEAAGNTNCPVKIKLVAPPLYVLTTQTLDKDQGISVLTDAVKACTAEIEKHKGKLVVKEAPRAVSEREDKLLNAQLDTLVEQNAEVAGDDDSEDEEDTGMGDIDLTNSGVHAD

SEQ ID NO: 24531 - protein, 801 aa, Bacillus anthracis
MKKRLVMIGNGMAGIRCMEEILKHDCDSYEITIFGDEPHPNYNRIMLSHVLQGKTNIQDIIMNEYSWYEENEITLYTNERVQSIDREEKVIMTEKNRTLTYDKLIIATGSSAFILPVEGSTLPGVTGFRTIEDTQFMMDTAKEKKKAVVIGGGLLGLEAARGLIDLGMDVHVVHLMPSLMEQQLDTKAASLLREDLEAQGMKFLMEKKTVKILGTNHVEGIQFEDGEVVDCDLIVMAVGIRPNTQIARDAGLIVNRGIVVNDYMLTNDESIYAVGECAEHDGIAYGLVAPLYEQGAILAKHISNLQTDGYSGSIVGTQLKVAGCDLFSAGQIYEDDQTKAISIFNECKRSYKKVLIRDNKVVGIVLYGDTADGTRLFSMLKKEEDIQEYTPASILHKAGEESELDVATMSADDTICGCNGVTKGTIVHAILEQELTTFEEVKGCTKAAGSCGKCRPLVEQVLSHTLGDAFDASAQSAGMCGCTPLSRDEVVAAIHEKGLKSPKEVRNVLGFVHEDGCSKCRPALNYYLRMAIPEEYEDDKASRFVNERMNGNIQHDGTFSVIPRMYGGVTTADDLMKIAEVAKKYDVPLVKITGASRIGLYGVKKQDLPNVWADLNMTSGYAYSKSLRNVKSCVGSRFCRFGTKDSLGLGMLLEQSLEMVDTPHKMKMGVTGCPRNCAEVLTKDFGVVCVENGYQLYIGGNGGTEVREADFVMIVPTEDDVLHIATAYMQYYRETGIYGERTAYWTERLDFDHIKEILQDANMVTKLNERFQTARGTYKEAWGQALETKSLKAMYEVETVK

SEQ ID NO: 24532 - protein, 514 aa, Bacillus cereus
MGFEEATPIQAETIPHALQGKDIIGQAQTGTGKTAAFGLPLLDKVDTHKESVQGIVIAPTRELAIQVGEELYKIGKHKRVRILPIYGGQDINRQIRALKKHPHIIVGTPGRILDHINRKTLRLQNVETVVLDEADEMLNMGFIEDIEAILTDVPETHQTLLFSATMPDPIRRIAERFMTEPQHIKVKAKEVTMPNIQQFYLEVQEKKKFDVLTRLLDIQSPELAIVFGRTKRRVDELSEALNLRGYAAEGIHGDLTQAKRMSVLRKFKEGSIEVLVATDVAARGLDISGVTHVYNFDIPQDPESYVHRIGRTGRAGKKGIAMLFVTPRESGQLKNIERTTKRKMDRMDAPTLDEALEGQQRLIAEKLQSTIENENLAYYKRIAEEMLEENDSVTVVAAALKMMTKEPDTTPIALTSEPPVVSRGGGSKKRGGNGGGYRDGNRNRSRDGRGGGDGRNRDRNRDGRNRDGNRDRNRDGNRDRNRDGGSRGRRGEGQGRPGSSNGRGERKHHSRPQA

SEQ ID NO: 24533 - protein, 416 aa, Vibrio vulnificus
MLKRDMNIADYDAELFAAIQEETLRQEEHIELIASENYTSPRVMEAQGSQLTNKYAEGYPGKRYYGGCEYVDKAEALAIDRACQLFGCEYANVQPHSGSQANSAVYMALLNPGDTVLGMSLAHGGHLTHGSPVNFSGKHYNVIPYGIDEAGQINYDEMETLALEHKPKMIIGGFSAYSQIVDWKRMREIADKVDAYLFVDMAHVAGLIAAGEYPTPVPHAHVVTTTTHKTLAGPRGGLILSNAGEDMYKKLNSAVFPGGQGGPLMHVIAGKAVAFKEAMEPEFKAYQARVVKNAKAMVAQFQERGYKIVSNGTENHLFLVDLIDKDITGKDADAALGAANITVNKNSVPNDPRSPFVTSGIRVGTPAITRRGFTEADAKELANWMCDVLDNIGNEAVIEATKQKVLEICKRLPVYA

SEQ ID NO: 24534 - protein, 514 aa, Ostreococcus tauri
MRARGANARDGTSVVVVRDDGRDDARGAKGQGASGLDAIFAAIPENELRSTDNANEKKMTHEKRTSKRREGERESAEARAKTNAAASTPVVSQRRGEEGRKATAKVDAKGKAREPLPKPEYTPQCPRCKSEDTKFCYYNNYNIKQPRFYCKECCRYWTEGGLLRNVRVGAGRRKSKSAKDKEAANTVTDKPAVGDDALGAKRSRRTGDDNRGREKSARNQKRDGSSDGSATEAEQGEGTFEYARGFPHGSNTGSDTAVRGRSPPEEQGSAEGEGSQRPGDHMRFLGGWGIDPSVARYVSTGLLPPNDDAIQAQAAAAAAASAAILNEATRWGMHFWNKQSTFPYNMPSSSSTSTMSEFPGNAQVGRGGVPTPIALAALKCERVAQPTPLHPTAAAAASTYGTVPRTQGTTTPTTAVMPSSPMAMQYVSMFQNPWAQFCVHSDKGNKCLTSKWRTLCSYTEECSPRSEVFQARRSHSRVHNHSSRKVKAKQSPLSEDKTLANNLQNVEYRCDANI

SEQ ID NO: 24535 - protein, 318 aa, Zea mays
  misc_feature (201)..(201): Xaa can be any naturally occurring amino acid
GPLSRLSALQVESCAEHLASIFGTEKDRVNCPFYFKIGACRHGDRCSRLHNRPTISPTLVLANMYQRPDMITPGVDAQGQPIDPEKMQEHFEDFYEDIYEELGKFGEIENLNVCDNLADHMIGNVYVQFREEEQAAAAYNALQGRFYSGRPIIVEYSPVTDFREATCRQFEENSCNRGGYCNFMHVKQIGRDLRRKLYGAXASRRYHARSRSPPPQRRGYREDYHHRDRDEYRGGGGGGGGRGRGSRHDRYDDGAGRGGRHDRYDDGAGRGGRYERYDDGGRRRHGSPPRRGRSPVRESSEERRAKIEQWNRERESKQ

SEQ ID NO: 24536 - protein, 108 aa, Triticum aestivum
GSTGVAGCYDGALQVMSVEFQVPSPLVPTRESYFVRYCKRNADGAWAVVDVSLDGLQGVKCRRRPSGCLIQEAPNGYSKVTWVEHVEVDDRSVHNIYKPLVGSGLAFA

SEQ ID NO: 24537 - protein, 635 aa, Solanum tuberosum
MESCDCIEALLPTGDLLVKYQYLSDFFIAVAYFSIPLELIYFVHKSACFPYRWVLMQFGAFIVLCGATHFISLWTFFMHSKTVAVVMTISKMLTAAVSCITALMLVHIIPDLLSVKTRELFLKTRAEELDKEMGLIIRQEETGRHVRMLTHEIRSTLDRHTILKTTLVELGRTLDLAECALWMPCQGGLTLQLSHNLNNLIPLGSTVPIIFLLSMRFLVALKQYRFHIPNPLARMRNTVGRYIPPEVVAVRVPLLHLSSFTNDWAELSTRSYAVMVLVLPMNGLRKWREHELELVQVVADQVAVALSHAAILEDSMRAHDQLMEQNNALDDARQEAEMAIRARNDFLAVMNHEMRTPMHAVIALCSLLLETDLTPEQRVMIETILKSSNLLATLINDVLDLSRLEDGILELENGTFNLHGILREAVNLIKPIASLKKLSITLALALDLPILAVGDAKRLIQILLNVAGNAVKFTKEGHISIEASVAKPEYARDCHPPEMFPMPSDGQFYLRVQVRDTGCGISPQDIPLVFTKFAEARPTSNRSTGGEGLGLAICRRFIQLMKGNIWIESEGSGKGTTVTFVVKLGICNHPNALPLLPMPPRGRLNKGSDDLFRYKQFRGDDGGISVNAQRYQRSL

SEQ ID NO: 24538 - protein, 600 aa, Rhodopseudomonas palustris
MLDTAPNGKVTTLLGQLDDALSAGDIDRAVDLFQTDCYWRDLIAFTWNIKTMEGKDQVRDMLKARLTDTKPSHWRIADGEDAAEADGIVECFIQFDTALARGVGHLRIKEGRIWTLLTTMAELKGFEEPQGFQRPMGVKHGADPSRKTWKEERDAEAAELGITRQPYCVIIGGGQGGIALGARLRQLGVPTIIIEKNERPGDSWRKRYKSLCLHDPVWYDHLPYLPFPPNWPVFAPKDKIGDWLEMYTKVMELNYWGSTVCKRAAYDEAAKQWTVVVERDGQEITLTPKQLVLATGMSAKPNMPKFEGMDVFKGDQHHSSQHPGPDAWKGKKAVVIGSNNSAHDICAALWEAGADVTMVQRSSTHIVKSNSLMELGLAGLYSEQAVQNGITTAKADLIFASLPYKILHEFQIPIYNAIRERDADFYKRLEAAGFMLDYGEDDSGLFMKYLRRGSGYYIDVGASELVADGRIKLKSGVDVQRLTEHSVILSDGTELPADLVVYATGYGSMNGWAADLISKEVADKVGKVWGLGSNTRKDPGPWEGEQRNMWKPTQQEGLWFHGGNLHQSRHYSQFLALQLKARMEGLPTPVYGLQQVHHQG

SEQ ID NO: 24539 - protein, 218 aa, Zea mays
MHHRFAGLVPTARPALPPIHGGVVGRSYPPVHRSLALRLAPFASASVRRACRPLAVSAQSTSLRPEKFFEVEMKVRDYEIDQYGVVNNAVYASYCQHGRHELLESVGISADAVARSGESLALSELNLKYFAPLRSGDKFVVKVRLAGIKGVRMIFDHIITKLPNHELILEAKATAVCLNKDYYPTRIPRELLSKMQLFLPVDSRGSNEDVNNRNNSCN

SEQ ID NO: 24540 - protein, 307 aa, Geobacter metallireducens
MPVFDSDKVIEQIGNTPLQRLAKLEAPGSAAVYGKAEFFNPGGSVKDRICLAMIEAAEKDGSLKPGMTVVEPTSGNTGIGLSMICAIKGYKLVLTMPDTMTVERRRLLAAYGAELVLTPGAQGMRGAVQKAEELAAQPGHIMMQQFKNGANPEAHRRTTGPEIVRALSGQSIDAFVAGVGTGGTITGVGEVLKEHNAAVRIVAVEPDASPILSGGQPGPHKIQGIGAGFVPDVLNTKVYDEVIRVTNEDAYETVRRLAQEEGVLVGISSGANVFAALQVAKRLGPGKNVVTILCDTGERYLSTGVFD

SEQ ID NO: 24541 - protein, 242 aa, Colwellia psychrerythraea
MSNVSMRDMLKAGVHFGHKTRYWNPKMKQFIFGARDKVHIINLEQTVPMFNEALAFVNNVSSKKGKVLFVGTKRAASDAIKDAAIKSDQFYVNHRWLGGMLTNWKTVRQSIKRLKDLESQSTDGTFEALTKKEALMRTREMEKLDKSLGGIKNMGGLPDVLFIIDADHEHIAIKEANNLGIPVISVVDTNSNPDGVDYVVPGNDDAIRAVTLYCDAVANSVLSGREQNIVVQAEKDGFVEAE

SEQ ID NO: 24542 - protein, 213 aa, Glycine max
  misc_feature (191)..(191): Xaa can be any naturally occurring amino acid
MGRRPARCYRQIKNKPYPKSRYCRGVPDPKIRIYDVGMKRKGVDEFPYCVHLVSWEKENVSSEALEAARIACNKYMTKSAGKDAFHLRVRVHPFHVLRINKMLSCAGADRLQTGMRGAFGKPQGTCARVDIGQVLLSVRCKDNNAAHASEALRRAKFKFPGRQKIIESRKWGFTKFSRADYLKYKSEGRIXVPDGVNAKLLGNHGNLRTCWKS

SEQ ID NO: 24543 - protein, 449 aa, Ralstonia eutropha
MQERTPRGRIVSAPEHFVSASLQQDIARHGLDSPRRDFLRKSFLGAAAGVATATLGRRALAGEGDPAILEPQPWATSLGQPVAARPYGQPSVHEKNLVRRESPGLTRVSAASVAFAPLQGLFGIITPNGLHFERHHQGWQDIDPARHRLMINGLVKAPRVYTMDDLMRLPSVSRMHFIECGANTGMEWGNVAVPTVQYTHGMLSCCEFTGVPLKVLLDDAGADFRRGKYLLAEGGDGSGMTRTIPMELADEIIVAWGMNGEMLRPENGYPLRLVVPGVQGVSWVKWLRRLELGDQPWNAKDETIHYVDMMPDGKLRQYTSIQECKSVITSPSGGQQMVGQGFYNISGLAWSGRGRIRRVDVSTDGGRNWLTARLETPVLSKCLTRFNLDWVWDGGPAILQSRAIDETGYVQPKMAQLRAVRGTRSIYHNNAIQSWQVAQGGEVSNVHVG

SEQ ID NO: 24544 - protein, 119 aa, Brassica napus
MATTNSLHHHHHSSYQHHRHNLHYQSHLTPTSLSLKHPTSTATFSSLICSSSSSSSSALVTSATTTNTSDITTETATKFEVLATHLINQDFRKADEETRRLLIQIAGEAAIKRGYVFFS

SEQ ID NO: 24545 - protein, 398 aa, Methanosarcina mazei
MGMKNMKNYNIPEIARNVFWVGAKDWNRRMFDALIPLPQGTSYNAYLVKGEKKTALIDTVNPGFEEEFEQKINLVSDLEKLDYLVMNHAEPDHSSAIRYIMDKAPDSILVATERGIKMAGLYHELPEDRIKVVAEGDSIDLGGKTLRFIEAPWLHWPETMFTYLPEERVLFPCDFFGAHTAQGVYDDDLEDLIPLAKRYYGEIMMPFNKMGAKALEKIKDLEIDIIAPSHGPIYKNPERILEPYRKWTAGKTENKALVVYISMWGSTKEMVNAIAETLLKEGVDVRMYDLAASDLGDVARELVDSRAIILGTPTVLAGMHPLALYGAYLVKALKPPAKYGVVLGSFGWGGGALRQAGDILTPSSMEVVGTHQVKGRAKEEDLKKIEEIGRQLAQKMKA

SEQ ID NO: 24546 - protein, 392 aa, Chlamydia trachomatis
MDYYTILGVAKTATPEEIKKAYRKLAVKYHPDKNPGDAEAERRFKEVSEAYEVLGDAQKRESYDRYGKDGPFAGAGGFGGAGMGNMEDALRTFMGAFGGDFGGNGGGFFEGLFGGLGEAFGMRGGSESSRQGASKKVHITLSFEEAAKGVEKELLVSGYKSCDACSGSGANTAKGVKVCDRCKGSGQVVQSRGFFSMASTCPDCSGEGRVITDPCSVCRGQGRIKDKRSVHVNIPAGVDSGMRLKMEGYGDAGQNGAPAGDLYVFIDVEPHPVFERHGDDLVLELPIGFVDAALGIKKEIPTLLKEGTCRLSIPEGIQSGTVLKVRGQGFPNVHGKSRGDLLVRVSVETPQHLSNEQKDLLRQFAATEKAENFPKKRSFLDKIKGFFSDFAV

SEQ ID NO: 24547 - protein, 284 aa, Desulfitobacterium hafniense
MELWYTEEHTENVRFSIKVDRQLYSGQSEFQRIDVFESKEFGTFFTLDGLMMVTQKDEFIYHDMIVHVPMATNPQIKDVLVIGAGDGGTVRELTRYDSIVNIDMVEIDKLVVDVCKEYLPQTACKLEDPRVRLFFEDGLRFIRTKENSYDLIIVDSTDPFGPGEGLFTKEFYGNCYKALKDDGILVNQHESPYYETYAQNMGRAHQRIKEFFPVCRVYQAHIPTYPSGHWLFGFASKKYDPLIDIDEQAWNDLGIKTQYYNTEIHKGCFALPNYVKEQLADAVE

SEQ ID NO: 24548 - protein, 206 aa, Triticum aestivum
  misc_feature (18)..(18): Xaa can be any naturally occurring amino acid
  misc_feature (46)..(46): Xaa can be any naturally occurring amino acid
QWVYDTTQFDNILKKLKXSATPAIKEFEDDVSNSPDSTPKEADQQXNEVTKVTRPQGRYKKRERGKSVSGYSAKDLEGILVRKSDDNCKVDQEVEPTCCDEPDPIICQDTVSQADDVNWWGHKFGFKSGGFLGAKSRKNKSSATKGTSNVRQTFGEEDQENLYNLVQDKATSGKQGLGIKGLPIKVAGHHWKGNKTSFGDSDEENS

SEQ ID NO: 24549 - protein, 438 aa, Alteromonadales bacterium
MNYQHLLYLSGAAIIFSAGAFALSMEKVEQSDVAASMHVESLVLGSGCFWGAEKRYEALDGVIDAESGYADGNGFEATYKNITKQSRRFDENNYAEVVKVTYNSNIISAQELLKNYFESHDPTQLNKQGNDIGTQYRSIILTSNDAQKDTALKVKAQYQQLLTNAGYGNIVTVIKPLEGFVAAEEYHQNYLQKNPNGYCPDHSTGVVFEPVPVKTKDNTALLTGKQIVIIDSRDYCPYCEKFKKEVANDYKGTIPLSFRYADQLDGLTIKSATWATPTILFLVNGEEVYGRQGYASRETFYKALGAFKLGDSEAYKVAFNAKTDRPYCKEYKIFKNTPDGTFVDKLSGEALFDTRDRFNSGTGWLSFTHPVKNSVTEHEDNSWGMQRIELRSKSTGIHLGHLFPGEGPRGKDRYCINATVLDFVPRDNSQYPYKPIGL

SEQ ID NO: 24550 - protein, 181 aa, Zea mays
  misc_feature (101)..(101): Xaa can be any naturally occurring amino acid
MASVRLSSATMTSSLAHATMVAPFIGLKSSAAFPVTCKANTEITSITSNGGRINCMKVWPPVGKKKFETLSYLPGLTDVEIAQEIDYLIRNKWTPCIEFEXEHGFVYREHGNIPGYYDGRYWTMWNLPLFGCTDPPQVLKEVQQCKREYPNAFIRIIGSDNNRQAQCISFIPHKPPSFTDA

SEQ ID NO: 24551 - protein, 72 aa, Helicobacter pylori
MARDDVIEVDGKVIEALPNATFKVELDNKHVVLCRISGKMRMHYIRIALGDRVKLELTPYSLDKGRITFRYK

SEQ ID NO: 24552 - protein, 431 aa, Escherichia coli
MVSLEKNDHLMLARQLPLKSVALILAGGRGTRLKDLTNKRAKPAVHFGGKFRIIDFALSNCINSGIRRMGVITQYQSHTLVQHIQRGWSFFNEEMNEFVDLLPAQQRMKGENWYRGTADAVTQNLDIIRRYKAEYVVILAGDHIYKQDYSRMLIDHVEKGVRCTVVCMPVPIEEASAFGVMAVDENDKTIEFVEKPANPPSMPNDPSKSLASMGIYVFDADYLYELLEEDDRDENSSHDFGKDLIPKITEAGLAYAHPFPLSCVQSDPDAEPYWRDVGTLEAYWKANLDLASVVSKLDMYDRNWPIRTYNESLPPAKFVQDRSGSHGMTLNSLVSGGCVISGSVVVQSVLFSRVRVNSFCNIDSAVLLPEVWVGRSCRLRRCVIDRACVIPEGMVIGENAEEDARRFYRSEEGIVLVTREMLRKLGHKQER

SEQ ID NO: 24553 - protein, 147 aa, Lactococcus lactis
MNGETVSMSDFKGKVVIVVNTASKCGFTPQFEGLEKLYENYKDQGLEILGFPCNQFVNQDAGENSEINEFCQLNYGVTFPMFQKIKVNGKEAHPLYQFLKKEAKGALSGTIKWNFTKFLIDREGNVIERFAPKTEPKEMEEEIQKLL

SEQ ID NO: 24554 - protein, 219 aa, Triticum aestivum
HYRTRFVQKSRLVPVRNSRDIVDPHVRDWSTRTLTWTEPVENSTHHHSSPNPTRAAAPRGSSATMSGRGKGGKGLGKGGAKRHRKVLRDNIQGITKPAIRRLARRGGVKRISGLIYEETRGVLKIFLENVIRDAVTYTEHAPPQDRHRHGRRLRPQAPGPHPLRLRRLGRWPPPDGRQSSSPPADSDVLVRPFLVVLRSRNLRWKPPCFPISSVWLTES

SEQ ID NO: 24555 - protein, 785 aa, Triticum aestivum
MAKAPCLCARPSLAARTRRPGPGPAPRLRRWRPNATAGKGVGEVCAAVVEVATKAEDEGEEDEPVAEDRYALGGACRVLAGMPTPLGATALAGGVNFAVYSGGATAAALCLFTPEDLKADRVTEEVPLDPLMNRTGNVWHVFIEGELQDMLYGYRFDGTFAPHCGHYLDVSNVVVDPYAKAVISRGEYGVPARGNNCWPQMAGMIPLPYSTFDWEGDLPLRYPQKDLVIYEMHLRGFTKHDSSNVEHPGTFIGAVSKLDYLKELGVNCIELMPCHEFNELEYSTSSSKMNFWGYSTINFFSPMTRYTSGGIKNCGRDAINEFKTFVREAHKRGIEVILDVVFNHTAEGNENGPILSFRGVDNTTYYMLAPKGEFYNYSGCGNTFNCNHPVVRQFIVDCLRYWVTEMHVDGFRFDLASIMTRGSSLWDPVNVYGAPIEGDMITTGTPLVTPPLIDMISNDPILGGVKLVAEAWDAGGLYQVGQFPHWNVWSEWNGKYRDIVRQFIKGTDGFAGGFAECLCGSPHLYQAGGRKPWHSINFVCAHDGFTLADLVTYNNKYNLPNGENNRDGENHNLSWNCGEEGEFARLSVKRLRKRQMRNFFVCLMVSQGVPMFYMGDEYGHTKGGNNNTYCHDSYVNYFRWDKKEQYSDLHRFCCLMTKFRKECEGLGLEDFPTAERLQWHGHQPGKPDWSENSRFVAFSMKDERQGEIYVAFNTSHLPAVVELPERTGRRWEPVVDTGKPAPYDFLTDDLPDRALTIHQFSHFLNSNLYPMLSYSSVILVLRPDV

SEQ ID NO: 24556 - protein, 846 aa, Zinnia elegans
MAMVVQHQQQRETSSSSSSMKQQQQQQQLDNGKYVRYTAEQVEALERVYAECPKPSSLKRQQLIRECPILSNIEPKQIKVWFQNRRCREKQRKEASRLQMVNRKLSAMNKLLMEENDRLQKQVSQLVYENGYMRQQLHTAQSVTDASCESAVTTPQHSLRDANNPAGLLSIAEETLTEFLSKATGTAVDWVQMPGMKPGPDSVGIFAISQSCSGVAARACGLVSLEPTKIVEILKDRTSWFRDCRNLEVLTMLPAGNGGTIELVYTQVYAPTTLAPARDFWTLRYTTSLENGSLVVCERSLSGPGGGPNAAAASQFVRGEMLPSGYLIRPCDGGGSIIHIVDHLNLEPWSAPEVLRPLYESSKVVAQKMTIAALRYIRQIAQESSGEVVYGLGRQPAILRTLSQRLSRGFNDAINGFNDDGWSLMNCDGAEDVIVSINSTKNLNTSTNSSNPLSFLGGVLCAKASMLFHNVPPAVLVRFLREHRSEWADFNVDAYSAASVKASPYGYQGIRPTRFTGSQVIMPLGQTIEHEEMLEVIRLEGHAVGQEDPFVSRDIHLLQLCSGIDENAVGACSELVFAPIDEMFPDDAPLIPSGFRIIPLEPKSGDPKDAAGTTHRTLDLTSSLEVGQSTNHGSSDNMRSVLTIAFQFPFENNLADSVATMARQYVRSVINSVQRVAMAISPSGLSPSLAPKLSPSSPEALTLAQWICQSYTYHLGTDLLTSGSVVGDSLLKDLWQHQDAILCCSLKSPPVFIFANQAGLDMLETTFVALQDITLDKMFDEAGRKALFPEFAKIMQQGYAYLPGGICMSTMGRHISYEQAIAWKVLAGDETTVHRLAFSFVNWSFV

SEQ ID NO: 24557 - protein, 261 aa, Oryza sativa
MEIDDDMIYSLIRNWDNDSSSSWIELLDHVVVSPASCFVPWKRTELDKQAVAGGGEAAQRLLKKAVGGGGAWMNRAAGSSIKNHVMSERRRWEKLNEMFLTLKSLVPSIDKVDKASSLAETIAYLKELERRVQELESGKKVSRPAKRKPCSERIIGGGDAGAVKEHHHWVLSESQEGTPSNVRVIVMDKDELHLEVHCRWKELMMTRLFDAIKSLRLDVLSVQASAPNGLLGLKIRAKYAISAAVAPAMISETLRTAVAGN

SEQ ID NO: 24558 - protein, 128 aa, Glycine max
AGSAINFKSYKKILEISFFKNNVFTNPKELSLQSLCRDQLNKILNPAEYTIITSLSNNYIDSYILSESNLFIYPYKIIIKTYKTTKLLLSIPIILKLTNALDISIKCIKYTRKTCIVPKTQSFPHAQF

SEQ ID NO: 24559 - protein, 628 aa, Lactobacillus acidophilus
MQANIKWLDDPEIFRVNQLPAHSDHPFFKNYREWQNNHSSFKQSLNGMWQFKFSKDPQSRPVDFYKKDFNTSSFTTIPVPSEIELNNFAQNQYINTLYPWEGKIFRRPAYALNKSDAEEGSFSEGKDNTVGSYIKHFDLNPELRDHDIHIVFEGAERAMYVWLNGHFIGYAEDSFTPSEFDLTKYIKEKDNILAVEVFKHSTASWLEDQDMFRFSGLFRSVELLAFPETHLVDLDLKPTVCDNYQDGIFNAELKFTGSLNGHVHLSVEDVNGSAILEQDVPLDSEVEFTSSTLENIHLWDNHHPYLYQLLIEVHDENGHLVELIPYQFGFRRIEINQDKVILLNGKCLIINGVNRHEWNAKTGRSITLNDMEKDIDTFKENNINAVRTCHYPNQIPWYYLCDQNGIYMMAENNLESHGTWQKMGQVEPSDNVPGSVPEWREAVIDRARNNYETFKNHTSILFWSLGNESYAGSNIVAMNEFYKEHDSSRLVHYEGVVHRPELKDQISDIESHMYLPPKEVAEYLRNNPQKPFMECEYMHDMGNSDGGMGSYIKLIDEYPQYVGGFIWDFIDQALLVYDPISKQNVLRYGGDFDDRHSDYEFSGDGLMFADRTPKPAMQEVRYYYGLHK

SEQ ID NO: 24560 - protein, 158 aa, Oceanobacillus iheyensis
MSVHDFTVTTIEGEEKRLSDYKGKVILIVNTASQCGFTPQLEDLQKLYKQYQDNDFEILGFPCNQFGNQDPGASEEISAFCQKNYGVTFQMFKKVDVKGKEAHPLYKHLTEEKKGILGGQIKWNFTKFLIDQNGNVIERFSPQKNPNTLNKDIEVLLR

SEQ ID NO: 24561 - protein, 502 aa, Unknown
  Frankia sp. CcI3
MRVLLVHPSALMYSKIFLRLEPLGLERVAAALLAAGHEVSMLDLQVEKPAAYARHLRKCRPDAVMFGVNYLANVPEVIEFAHRAKRELPDCLVVAGGHSVSFIAEHLLKQCDGALDVVARGEGEVVAPRILEADRARLADVPGAVTADGAGPTPALLPGLDEPLPARHLLAHRRRYFIGELDPCASVEFTRGCPWDCSFCSAWTFYGRSYRRLSPDAAGEELSAIREPNVFIVDDVAFIRPEHGMAIADQVERRGIRKRYYLETRSDVLLRHPEVFERWRRLGLEYMFLGMEALDADGLDLYHKRISPDENIRALEVARKIGITVAVNLIADPDWDEKQFRLVREWALSVPEIVHLTVCTPYPGTEIWHTQSRRLTTLDYRLFDIQHAVVPTRLPLDRFYRELVATQAVLNRKHLGAKALAATARIVAANLARGQTNFPRMLWKFPRVYNAGRLYAEHQHPARYRLPEPVPAAMTPRRRELYVHQPAARHPVASRERERTDP

SEQ ID NO: 24562 - protein, 384 aa, Oryza sativa
MALALRPPRFQPLPAPIPASTASTTALAARPSSSAHAIICAAAASPFTEATSSSRYRRDAWSYAASDGDSSSSSAAAAAAAASSGRRDDEIALQLPELRRLLEALRASRGRGAEGEGGGGGPGRVALVGTGPGDPELLTLKAVRAIEAADLVLYDRLVSNDVLDLVGEGARLLYVGKTAGYHSRTQEEIHELLLSFAEAGANVVRLKGGDPLVFGRGGEEMDFLQQQGIRVEVIPGITSASGIAAELGIPLTHRGVATSVRFLTGHSRNGGPDPLYVAENAADPDTTLVVYMGLSTLPSLAPKLMKHGLPPDTPAVAVERGTTPQQRMVFAMLKDLVNEVKSEDLVSPTLIIIGKVVALSPFWIDSSKQGAQSIENLYAAETKR

SEQ ID NO: 24563 - protein, 359 aa, Nicotiana tabacum
MAAITLLGLLLVASSIDIAGAQSIGVCYGMLGNNLPNHWEVIQLYKSRNIGRLRLYDPNHGALQALKGSNIEVMLGLPNSDVKHIASGMEHARWWVQKNVKDFWPDVKIKYIAVGNEISPVTGTSYLTSFLTPAMVNIYKAIGEAGLGNNIKVSTSVDMTLIGNSYPPSQGSFRNDARWFTDPIVGFLRDTRAPLLVNIYPYFSYSGNPGQISLPYSLFTAPNVVVQDGSRQYRNLFDAMLDSVYAALERSGGASVGIVVSESGWPSAGAFGATYDNAATYLRNLIQHAKEGSPRKPGPIETYIFAMFDENNKNPELEKHFGLFSPNKQPKYNINFGVSGGVWDSSVETNATASLVSEM

SEQ ID NO: 24564 - protein, 440 aa, Unknown
  Synechococcus sp. CC9311
MNSQGVPEPSADLLSLATAVRRAAVVLGQSSNQQRQQALMAMAASLEAHADRIVAANAEDLAQASADGLAPALVARLKLDAGKLAGAIDGVRQLSSLQDPLGARQLHRELADGLVLERVTVPLGVLGVIFEARPDAVIQIAALAIRSGNGAILKGGSEAKCTNQAVMQSLKEGLAGTSVSVDALDLLTTRAESLALLRLDGLVDLIIPRGSNELVRFIQDNTRIPVLGHADGVCHLYVDQEVDCTQALRIAIDSKTQYPAACNAIETLLVHEKIAPIFLKEAVPAFQEAGVCLRGDEASRDLGVEQVATSDDWSQEYLDLVLAVRVVKDFDEALEHIRMYGSRHTEAIATVNHDTAERFLRAVDSAGVYHNCSTRFADGFRYGFGAEVGISTQTLPPRGPVGLEGLVTYRYRLRGEGHVAADFSEGREQFSHRDLPTGTE

SEQ ID NO: 24565 - protein, 176 aa, Thermoplasma volcanium
MVTKPARMYTRITGPAYTRKEFMGGVPYPKITTFVQGNQKRDFPIEMQLIAMESCQVRHTALEAARVSVNRRMTEAAGLDNFYLKVVPYPHHVLREHKMATGAGADRISSGMRAAFGRPVGTAARVYQNDVIMIGRTDEAHAHELKIALKKAAIKLPTPCKVVITKGKEIAGAIGV

SEQ ID NO: 24566 - protein, 126 aa, Zea mays
  misc_feature (40)..(40): Xaa can be any naturally occurring amino acid
MAVLSAADASPVSAIGFEGYEKRLEITFSEAPVFVDPHGXGLRALSRAQIDSVLDLARCTIVSELSNKDFDSYVLSESSLFIYPLKIVIKTCGTAKLLLTIPRILELAEELSMPLAAVKYSRGTFI

SEQ ID NO: 24567 - protein, 159 aa, Prochlorococcus marinus
MAINISQIVVRTPEGAEKSLSEYNGTVLLIVNVASRCGFTKQYKGLQALQDTYGPKGLKVLGFPCNDFGAQEPGTLEEIKSFCSTTYGASFELFDKVHAMDKTTEPYTTLNQTEPAGDVAWNFEKFLVGKDGTVIKRFKSGVEPESTELKGAIEQALNT

SEQ ID NO: 24568 - protein, 183 aa, Glycine max
EICMTGLDRDKARVFHKEWGGGKMTEMSGISEIVQSHVICDFEFEPCGYSMNGIEGAAFSTVHVTPENGFSYGSYEVQGLDPGSNGFGALVRKVLKCFCPSDFSVAVTCEVGAEDWAMSDADVEGYCCQNVVKQQLLPGKGCLVYRTYSARGRGRGSPKIAIVKCSNEIEKEELVLSSCLTST

SEQ ID NO: 24569 - protein, 356 aa, Triticum aestivum
MALLTDLLNLDLTDSTEKIIAEYIWIGGSGMDLRSKARTLPGPVTDPSKLPKWNYDGSSTGQAPGEDSEVILYPQAIFKDPFRKGNNILVMCDCYTPAGVPIPTNKRYNAAKIFSNPDVAKEEPWYGIEQEYTLLQKDINWPLGWPVGGFPGPQGPYYCSIGADKSFGRDIVDSHYKACLFAGVNISGINGEVMPGQWEFQVGPTVGISAGDQVWVARYLLERITEIAGVVVTFDPKPIPGDWNGAGAHTNYSTESMRKDGGFKVIVDAVEKLKLKHKEHIAAYGEGNERRLTGKHETADINTFSWGVANRGASVRVGRETEQNGKGYFEDRRPASNMDPYVVTSMIAETTILWKP

SEQ ID NO: 24570 - protein, 335 aa, Methylococcus capsulatus
MRHCISVLGAGSWGTALALLIARNGVPTLLWSHRREHAEAMAAERRNAHYLPHATFPDTLSVTPDLAEAAATASDAVLVAVPSHAFRATLDLCAPHLQPEAGLMWATKGLDRTRGCLLHETAREILGPDRALAVLSGPTFAAEVVAELPSAITVGASSEAFGAKIVSWLHNAYFRAYTTDDLIGAQLGGACKNVLAIAAGISDGLGFGANARAALITRGLAEMMRLSLALGARTETLMGLAGVGDLVLTATDNQSRNRRFGLGVGKGRPREEIHAEIGQEIEGILAARLIHELAGRKGVDMPITAQTYRVLYEGLPPEEAVRNLLLRDPKPEWDR

SEQ ID NO: 24571 - protein, 848 aa, Zinnia elegans
MAMAVEHQQYKEISGNNSITKHQLDNGKYVRYTTEQVEALERVYAECPKPSSLRRQQLIRECPILSNIEPKQIKVWFQNRRCREKQRKESSRLQTVNKKLSAMNKLLMEENDRLQKQVSQLVCENGYMRQQLHTGSAATDASCESVLTTPQQSLRDANNPAGLLSIAEETLAEFLSKATGTAVDWVQMPGMKPGPDSVGIFAISQSCSGVAARACGLVSLEPTKIVEILKDRPSWFRDCRNLEVFTMFPAGNGGTIELVYTQIFAPTTLAPARDFWTLRYTTTLENGSLVVCERSLSGSGAGPNPAAASQFVRGEMLPSGYLIRPCEGGGSIVHIVDHLNLEAWSVPEVLRPLYESSKVVAQKMTIAALRYIRQIAQESSGEVVYGVGRQPAVLRTLSQRLSRGFNDAVNGFSDDGWSLMNCDGAEDVIVAVNSTKNLNNSMNSSTSPPYLGGIICAKASMLFENVPPGVLVRFLREHRSEWADFNVDAYSAASVKANPYNTYPGMRPTRFTGSQIIMPLGHTIEHEEMLEVVRLEGQALGQEDPFMSRDIHLLQLCNGIDENSVGACSELIFAPIDEMFPDDAPLIPSGFRIIPLDPKSVDAKNALVTTHRTTLDLTSSLDVTPTPNHGSTDVSTCQTTRSVLTITFQFPFENSLAESVATMARQYVRSVINSVQRVAMAISPSGLSPCVGPKPSPGSPEALTLAQWICQSYMYHLGADLLSSGSVVGESLLKDLWQHQDAILCCSLKSQPVFIFANQSGLDMLETTLVSLQDITLDKMFDDSGRKALVPEFAKIMQQGYAHLPGGICMSTMGRHVTYEQAVAWKVLAADESTVHCLAFSFVNWSFL

SEQ ID NO: 24572 - protein, 112 aa, Klebsiella pneumoniae
MKLVTVVIKPFKLEDVRERLSSMGIQGLTVTEVKGFGRQKGHAELYRGAEYSVNFLPKVKIDVAIADDQLDEVVDVISKAAYTGKIGDGKIFVAELQRVIRIRTGESDEAAL

SEQ ID NO: 24573 - protein, 703 aa, Unknown
  delta proteobacterium MLMS-1
MEKKLSVEIGGRTLTLETGRLAKQASGSVLVTYGQSVVLVTATAAREARASVDFLPLTIEYQERFYAVGRIPGSFFRREIGRPTENETLACRIIDRPLRPLFAAGYQNETQVIATVLSADNENDPELMAMIGASAALTVSHIPFNGPVAGVRVGMIDGEYVLNPPLDQRHNSRLDLIVAGTSKAVVMVEGGADGLPEDEVREGIFFAHEAMQPLIDLQEELCKEVGRPKMEVAPPPVDEDLRTRVESLAAAEMTEVISTADKKARGEAAHNLQERVLATLEADLVANTPEADLESKLKEAKGLLKDLQKKMMRQRIVKEHQRIDNRRLDEVRPITSEVAALPRVHGSALFTRGETQVLVSATLGSGDDEQRIESLSGMNFKPFMLHYNFPPYCVGEVRFLRGPSRRDIGHGALAERAIQAVLPDADSFPYTIRVVSEVLESNGSSSMATVCGASLSLMDAGVPMKKAVSGIAMGLIKEGEEVAILSDILGDEDHLGDMDFKVAGTDEGITALQMDIKVEGVSREIMTQALNQAKDARLHILEKMQQALEAPRREVPEHAPKLFTININPDKIRDVIGPGGKVIRGITADYGVKIDVEDDGKVKIFAPNGEVADQVRELVLSLTAEAEIGKIYTGTVQKIMDFGAFVQILPGTDGLVHISELENRRVEKVTDVLKEGDEVRVKVLDIDGRGKIRLSRKAVLAEE

SEQ ID NO: 24574 - protein, 120 aa, Brassica napus
  misc_feature (72)..(72): Xaa can be any naturally occurring amino acid
MNAAVFTSSALSLPISFCKTRSSQVTRKKGEFRVFAVFGEDSGLVEKKNQWGHLFDVEDPRSKTPPPPYKGXGKFMDVNQALEVARLDIQYLDWRARQDLLTIMLLHDKVVDVLNPLARE

SEQ ID NO: 24575 - protein, 370 aa, Oryza sativa
MSRVPTSWGFVYSRVNKVSEEPNVVNRITTAFWELQLPACSDEPISSGTPSSPSSPPTKETGDANTVVIDDLFLAHSDAILPAGGDQKEEHQLGDDLGQQQAATAMEIDDDVIYSLIRNWDNDSSSSWIELLDHAIVSPASCFVPWKRTELDKEAVAGGEAAQRLLKKVVGGGGAWMNRAAGSCSIKNHVMSERRRREKLNEMFLILKSLVPSIDKVDKASILSETIAYLKELERRVQELESGKKVSRPAKRKPCSETIIGGGGGGGGAGAVKEHHHWVLSESQEGTPSDVRVIVMDKDELHLEVQCRWKELMMTRVFDAIKSLRLDVVSVQASAPDGLLGLKIRAKYASSAAVVPAMISETLRTAVAGY

SEQ ID NO: 24576 - protein, 631 aa, Magnaporthe grisea
MSPSEVLQFPADDRIEPGSTDYPAAQFPTIKNTSVDVDAAADDIVGAFNKALDAGDANAVAALFLPDGASHGYWRDHLCLTWVMRTLKGRGQIGSFLASEIPHDGGDVKLPKRIAVDRSSAFRSPTLTAFEASGTHKCIGFHVEVEAQNGKGRGLARLAEGEDGKLYIATLFTTLLEIDGHPEPVRARRAKGVEHKGTHDEPNWRERREAAAGFGEQQPTVLVVGAGQAGLSVAARLQMQGVPTLVIDRNPRVGDSWRNRYHHLVLHDPIWFDHMPYIPFPDHWPVFTPKDKIADFFEAYVSLLELNVWTDTNLADSSWDEEKREWTVKLERAGETRTVRPKHIIQATGHSGKKNFPQIKGMDAFKGTRLCHSSEFPGATPNSAGKRAVVVGSCNSGHDIAQDFYSKGYDVTMVQRSSTCVIGSNAIVNIGLAGLYEEGGPPTEDADVVLYSYPFEQFKAAQRAVTALQNEADREILEALERAGFKVDMGPEACGLFIKYFQRGGGYYMDVGASRLVADGKIKIKQGCEISEVQADGLLFADGQKLEADEIVFATGYLNMRGEARAIFGDALADRVDDVWGFDDKGEHRTIWSRSGHPGFWFMGGNLALCRYFSRLLALQIKAAELGLNKL

SEQ ID NO: 24577 - protein, 351 aa, Ipomoea hederacea
ERLASSGIERIPKEYIRPEEERRSIGDIFEEEKIAGGPQVPTVDLKGINSEDLEVREKCREELRKAAVDWGVMHLVNHGIPEELTGRVKAAGEGFFGQPIEEKEKYANDQAAGNVQGYGSKLANNASGQLEWEDYFFHCIFPEDKTDLSIWPKTPSDYIDATKEYAKQLRALATKVLAVLSLGLGLEEGRLEKEVGGMEELLLQMKINYYPKCPQPELALGVEAHTDVSALTFILHNMVPGLQLFYGGKWVTAKCVPNSIIMHVGDTVEILSNGKYKSILHRGVVNREKVRVSWAVFCEPPKDKILLQPLPETVSEAEPPRFPPRTFAQHIKHKLFRQSDQEAADTPKPDN

SEQ ID NO: 24578 - protein, 840 aa, Oryza sativa
MTPSLLAFSSSSAARRPAPPPSAQRRGAAAPPRAPRRLPLRRNDEEQPRLHEPHLASPSCATIEEQPRRRELARAARSFYRFRTDDDDVVDVAVSGEDGDGGGGGYAVSVEVPGTRGREGGLVLRASGSGEGVPLAPAAGGASLAAELSFDPPRAPFYLSFMLTDASGAEIRTHRKTSFRVPVGVGPGSPAPLGMSISGDGAVNFAVYSKNANAVSLYLYAAAVGGGGGDEPALEIDLDPYIHRTGNVWHVSLASVDGYVSYAFCCGGIRLPLLDPYAKVIGDFVSSNSVYDEGVTAPSMRCFASLAIAPSYNWGRDRHPRLPLEKLVVYRANVALFTKDRSSGLPDDAAGTFTGLSAKVEHFRSLGVNAILLEPVFPFHQVKGPYFPYHFFSPMNLYSSKGLSVSAIKSMKDMVRVMHRNGIEVLLEVVFTHTAEGESECQTISMRGIDNSSYYIANGIAGCKASILNCNHPVTQKLILDSLRHWVLDFHVDGFCFINAPFLVRGPGGEYLSRPPLLEAIAFDPVLSMTKIIADPWSPLDISNVQFPFPHWKRWAEVNTRFSIDVRKFLKREALISDLATRLCGSGDLFSTRGPAFSFNHVSRNSGLSLVDLVSFSNDDLLSESSWNCVEEGPSEDSAVLQTRLRQIRNFLCILFVSLGVPVLNMGDECGHSAAGSVSYKDRGPLNWRGMKTTFVKEVTGFISFLTALRSRRGDIFQRREFLKLENIHWYGSDLCEPGWDDPTSNFLCMHINAEVDEMAADSVRGDLYICFNANEESVSAALPALAEGSVWLRLVDTSLAFPGFFATESNPKVQQVPGLSSYHVEAHTCVLFESKSALA

SEQ ID NO: 24579 - protein, 495 aa, Nostoc punctiforme
MGLIDPTKIDYLIISHTEPDHSGLVKNILQLAPSITVVGAKVAIQFLENMVHQPFNSRQVKSGERLNLGNGHELEFISAPNLHWPDTIFTYDHKTSTLYTCDVFGMHYCDDHTYDENITLLEEDFQYYYDCLMGPNARSVLAALKRIEKLEIGTVATGHGPLLQHYIPDWLGRYQNWSLEQAKTETLVALFYVEDYGHSEQLVRTIAHGCAKTGAAVELFPLNSSEPQEVRELVAQSSGLVIAMPPQSSVIAQASLSTILAAVHKKQSIGLLESGGGEDEPIYPLRNKFQELGLTEAFPPILVKEIPTQATEQLCDEAGTDLGQWLNRDRTIKQIKSINTELEKALGRLSTGLYIITAKKGEIQSAMLASWVTQASLEPLGVAIAVSKDRAIESLMHVGDRFVLNVLEEGKYQGLMKHFLKRFAPGVDRFAGVKTYPAKNESPVLAEALAYMECEITSRMDCGDHWVIYSTVQTGRVAKLDALTAAHHRKIGNHY

SEQ ID NO: 24580 - protein, 425 aa, Unknown
  Shewanella sp. MR-4
MSQTNQAQYLQQLGSQAKQASYALANLSAAQKADLLEAIAEALTQNTQAILAANAKDVAAAKAEGLNDAMIDRLLLNESRLAGIIGDIGDVVRLADPVGEEFGSRVLDNGLRLTRRRVPLGVIGVIYEARPNVTVDIAVLALKTGNAVILRGGKETLESNKLISEVIRGAIASQGLPVDAVQLIDSPDRALVTGLLKLDQYVDMIVPRGGQALQRLCAEQATIPVILGGIGICHLYVDKHADLERALEVIANAKVQRPTVCNALDTLLVDNAVAERFVPQIAEYLHRLGVRFSVCEQSYALLDGLGFDISPATEQSFATEWLSLALGIKVVNDIDTAIAHIRTYSSGHSEAILTDDIHTATHFMNEVNSAAVYVNASTRFTDGGQFGLGAEVAVSTQKLHARGPMGLEALTTYKWLAWGDYTSRA

SEQ ID NO: 24581 - protein, 351 aa, Ipomoea purpurea
ERLAGSGIERIPKEYIRPEEERRSIGDIFEEEKIAGGPQVPTVDLKGINSEDLEVREKCREELRKAAVDWGVMHLVNHGIPEELTGRVKAAGEGFFGQPIEEKEKYANDQAAGNVQGYGSKLANNASGQLEWEDYFFHCIFPEDKTDLSIWPKTPSDYIDATKEYAKQLRALATKVYAVLSLGLGLEEGRLEKEVGGMEELLLQMKINYYPKCPQPELALGVEAHTDVSALTFILHNMVPGLQLFYGGKWVTAKCVPNSIIMHVGDTVEILSNGKYKSILHRGVVNKEKVRVSWAVFCEPPKDKILLQPLPETVSWTEPPRFPPRTFAQHIKHKLFRQSDQEAADTPKPDN

SEQ ID NO: 24582 - protein, 484 aa, Mannheimia succiniciproducens
MSTKGDIGVIGLAVMGQNLILNMNDNGFKVVAFNRTTTKVDEFLQGAAKGTNIIGAYSLEDLAAKLEKPRKVMLMVRAGDVVDQFIDALLPHLEQGDIIIDGGNSNYPDTNRRTKALAEKGIRFIGTGVSGGEEGARHGPSIMPGGNPEAWPYVKPILQAISAKTDKGEPCCDWVGAEGAGHFVKMVHNGIEYGDMQLICEAYQFLKEGLGLSYEEMHEIFQQWKQTELDSYLVDITTDILAYKDTDGQPLVEKILDTAGQKGTGKWTGINALDFGIPLTLITESVFARCVSSFKEQRVAAAKLFNKTVSPVEGDKKVWIEAVRKALLASKIISYAQGFMLIREASEQFGWNINYGATALLWREGCIIRSAFLGNIRDAYETNPDLVFLGSDPYFKGILQNALADWRKVVAKSIEAGIPMPCMASAITFLDGYTSERVPANLLQAQRDYFGAHTYERTDKPRGEFFHTNWTGRGGNTASTTYDV

SEQ ID NO: 24583 - protein, 258 aa, Bacillus anthracis
MGKVYIVGAGPGDPDLITVKGLKCIEKADVILYDRLVNKELLSYAKPEADLIYCGKLPNYHTMKQETINTFLIKYAKKGKIVTRLKGGDPFVFGRGGEEAEALAKQGVPFEIVPGISAGIAAPAYAGIPVTHRDASASFAIVTGHRKEDAAEEVKWGNLAKGVETLAVYMGVSNLPYICEQLMKHGKDKSTPAAIIERGTTSMQRTVVGTLGTIVDVAKKEQIQNPSMIVIGEVVRFREKIHWFEKQTESTYQVSGVL

SEQ ID NO: 24584 - protein, 468 aa, Salmonella enterica
MSKQQIGVVGMAVMGRNLALNIESRGYTVSVFNRSREKTEEVIAENPGKKLVPYYTVKEFVESLETPRRILLMVKAGAGTDAAIDSLKPYLEKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELANTFTEWNNGELSSYLIDITKDIFTKKDEDGNYLVDVILDEAANKGTGKWTSQSALDLGEPLSLITESVFARYISSLKAQRVAASKVLSGPKAQPAGDKAEFIEKVRRALYLGKIVSYAQGFSQLRAASDEYHWELNYGEIAKIFRAGCIIRAQFLQKITDAYAENAGIANLLLAPYFKKIADEYQQALRDVVAYAVQNGIPVPTFSAAVAYYDSYRAAVLPANLIQAQRDYFGAHTYKRTDKEGIFHTEWLE

SEQ ID NO: 24585 - protein, 343 aa, Unknown
  Rhodococcus sp. RHA1
MRIGMLTGGGDCPGLNAVIRAVVRTAAGRYGSSVVGFRDGWRGLLEDRKVVLSNDDRIDRILTRGGTILGTARVNPDKLKAGLDQIRQTLDDNGIDALIPIGGEGTLTAASWLAESGVPVIGVPKTIDNDIDCTDVTFGFDTALSIATDAIDRLHTTAESHQRVMLVEVMGRHAGWIALHSGLATGAHLTLVPEVPFDVGEVCSLVKKRFQRGDSHFICVVAEGATPTPESMSLREGGIDEFGHKRFTGVAQQLGDEIVRRIGKEVRTTVLGHVQRGGTPTPYDRVLATRFGVHATDAVHRGDFGNMVALHGTSIDLVPLEEATRRLKTVPRERYEEAAAFFG

SEQ ID NO: 24586 - protein, 175 aa, Vibrio angustum
MKHTIEVMISEQEVQERVKELGKQITECYKDSKDLVMVGLLRGSFVFMADLARAIDLPHEVDFMTASSYGNTMESSRDVRILKDLDDDIKGKDVLLVEDIIDTGNTLHKVCEILSLREPNSIRICTLLDKPERREVDVKVDWYGFVIPDEFVVGVGIDYAQKYRHLPFIGKVVPE

SEQ ID NO: 24587 - protein, 291 aa, Saccharomyces cerevisiae
  misc_feature (1)..(1): Xaa can be any naturally occurring amino acid
XVHVASVEKGRSYEDFQKVYNAIALKLREDDEYDNYIGYGPVLVRLAWHISGTWDKHDNTGGSYGGTYRFKKEFNDPSNAGLQNGFKFLEPIHKEFPWISSGDLFSLGGVTAVQEMQGPKIPWRCGRVDTPEDTTPDNGRLPDADKDAGYVRTFFQRLNMNDREVVALKGAHALGKTHLKNSGYEGPWGAANNVFTNEFYLNLLNEDWKLEKNDANNEQWDSKSGYMMLPTDYSLIQDPKYLSIVKEYANDQDKFFKDFSKAFEKLLENGITFPKDAPSPFIFKTLEEQGL

SEQ ID NO: 24588 - protein, 105 aa, Arcobacter butzleri
MGKYIDLNKNNIKENIQEGVVLVDFWAPWCGPCRMLAPAIDQLAEEFENKAKICKVNTEEEPDLTSEYQVRSIPTILFFKNGEIVDQMIGATTKAKLEEKLNSLL

SEQ ID NO: 24589 - protein, 291 aa, Saccharomyces cerevisiae
  misc_feature (1)..(1): Xaa can be any naturally occurring amino acid
XVHVASVEKGRSYEDFQKVYNAIALKLREDDEYDNYIGYGPVLVRLAWHISGTWDKHDNTGGSYGGTYRFKKEFNDPSNAGLQNGFKFLEPIHKEFPWISSGDLFSLGGVTAVQEMQGPKIPWRCGRVDTPEDTTPDNGRLPDADKDAGYVRTFFQRLNMNDREVVALMGAHALGKTHLKNSGYEGPWGAANNVFTNEFYLNLLNEDWKLEKNDANNEQWDSKSGYMHLPTDYSLIQDPKYLSIVKEYANDQDKFFKDFSKAFEKLLENGITFPKDAPSPFIFKTLEEQGL

SEQ ID NO: 24590 - protein, 97 aa, Spinacia oleracea
  misc_feature (1)..(1): Xaa can be any naturally occurring amino acid
XAYKVTLVTPTGNVEFQCPDDVYILDAAEEEGIDLPYSCRAGSCSSCAGKLKTGSLNQDDQSFLDDDQIDEGWVLTCAAYPVSDVTIETHKKEELTA

SEQ ID NO: 24591 - protein, 151 aa, Unknown
  marine gamma proteobacterium HTCC2207
MRFLHSMVRVTDLEKSLAFYCTALGLAELYRYEVPKGRFTLVFLAAPSDADNAQETKAPLIELTYNWPPEQGEPEHYGEGRNFGHLAYKVDNIYATCQRLMDAGVVINRPPRDGHMAFVRSPDNISIELLQEGEALPAQEPWASMNNTGSW

SEQ ID NO: 24592 - protein, 736 aa, Geobacillus kaustophilus
MKNQNQHNTSKCPYHGSVTSYNSNRTTNKDWWPNQLNLSILHQHDRKTNPHDEEFNYAEEFQKLDYWALKEDLRKLMTESQDWWPADYGHYGPLFIRMAWHSAGTYRIGDGRGGGSTGTQRFAPLNSWPDNANLDKARRLLWPIKKKYGNKISWADLMILAGNVAIESMGGKTIGFGGGREDVWHPEEDIYWGAEKEWLASERYSGDRELENPLAAVQMGLIYVNPEGPDGKPDPVAAARDIRETFRRMGMNDEETVALIAGGHTFGKAHGAGPASHVGPEPEAAPIEAQGLGWISSYGKGKGRDTITSGIEGAWTPTPTQWDNSYFRLLFEYEWKLTKSPAGAYQWEAVNLREEDLAPDAEDPNVKVPPMMMTTDLALRFDPEYEKIARRFYENPEEFADAFARAWFKLTHRDMGPKTRYLGPEVPKEDFIWQDPIPTVDYELSDAEIEEIKAKILNSGLTVSELVKTAWASASTFRNSDKRGGANGARIRLAPQKDWEVNEPERLAKVLSVYEDIQRELPKKVSIADLIVLGGSAAVEKAARDAGFDVKVPFIPGRGDATQEQTDVESFSVLEPFADGFRNYQKKEYSVGPEELLIDKAQLLGLTAPEMTVLVGGLRVLGANYRDLPHGVFTDRIGVLTNDFFVNLVDMNYEWVPTEGGIYEIRDRQTGEVRWTATRVDLIFGANSILRSYAEFYAQDDNREKFVRDFINAWVKVMNADRFDIHLKQAKESVTV

SEQ ID NO: 24593 - protein, 714 aa, Klebsiella aerogenes
DLNAIESCARRSKRGAVVGGGLLGLEAAGALKNLGVETHVIEFAPMLMAEQLDQMGGEQLRRKIESMGVKVHTSKNTKEIVQQGTEARKTMHFADGSELQVDFIVFSTGIRPRDKLATQCGLAVAQRGGIMVNDSCQTSDPDIYAIGECASWNNRVYGLVAPGYKMAQVAVDHLLGSENSFTGADLSAKLKLLGVDVGGIGDAHGRTPGARSYVYLDESKEVYKRLIVSADNKTLLGAVLVGDTSDYGNLLQLVLNAIELPENPDSLILPAHAGSGKPSIGVDKLPDSAQICSCFDVSKGDLIAAINKGCHTVAALKAETKAGTGCGGCIPLVTQVLNAELAKQGIEVNNNLCEHFAYSRQELFHLIRVEGIKTFDELLEKHGQGYGCEVCKPTVGSLLASCWNEYILKPQHTPLQDSNDNFLANIQKDGTYSVIPRSAGGEITPEGLVAVGRIAREFNLYTKITGSQRIGLFGAQKDDLPEIWRQLIEAGFETGHAYAKALRMAKTCVGSTWCRYGVGDSVGFGVELENRYKGIRTPHKMKFGVSGCTRECAEAQGKDVGIIATEKGWNLYVCGNGGMKPRHADLLAADLDRDTLIKYLDRFMMFYIRTADKLTRTAPWLDNMEGGIDYLRSVIIDDKLGLNDHLEEELARLRAAFACEWTETVNNPAAQTRFKHFINSDQRDPNVQVVPERDQHRPATPYERIPVTLVEEKA

SEQ ID NO: 24594 - protein, 235 aa, Pneumocystis carinii
SHGIQAYRVSLHSILDSIELRQNDKALLFKSPNSKIEEISVVYFRTGYSPSHYPTSIQWSARLLIEESRAIKCPTVITQLAGCKKVQQVLCENNIINKFLPENISKSLKETFVSIYPLNKSLSGQEAYHLLMNNPQNYVLKPQREGGGNNIYGLNILSFLETISESQREQYILMEMIHPFLQTNTIVQNNELYHTNGGNELGIYGGYLLRTKDKDKNEGGVMIGCSSIDSCVLIP

SEQ ID NO: 24595 - protein, 560 aa, Pneumocystis carinii
MEHSFYERKGNEQLTSWGLLILMVLLIMALWVSYYLQDKRVRSMHETVISILLGMIVGVLIKEIKNTDIQKIVTFNYGYFFNLLLPPIILNSGYELHQELFFKNAGAIFTFAFVGTFVSAVITGLLIYLWALTGLEQIGISWIEALKFGATISATDPVTILSIFRTYNVDPTLYTIIFGESLLNDSVSIVMFETLQRFYNKEMSIIDVFIGIGRFFIIFIISLTIGIIAGISIALLLKYSHLRRFPYIESCIITLIAYSSYLFSNGCHMSGIVSLLFCAITLKHYAFYNMSIQTQFSTKFLFKILSQLSENFIFVYLGISLFTQENLVYKPLLILVTMLFVCIARYISIFSISKLINMIIESYNIVFYEKLPTSYQFMLFWSGLRGAVGVALIQALEGKEANTFKATILVVVVLTVIIFGGTTPQMLEITGIRMGITNYQDDYHMESFYNENPSLEETIYDRFQYRKSGQLDSFNVLYPFWIGSSETQGNEEDNTNRESFDSNLFFPTVTEPAKLEDISYTSYEMTNEDISTDKDKLSTSNNHIKWFKNFDSKVLMPFRC

SEQ ID NO: 24596 - protein, 738 aa, Arabidopsis thaliana
MSSPVKKMKKKTTTSPILSPTPHSTQILSLPVDLLISILARVSRLDYPILSLVSKSFRSLIASPELYETRSLLGRTESCLYLCLGIPSDFNPRWFTLCRKPKPSGHVMAAISIPNSRPVHCSGLVAVGSDIYNIGGSIINEHSSSVSILDCRYHTWRDAPNMLVERNSHAANVIDGKIYVAGGSRDSNSSNWMEVFDIKTQTWEPVLNPIADGCDRRIRKSAVIEEAICLFGNIDGIKLYDSKIGCWMKLKGLEGLPEFASYSYVRLADYGGKMAVLWDKLPTTGNNNMVIWCAVITLEKRHNENIWGRVEWFDAVLTVPEPYEFVGVFTFVARTNTEVDRRLYSPMSSPEKKRKTTKKPSPTPQSTTPNPSLPDDLVVSCLARVSRLYYPTLSLVSKSFRSLIASPDLYKTRSLLGRTESCLYVCLQEKDSDPNPRWFTLCLKPNRTLTNDITEKKKKKKKKKKMSSGYVLAAIPVLHSRPAYWSGLVAVGSNIYNIGGPIDKAHSSIVSVLDCQSHTWHEGPGMRVERRYPAANVVEGKIYVTGGCKDCSNSSNWMEVFDPRTQTWESVSSPGAEIGGCSIHKSAVVEGEILIANSHGLIYKPKEGRWERMKWDMDIGWVWYSYCVVENVLYYYYKGVFKWYDTMARLWRDLKGVKGLPRFARCGGKMADYGGKMAVFWDKIVTSDDGCKNKMILCAVIALERRNSEEIWGKVEWHDAVLTVPLSYEVVYALSPTV

SEQ ID NO: 24597 - protein, 457 aa, Klebsiella aerogenes
MDHLPIFCQLRQRDCLLVGGGDVAERKARLLLDAGANVTVNALDFTPQFQVWADSQMLTLVQGEFIPSLLDNCWLAIAATDDETVNQQVSEAAEARRIFCNVVDAPRQASFIMPSIIDRSPLMVAVSSGGTSPVLARLLREKLESILPLHLGQLARYAGHLRARVKQQFATVGERRRFWEKLFVNDRLAQSLANDDRQAVADTTEQLLTEPLEHRGEVVLVGAGPGDAGLLTLKGLQQIQQADVVVYDRLVSDDIMNLVRRDADRVFVGKRSGYHCVPQEEINQILLREAQKGRRVVRLKGGDPFIFGRGGEELETLCEAGIPFSVVPGITAASGCSAYSGIPLTHRDFAQGVRLVTGHLKTGGELDWANLAVEKQTLVFYMGLNQAPAIREKLIAHGMAEDMPAAIVENGTAVTQKVVSGTLGQLDILAQQMASPALIIVGRVVGLRDKLNWFSNH

SEQ ID NO: 24598 - protein, 244 aa, Unknown
  Streptomyces sp. CH7
IPGDTEVRELDLASLASVRAFAAKLTADHPSVDVLVNNAGLVHLGPRRTTADGFELHVGTNMLGPYALTGLLLDALTAGSGGRVVSLSSITHKNAHLDFGDLMSEHGYRASSAYGRSKLATTLFGLELDRRLRAAGLPVVSALAHPGLTRTNLTPRAWEHRGRFGRLIAAGGLLATQSVEQGALPQLRAATDPEVRGGQFFGPARLWETRGPVTEARLGEEAADPAVARRLWAVAEDLTGVRYP

SEQ ID NO: 24599 - protein, 416 aa, Magnetospirillum magnetotacticum
MRYLPLTESDRRAMLDVIGAKSVDDLFRDVPPSARLAGPLPLPSHQGEMEVERAFTRMAGKNLSAGCAPFFIGAGVYRHHIPAAVDQLLLRGEFLTAYTPYQPEVAQGTLQMLFEFQSQVAAITGMDVANASMYDGATATAEAAVMACRITKRAKVIVSGGVHPHYAETVETSLRYTEMEADVLPPDPLGMEDMIGRVDSQTACVIVQNPGFFGTVRDLRPLAALCHEVGALLVVMVAEPTSLGLIESPGAMGADIVVCEGQSLGMGMNFGGPGLGLFATRDKYVRQMPGRLVGQTADVDGRRGWVLTLSTREQHIRREKATSNICTNSGLCALAFSIHLTMLGGSGFGRLAELNHVAATRLEQKLRAVKGVRVLPQSYYNEFAIHLGDDADAAAVVDALADKGILAGVPASRFYP

SEQ ID NO: 24600 - protein, 272 aa, Schizosaccharomyces pombe
MKANIACVQMAPKVCDVKHNLQKMSSYVHEVMESNPSTNLILFPELITSGYECGNTFTQIAEIAGEGPSFKTMSNLAAKYHVNIIYGFPEKEEKQSNIIYNSCIYITENGNLGGVYRKVHLFDTERKHFKKGSDFPIFETSFGKLGVMICWDTAFPEVARIHALNGADLLVVATNWENPYSDDWDLVTKARAFENCIPLVAANRVGTDEKLSFFGHSKIIGPTGKVIKALDEEKEGVISYTVDLDDAKPLRKNYYTFFEDRMPDLYKRLLSP

SEQ ID NO: 24601 - protein, 85 aa, Chaetium bromoides
ECQKVGAPPEVSARLTAMAQELEARQRTALGGLGAALEPELDQFMEAYHEMLVKFREELTRPLQEAMEFMRKVESQLNSLSISGR

SEQ ID NO: 24602 - protein, 283 aa, Klebsiella pneumoniae
MPFPDTLHLESDLATALAASRDILVVVPSHVFGQVLRQIKPLMRSDARLVWATKGLEAETGRLLQDVAREALGDDIPLAVISGPTFAKELAAGLPTAISLAATDPQFAEDLQRLLHCGKSFRVYINPDFIGVQLGGAVKNVIAIGAGMSDGIGFGANARTALITRGLVEMSRLGAALGADPETFMGMAGLGDLVLTCTDNQSRNRRFGMMLGQGMDVQSAQDKIGQVVEGYRNTKEVRVLAQRLGVEMPITEEIYQVLYCGKIAREAALTLLGRARKDERSSN

SEQ ID NO: 24603 - protein, 716 aa, Saccharophagus degradans
MSEGYSVSEGRSFPMGATVSAQGTNFAIFSEHAEKVELCLFDEMGQTETARIMLPGNTDHVWHGFVEGVHAGALYGYRVYGPYEPQRGHRFNPNKLLLDPYAKRIDGAFHWSSIMYGYDADNPRQDLVKDKRDNSRDMPKCVVVAPLSLSDKERISEARPQVPWHKTIIYETHVKGFTQLNLAIPSSARGTFAGLAHPENLAYIKELGVTAIELLPVHGFIDESFLTAQGLSNYWGYNSLHFFAPHSGYLNDGDPAEFRHFTQAAHEAGLEVILDVVYNHTSEGNHLGPTLSFRGIDNASYYCLQAQDSRFYVNDTGCGNTLNLKHPRVLQMVMDSLRYWVTEMGVDGFRFDLATVLGRESHGFDPGSGFFDAIKQDPVLASVKMIAEPWDIGPGGYQLGNYPTGWSEWNDRYRDTCRRFWRGDPGMLPEFARRIHGSSDLFEHSGRKPSSSVNFITSHDGFTLADLVSYKNRHNEANNEQNSDGHHSNFSENYGVEGETDDDAILYVRERQKRNFLATLFLSQGTPMLLAGDELSRSQKGNNNAYCQDNEINWLDWQALTKKEIALSKFVSHLIKVRSSSPLLTSQRYIHKPDEPDGKISWCVNWINSYGEPMKDAQWAEQHAHCLGWVLEKIPVAEDSDKKSERLLVLFNSGNDDVLFRLPEDENVIGWKCLVDTRFIDGQGVPSCYEPRGEVPLMHKSLCLLKALFDGQDERD

SEQ ID NO: 24604 - protein, 85 aa, Chaetium bromoides
ECQKVGAPPEVSARLTAMAQELEARQRTALGGLGAASEPELDQFMEAYHEMLVKFREELTRPLQEAMEFMRKVESQLNSLSISGR

SEQ ID NO: 24605 - protein, 425 aa, Saccharophagus degradans
MLDPNSRYVSRLTRDTVALVLAGGRGSRLHELTDWRAKPALHFGGKFRIIDFPLSNCVNSGIRRIGILTQYKAHSLIRHVIRGWSSFKKEFGEYVEILPASQRYSPNWYQGTADAIYQNLDILQAEAPKYILVLSGDHVYQMDYGAIIAHHVETGADLTVSCIEVPIEEAAGSFGVMTVDDDNRIIRFDEKPQRPTELANKPGYTLASMGNYVFNTEFLFDQLRKDAADPDSEHDFGKNIIPNIIAEKLVSAYRFRDHDTNETAYWRDVGTLDSFWEANMELVSPNPSLNLYNHDWPIWTYQTQLPPAKFVFDDDSRRGYAVDSMVSGGCIVSGGKVKSSLLFSDVHIHSYAEIEESVLLPEVEVHRSAKIKKAIIDSACVIPEGMIIGHDHEHDKARGFRVTKKGVTLVTREMLGQQPAGTSAK

SEQ ID NO: 24606 - protein, 629 aa, Hypocrea lixii
MLARSVYTVTRSQITSTSYLPSLSSYSKFLQPKFTFSTMPPKGSKRETASPVGKANGVETKRVKHEANQDELHQPHPFAKDAEEHGIVLRRFYPHEMSTSRAYAYNSNEIERPMEGLVAALEETAGARKQAKVRHAVVHWFKMDLRHSDNRSLALASAKAKEAGVPLICVYIISPQDFEAHLTSPVRVDFMLRTLSVLKDDLAALDIPLHVETVDKRKDIPRRILELMEEWGSNHLFANMEYEVDELRRETRMIRQFAENNMSFEVVHDTCVVPPGELHSGTGKQYAVYTPWYRAWMAHIHENLDLLEIYDRPEKNPGATRRTFKTLFDCPIPDAPKNKQLNDEEKKRFHGLWPCGEHEAMSRLEKFCDEAVTSYHDRRNIPGDNGTSCLSVHLASGTISSRTCVRTARDRNKTKRLDGGHQGIHVWISEVAWRDFYKHVLVNWPYVCMNKPFKPEYANIEWSYNMDHFEAWCEGRTGFPIVDAAMRQLNHMGYMHNRCRMIVASFLSKDLLIDWRMGEKYFMEHLVDGDFASNNGGWGFSASVGVDPQPYFRVFNPLLQSEKFDPNGEYIRKWIPELKALSDKEIHDPYNRGAGTKAKKQGYPKQIVDHKGARERALSAYKDGLERGI

SEQ ID NO: 24607 - protein, 704 aa, Enterococcus faecalis
MTEKQVFKTTWGGRPLEVEIGQLAKQANGAVLVRYGDTVVLSAAVASKEAKDVDFFPLTVNYEEKMYAVGKIPGGFIKREGRPSERATLTARLIDRPIRPMFSEGFRNEVQITNIVMSVEQDCTPEMAAMFGSSLALAISDIPFDGPIAGVDVGRINGEYVLNPTVEQAEQTDIELTVAGTKEAINMVESGAKEVSEEDMLGALLFGFDAIKELVAFQEEIVAAVGKPKMDVDLLQVDADLKKEIFDAYYNTMKTAVMTEEKLAREVEIDKVKDTVKEVYAEKFSEHEEEAQLLKEVKQIAEDLEKDVVRELITIDKIRPDGRKLDEIRHLSSEVSILPRVHGSGLFTRGQTQALSVCTLAPLGEHQIIDGLGVQDSKRFIHHYNFPQFSVGSTGRAGSPGRREIGHGALGERALAQIIPSEEDFPYTIRLVAEVLESNGSSSQASICAGTLALMDAGVPIKAPVAGIAMGLVSDGENYTILTDIQGLEDHLGDMDFKVAGTKDGITALQMDIKIQGITEQILTEALDQAKKARMEILEELTTTIAAPREELSQYAPKIEMIQIKPAKIKDVIGKGGETINSIIDETGVKIDIDQDGNVSIASSDAEMIKKAIKIIEELTKEVEVGQVYLAKVVRIEKFGAFVNLIKGKDGLIHISQLANERVNNVEDVVKLGDEVLVKVTEIDKQGRVNVSRKALLNEENKEK

SEQ ID NO: 24608 - protein, 323 aa, Klebsiella pneumoniae
MSKIFEDNSLTIGHTPLVRLNRIGNGRILAKVESRNPSFSVKCRIGANMIWDAEKRGVLKPGVELVEPTSGNTGIALAYVAAARGYKLTLTMPETMSIERRKLLKALGANLVLTEGAKGMKGAIQKAEEIVASNPEQFLLLQQFSNPANPEIHEKTTGPEIWEDTDGQVDVFISGVGTGGTLTGVSRYIKNTKGKKDLITVAVEPTDSPVIAQALAGEELKPGPHKIQGIGAGFIPGNLDLKLVDKVIGITNEEAISTARRLMEEEGILAGISSGAAVAAALKLQEDEAFTNKNIVVILPSSGERYLSTALFADLFTEKELQQ

SEQ ID NO: 24609 - protein, 350 aa, Ipomoea trifida
ERLAGSGIERIPKRYIRPEKERPSIGDIFAEEKMAGGPQVPTVDLKGINSEDLEVREKCREELRKAAVDWGVMHLVNHGIPEELTARVKAAGEGFFGQPIEEKEKYANDQAAGNVQGYGSKLANNASGQLEWEDYFFHCVFPEDKADLSIWPKTPSDYIAATREYAKQLRALTTTVYAVLSQGLGLEEERLEKKWRDGRASSTNEDNYYPKCPQPELALGVEAHTDVSALTFILHNMVPGLQLFYEGKWVTAKCVPNSIIMHVGDTVEILSNGKYKSILHRGVVNREKVRVSWAVFCEPPKEKIILQPLPETVCRADPPRFPPRTFAQHIKHKLFRLTDQEGADTPKPDE

SEQ ID NO: 24610 - protein, 740 aa, Colwellia psychrerythraea
MFKSTLPIAAAISVALTSMVLPAKALAANEAKTNQFWWPDQLSLSPLRQHGAESNPYGEQFNYAKEFASLDLAMLKKDIQTTLTDSKSWWPADWGHYGPLMIRMAWHSAGVYRVHDGRGGASGGQQRFAPLNSWPDNVNLDKARRLLWPVKQKYGRKISWADLMVLSGNVALESMGFKTFGFAGGRTDDWEPDLVYWGPETAMLSDKRRDKKGKLKGPLAAVEMGLIYVNPEGPHGKPDPLLAANDIRMSFGRMAMNDEEIVALLAGGHTLGKAHGAKKPNGCVGAEPAAADIEAQGLGWKNKCGTGVGADTISSGLEGAWTVTPTQWSSNYLDNLMNFNWVLTKSPAGAKQWIPDNKAAANLVPDAHIPNKRHAPIMFTTDIALKEDPQFRKIVERFRADPTQFDLAFAKAWFKLTHRDMGPRARYVGAEVPSEVLMWQDPIPAINYQLITDKDIKQLKKQITNSGLTTSELVRTAWAAASSHRVTDMRGGANGARINLEPQNSWAVNNPKELGKVLAKLEGIQARFNKKSAKTKVSLADVIVLGGATAIENAAAKAGNRITVPFSPGRADASQAQTNVKSFNYLKPKADGFRNFYTDDSYSSPAEMLVDKANSLGLNVPEMTVLIGGMRALDANYDASSYGVLTNNPGVLTNDFFVNLLDMKTVWSKDKSNAGIYIGHDRASGTEKWQATPVDLIFGSSSELRAIAEVYASDDADKKFINDFTKAWVKVMQLDRFDLK

SEQ ID NO: 24611 - protein, 221 aa, Triticum aestivum
VGYAQGFPIHDVVNRRPVNVIRLTIGRFGPTSHAPGRHGRGISVFAEVSHCVHLVSWEKENVSSEALEAARIACNKYMTKHAGKDAFHLRVRVHPFHVLRINKMLSCAGADRLQTGMRGAFGKPQGVCARVAIGQVLLSVRCKPNNAIHATEALRRAKFKFPGRQKIIESRKWGFTKFNRNDYLKFKSEGRILPDGVNAKILGCHGRLANRAPGQAFLSAA

SEQ ID NO: 24612 - protein, 146 aa, Escherichia coli
MGPLCSREKRMLGLMVGALVLWIFGGDYIDAAMVGYSVVALMLLLRIISWDDIVSNKAAWNVFFWLASLITLATGLNNTGFISWFGKLLAGSLSGYSPTMVMVALIVVFYLLRYFFASATAYTSAPAPMMIAARWRCRKSRCRCSA

SEQ ID NO: 24613 - protein, 103 aa, Escherichia coli
MKKIDAIIKPFKLDDVRERLAEVGITGMTVTEVKGFGRQKGHTELYRGAEYMVDFLPKVKIEIVVPDDIVDTCVDTIIRTETGKIGDGKIFVFDVARVIRIVP

SEQ ID NO: 24614 - protein, 303 aa, Triticum aestivum
  misc_feature (198)..(198): Xaa can be any naturally occurring amino acid
  misc_feature (225)..(225): Xaa can be any naturally occurring amino acid
NKFVQKSRFVPVRNSRDIVDPRVRDAGDAMAGERVVVGGWVKTGRQQGKGEFAFLEVNDGSCQGNLQVMVEKDVHPLAQLTHTGTSVLVEGVLKKPPAEAKQRIELKVERVIELGEVDAAAYPLPKTKITLETLRDFVHLRARTNTIGAVARIRHQLAYATHSFFDENGFLYIHTPIITTSDCEGAGEMFQVTALFSXAEKVEKELKENPAPSEADVEAAKLVGXEKGDAVAQLKAAKASKQEITAAVPVLTKAKENVLRGEERSKLKPGLHSRMMERLRLSTSTSDVQATKLAVITWQIRKD

SEQ ID NO: 24615 - protein, 563 aa, Mycobacterium avium
MPVTDAATEPAYTVGDYLLDRLAELGVSEIFGVPGDYNLEFLDHIVAHPRLRWVGNANELNAGYAADGYGRLRGMSALVTTFGVGELSAANAVAGSYAEQVPVVHIVGGPSKDAQGTRRALHHSLGDGDFEHFFRVSREITCAQANLMPATARREIDRVLSEVREQKRPGYILLSTDVARFPTEPPEAALPRYTGGTSPRALAMFTEAAAALIGEHRITVLADLLVHRLQAIKELEALLAADVVPHATLMWGKSLLDESSPNFLGIYAGSASAPAVRTAIEEAPVLVTAGVVFTDMVSGFFSQRIDPARTIDVGQYQSSVAGEVFAPLEMGEALQALTAILTRRGVSSPPVASPPAEPLPPPPPREQPLTQKMVWDRVCTALTPGNVVLADQGTSFYGMADHRLPQGVTFIGQPLWGSIGYTLPAALGAAVAHPDRRTVLLIGDGAAQLTVQELGTFAREGLSPVIVVVNNDGYTVERAIHGETAPYNDIVGWKWTEVPNALGVTEHLAFRVQTYGELDDALTAAARHQDRMVLVEVVLPRLEIPRLLVELVRPTSPDGSPRR

SEQ ID NO: 24616 - protein, 961 aa, Clostridium thermocellum
MTDSPQKRILKRKNRCKGIITAVIIAAQLLTSSILFAEAPPATFTPAENWEDYDYFNFAEALQRSLYFYDAQKCGVEAGYDHGGRLEWRGACHEVDERIPISNTPLSEAFLAKYRHIIDPDGDGTVDVHGGFHDAGDHVRFGLPQSYTAGTLGWGFYEFRESFRAIGEEEHMIEILRYFTDTFLRCSFMDEEGNIVAFCYMVGEGDEDHCYWGPPELYPEEYLRSRPADFATFDDPGSDVCASTAAALCTSYLNFKDEDPEYAEKCLTVAKALYDFAVKYRGLHKGDGYYTSDYDEDELAWAAVWLYECTGDMKYINDIVAVDETGNYVGYMKRIIPDTFKQNVWYNSWVHCWDAVWGGTFIKLNELFPENELFDFIARWNVEYLSGGKCPHEDPNDHNYCKPSPAGYTMINGWGSARYNAAAQLCALVYMKNNPDRTDFGEWAKSQMEYLMGRNPMGYSYIVGYGYEKGLPFAKHPHHRAAHGSKTNSMNDPEEHRHILWGALVGGPDLNDYHIDSTTEYAYNEVAVDYNAAFVGALAGLYKYYGQGHEPIPNFPPLEPETDDYFCEAKIVRETKDSTQVLLRIHNESTRPPHYETGMMARYFFNISELIENGQSIDDVIFTIEYDEQISMQQEPVVYRGPFKWDDAGTYYFEFDWSGRKIYGDRELQISFRVKQDSNYMTHWDSSNDYSRQGLTNEYAISKNVPVYLNGVKVYGEEPPKLSPTPTPTIDPSQTPDANASISVSYKCGVKDGTKNTIRATINIKNTGTTPVNLSDIKVRYWFTSNGNEQNNFVCDYAAFGTDKVKGIVKKIENSVPGADTYCEISFTEDAGRLAPGGSTGTIPFRIEGAAEYDQTDDYSYNSEMSDDFGDNTKITAYIKDKLKYGVEPVTIIDITLGDLNYDGKVNSTDYLVLKRYLLGTIDKESDPNFLKAADLNRDGRVNSTDMSLMKRYLLGIITSF

SEQ ID NO: 24617 - protein, 112 aa, Novosphingobium aromaticivorans
MKFIIAIIKPFKLDEVREALSGLGVAGMTVSEVKGFGRQKGQTEIYRGAEYSTNMLPKVKIEIAASDDLAPQIVETIQQAASTEAIGDGKVFVLDLASATRIRTGETGDTAL

SEQ ID NO: 24618 - protein, 437 aa, Pneumocystis carinii
MFMTGQCSKKESKYEPLVMSTRIGRRYNRNKGPDASYKFPMVYPTTRCRLKLLKMERIKDYLLLEQEFVSNQELLKLDSEKRDQKGEEEDDDKLQSLIGSPMGVGTLEEMIDDDHAIVSSATGPEYYVSIMSFVNKDLLEPGCSVLLHHKAVSIVGVLSDDIDPMVSVMKLDKAPTESYADIGGLESQIQEIKETVELPLTHPELYEEIGIRPPKGVILYGEPGTGKTLLAKAVANQTSATFLRIVGSELIQKYLGDGPKFVRELFQTAQDNSPSIVFIDEIDAIGTKRYDSTSSGEREIQRTMLELLNQLDGFDDRGDVKVIMATNRINDLDPALIRPGRMDRKILFETPDQNTKRKIFQIHTSKMNLGDDVLIEEFITAKDEMSGADVKVIAICTEAGLLALRERRMRVVADDFRKAKEHVLKTKQKNIQGELYI

SEQ ID NO: 24619 - protein, 405 aa, Vibrio cholerae
MAGVLGMILAGGEGSRLKPLTETRTKPAVPFGGSYRLIDFALNNFVNADLMRIYVLTQFKSQSLYIHMKKGWNLSGITDRFIDIIPAQMRDGKRWYEGTADAIYQNLRFVEIVAPDQVCIFGSDHIYKMDIRQMLDFHRRMEAELTVSALRMPISQASQFGVIEVDENGKMVGFEEKPSNPKSIPGEPEWALVSMGNYIFEAETLSKELREDAENNQSSHDFGKDIIPKMFPRGKVYVYDFTTNKIKGEKESTYWRDVGTIESYWSAHMDLLDKDPEFSLYNRSWPLHTYYPPLPPATFVDVKDKKVKITDSLISGGSYIQGSTIYKSVLGFRSNIAAGSFISESVILGDVKIGAGCTIKRAIIDKDVEIAAGTIIGEDLEMDRKRFHVSDEGIVVIAKGSKVGF

SEQ ID NO: 24620 - protein, 276 aa, Chlamydophila abortus
MEEQPLCNLSVKDLMEAGAHFGHQTRRWNPKMKLYIFEEKNGLYIINLAKTLYQLRKALPQVCKVIKENKPILFVGTKKQAKCVIKEAAIEAGEYFVAERWLGGMLTNMTTIRNSIKTLDKIEKDLTQNSSYLTKKEIALLAKRHQKLLKNLEGIRYLKKAPGLVIVVDPSYEKIAVAEAKKLGIPVLALVDTNCDPTPIDYVIPCNDDSLKSIRLIISTIKDSIIDTKKKLGVEIVSPIKTLDIQDSEDMDVYATDEDNRQEDLLAKKYDSNEAN

SEQ ID NO: 24621 - protein, 730 aa, Clostridium thermocellum
MKKFLSLILVVSFLIMLLTPSTKISAATTFNYGEALQKAIMFYEFQRSGKLPSTIRNNWRADSCLDDGKDVGLDLTGGWFDAGDHVKFNLPMAYTAAMLAWAVYEEKDAFVKSGQLKYILDEIKWATDYFIKCHPEPDVYYYQVGDGDIDHMWWGPAEVVHLRTKRPSYKVDITSPGSTVSAETAAALAAASIVFKDTDPQYSNLCLKHAKELFNFADKTRSDAGYTAATNFYTSHSGFYDELTWAATWIYLATGDTSYLDKAESYVEFWSTEPQTDIMSYKWGHCWDDVRYGAQLLLARITNKPIYKESMERHLDYWTVGVDNSRIKYTPKGLAWLNNWGSLRYATTTAFLAAVYAGWEGCSPQKAKIYNDFAKAQVDYALGSTGRSFVVGFGENWPQHPHHRTAHGSWYDSMNVPDYHRHVLYGALVGGPGESDNYRDDISDYQCNEVACDYNAGFVGALAKMYNRYDGRPVPEFKAIEVPEDEFMVEAYVSSSDKNYVEIKTRLNNRTAWPARVSEGLSFRYFIDLTEVIEAGYGPNDLIISGGQGSSGKVSGPHLWNKEKNIYYIEVDYTGDRLFPGGQDHYRRDSSLRIAVPGNSGCWNSENDPSFKGLSKASEFKKAEYIPVYEYGVKVAGIEPEGTVVQPSPSPTPTPTPPHSDDVLYGDINNDKTVNSTDVTYLKRFLLKQINSLPNQKAADVNLDGNINSTDLVILKRYVLRGISKLPYAP

SEQ ID NO: 24622 - protein, 213 aa, Glycine max
MKKARALSVAVNVLCLAIVCSAIESPQHTVVHSESDFEIRLYRTSVWMSAPALDISFEKATWNGFHRLFQFTEGANLNFSRIPMTIPVLTTAVPGAGPLQSQGYYVSLYLPVKFQGDPPVPLPELNIKPYEFSSHCVAVRKFSGFAKDERIVKEAEKLATSLSRSPWAESKTGRGYSIAQYNTPIRIVKRKNEVWVDIDAPELGCKSVGVAAH

SEQ ID NO: 24623 - protein, 326 aa, Burkholderia thailandensis
MDTVVPLLSDSAARWLPLALSEQVSGKAPLAVMCMGQPIVLFRDAAGAARAMEDRCAHRRAPLSLGRVTPEGRLQCGYHGWTYDGASGACVAIPNLSHDERVPAHYAARAYETFERDGYVWGRAALGVDTRELAAAFARASRCAQRFAGCATVTVAYDEYVAALADGPHLLMRIAGLRITDYVIADPEPRGGRIDMERGVTWAARRHDHRFGAHYPWTLRLAPPQDGAPASVEIDTRDGAPMLWASVAMTPAARGTTNVLWRGGVSADTGGPGATLFRLWARLRRPPFAMLEHVDGRALSKLDASCSRDARVIPVGSDRLPCERSR

SEQ ID NO: 24624 - protein, 537 aa, Schizosaccharomyces pombe
MEAAPSEKVPAKKLSSSENLDIGVSEVVTVDAAENNSNGIKRGLKTRHVSMMALAGIIGPGVFIGMGSALHIGGPVGLIVGFAIVSIVVFGVMLSIGEFNSLFDFNFNTHAARWVDPAFGAAIGWNYVIVWLTNIAAEYTSLTSILQYWGPHVPSYGFFLIFWGFFTCYQMLGVSVFGESEYILAFIKLLFITGFYIFAIIYAAGGIPHHKPPNLFKEMPLAHGFGGIVSAFVYAGVFFSGVESVSMTAAESKNPKKAIPLAVRQTFWRILYVYFGISISYGITVAWNDPNLSSGSKTLKSPMTIAIMNAGWNHAGDFVNAVILITCLSSINSGIYIGSRSLYNLAKDGMAPKIFKRVDKRGVPWVAVHSVHLFGFLSIMNYSTGAVKAYGYIINLAGVSAFIVWTAIIFVHFRFRRGWVKQGYALSDLPFKSPLYPFPQLIGFVIGIILTLVQGWTVFKPFAAGDFVDAYILLPLFFVIWLSYKFIKKTKWVSYEDMDFINGRRVIEPTYSNEQSSDKETEDGKKTSFWNRVWKEV

SEQ ID NO: 24625 - protein, 566 aa, Pneumocystis carinii
MIGLYAHVNASKDHFDDVINASPPLEEPQEPPLRGTLYLLFLTLVLGGLQLTCKSRKIFILYYIREGTPYLLSLGLTKHYTSFVWIAAPLTGIIIQPLIGFFSDRSRSKFGRRRPFLVVGTLCVVISLIGLAYFKDIAFFFFSGHEKVAKNMTIIVSIIIVYLLDFSINIVQASSRALIIDMVPMVQQDLANAWASRMIGIFNVVGYLNGYLNLPKIAPALGNTEFKALSVIGSIVLIVCMAVTFFVAKEKRYFMESLFNFFKTIFSTIITLPSEILWICIIQFFAWIELISMVFKVSDSFLCKIFFGTTYVAEIYAEKYCNKYLKYPDHLYTKEKEYLLIEEATRYGSFAFCAFFYYFFIRNIFLSFIFFMDFWSFYFYFMHAFNHTSKINHFFFPLFVSGKKLFKYIFRLKFYNILQNINIQFLWTFGHFIFTLCMLSTILVKSITQATIIIALCGLSWAITLWAPFSLIAIQLSSNNQLHRSGTILGVHNIFITVPQVLSIIMVGIIFKLTGYKKFEDIIKCNDNMDYSFIWIFQISGISALIAMYLSFKIYTNDPSYERNKI

SEQ ID NO: 24626 - protein, 284 aa, Oryza sativa
MEPSPDAPRAGAAEEQPGPSSSASAPAPAASSNEEEGRHQSQAQQQVQEAQPQPLAQQAPAAAGLSRYESQKRRDWNTFLQYLRNHKPPLTLPRCSGAHVIEFLKYLDQFGKTKVHADGCAYFGEPNPPAPCACPLRQAWGSLDALIGRLRAAYEESGGRPESNPFAARAVRIYLREVREAQAKARGIPYEKKRKRGAAAAAAAPPVVVAPPPVVTAPDDATGTSGGAGEDDDDDEATHSGEQQDTTPAASPTTPPATSVGTTTAAATAAAAKGSAAKGSATSS

SEQ ID NO: 24627 - protein, 471 aa, Klebsiella aerogenes
MDYLPLFAELKQRPVLVIGGGEIAERKIKFLLRAQAQVQVVAETLSPALADLAARQALSWRATAFSDSLVDDVFLVIAATEDEALNQRVFAAANARYRLVNVVDNQALCSFVFPSIVDRSPLLVAISSSGKAPVLSRILREKIEALLPTNLGRLAESASYWRNHLKTRLTTTEARRRFWERVFTGRFASLMVAGNSAEAEKALQDELDKPERETGEIILVGAGPGDAGLLTLRGLQAIQQADVVFHDHLVTQPVLELVRRDAELICVGKRAGEHSVPQHETNQLLVEAAKAGKTVVRLKGGDPFIFGRGAEELQAAAEAGIPFQVVPGVTAAAGATAYAGIPLTHRDYAQSAVFVTGHYKPDSAPFDWSLLAKSQQTLAIYMGTMKAAEISAQLIAHGRDSDTPVAVISRGTRDDQQTITGTLQQLEHLAKDAPMPSLLVVGEVVQLHQQLAWFQHTSSAEGFNASVVNLA

SEQ ID NO: 24628 - protein, 416 aa, Vibrio vulnificus
MDLITLGKAAKDAAFQLATASTAQKNKALAIIADELEANAADILAANSKDIELGRQAGLSEAMLDRLLLNESRLNGIANDVRNVISLTDPVGSEIDSKVLENGMQLSRRRVPLGVVGVIYEARPNVTIDIAALCLKTGNASILRGGKETFFSNMELVKVIQSALAKAGLPAASVQYIEKPDRELVTQLLKLDDYVDMIIPRGGAGLHKMCKENSTIPVIIGGFGISHIFVDETADLAKSVDVVENAKAQRPSACNALDTLLVHERIAEQFLPMLVAKLNGKVTFVVEPKAKAYMTKAEQVRDASDGDFDTEWLSYTLGVKVVADVQEAIDHMREHNASHSDAIMTNHLQNAELFINSAGSAAVYVNASTRFTDGAQFGLGAEVAVSTQKLHARGPMGLEELTSYKWVGKANYLSRA

SEQ ID NO: 24629 - protein, 343 aa, Oryza sativa
MFNCAAREKAMVINLEFIRAIVTADEILLLDPLTIDVIPFVARGTHHLPLKNLVCGNGQPGGDDHGEKHDDSHGDQVPRLNEATGAEHELPFEFQVLELALETVCSSFDVNVSGLERRATPVLEELTKNVSTRNLDRVRTLKSDLTRLLAHVQKVRDEIEHLLDDNEDMAHLYLTRKQLQNQQVEALISSAASNSIVPGGTSLSRLNNSFRRSVSIATSMHLDNDVEDLEMLLEAYFMQLDGIRNRILSVREYIDDTEDYVNIQLDNQRNELIQLQLTLTIASFGIAVNTFIAGAFAMNIQSKLYSIDDGSFFWPFVGGTSSGCFMICIVLLWYARWKKLLGP

SEQ ID NO: 24630 - protein, 85 aa, Panicum miliaceum
ECQKVGAPPEVSARLTAMAQELEARQRTALGGLGAATEPELDQFMEAYHEMLVKFREELTRPLQEAMEFMRRVESQLSSLSISGR

SEQ ID NO: 24631 - protein, 512 aa, Pinus taeda
MSVPEMGPFGVVVTGIVAIAIVYKLVQRWRFKLPPGPRPWPVVGNLLQIEPVRFRCFWDWSKKYGPIMSVWFGSTLNVVVSNTELAKEVLKEHDQQLADRPRSRSAEKFSRNGQDLIWADYGPHYVKVRKVCTLELFSPKRLEALRPIREDEVAAMVESIFNDCGKQEGIGKPLVVKRYLSGVAFNNITRPAFGKRFVNEEGKMDPQGVEFKEIVATGLKLGASLTMAEHIPYLRWMFPLEEGAFAKHGARRDNVTKAIMEEHTLARQTSGAKQHFVDALLTLQEKYDLSEDTIIGLLWDMITAGMDTTAITVEWAMAELVRNPRIQQKAQEEIDRVVGRDRVMNETDFPHLPYLQCITKEALRLHPPTPLMLPHKATQNVKIGGYDIPKGSNVHVNVWAIARDPAVWKDPVTFRPERFLEEDVDIKGHDYRLLPFGAGRRICPGAQLGINLVQSMLGHLLHHFVWAPPEGMQAEDIDLTENPGLVTFMAKPVQAIAIPRLPDHLYKRQPLN

SEQ ID NO: 24632 - protein, 72 aa, Corynebacterium efficiens
MAKEGAIEVEGRVVEPLPNAMFRVELDNGHKVLAHISGKMRQHYIRILPEDRVVVELSPYDLTRGRIVYRYK

SEQ ID NO: 24633 - protein, 85 aa, Panicum miliaceum
ECQKVGAPPEVSARLTAMAQELEARQRTALGGLGAATGPELDQFMEAYHEMLVKFREELTRPLQEAMEFMRRVESQLSSLSISGR

SEQ ID NO: 24634 - protein, 547 aa, Arabidopsis thaliana
MEVSNQTRKRKAIDAGHGSQPTAYRGSDGVDLSLLEALEKSSHNGVEALDLKTLKKLVLSFERRLRDNIAARLKYVENPEKFADSEVDLHDDLQKLKVLAGAPELYPDLVASNTVPSIVNLLSHENSDIANDVVQLLQDLTDEDALEDNDEPARVLVDALVENNVLELLVQNMNRLSEADPDEATAIYATLTVIENLVEVKPAVAQLVCERTKLLRWLLTKIKVREIEGIKQYASEILAILLQNSTANQKRLGQMNGVDAVLEGAAMYKSKDPKTPDEEEMLENLFDCLCCLLMPLENKERFVNAEGVELMIIIMKQKKYAYGSAIRALDFAMTNYPPACERFVDVMGLKTAFAAFMGKIPLNKRIKRERYKEELEERVISLIASLFAGILRGSRRDRLLSKFVENEFEKIDRLMELYLRYSDRVRSEAERLDQLELDDLELDEDEKYNRKLESGLYSLQLVAVILGHIWCSEHSGMRARVELLLKQQKLSKPMSSRFFRSITTTLEILMEQRRRNEDRREFSCSYQRCDLEKERKKLEIVQMAWYY

SEQ ID NO: 24635 - protein, 405 aa, Escherichia coli
MNRTVMMALVIIFLDAMGIGIIMPVLPALLREFVGKANVAENYGVLLALYAMMQVIFAPLLGRWSDRIGRRPVLLLSLLGATLDYALMATASVVWVLYLGRLIAGITGATGAVAASTIADVTPEESRTHWFGMMGACFGGGMIAGPVIGGFAGQLSVQAPFMFAAAINGLAFLVSLFILHETHNANQVSDELKNETINETTSSIREMISPLSGLLVVFFIIQLIGQIPATLWVLFGEERFAWDGVMVGVSLAVFGLTHALFQGLAAGFIAKHLGERKAIAVGILADGCGLFLLAVITQSWMVWPVLLLLACGGITLPALQGIISVRVGQVAQGQLQGVLTSLTHLTAVIGPLVFAFLYSATRETWNGWVWIIGCGLYVVALIILRFFHPGRVIHPINKSDVQQRI

SEQ ID NO: 24636 - protein, 377 aa, Solanum lycopersicum
MSIRSSPLLPHILRYQKRSLIGTTSSGRFSTFASPKCAASDPDQLKSAREDIKELLKATFCHPILVRLGWHDAGTYNKNIEEWPQRGGANGSLRFEIELKHGANAGLVNALKLLQPIKDKYSAVTYADLFQLASATAIEEARGPKIPMKHGRMDVSVPEECPEEGRLPDAGPPSPAAHLRDVFYRMGLNDKEIVALSGAHTLGRSRPERSGWGKPETKYTKDGPGAPGGQSWTVQWLKFDNSYFKDIKEKRDNDLLALPTDAVLFEDPSFKDYAEKYAVDQDAFFKDYAEAHAKLSNLGAKFDPPEGASQETIILHKFNQRSSWQQNTINWKERALGCYETKDSSRIRKGLGGTPDKPLPTNYFLNIIISSLVFWQF

SEQ ID NO: 24637 - protein, 299 aa, Unknown
  Oceanospirillum sp. MED92
MSTYFPTIEDYVGKTPLVRLQRIGQANGNIILCKLEGNNPAGSVKDRPALSMIQRAEDRGQIKPGDTLIEATSGNTGIALAMAAAIKGYKMKLIMPDNSSEERKASMTAYGAELIPVTKEEGMEGARDLALAMQERGEGIVLDQFSNMDNPEAHYCGTGPEIWEQTQGKVTHFVSSMGTTGTIMGTSRFLKEQNPDVQIVGLQPSEGAQIPGIRRWPQEYLPKIFDENRVDRILDINQDDAENTMRALAQEEGIFCGVSSGGSVAGALRLAEEVENAVIVCIICDRGDRYLSTGVFNQN

SEQ ID NO: 24638 - protein, 387 aa, Fusobacterium nucleatum
MIRSYMAIIYLGDSKKNISPLTKVRALASIPVGGSYRIIDFSLSNVVNAGIRNVGLFCGNEELNSLTDHIGMGAEWDLARKKDGIFIFKRMLDDNFSLNQARISKNMEYFFRSTQQNIVVLNAHMVYNLDVSDLIEKHEASGKEITMVYKKVKKANEHFNHCSSVKIDENNRVIGIGQNLFFKEEENISLDAFVLSKELMLKLLVDSIQEGKYNVLSELIARNLPSLNINAYEFKGYLQCINSTREYFNFNMNLLNQKIRDDVFGIKSGRKIFTKVKDTPPTLFKETADVENSLVSNGCIIEGTVKNSILSRGAIIEKDVVLEECVILQDCHIKKGAHLKNVIVDKNNIIHENEKLSASKEYPLVIEKSMKWDTKQYQDLMDYIRNK

SEQ ID NO: 24639 - protein, 469 aa, Bacillus subtilis
MNQSQSGLKKELKTRHMTMISIAGVIGAGLFVGSGPVIHSTGPGAVVSYALAGLLVIFIMRMLGEMSAVNPTSGSFSQYAHDAIGPWAGFTIGWLYWFFWVIVIAIEAIAGAGIIQYWFHDIPLWLTSLILTIVLTLTNVYSVKSFGEFEYWFSLIKVVTIIAFLIVGFAFIFGFAPGSEPVGFSNLTGKGGFFPEGISSVLLGIVVVIFSFMGTEIVAIAAGETSNPIESVTKATRSVVWRIIVFYVGSIAIVVALLPWNSANILESPFVAVLEHIGVPAAAQIMNFIVLTAVLSCLNSGLYTTSRMLYSLAERNEAPRRFMKLSKKGVPVQAIVAGTFFSYIAVVMNYFSPDTVFLFLVNSSGAIALLVYLVIAVSQLKMRKKLEKTNPEALKIKMWLFPFLTYLTIIAICGILVSMAFIDSMRDELLLTGVITGIVLISYLVFRKRKVSEKAAANPVTQQQPDILP

SEQ ID NO: 24640 - protein, 532 aa, Nostoc punctiforme
MKSIEVFISYHQEDETLRQELEKHLASLRRENIITSWNDRKIIPGQEIKGEIDEHLNQAGLILLLISPDFIDSDYHWTVEVTRALEQNTAKKARVIPVLLRYADWETPPIDQLSPLPSNRKPIKSWNDRDEAFLEVVKGIREAVRLVENSNSSPPKQRTKELEYQVTSLINEADRLREAKKLEEAVVKYKAALSLDPNSVYAHNALGVVLHTQGKLSEAIAAYQKALQIDPNYVNAHCNLGKALHTQGKLSEAMAAYQRALRLDPNDADTHCNLGIALHDQGKLSEAIAAYQKALQIDPNYVNAHCNLGKALHNQGKLSEAMAAYQRALRVDPNYASAHCNLGVTLYHQGKLSEAIAAYQKALQIDPNYVNAHCNLGKALHTQGKLSEAMAAYQRALRVDPNYASAHCNLGVTLYHQGKLSEAIAAYQRALRLDPNDADTHCNLGIALHDQGKLSEAIAAYQRALLIDPNDADAHCNLGIALKGQGKLEEAIAELEIAVRLNPNNTVIRNNLEIYRNEKNEKKGFWGRLFGG

SEQ ID NO: 24641 - protein, 932 aa, Clostridium thermocellum
MIICMITSIIAVPSYVSAEPEYNFAKALQLSLYFYDANKCGEGITGGRLEWRGDCHLEDKEVPLIPMTEDYFGTNMSQEYIDKYRHILDPDGDGTVDLSGGMHDAGDHVKFGLPGTYAASTLGWGFYEFREAYEKVGVDDHAKEILRWFNDFYLKATFLDEDGNVIAYCYQVGEGNIDHNFWNPPELQSSKVLDLFARPAYFATPETPASDQCAGAAASLAINYLNFKDEDPEYAQRCLDTAIALYEFAKKYRGLGESGGFYGSSYDHDELAWAAVWLNIATGDMQYIDDIVATDSEGNYIGYMQRIIKDTTNTWQNIWVHCWDTVWGGVFAKLAPITNTERDWYIFRWNLEYWSGIPHENPNDTTFLAKSPGGFSVVNAYGSARYNTAAQLCALVYRKYTGRSDFADWAKSQMEYIMGNNPMNRCYIVGYSENSAKHPHHRAAHGSKTFSMLDPEEHRHTLWGALVGGPDLDDFHVDETTDYVYNEVAVDYNAAFVGACAGLYYYYGEALGHKPVPNFPPKEEAVEEYYVEGKIEQENKERTQVTIKIFNDTCHPPRFETGLMARYFFNISELLDAGQSIDDVKIEAYYDENKASYDGPAEVRGPIKYDDAGTYYVEVDWSGRIIYGKREIQLALISSLDSNYKSNWNPENDYSREGLGKEFVRTEKIPLYLNGVKVFGNEPPQIEPSPTPSDGPGSTPPPSQKPSLEVLYKYGDTTAATKDIRGSIKIKNTGTKPVNLSDVKVRYWFTKDGASSQEFVCDYAHLSESMITAKFVDLENPVENADNYLEIGFDSNAGILGPGSDTGEIQFRIVKGDYESYDQSNDYSCMATAKDFTANPNITAYVNSVLVYGNPPVDEEEEIEIVYGDLNGDGRVNSTDLLLMKKRIIREIDKFNVPDENADLNLDGKINSSDYTILKRYVLKSIEKLPVK

SEQ ID NO: 24642 - protein, 376 aa, Desulfotalea psychrophila
MQLRREIFDKARRVVVKVGSAILTNVGGIHTSFIADLAREISYLRQSGHEVILVSSGAVAAGRKKISWQDSAPLGMKEKQALAAIGQSHLMRTYEEAFGFYELDVAQILLTHADLSHRDRYLNIRNTILTLLKFGVTPIINENDTVSVEELKFGDNDTLAALLTNLLEADICICLTDVDALYDKNPQKDPTARPLHIVTKISPEIEAMAGNSNSLFGTGGMQSKIRAAKIVFSGGGTAIIGPGRAPRVLQRLFAGEDIGTIFLPCKERMKSKKQWIAHVLKPKGTLLLDAGACKALLQGGKSLLPSGIVGISGEFDRGDSVNCCRLDGSRIAVGLVNYASVDVNAIKGLQSREIASVLKCCDNEEVIHRDNLVILS

SEQ ID NO: 24643 - protein, 322 aa, Shewanella oneidensis
MSKIFEDNSYTIGNTPLVRLNRVSQGKVLAKVESRNPSFSVKCRIGANMIWDAEKKGLLTKDHELIEPTSGNTGIALAYVAAARGYKLTLTMPNTMSLERRKLLKALGANLVLTEGAKGMKGAIDKAEEIRQSAPEKYILLQQFNNPANPEIHEKTTGPEIWNDTDGAVDVFVAGVGTGGTITGVSRYLKKVAGKAITSVAVEPADSPVITQTLAGLPVQPGPHKIQGIGAGFIPGNLDIELIDRVETVTNDEAIEMARRLMQEEGILVGISSGAAVVAANRIAALPEFADKTIVVVLPSAAERYLSSVLFQGQFGDEENIQ

SEQ ID NO: 24644 - protein, 461 aa, Unknown
  Rhodococcus sp. RHA1
MRIAEHVVDLIGNTPLVKLSSVIGENHGTVAAKIEYLNPGGSSKDRIAVKMIDAAEASGELKPGGTIVEPTSGNTGIGLALVAQKRGYKCVFVCPDKVSEDKRNVLKAYGAEVVVCPTAVAPEHPDSYYSVSDRLARELPGGWKPNQYSNPGGPQSHYETTGPEIWADTDGKITHFVAGVGTGGTITGTGRYLKEVSGGKVKVIGADPEGSVYSGGTGRPYLVEGVGEDFWPSAYDPSIPDEIIAVSDADSFEMTRRLAREEGLLVGGSCGMAVVAALEVAKREGPDAVIVVLLPDGGRGYLSKIFNDKWMASYGFLRTPLDGKPDEKTVGDVLRGKSGELPDLVHTHPSETLRDAIEILREYGVSQMPVVGAEPPVMAGEVAGSVTERDLLSAVFEGRAHLADPVEKHMSKPFPLIGSGEPVSAATKALGDTDALMVVDDGKPAGVITRHDLLGFLSAGS

SEQ ID NO: 24645 - protein, 80 aa, Psilotum nudum
MKEHDLINMEGIVTESLPNAMFRVFLDNGCHVLTHISGKIRRNYIRILPGDRVKVELSIYDLTKGRILYRIRNEASKDTL

SEQ ID NO: 24646 - protein, 72 aa, Vibrio cholerae
MAKEDVIEMQGTVLDTLPNTMFRVELENGHVVTAHISGKMRKNYIRILTGDKVTVEMTPYDLSKGRIVFRAR

SEQ ID NO: 24647 - protein, 195 aa, Burkholderia vietnamiensis
MRVAEVVRNTSETQIRVKLDLDGTGRQKLATGVPFLDHMLDQIARHGLIDLEVEAHGDTHIDDHHTVEDVGITLGQAVAKAVGDKKGIRRYGHSYVPLDEALSRVVIDFSGRPGLEFHVPFTRARIGTFDVDLSIEFFRGFVNHAGVTLHIDNLRGINAHHQLETVFKAFGRALRAAVELDERAAGQIPSTKGSL

SEQ ID NO: 24648 - protein, 332 aa, Unknown
  Rhodococcus sp. RHA1
MSKAAVLGAGSWGTAFAKVLADAGTDVTMWARRAEVAESIVSRHENADYLPGIALPPSLTATDDARAALDGADIVVLAVPSQSLRDNLQVWSPMIPEDATLLSLAKGIETGTLMRMSQVIIQVTGADPGRVAVLSGPNLAREIAIGQPAATVVACTDSTRALELQKASATGYFRPYTNSDVIGCEIGGACKNVIALACGMASGIGLGENTIASIITRGLAEIIRLGVALGAKPATLAGLAGVGDLVATCTSPLSRNRSFGERLGQGGSIESAQAATHGQVAEGVKSCSSVRALAASYDVEMPLTDAVHRVCHEGVVVQDAIGQLLGRRTKPE

SEQ ID NO: 24649 - protein, 167 aa, Brassica napus
  misc_feature (16)..(16): Xaa can be any naturally occurring amino acid
  misc_feature (38)..(38): Xaa can be any naturally occurring amino acid
  misc_feature (140)..(140): Xaa can be any naturally occurring amino acid
SLHISVLGSKSSPGSXEAVTLAQWVSQSYTHHLGSDSXTIDSLGSKTLLKFTWNHQDAILCCSLKPQPVVIFANQAGLNMLETMLVSLQDIALEKIFDESGRRALCSDFAKLMQQGFACLPSGICLSTMGRHVTYEQVVXWKVFAASKTTTIIIGQISQKKKKKKKK

SEQ ID NO: 24650 - protein, 229 aa, Cytophaga hutchinsonii
MVSCSNQQTQTKAITVSDTTLLSAEEFSQKIKKEPNALILDVRTPEEFSEAHIANATNVNWKDNFASGITEVNKNQPVLVYCLSGGRSASASDYLRKNGYTQVYELQGGLLKWQASNFEVVADTVTAAQDSGMTLQQFEALLVTDKYVLIDFYATWCGPCKMMEPALEDIAATMSDKVIVVRIDVDKNEELSKHFEVESLPTVQIYKNKKLVWEDIGYKTKKQLVSQLK

SEQ ID NO: 24651 - protein, 467 aa, Geobacter metallireducens
MNVLLVSVNREHAPYPVFPLGLACLAGPLRAAGHRLSVLDLCFAADPEEATRQALAEFSPDVVVLSLRNIDNVTYPGSRSYLSGVRDVVAICRERAAVVVGGSGFSLMPREVLAYLGADYGVVGEGEDVLPRLLARIAAGEGGDGLPGVVARENAGFLPPHPVQAIGTPLRGLFQVERYHREGGMANIQTKRGCPFSCIYCTYPLLEGERMRLRPVADIIAEIGDLVDVHGVSYLYFVDDIFNYPLEFALELCRAMSAARLPVAWSAFINPDFLPPQLLDAMLAAGCDALEFGTDSGSPVMLRNLRKSFGIEKVREASRLCREAGVDFAHYILFGGPGETPATIAESFALMDEVAPTAVIAMTGIRIFPGTAIYRQALADGLITPETDLLRPAFYIAPTIADTLCELVREEALKRTNWVVPGLEITANDAMLEALRHFAGPGPLWKMLKLLGRRRGSVPSPWSHSPS

SEQ ID NO: 24652 - protein, 517 aa, Staphylococcus aureus
MSEVKKVVKHEQQKKEKTKKQYKPFWIVMSFIILIVVLLLPAPSSLPIMAKAVLAILAFAVIMWVTEAVSYPVSATLIIGLMILLLGFSPVQNLGEKLGNPKSGSAVLAGSDLLGTNHALSLAFSGFATSAVALVAAALFLAAAMQETNLHKRLALLVLSIVGNKTRNIVIGAIIVSIVLAFFVPSATARAGAVVPILLGMIAAFKVSKDSKLASLLIITSVQAVSIWNIGIKTAAAQNIVAINFINHQLGFDVSWGEWFLYAAPWSIVMSIALYFIMIKVMPPEINTIEGGKDLIKEELHKLGPVSAREWRLIVISMLLLLFWSTEKVLHPIDSASITIIALGVMLMPKIGVMTWKHVENKIPWGTIIVFGVGISLGNVLLKTGAAQWLSDQTFGVLGLKHLPIIATIALITLFNILIHLGFASATSLSSALIPVFISLTSTLHLGDQSIGFVLIQQFVISFGFLLPVSAPQNMLAYGTGTFTVKDFLKTGIPLTIVGYILVIVFSMTYWKWLGLL

SEQ ID NO: 24653 - protein, 698 aa, Gibberella zeae
MTTVTLARPIPPHRPSSTITPPLSLESSTTSSSSPCSGPIPNKHLPICPTGPACPDELDTPPPSPPAQDQLQQTSALYPLDSFKRVDSGELSIYELDAFNVAEAVDVASRQPLPDPALVFPWFHGLHPQNHVQQSFFAARRRATRPTPSCIRALTLVKADGDLNYARLKGAIAPNEIIQPNSPARFIEADPREGFSVRNFQIQTVKTAVLSDIIVYGQDLNKTRKVAWDIANAQKLWREKHQDQGEWMPEYHTFVCTNPFSKFEENHSEIVAVDESGHLTGNVLDFFSQERREMWAMTEASEFSKNVFMGPTPEQGSPEEQKYDILIECSDLGRLNPLALQLIAESPDQDGKQRFLDFPSSGSILPPTWSHSEADGVLETCKWIYHLAHGSYPEPDPGLSIGDVDAEGDSPMPSDHGSAFEVRPHKILLHCADGYTESTMLSIAYFSYSTGRPVPEAWLQLHTEKKRNFFAYPTDVALLTSITPRLLRESPVCKGLSLTDITHLTRDEPSWFAALDGSFPSRVLDYMYLGNLGHANNPDLLRALGITQILSVGEIAMWREGDLEAWGKENVCVVQGVQDNGIDPLTEEFARCLDFIDRGRRNGTATLVHCRVGVSRSATICIAEVMRSKGMSFPHAYCYVRARRLNVIIQPHLRFAYELLKYEEALQQDGDPDAEVKRTLEWAEIAREIALMNRPYSR

SEQ ID NO: 24654 - protein, 457 aa, Staphylococcus aureus
MAIAVLLNRMFRMEHNPLFEYIYQQKEDIDACYFIIPEEDMSSASDLKAQFYRGTLQRFYQSLHAEKLTPYVMSYDDIISFCKENNISEVVIAGDIMSYHLEEYDILHQRSLFNEARIAVTLIRGNHYFKASKTMNQQGEPYKVFTSFSKKWRPYLRHRDVYHYDLKSFEDFVIASPDDLVFDDIAFGSSQIIEQNKWQHFLDQDIQNYESGRDYLPEVLTSQLSVALAYGLLDIIEIFNDLLARYDEDEANYEAFIRELIFREFYYVLMTQYPETSYQAFKSKYRQIKWSQNEADFNAWCEGQTGFPIIDAAIMELTQTGFMHNRMRMVVSQFLTKDLFIDWTWGEKFFRKHLIDYDAASNIHGWQWSASTGTDAVPYFRMFNPIRQSERFDPKALYIKTYLPIFNQIDAKYLHDTQRNESNLFELGIELGRHYPRQMVDHQEKRTQVLAAFKALD

SEQ ID NO: 24655 - protein, 434 aa, Geobacter metallireducens
MKSRPRLLLVYPATHKLGWVRRFQLPSLSLKQVAAVTPPEWEVVMADEVHEDVPFGEKFDLVGITAMTHQAVRAYEIADRFRAQGVPVVLGGIHPTVLPEEAQAHADAVLIGEAEPVWAKLLDDFLAGRLAPLYRAPIPTDDRLVIPWSRRDILAGRQYLTTQTVQASRGCPYDCPFCTVTPYFGRTFRYRNPDDVLAELRSFEGKLMVFVDDNILGDPVRAKPILEGMAGMNLRWGGQANLRFAEDPELVKLVARSGCIGIFVGIESVTGPHANHAKTGNGSSQIDLVKRVRDAGIVLEASMIFGFDDHDEGIFERTVRFLEECAPSIPTFNVLTPYPGTSLFKQFDREGRLLHKDWSRYDHGQVVFRPKQMTPERLYRGWQEARWEAYRLPAIASRVMKGKGKLVNLAYNFLRRGGIERPDRIVHIREVAEP

SEQ ID NO: 24656 - protein, 85 aa, Cenchrus ciliaris
ECQKVGAPPEVSARLTAMAQELEARQRTALGGLGAATEPELDQFMEAYHEMLAKFREELTRPLQEAMEFMRRVESQLNSLSISGR

SEQ ID NO: 24657 - protein, 337 aa, Solanum tuberosum
LGVCYGMMGNNLPSHSEVIQLYKSRNIGRLRLYDPNHGALNALRGSNIEVILGLPNVDVKHIASGMEHARWWVQKNVKDFWPDVKIKYIAVGNEISPVTGTSSLTSFQVPALVNIYKAVGEAGLGNDIKVSTSVDMTLIGNSYPPSQGSFRNDVRWFTDPIVGFLRDTRAPLLVNIYPYFSYSGNPGQISLPYALFTAPNAVVQDGSRQYRNLFDAMLDSVYAAMERTGGGSVGIVVSESGWPSAGAFGATQDNAATYLRNLIQHAKEGSPRKPGPIETYIFAMFDENNKNPELEKHFGLFSPNKQPKYNLNFGVSERVWDISAETNSTASSLISEM

SEQ ID NO: 24658 - protein, 298 aa, Fusobacterium nucleatum
MEAYMEKIYGVIDVTSGYANGKTKNPKYQDLHSSGHAETVHVKYDASKVNLSTLLKYYFKIIDPTSVNKQGNDRGSQYRTGIYYVNQNDKSVIQDEIKEQQKKYSQKIVVEVLPLKEYYLAEEYHQDYLKKNPNGYCHIDLSKADDIIVDEKKYPKLSEKELRMKLNSKQYEVTQNGDTERAFQNDYWDFFDKGIYVDITTGEPLFSSTDKYASQCGWPSFVKPIVPEVVTYHNDTSFNMIRTEVRSRSGKAHLGHVFDDGPRDRGGKRYCINSAAIQFIPYAEMEAKGYGYLLPLVK

SEQ ID NO: 24659 - protein, 363 aa, Solanum tuberosum
MATSQIAVIVLLGLLVATNIHITEAQLGVCYGMMGNNLPSHSEVIQLYKSRNIGRLRLYDPNQGALNALRGSNIEVILGLPNVDVKHIASGMEHARWWVQKNVKDFWPDVKIKYIAVGNEISPVTGTSSLTSFQVPALVNIYKAVGEAGLGNDIKVSTSVDMTLIGNSYPPSQGSFRNDVRWFTDPIVGFLRDTRAPLLVNIYPYFSYSGNPGQISLPYALFTAPNVVVQDGSRQYRNLFDAMLDSVYAAMERTGGGSVGIVVSECGWPSAGAFGATQDNAATYLRNLIQHAKEGSPRKPGPIETYIFAMFDENNKNPELEKHFGLFSPNKQPKYNLNFGVSERVWDISAETNSTASSLISEM

SEQ ID NO: 24660 - protein, 384 aa, Fusobacterium nucleatum
MVMKKKRIIAMILAGGQGTRLKELTEDLAKPAVAFGGKYRIIDFTLTNCSNSGIDTVGVLTQYEPRILNNHIGRGSPWDLDRMDGGVTVLQPHTRKNDEKGWYKGTANAIYQNIKFIEEYDPEYVLILSGDHIYKMNYDKMLQFHIQKDADATIGVFKVPLVDAPSFGIMNTKDDMSIYEFEEKPKEPKSDLASMGIYIFNWKLLKKYLDEDEKDPNSSNDFGKNIIPNMLNDGKKMFAYPFKGYWRDVGTIQSFWDAHMDLLSEDNELDLFDKSWRVNTRQGIYTPSYFTKESKIKNTLIDKGCIVEGEIEHSVIFSGVKIGKNSKIIDSIIMADTEIGDNVTIQKAIIANDVKIVDNIVIGDGKKIAVVGEKKIIDSQSLVK

SEQ ID NO: 24661 - protein, 373 aa, Saccharophagus degradans
MSKRQLVKQSRRWVIKIGSALLTNNGRGLDREEMAVWVKQMAALSKRGYEVVLVSSGAVAAGMTRLGWAERPKALHELQAAAAVGQSSLIQAYEQEFQKYSIKTAQILLDHDDLSNRQRYLNARSTLRTLTKLGVIPIVNENDTVVTDEIRFGDNDTLGALVANLIEADTLCILTDQKAMFDSDPRQNALAKMLIERSAFDPGLDAMAGDGGALGRGGMISKVRAARLAARSGANTIVVGGKVFDVIPRVASGEILGTLLYSESQPIAARKRWLAGNMQPRGRLTLDDGAVKVLREQGKSLLPVGVRAVEGYFTRGELVLCEDTAGREIARGLVNYSSDETNKIKGASSSRIDSLLGYKDYDELIHRDNLVLV

SEQ ID NO: 24662 - protein, 328 aa, Solanum tuberosum
NNLPSHSEVIQLYKSRNIGRLRLYDPNHGALNALRGSNIEVILGLPNVDVKHIASGMEHARWWVQKNVKDFWPDVKIKYIAVGNEISPVTGTSSLTSFQVPALVNIYKAIGEAGLGNDIKVSTSVDMTLIGNSYPPSQGSFRNDVRWFTDPIVGFLRDTRAPLLVNIYPYFSYSGNPGQISLPYALFTAPNVVVQDGSRQYRNLFDAMLDSVYAAMERTGGGSVGIVVSESGWPSAGAFGATQDNAATYLRNLIQHAKEGSPRKPGPIETYIFAMFDENNKNPELEKHFGLFSPNKQPKYNLNFGVSERVWDISAETNSTTSSLISEM

SEQ ID NO: 24663 - protein, 153 aa, Aspergillus nidulans
MDHSRDPCPWVALSDFGGAFCMGAIGGAVWHGVKGFRNSPYGERRIGAITAIKARAPVLGGNFGVWGGLFSTFDCAVKGIRKKEDPYNAIIAGFFTGGSLAIRGGYKAARNGAIMCAVFLAVIEGVGIGFQRMMADQTKLELPPAPPSDKAVA

SEQ ID NO: 24664 - protein, 347 aa, Glycine max
MAKYHSSGKSSSMTAIAFLFILLITYTGTTDAQSGVCYGRLGNNLPTPQEVVALYNQANIRRMRIYGPSPEVLEALRGSNIELLLDIPNDNLRNLASSQDNANKWVQDNIKNYANNVRFRYVSVGNEVKPEHSFAQFLVPALENIQRAISNAGLGNQVKVSTAIDTGALAESFPPSKGSFKSDYRGAYLDGVIRFLVNNNAPLMVNVYSYFAYTANPKDISLDYALFRSPSVVVQDGSLGYRNLFDASVDAVYAALEKAGGGSLNIVVSESGWPSSGGTATSLDNARTYNTNLVRNVKQGTPKRPGAPLETYVFAMFDENQKQPEFEKFWGLFSPITKQPKYSINFN

SEQ ID NO: 24665 - protein, 563 aa, Pseudomonas fluorescens
MRPVRPVQNRLKETHMQDWQRSVIYQIYPKSFYSHGGQATGDLLGVVDKLDYLHWLGVDYLWLTPFLRSPQRDNGYDISDYYAIDPSYGTMADCELLITEASKRGIKLMLDIVVNHTSIEHPWFQAARSSLDNPYRDFYIWRDQPNNWESKFGGSAWEYEAQTGQYYLHLFDHTQADLNWDNPQVRAEVFKMMRFWRDKGVGGFRLDVINLISKPADFPDDHTDGRRFYTDGPNVHRYLQEMHREVFEGFDLINVGEMSSTSLEHCVRYSCPASRELSMTFNFHHLKVDYPNLQKWVRADFDFLELKRILSDWQVGMQAGDGWNALFWCNHDQPRVVSRFGDDGEYREPSAKMLATALHFLQGTPFVYQGEELGMTNPGFEHIEQYRDVETLNIYRLKRNAGVSEANAMASIMQKSRDNGRTPMQWNAGPNAGFSRAEPWIGVPANAAFINVEQQQQDPTSVLHYYRQLIALRRSEALIQDGVYRLLLPEHPHVWAYLREGQGERLLVVSHFYGGDCEVELPEGVLTHDTKQRWVIGNYEAGEHRYRRLRLRPYESFVLHLSD

SEQ ID NO: 24666 - protein, 503 aa, Ralstonia eutropha
MRDRTLVISVLIVASCGLGYELIAGALSSYLLGDSILQFSSIIGCYLFAMGVGSWLSRYVKDEDVLARFIDIEILVGLLGGISAALLFVVFAWLSAPFRTALYALVFLTGVLVGMEIPLVMRILNARRAAFSDLVSRVLTFDYLGALAVSLVFPLVLAPRLGLSRTGFLFGMLNAAVALYTTRLFRDELPQVPLRTMRALVVIALLGAGFAGSDRLTHWAERGLFGDEIIHSESTPYQRLVITRWKDDLRLYINGNLQFSSRDEHRYHEALVHPVMQALPWARRVLVIGGGDGLALREILRHRNIEHVTLVDLDPAMTTLFSQSAPLRALNRDSLRDARVTVFNADAAQWMEQNAEVFDAIIVDLPDPSNFGLGKLYSVPMYRLLSRHLAEKGYAVVQSTSPYYAPRSFWGIDATLHEAGLHTWPYHAYVPSFGEWGFILAGKRSDYTPPTRYDMPMKFLDADSTALMFRFPPDMAPRAGHANRLNEQSLVHDFEQDWGNVIR

SEQ ID NO: 24667 - protein, 350 aa, Prunus persica [sequence omitted]

SEQ ID NO: 24668 - protein, 220 aa, Solanum lycopersicum
MGRRPARCYRQIKNKPYPKSRFCRGVPDPKIRIYDVGMKKKGVDEFPFCVHLVSWEKENVSSEALEAARIACNKYMTKSAGKDAFHLRVRVHPFHVLRINKMLSCAGADRLQTGMRGAFGKPQGVCARVAIGQVLLSVRCKDGNANHAQEALRRAKFKFPGRQKIIVSRKWGFTKFSRTDYLKYKSENRIVPDGVNAKLLGCHGRLAARQPGRAFLEAAN

SEQ ID NO: 24669 - protein, 485 aa, Unknown
  Mycobacterium sp. MCS
MTNHLLAPAHHVKERLSSVIMVPAPHAVDDRWRRWSRDWPVRELAPAPAGSGLKAVRGDAGLPFVGHTLDYIRFGSDFSRERYDRLGSVSWMGAFGTKMVVIAGPDATREAFTSEAKAFSQDGWSFLIDAFFHRGLMLMSFDEHLMHRRIMQEAFTRPRLTGYVEQVTPCVRSAVPAWPVGPSVRIYPLLKELTLDIATDVFMGGRGKDESDAVNKAFVATVRAASSLVRAPLPGTRFRAGVQGRRVLEDYFFRHLPAARAGETEDLFAALCQATTEDGERFSDEDVVNHMIFLMMAAHDTSTITTTAVTYFLAKYPQWQEAAAAEAAAIGDGLPDIEALEKMTVIDLVIKEALRLLAPVPLVMRKTVRDVAIDGYHIPSNTLCAITPAVNHFDRTIWSDPERFDPSRFDEPRREDQHHRFAWVPFGGGAHKCIGMQFGTLEVKAILHRMLRSFTWKVPENYHVRWDNTSLPIPVDGLPLEMKRR

SEQ ID NO: 24670 - protein, 341 aa, Novosphingobium aromaticivorans
MSVFLRNAWYMACWSHEVPEGGFLARRLLDKPWVIWRKADGTPVIMADRCPHRFVPLSRGQRDGDMMRCGYHGLAFSSSGGCVHNPFTDEALPLARVEVLPVVEKHTGLWFWPGDADRADPALIPDFGFLDVERPLHRGHLKMDAGYELVTDNLMDLSHAEFIHRDSFGVNGSLLTCGQHEVVQDEGGAIWNNWTMPDSEPPSWAVAMLPEGARTDQWLHMRWNAPSCLALFLGLARSGTDRKDMVVPPMADPHILTPETVTSTHYFYTHEPTPEAHALLEKAFLEEDHPMLHAQQEAMGSADFWDLRPVVLPSDAGAIRVRRRMMQLRRAEAGLEEEAAA

SEQ ID NO: 24671 - protein, 569 aa, Arabidopsis thaliana
  misc_feature (25)..(25): Xaa can be any naturally occurring amino acid
SDQNPTNSQRIRLHRSVRSVQRRFXAAYQLMEEISPAVALTLGLANTMCDSGISSTFDISELENVTDAADMLCNQKRQRYSNGVVDCIMGSVSEEKTLSEVRSLSSDFSVTVQESEEDEPLVSDATIISEGLIVVDARSEISLPDTVETDNGRVLATAIILNETTIEQVPTAEVLIASLNHDVNMEVATSEVVIRLPEENPNVARGSRSVYELECIPLWGTISICGGRSEMEDAVRALPHFLKIPIKMLMGDHEGMSPSLPYLTSHFFGVYDGHGGAQVADYCHDRIHSALAEEIERIKEELCRRNTGEGRQVQWEKVFVDCYLKVDDEVKGKINRPVVGSSDRMVLEAVSPETVGSTAVVALVCSSHIIVSNCGDSRAVLLRGKDSMPLSVDHKPDREDEYARIEKAGGKVIQWQGARVSGVLAMSRSIEMRIITTCYSLCKIMRSPESGFQSASFSGDQYLEPFVIPDPEVTFMPRAREDECLILASDGLWDVMSNQEACDFARRRILAWHKKNGALPLAERGVGEDQACQAAAEYLSKLAIQMGSKDNISIIVIDLKAQRKFKTRS

SEQ ID NO: 24672 - protein, 92 aa, Arabidopsis thaliana
MSNRRSRQTSNASRISDDQMIDLVSKLRQFLPEIHERRRSDKVSASKVLQETCNYIRKLHREVDNLSDRLSQLLDSVDEDSPEAAVIRSLLM

SEQ ID NO: 24673 - protein, 251 aa, Novosphingobium aromaticivorans
MAAPVVTMHQLIEAGAHFGHQTHRWNPRMKPYIFGARNGIHILDLSQTVPLMARALEFISATVQAGGKVLFVGTKRQAQEPIAQAARASGQHYVNHRWLGGMLTNWKTISGSIKRFKALEEQLAGDTAGLTKKEVLQLTRERDKFELSLGGIRDMGGIPDVMFVIDANKEELAIKEANVLGIPVVAILDSNVSPEGIAFPIPANDDASRAIRLYCEAVAAAATKGGRDAALASGADLGAMAEPLAEEAAEV

SEQ ID NO: 24674 - protein, 385 aa, Streptococcus pyogenes
MKFTEFNLSQDIQSAVVTAGFEKASPIQEMTIPLALEGKDVIGQAQTGTGKTAAFGLPTLNKIRTNENIIQALVIAPTRELAVQSQEELFRFGREKGVKVRSVYGGSSIEKQIKALKSGAHIVVGTPGRLLDLIKRKALILDHVETLILDEADEMLNMGFLEDIEAIISRVPADRQTLLFSATMPAPIKQIGVKFMKDPEHVQIKNKELTNVNVDQYYVRVKEQEKFDTMTRLMDVNQPELSIVFGRTKRRVDEITRGLKLRGFRAEGIHGDLDQNKRLRVIRDFKNDQIDILVATDVAARGLDISGVTHVYNYDITQDPESYVHRIGRTGRAGKSGESITFVSPNEMGYLSMIENLTKKQMKPLRPATAEEAFQAKKKVALKNH

SEQ ID NO: 24675 - protein, 447 aa, Corynebacterium efficiens
MTVDEQVSNYYDMLLKRNAGEPEFHQAVAEVLESLKIVLEKDPHYADYGLIQRLCEPERQLIFRVPWVDDNGQVHVNRGFRVQFNSALGPYKGGLRFHPSVNLGIVKFLGFEQIFKNSLTGLPIGGGKGGSDFDPKGKSELEIMRFCQSFMTELHRHIGEYRDVPAGDIGVGGREIGYLFGHYRRLANQHESGVLTGKGLTWGGSLVRTEATGFGTVYFVQEMIKAEGETLEGKKVIVSGSGNVATYAIQKVQELGAVVVGFSDSSGWVSTPNGVDVAKLREIKEVRRARVSSYADEVEGAEYHTDGSIWDLTADIALPCATQNELDGDNARTLADNGCRFVAEGANMPSTPEAIDVFRERGVLFGPGKAANAGGVATSALEMQQNASRDSWSFEYTDERLHRIMKNIFKSCADTAKEYGHEKNYVVGANIAGFKKVADAMLAQGVI

SEQ ID NO: 24676 - protein, 95 aa, Zea mays
LSTQGTRAAWAAHIQTTPTQSPPTRAGLQLEPDERRERVTIRAASGPARGNVGGRAELSSALVISLSTGVSLFLGRFVFFNFQRENVAKQVPAQN

SEQ ID NO: 24677 - protein, 309 aa, Arcobacter butzleri
MLDLAIIGGGPAGLTAGLYATRGGLKNVIMFEMGMPGGQITSSSEIENYPGQVEIVSGMDLMMKWPEQCQRFGLKHEMAQVENVTKNGDIFKVTTSDKKEYEAKSVLIATGSVPRRAGFKGENEFFGKGISTCATCDGFFYKGKEVAVVGGGDSAIEEAIYLAKLCKKVYLVHRRDTYRAAPSTVEHMKHTENIEEVTNVSVEEVFGDASGVTGLKVKCNKTGEIRDLPTPGVFIFVGRDVLNAPLKQADGSFLCDVRESGEVVVDLKMRTSVAGLYAAGDIRIDAAKQVVCAAGDGATAAVNIIEYLG

SEQ ID NO: 24678 - protein, 676 aa, Unknown
  Nostoc sp. PCC 7120
MSDVCLVLMPYAAVERPSIALGLLKARLQQAKLEPTILYPNIQFAEEIGLDVYAMISENFIETFLGEWTFSGVLFPEFNPNHSEYFDLISPCFKSYENYLPDRNLKEAFLAVREQATAFIESVAQSVANLQPRIIGCSSTFQQHCASLALLKRVRELAPEIITFMGGANCEGAMGLATHTHFSWVDFIISGEGDDLFNEFCYQLLDGGREVDPSILPYGVISPSHRTSTKISIAAPRASVQNLDQVPIPDYDDYFQTLHASTLSPYIQPGLLIETSRGCWWGQKHHCTFCGLNGSGINYRSKSPDRVLKEFTQLCERYGLRKFQVVDNILDMNHMNTVIPVLAAGDEAYNIFYETKANLRWEHLQQLAQAGVRCIQPGIESMHNSILKLMNKGNTAWMNVQLLKWARELGIIVFWNILADFPGESDEWYVEMMEWLPLIAHLQPPSGASEIRYDRFSPYYERPSDWGLNLSPLRPYKYVYPLAPEILSELAYFFEDQNNLVTRYATEENEQTSEKTERPGLENLKLWVNQWNRLWQSLYYKEHKPEYLPILSMNDSGSLITIYDSRPCATESLLFLEGLAYWVYKVCDRALTYREVVSEINKKLDVPVSWDEIFPIVSELRERKILLDIDGRLLSLALKGSCSPYLSVSELPAGYIDLHEFRRHNSKSSEKVLLPN

SEQ ID NO: 24679 - protein, 2155 aa, Blumeria graminis
MTRKDLATRNSSATSSAPDGGRTRDILNLSASWTICPIQQGTRVCVNTNQNKLLATKTQVYCKEHQPVFSPTTFNAYLREREHCSSVLGNCSRNFAALETGKKECLPPNQHNISTPTAASLHHFEATWMASTRGPLTLPGSASFGTSFFSDANDQKPENSPLSPGPRLSTGLSTTSTVGDLTGETYFGEERRPSIASVHTASSQSSISSVSRPGIHKKLQTFFGDDFPGRNRADSSLPSQRNQGRSQSFVRKQRDRATSSGAETTRKREASPADSRPRTPVPSRDVVPFLYQDSQDISKYGEAPVRDKLSGLDRDRYAGDSVITSKLSSSFTGQSHVVSSGRFTKGTEDLRPSHPSLVREEFGSASRSRDRAPKAMGTALGSSSNSGQAKRSVSPTIIAAVIKNSTSNNINSNSNINSGNHDGSTSPTLPSKRGILGRFLKHKEKDSVPLRLKEVPNTSRTFSSPGSRNDTTRGPTSPETAMSSWSREGSITGLDSSSSKAETGRPNNGSYRQGAFSKLQLRKGKPKITDEQDSLAESTENNDIISGLMFSLDTNLNNMEGILAKPPPLTPLDNSLINSLEDEAKDEAENIGSLGWNAPDSWAVKKSNDDTMSRLSDINEAYVPPMEDEKSNPYCIRIFRLDGTFATLSTPLNATVAELMGQLGRKTYMTDSLANYQIVMKKHDLQRILGPGERPVVIQKRLLEQAGYEERDRIEDVGREDNSYLCRFSFIPARESGYASFATDPLAGRVQKYSHIDLSRRNLVTIPIALYSKASEIISLNLSRNLSLDLPKDFIQSCQNLRDIKFTNNEAWKLPLSLSHGTRLSILDVSNNRLEQLERSELDRLQNLASLKLANNRLGSLPSYFGNFKLLRTLNVSSNFLESFPTFLCDLESLVDIDMSFNGISSLPDEIGQLTNLERFIITNNRLNGSLPLTFGDLVNLKEVDIRYNALSSIDVIARLPKVEQISADHNSVSVCESEFTKIRILRLNSNPVTKFEILNSVPTLKTLNLSNAKLAHVPDAIFDRMPNLVKLILDINHFVSLPMHIGKLRKLEHFSIARNALNSLPQEIGCMTELRFLDVRQNNLKKLPIELWYASKLETLNVSSNVLDSFPMPASRPPQIPGEIFPMVPQNTSNGSLGPNSTASSFEEIGALEAFGQRRSSQASYSLLGVGGSPGSGVTERKTSVVSSYSKGGRQTSIVTRTGSEMTAGNITPLRKDSGISTRLISTFSRSLKNLYLADNQLDDDVFDKLILLGELRILNLSYNDLNDIPHRSIKSWPQLSELYLSGNELTSLPSDDFEEFSLLQVLHINGNKFQTLPAELGKAHRLAVLDCGSNSLKYNVSNWPYDWNWNWNTNLKYLNLSGNKRLEIKPSAPGGAGNRDGRDLTNFNALQNLRILGLMDVTLTISSIPDQTEDRRVRTSGSVAGHLSYGMADTLGKNDHLSIIDMVVPRFNSSEAETLMGMFDGQALSGSGSKIARYLHENFGHIFSEELKKLNSELGETPADALRRAFLSLNKDLAIAATQCAEERPLLTHRSTTASTALSHTDLQSGGVATVVFLQNSELYVANVGDAQAMLIHSEGGHRILTRKHDPAEPNERQRIRDAGGWVSRQGKLNDILEVSRAFGYVQIMPAVQAAPHITQVTVKEQDEMILIASRELWEYLSPELVVDVARYERGDLMRASQRLRDLAIAFGATNKLMVMMIGVSDLKKRAQIRPHRVQSLLFNPGTIIDETYAPTRRPRKKGETVEDSGLRRLQAEVDAPVGDVSIAFTDIKSSTLLWETYPSAMRSAIKLHNEVMRRQLRIIGGYEVKTEGDAFMVSFPTATSALLWCFAVQQALLEVQWPSEVLSSVLGQEVYDNDQTLIFKGLSVRMGVHWGHPVCETDPVTRRMDYFGPMVNRAARISAVADGGQITVSADFISEIQRCLETYSESARSDSMGSEEAFESDIYRQAIRRELRSLSSQGFEVKDMGERKLKGLENPEYIYLMYPHALSGRIHYQQRLAEGDKLVAVEGPARFSDTTQLNIDIDSLWGLWHVSLRLEMLCSSLEVENGIGMPLQAPETTILEKIRSRGGEITDRVLINSLAHQVTRIESCISSLVTRHLAVGQCPLYNFDQLRAPMTEVLGSIAVQLRELRILKAGYIDQDFSNLSKRRT

SEQ ID NO: 24680 - protein, 469 aa, Geobacter metallireducens
MNILLLRPHPGSDAFGLGPFFRVEPLGLEYLGAALLARGHAVTIADLRFRPGASTWVRRSQPRLVGITCLHALEYDRIIATAREVRRVSPDAFILVGGHAAAAFPDPLKDNVIDAICLDDGEEIITALAEALETGRPLTDIPALLFRTGDGWVETPPLSDQTCLDLVPLPARHLVDRHRNNYHCLLFKPVWLIETARGCPHRCSFCSVWQLYGRSVRERSIATVVEDFATAGDSIFVADDLFWYNRERSIELAEALKKRGVHKRWILVQTRTDLICRSADIMAAWRPLAKDFDIFLGLEAASDKGLSGLDKDAGLAESIEGVRIARELKYGINGNFLVGHDWGEEEFRELWDFVAQYGLQRAGFTIHTPLPGTDHYREMKPRIPDQPWSNFDMHHLLWEPRIGAKRFFELYAETWRRSILNTSGEKSIVDWMRQVRPSQIPYIARVLWRTQRMMKPAAYLKEYEATRPR

SEQ ID NO: 24681 - protein, 489 aa, Oryza sativa
MPLEAYIFPTEYNASAAAPTCQPSLHPPDQPQQETDHRSLEPFNNTTGGKSSAEAAALDELDEFRSRILQGKAENGRVPDGATPAAHRLEPSGAEYNYAAASKGAKVLAHNREAKGAANILGGDKDRYLRNPCSADDKFVDVELSEETLVRTIGLANLEHYSSNFRDFELYGSPSYPAPAEEWELLGRFTADNAKHAQRFVLPDPRWTRYLRLRLATHYGSGFYCILSYLEVYGIDAVEQMLQEIISGSGADTDASAAAKAEEGGDGGTLRNDTAQVNARLDGVGGGGGSAAGRNDSAGDGAGAKNNGSRMTVAGDGKPAAAGRFHGDAVLKIMMQKMRSLELGLSTLEDYTKALNHRYGAKLPDLHTGLSQTTMALDRMKADVRDLVEWKGNVKALRILDENCCVGCRSNVEEMRSIQETMQNKELAVLSISLFFACLALFKLACDRVLFLFTRKGAAAAERMCGASKGWILVLASSSFTTFLVLLYN

SEQ ID NO: 24682 - protein, 291 aa, Geobacillus kaustophilus
MKHEGSALPPYLHMDNGELWLTEDDRDNLKISYRIKEVIFAEPSEYQHVMILDSYDFGRMLVLDGVVQTTSIDGHIYNEMISHVPLQFHPEAKRVLIIGGGDCGAARETAKYAHLEAIDMVEIDEKVVRACKEHLPAVSGNLSDPRVRFVYDDGVVFVQEKENVYDVIMIDSSDPVGPAEALFSPEFYANVHRALKADGLMVCQSQSPIFHLDILKRTYRNIRELFPHVLVYTAVVPTYPGGLWSFTIGSKRPLDFPAQTTIPNDTKYVNDAVFRQCFALPEFLRSALEVE

SEQ ID NO: 24683 - protein, 354 aa, Pseudomonas syringae
MHPKNAWYVACTADEVADKPLGRQICNEKMVFYRDQNQQVVAVEDFCPHRGAPLSLGYVENGQLVCGYHGLVMGGDGKTASMPGQRVRGFPCNKTFAAIERYGFIWVWPGEREKADPALIHHLEWAVSDEWAYGGGLFHIQCDYRLMIDNLMDLTHETYVHASSIGQKEIDEAPPVTTVEGEEVITARHMENIMPPPFWKMALRGNNLADDVPVDRWQICRFTPPSHVLIEVGVAHAGKGGYHAPHEFKASSIVVDFITPETDTSIWYFWGMARNFKPADEQLTATIREGQHKIFSEDLEMLERQQLNLLQHPHRNLLKLNIDAGGVQSRKILERLIAAEQADTADQIPVAAVK

SEQ ID NO: 24684 - protein, 472 aa, Geobacter metallireducens
MKVLFIHPFGSNWLGTGTDITTIFNLMPPLGLLSIAAFLEARGIGTEVIDCYATPMPAETLVAEVIRRRPDVVGFSCTTSSFLEGYSIAERIKEKAPGITTVFGGAHACSVGVGLLDTFPAIDYLVIGEGEQTFFELVTNLDHGGSGIPGVGYRENGKGVISALREHIANLDDLPFPAYHRLPQFPKRYILPLFSYPKAPNTSIISSRGCPYQCSYCDRSVFSRGFRFNSPEYIVEHLKMLNRDYGIRHVFFYDDLFTTDRARVARFCELKERERLPVTYNCIARLEHVDAELLRLLKRSGCWQVNFGIESGDPEVIKKHRKFYGLDEVQRKLQLVRDTGMRVKGLFMVGLPGETEESIRRTIDYALALPLDEINVTKFTPFPGAPLYATIREQGEFDENWPLMNCLNFVFVPHGMTREQLEGLYNEFISRFYRRSRIHWGYTKMLWKSPHSVATFLRHLPEILAFELKQKW

SEQ ID NO: 24685 - protein, 231 aa, Antirrhinum majus
TAVDWVQMIGMKPGPDSIGIVAISRNCSGIAARACGLVSLEPTKVAEILKDRLSWYRDCRCLDIASAIPTGNGGTIELMYMQTYAPTTLASARDFWTMRYTTSLEDGSLVICERSLTSSTGGPAGPLATCFVRAEMLPSGFLIRPCDGGGSIIHIVDHLDLDAWSVPEVLRPLYESSKILAQKITVAALRHIRQIAQESNGEIQCSGGRQPAVLRTLSQRLCRGFNDALNG

SEQ ID NO: 24686 - protein, 495 aa, Burkholderia pseudomallei
MTTTTNTTANTTTEPAAPGAARAAPATPPIRDCLDRYCIIGGGAAGIATAKNLREHGIAFDLIEREDDIGGTWYYGKPCSAIYQSVHMISSREFSEYTDYPMPADYPTYARGDQALAYLRDYARRFGVYEHAQFNRTVLEVAPLAHGGAWRVELDGHDVRHYKGVFVCNGHLSKPQVPDYPGRFDGLQLHSALYKTPDVLKGKRVLVVGAGNSGCDIAVEAVHHASAVFHSTRRGYFYWPKFLFGIPADRWAEWPLKLRMPLWARRFFGERLLRLTTAGQPEDYGLPKPDHKLFEAHFIINSTLFYHLGHGDLVAKPDVVELKGDRVAFSDGSEERIDAIVYATGFQLSFPFLDQSYLQWDKMQPRLYLNMFDRAHPNLFFIGLFQTSTGNWPLMDYQAQLVARYLRARDAAPRKAARLDRMIGRDRSNWNGGIRFSDTQRHVIEVEHFAYRLQLKRLIRALPDSRVAARQARPVAVASAVPAPAAAARARTGDA

SEQ ID NO: 24687 - protein, 563 aa, Saccharomyces cerevisiae
MSEITLGKYLFERLKQVNVNTIFGLPGDFNLSLLDKIYEVDGLRWAGNANELNAAYAADGYARIKGLSVLVTTFGVGELSALNGIAGSYAEHVGVLHVVGVPSISAQAKQLLLHHTLGNGDFTVFHRMSANISETTSMITDIATAPSEIDRLIRTTFITQRPSYLGLPANLVDLKVPGSLLEKPIDLSLKPNDPEAEKEVIDTVLELIQNSKNPVILSDACASRHNVKKETQKLIDLTQFPAFVTPLGKGSIDEQHPRYGGVYVGTLSKQDVKQAVESADLILSVGALLSDFNTGSFSYSYKTKNVVEFHSDYVKVKNATFLGVQMKFALQNLLKVIPDVVKGYKSVPVPTKTPANKGVPASTPLKQEWLWNELSKFLQEGDVIISETGTSAFGINQTIFPKDAYGISQVLWGSIGFTTGATLGAAFAAEEIDPNKRVILFIGDGSLQLTVQEISTMIRWGLKPYLFVLNNDGYTIEKLIHGPHAEYNEIQTWDHLALLPAFGAKKYENHKIATTGEWDALTTDSEFQKNSVIRLIELKLPVFDAPESLIKQAQLTAATNAKQ

SEQ ID NO: 24688 - protein, 478 aa, Glycine max
MEGGKRITVSPRPCCGRRIVAAKKRPRANDGFVNSVKKLQRREISSKRDRAFTMSDAQERFRNIRLQEEYDTHDPKGPSSMVLPFLRKRSKIIEIVAARDIVFALAQSGVCAAFSRETNQRICFLNVSPDEVIRSLFYNKNNDSLITVSVYASDSYSSLKCRSTRIEYIRRGTPDAGFALFESESLKWPGFVEFDDVNGKVLTYSAQDSIYKVFDLKNYTMLYSISDKNVQEIKISPGIMLLIYAKASSHVPLKILSIEDGTILKSFSHLLYRNKKVDFIEQFNEKLLVKQENENLQILDVRTFEHTEVCRSEFMTPSAFIFLYENQLFLTFRNRTVAVWNFRGELVTSFEDHLLWHPDCNTNNIYITSDQDLIISYCKADSDDSLSEGNAGSINVSNILTGKCLAKIRASNSFPVDNSCSDNPSGSCCCNSKKRKHGSKTRSTVAEALEDITALFYDEERNEIYTGNRHGLVHVWSN

SEQ ID NO: 24689 - protein, 256 aa, Bradyrhizobium japonicum
MTSSRFDLRGKVAIVTGGNGGIGLGLAHGLADAGADIAVVGRNETKSAAAVADLRQRGVKAIAVTTDVTDQAAVAAMIDRVVKEFGRIDILINNAGMSIRKPPHELELDEWNKVIDTNLTSAFVCSKLAYPALKASGNGKVINIGSMMSIFGASFATAYAASKGGIVQYTRACANAWAPDNIQVNAILPGWIDTDLTRGARQQVSGLHERVLARTPAGRWGEIDDFAGIAVFLASPASNFVTGTAIPVDGGFSVMA

SEQ ID NO: 24690 - protein, 85 aa, Cenchrus echinatus
ECQKVGAPPEVSARLTAMAQELEARQRTALGGLGAATEPELDQFMEAYHEMLVKFREELTRPLQEAMEFMRRVESQLNSLSVSGR

SEQ ID NO: 24691 - protein, 631 aa, Unknown
  Marinobacter sp. ELB17
MCGLAGFLRTASTPDRDAHKGWLENMGQAIIHRGPDAGSTWLDDAVGLVHRRLSILDLSDAGTQPMVSASGRYVVAYNGEIYNFQELRDELISQGHSFRTRTDTEVLLALYEIHGPKCLQLLNGMFALAIWDRKAQKLFLARDRLGKKPLYFYEADGQFAFASELKALTPAPFVKTELRYDAIKDFFFYQYIPDPKTIYKNVHKLAPGHWLMTDGISTHQEQYWDVSFGAPSSASLGELEDGLFNLIDDAVRLRMVSDVPLGAFLSGGIDSSAVVGLMAGHTNKPVTTCAIGFDSKRFDEVHWAKKVAEQFKTDHHEFTVKDNVAESLSSIARFFDEPFADPSFVPTYFVSQLARQKVTVALAGDGGDENFAGYSKYYTDHVENRLRGMFPTALRHNLFPGLARLAGMVNSGPTRKAKSLLGTLALDPDEAFFVTNSFFRRDVWNSLVKGELKRETQDYDPADITRAHYRNADTDDHLSSILYTDIKTYLPGDILVKVDRMSMANSLETRAPLLDYRVVEYAAQIPAALKLHGKEKKYILKKAFERMLPEDILYRKKMGFSVPLAQWLRQELKPIVEQLLLSPNSGVANLFEPAGIRNLWQRHLAGDDQFTQELWSLLAFELWWQQYQVGA

SEQ ID NO: 24692 - protein, 331 aa, Nicotiana tabacum
MCSIQIIGAQSIGVCYGKAANNLPSDQDVINLYNANGIRKLRIYYPDKNIFKALNGSNIEIILGVPNQDLEALANSSIANGWVQDNIRSHFPYVKFKYISIGNKVSPTNNDQYSEFLLQAMKNVYNALAAAGLQDMIKVSTVTYSGVLANTYPPERSIFREEFKSFINPIIQFLARNNLPLLANVYPYFVHVSNTADVSLSYALFTQQGTNSAGYQNLFDAILDSMYFAVEKAGGPNVEIIVSESGWPSEGSSAATIENAQTYYRNLINHVKSGAGTPKKPGKTIETYLFAMFDENDKIGEITEKHFGLFSPDQRAKYQLNFNYLPIYILR

SEQ ID NO: 24693 - protein, 627 aa, Pseudomonas aeruginosa
MCGIAGFWNITGTLLGDNARVARQMAAAIHHRGPDESGIWYEAPRAPILVHARLAVLELSPAGSQPMHSDCGRYVLIYNGEIYNHLALRARLSEAGVTHSWRGGSDTETLLACFAQWGVESTLKLTVGMFALALWDRQEKTITLARDRMGEKPLYWGWQNGVLFFASELKALKEHPLFRGDIDRDALALFLRYGYVPAPYSIYKGIGKLRAGSYLVLSERSLNETCEPAAYWSANAAIEEALSNPFQGTDAEAVDLLESQLRTSISDQMVSDVPLGAFLSGGVDSSTVVALMQQQSSRPIRTFSIGFDEPGYDEAVYAKAVAEHIGTDHTELYVNSKDALDVIPSLPKIYCEPFGDSSQIPTLIVSGLARQQVTVALSGDGGDELFGGYNPYQFTPRVWRMLERFPHSMRRFASAFAQDLPLPDKLGKLRDVFASRTAEELFYRLNSHWRNHEYPVIGAKGHTALLDTPERWPRVDSFQHWMMAMDVQGYMPDDILVKVDRAAMANSLETRVPLIDHRVFELAWRMPLHMKIRNGKGKWLLREVLYRHVSRELIERPKKGFSVPVSDWLRGPLKEWAESLLDERRLQQEGYLDSRLIRRIWNDHLAGRRDHSRRLWSVLMFQAWLES

SEQ ID NO: 24694 - protein, 356 aa, Nicotiana tabacum
MALCIKNGFLAAALVLVGLLMCSIQMIGAQSIGVCYGKIANNLPSEQDVINLYKANGIRKMRIYYPDKNIFKALKGSNIEIILDVPNQDLEALANSSIANGWVQDNIRSHFPYVKFKYISIGNEVSPINNGQYSQFLLHAMENVYNALAASGLQDKIKVTTATYSGLLANTYPPKASIFRGEFNSFINPIIQFLAQNNLPLLANVYPYFVHISNTADVPLSYALFTQRGKNSAGYQNLFDAILDSMYFAVEKAGGPNVEIIVSESGWPSEGNSAATIENAQTYYRNLIDHVKRGAGTPKKPGKSIETYLFAMFDENVKKGEITEKHFGLFSPDQRAKYQLNFNSLMPIYIDISRVI

SEQ ID NO: 24695 - protein, 301 aa, Prosthecochloris aestuarii
MRNDKWDAGRIARQDGRIALISGANSGIGFDTAVVLAGKGAEVVLAVRDIGKGEEACKAIRKDFPDAALQVMLLDLADLSSVRRFAYAFLARYSRLDLLINNAGVMVPPQRCVTVDGFELQFGTNHLGHFALTLLLSGLLKQTPSSRVVTVSSGAHYFGKLDFSDLNWQRRPYRKWQAYGDSKLANLYFTRQLQRRLAEDHASTIAVAAHPGWSGTNLQRYEPLAMLMNRFFAQTSAMGALPELYAATARDVAGAEYFGPGGIGGLRGYPVRCSSSRLSEDQGVGQRLWEVSEVLTGVFWQ

SEQ ID NO: 24696 - protein, 441 aa, Methanosarcina acetivorans
MNLNIIRSSMTEITKSKDESMRSHLVKPGSVYDGIEPGELGESTESVQDRVRQLESRNSFLEEQCSQIESEKRYLENQKIKYEREIRKLQSELDRMKTSPLIIGTVIDVIKNDRIIVRSSNGPQFLVNVSQYIDEKKLLPGAKVALNQHTLAIAEVIPSTEEPFVAAMEVIESIEVDYDQIGGLDEQIQELQEAVELPLIEPERFARIGIEPPKGVLLYGLPGTGKTLLAKAVAHRTNATFIRVVGSELVQKYIGDGSKLVREIFEMARKKAPSIIFIDELDSIAARRLNETTGADREVQRTLMQLLAEMDGFDKRKNIRIIAATNRPDVLDPAILRPGRFDRLVHVPMPGIEARGKILKIHCGKMTLAGDIDFKKLAKVTEGMSGADLKAIATEAGMFAVRKDKALVEMEDFLEAVEKVSMAADTQKMMPGNLPETTMFV

SEQ ID NO: 24697 - protein, 102 aa, Glycine max
MASGSLKNMLSVAMNQGVVEARARIFGHQLNPTGMKTPHKLLRMKLFGEKVAQWYPHDIKKDDPLVMARQEQERLSKLEMLKRRGKGPPKKGQGRRAAKRNK

SEQ ID NO: 24698 - protein, 548 aa, Lactobacillus sakei
MQTNWWQNAVFYQVYPRSFQDSNGDGIGDIQGIIQRLDYLADLGVNAIWLSPVYQSPNVDNGYDISDYQAINPEYGSMVDMEQLIEAAKIRKIKIVMDLVVNHTSDQHPWFLEARKSKDNPYRDFYIWRDPATDGSVPNDLQSNFKGSAWAFDAVTGQYYLHFYAKEQPDLNWQNPKVREAVYQMMTWWLQKGIGGFRMDVIDLIGKEPDRKIKENGPQLHAYLQEMNARVLSQYDVVTVGETWGATPEIGQMYSNPNRHELSMIFQFEQINLDKQSGMTRWDLKPLIPAELHAVFSKWQLALDGVGWNSLFWSNHDLPRIVSRWGDDSQYREKSAQALAIYLHMLKGTPYIYQGEEIGMTNYPITSYHEIEDIESRRVYQQRQQQGYAISDILNGINAKGRDNARHPMQWNGKNQSGFTDGTPWLPVNPNYLEINVELAKQDERSIYATYQQLIKLRKRNAIIRQGRFENVPTGNQNVISYKRMLGEQSWLVIINLSKNRESYTLPIQHFGPNQKIISNNLLLNKIAISGVLQPYDALVVAIGNEEK

SEQ ID NO: 24699 - protein, 611 aa, Arabidopsis thaliana
MASLSGLYSSSPSLKPAKNHSFKALPAQSRDSFSFPHTSKPTNLPLTLSSARSVARDISHADSKKELLKDPDALWKRYLDWFYQQKELGLYLDISRVGFTDEFVAEMEPRFQAAFKAMEDLEKGSIANPDEGRMVGHYWLRNSKLAPKPTLKTLIENTLDSICAFSDDIISGKPPSSPEGRFTQILSVGIGGSALGPQFVAEALAPDNPPLKIRFIDNTDPAGIDHQIAQLGPELASTLVVVISKSGGTPETRNGLLEVQKAFREAGLNFAKQGVAITQENSLLDNTARIEGWLARFPMYDWVGGRTSIMSAVGLLPAALQGINVREMLTGAALMDEATRTTSIKNNPAALLAMCWYWASNGVGSKDMVVLPYKDSLLLFSRYLQQLVMESLGKEFDLDGNTVNQGLTVYGNKGSTDQHAYIQQLRDGVHNFFATFIEVLRDRPPGHDWELEPGVTCGDYLFGMLQGTRSALYANGRESISVTIQEVTPTSVGAIIALYERAVGLYASIVNINAYHQPGVEAGKKAAAEVLALQKRVLSVLNEATCKDPVEPLTLEEIADRCHAPEEIEMIYKIIAHMSANDRVLIAEGNCGSPRSIKVYLGECNVDDLYA

SEQ ID NO: 24700 - protein, 431 aa, Unknown
  Rhodococcus sp. RHA1
MTAVPGTDVNTAPLAELDPEVAQAMAGELARQRDTLEMIASENFVPRAVLQAQGSVLTNKYAEGYPGRRYYGGCEHVDVVEDLARNRAKELFGADFANVQPHSGAQANAAVLMALMNPGEKLLGLDLAHGGHLTHGMKLNFSGKLYDVESYGVSKEDHRIDMDEVRKIAVAAQPKVIVAGWSAYPRHEDFAAFRSIADEVGAYLWVDMAHFAGLVAAGLHPSPVPYADVVSSTVHKTLGGPRSGLILAKQEWAKKLNSAVFPGQQGGPLMHAIAAKAVSLKIAGTEEFKDRQQRTLTGAKILAERLTGADVADKGVSVLTGGTDVHLVLVDLRNSQLDGQQGEDLLHEVGITVNRNAVPFDPRPPMVTSGLRIGTAALASRGFGDEQFTEVADIIGTALAGSSDVETLKSRVSKLAADFPLYEGLEDWRLI

SEQ ID NO: 24701 - protein, 193 aa, Oryza sativa
MKTTGGGGSPKEAVVPSAASGDTTLGRHLAHRLVQVGVNNVFAMPGDLKLTLLDHLIAEPGLHIVGCCNELNAGYAADGYAWARGVGACTVTFTVRGQLLDGRRRRSRRFWNQVTGDEAGAAFRNQERAGAAPSLPSAVACWSSSVVVDGGSASPSSPPSPSSETTASWTGTVEARGPQLQPASWASCYGCRK

SEQ ID NO: 24702 - protein, 181 aa, Exiguobacterium sibiricum
MGIHPVMEIVIKEKLVSESELAAKVKELAVAIERDAAGRQIVLVVVLKGSMVFAADLMREIKGSVQIDTVACSSYGAKTVSSGRVQLKKDLDLDVEGKYVVVIEDIIDTGHTLSFLCEHMKLHKPGVLKICTLLDKPARREVPLDADYVGFEIPDYFVVGYGIDCAEEYRNLPYVGWVETD

SEQ ID NO: 24703 - protein, 917 aa, Pseudomonas syringae
MLTKLGIKGRELLLTILPASLMAAMLGGYFTWMQLSELQSQLLLRGEMIAQDLAPLSASALGRKDKVLLSRIATQTLEQPDVRAVSFLDVDRSPLAHAGPTMISPTPIGNSSQLLNSTGTDATRYLLPVFGNQRHLTSPIIPAEADTLMGWVDVEISHNGTLLRGYRSLFASLLLIFTGLAITAVVAVRLSRTINGPMSQIKQAVSQLKDGNLETRLPPLGSRELDELASGINRMAATLQNAQEELQMSIDQATEDVRQNLETIEIQNIELDLARKEALEASRIKSEFLANMSHEIRTPLNGILGFTHLLQKSELTPRQFDYLATIEKSADNLLSIINEILDFSKIEAGKLVLDNIPFNLRDLLQDTLTILAPAAHAKHLELVSLVYRDTPLALSGDPLRLRQILTNLVSNAIKFTREGTIVARAMLEDETEEHAQLRISVQDTGIGLSSQDVRALFQAFSQADNSLSRQPGGTGLGLVISKRLIEQMGGEIGVDSTPGEGSEFWISLKLPKAREDKEESLNLPLEGLRAAVLEHHDLARQALEHQLEDCGLHTVVFTNLENLLNGVTAAHETPAAIDLAVLGVTTLEISPERLRQHIWDLENLNCKVMVLCPTTEYALFQLAVHDVYTQLQAKPACTRKLQKALSELIAPRAIRADIAPPLSSRAPRVLCVDDNPANLLLVQTLLEDMGAEVMAVEGGYAAVNAVQQEAFDLVLMDVQMPGMDGRQATEAIRAWEAERGQSSLPIVALTAHAMANEKRSLLQSGMDDYLTKPISERQLAQVVLKWSGLALRNPAPERQNESLEAHVGPLVLDPEEGLRLAAGKADLAADMLAMLLASLDADREAIRVARASQDVQALIERIHRLHGATRYCGVPQLRTACQRAETLLKQDAPHTGDALDDLDKAIVRLETEARVTA

SEQ ID NO: 24704 - protein, 1039 aa, Pseudoalteromonas haloplanktis
MTSLQHIINRRDWENPITVQVNQVKAHSPLNGFKTIEDARENTQSQKKSLNGQWDFKLFDKPEAVDESLLYEKISKELSGDWQSITVPSNWQLHGFDKPIYCNVKYPFAVNPPFVPSDNPTGCYRTEFTITPEQLTQRNHIIFEGVNSAFHLWCNGQWVGYSQDSRLPSEFDLSELLVVGTNRIAVMVIRWSDGSYLEDQDMWWLSGIFRDVNLLTKPQSQIRDVFITPDLDACYRDATLHIKTAINAPNNYQVAVQIFDGKTSLCEPKIQSTNNKRVDEKGGWSDVVFQTIAIRSPKKWTAETPYLYRCVVSLLDEQGNTVDVEAYNIGFRKVEMLNGQLCVNGKPLLIRGVNRHEHHPENGHAVSTADMIEDIKLMKQNNFNAVRTAHYPNHPLFYELCDELGLYVVDEANIETHGMFPMGRLASDPLWAGAFMSRYTQMVERDKNHASIIIWSLGNECGHGANHDAMYGWSKSFDPSRPVQYEGGGANTTATDIICPMYSRVDTDIKDDAVPKYSIKKWLSLPGETRPLILCEYAHAMGNSLGSFDDYWQAFREYPRLQGGFIWDWVDQGLSKIDENGKHYWAYGGDFGDELNDRQFCINGLLFPDRTPHPSLFEAKYSQQHLQFTLREQNQNQNQNQYSIDVFSDYVFRHTDNEKLVWQLIQNGVCVEQGEMALNIAPQSTHTLTIKTKTAFEHGAQYYLNLDVALINDSHFANANHVMDSEQFKLINSNNLNSKSFASATEKSVISVNETDSHLSIENNTFKLVFNQQSGLIEQWLQDDTQVISSPLVDNFYRAPLDNDIGVSEVDNLDPNAWEARWSRAGIGQWQRTCSSINAVQSSVDVRITCVFNYEFNGVLQAQTQWLYTLNNTGTISLNVDVNLNDTLPPMPRIGLSTTINKQSDTKVNWLGLGPFENYPDRKSAARFGYYSLSLNELYTPYIFPTDNGLRSDCQLLSINNLIVTGAFLFAASEYSQNMLTQAKHTNELIADDCIHVHIDHQHMGVGGDDSWSPSTHKEYLLEQKNYNYSLTLTGGITT

SEQ ID NO: 24705 - protein, 300 aa, Pseudomonas syringae
MTLQYQTIADCVGNTPLVRLQRMMGTTSNTILLKLEGNNPAGSVKDRPALSMITRAELRGQIVPGDTLIEATSGNTGIALAMAAAIKGYRMILIMPDNSSAERKAAMTAYGAELILVSKDEGMEGARDLADRMQAEGRGKVLDQFANGDNPEAHYTSTGPEIWQQTAGTVTHFVSSMGTTGTIMGTSRYLKEQNPDVQIVGLQPMEGASIPGIRRWPYEYLPKIYQSDRVDRIIDMGQTEAEETMRRLAREEGIFCGVSSGGSVAGALRIAREVENATIVAIICDRGDRYLSTGIYDMPN

SEQ ID NO: 24706 - protein, 125 aa, Cytophaga hutchinsonii
MEKEALYYRLGKENLDLLVDRFYDLVFVNDQIAHLFKNDKEEIKGKQRLFLTQFLGGPALYSEKFGHPQMRARHMPHPITETDAIAWLHCMSQAIGSLPVSEALKDELFARFPPTAMFMVNKEEQ

SEQ ID NO: 24707 - protein, 326 aa, Bacteroides thetaiotaomicron
MGTVKCIGILTSGGDAPGMNAAIRAVTRAAIYNGLQVKGIYRGYKGLVTGEIKEFKSQNVSNIIQLGGTILKTARCKEFTTPEGRQLAYDNMKREGIDALVIIGGDGSLTGARIFAQEFDVPCIGLPGTIDNDLYGTDTTIGYDTALNTILDAVDKIRDTATSHERLFFVEVMGRDAGFLALNGAIASGAEAAIIPEFSTEVDQLEEFIKNGFRKSKNSSIVLVAESELTGGAMHYAERVKNEYPQYDVRVTILGHLQRGGSPTAHDRILASRLGAAAIDAIMEDQRNVMIGIEHDEIVYVPFSKAIKNDKPVKRDLVNVLKELSI

SEQ ID NO: 24708 - protein, 310 aa, Arabidopsis thaliana
MVDENVETNASTLVASVDHGFGSGSGHDHHGLSASVPLLGVNWKKRRMPRQRRSSSSFNLLSFPPPMPPISHVTTPLPARKIDPRKLRFLFQKELKNSDVSSLRRMILPKKAAEAHLPALECKEGIPIRMEDLDGFHVWTFKYRYWPNNNSRMYVLENTGDFVNAHGLQLGDFIMVYQDLYSNNYVIQARKASEEEEVDVINLEEDDVYTNLTRIGNTVVNDLLLQDFNHHNNNNNNNSNSNKCSYYYPVIDDVTTNTESFVYDTTALTSNDTPLDFLGGHTTTTNNYYSKFGTFDGLGSVENISLDDFY

SEQ ID NO: 24709 - protein, 257 aa, Salmonella enterica
MSETFDPRCVWFVGAGPGDCELITLKGYRLLQQAQVVIYAGSLINTELLDYCPAQAERYDSAELHLEQIIELMAAGVKAGKTVVRLQTGDVSLYGSVREQGEELTRRGIDWQVVPGVSAFLGAAAELGVEYTVPEVSQSLIITRLEGRTPVPAREQLEAFASHQTSMAIYLSVQRIHRVAERLIAGGYPATTPVAVIYKATWPESQTVRGTLADISDKVRDAGIRKTALILVGNFLGKEYHYSRLYAADFSHEYRKA

SEQ ID NO: 24710 - protein, 142 aa, Pisum sativum
MQTALTFAATITVVPLTTPKSVSHLTIFPTKFTASRASPPRYTAIKVASGNSDPATVNYNSAFSVFQLEACERFGGEACLADMYPEVKLQPERSNDAPKTAASENIDRDYLEYNDPKTVFQAEACDDLGGTFCEPDYQKGVY

SEQ ID NO: 24711 - protein, 565 aa, Rhodopseudomonas palustris; identical to SEQ ID NO: 499

SEQ ID NO: 24712 - protein, 112 aa, Parvularcula bermudensis
MKKVEALIKPFKLDDVKEALQALGLKGMTVSEARGFGRQKGHTELYRGAEYVVDFLPKLKIEIVIEDSLVDDVLRAITEAAQSGRIGDGKIFVTTVERAVRIRTGETDAAAL

SEQ ID NO: 24713 - protein, 359 aa, Oryza sativa
MGIRDDLLRGIYAYGFEKPSAIQQRAVLPIISGRDVIAQAQSGTGKTSMISLSVCQIVDTAVREVQALILSPTRELAAQTERVMLAIGDFINIQVHACIGGKSIGEDIRKLEHGVHVVSGTPGRVCDMIKRRTLRTRAIKLLILDEADEMLGRGFKDQIYDVYRYLPPELQVCLISATLPHEILEMTSKFMTDPVRILVKRDELTLEGIKQFFVAVEKEEWKFDTLCDLYDTLTITQAVIFCNTKRKVDWLTERMRSNNFTVSAMHGDMPQKERDAIMGEFRSGATRVLITTDVSLVINYDLPNNRELYIHRIGRSGRFGRKGVAINFVKKEDIRILRDIEQYYSTQIDEMPMNVADLI

SEQ ID NO: 24714 - protein, 378 aa, Debaryomyces hansenii
MSSPIVYQLGHESIKDHVFSPDRQILAITKLNTVEIYQTSSNSSSKPKLITTLKGHDKTVTSVDISPDGSKILTCSQDRNALVWKYDQAEQEYKPTLVLLRISRAATVCRWSPLGNKFAVGSSDRIIAVCYYEPENDWWVSKHLKKPLKSTITSLDWHPNNILLASGSTDGHTRVFSTYIKGLDEKPEPSVWGSKLPFQTLCGDFINETGAWIHDVSFDPSGNSLAFVSHDSSLTVVYPEGEGLPPRAILNVKTNYLPFKSLVFSSENRILVGGHNCNLIAFEGNESGWKEAFKVEKQKDLIKDTTVPEDEEEEISSHDALNMFKQLDLKGRVNKPSAKGAGKVLSTIHQNTIASIKTYSNNQISTSGIDGKIVIFTI

SEQ ID NO: 24715 - protein, 283 aa, Bacteroides thetaiotaomicron
MSEEKWAIITGADGGMGTEITRAVAEAGYHIIMACYRPSKAEPIRQRLVNETGNANMEVMAVDLSSMASTASFADRIVERHLPVSLLMNNAGTMETGLHITDDGFERTVSVNYLGPYLLTRKLLPALTCGARIVNMVSCTYAIGHLDFPDFFRQGRKGSFWRIPVYSNTKLALMLFTIELSERLREKGITVNAADPGIVSTDIITMHQWFDPLTDIFFRPFIRTPKKGASTAVGLLLDEAVAGVSGQLYASSHRKQLSEKYLCHVQQKQLWQETEQALERWLK

SEQ ID NO: 24716 - protein, 418 aa, Unknown
  Frankia sp. EAN1pec
MILGTGSAWDTACVQLADAAQHLGLDDGMHDLLRTPRRSITVSVPLLRDDGQLLVLSGYRVQHNLARGPAKGGLRYHPACDLDEVKALAMWMTWKCALMGIPYGGAKGGIAVEPGLLSRQERERMTRRYAAELVPLIGPDKDIPAPDVGTDEQTMAWIMDTYSTHTGHTAPGVVTGKPLSIGGSAGRAGATSRGVQLAAFAALRELGRDPRETTVAVQGFGKVGALAAQYLHDAGCRLVAVSDVKGGIHNRAGLNPSALIRHLARGADTVVGYPGTDTITNTELLELNVDMLVPAALEGVINTGNADRVRAPLIVEGANGPVTAEADHVLTGKGTVIVPDILANGGGVAVSYFEWVQDIQAYFWTEDQVNDRLRALMQRSYQEVSALARERRVSLRTAAHIIGVARVAEAHRTRGLYP

SEQ ID NO: 24717 - protein, 291 aa, Saccharomyces cerevisiae
  misc_feature (1)..(1): Xaa can be any naturally occurring amino acid
XVHVASVEKGRSYEDFQKVYNAIALKLREDDEYDNYIGYGPVLVRLAWHISGTWDKHDNTGGSYGGTYRFKKEFNDPSNAGLQNGFKFLEPIHKEFPWISSGDLFSLGGVTAVQEMQGPKIPWRCGRVDTPEDTTPDNGRLPDADKDAGYVRTFFQRLNMNDREVVALMGAGALGKTHLKNSGYEGPWGAANNVFTNEFYLNLLNEDWKLEKNDANNEQWDSKSGYMMLPTDYSLIQDPKYLSIVKEYANDQDKFFKDFSKAFEKLLENGITFPKDAPSPFIFKTLEEQGL

SEQ ID NO: 24718 - protein, 250 aa, Unknown
  Fragaria x ananassa
MGKCYPTVTEEYKKAIDKAKRKLRGLIAEKNCAPLMLRLAWHSAGTYDVKTKTGGPFGTMKQSAELAHGANNGLDIAVRLLEPIKEQFPILSYADFYQLAGVVAVEVTGGPDVPFHPGREDKPEPPPEGRLPDAGKGSDHLREVFGKTMGLSDQDIVALSGGHTLGRAHKERSGFEGPWTPNPLIFDNSYFTVLLSGEKEGLLQLPTDKALLSDPVFRPLVEKYAADEDAFFADYALAHQRLSELGFAEA

SEQ ID NO: 24719 - protein, 211 aa, Antirrhinum majus
MSSSSAFAPDHHHITPSEQLCYVHCNFCDTVLAVSVPCTSLIKTVTVRCGHCTNLLSVNMRGLLLPAANQLHLGHSFFSPQNLLEEIRNSPSNLLMNQPNPNDSMMPVRGLDELPKPPVANRPPEKRQRVPSAYNRFIKDEIQRIKAGNPDISHREAFSAAAKNWAHFPHIHFGLMPDQPVKKPNVCRQHGDDVLMKDGFLAPANVGVSPY

SEQ ID NO: 24720 - protein, 457 aa, Gracilaria gracilis
MQIFVKTLTGKTITLEVESSDTIENVKTKIQDKEGIPPDQQRLIFAGKQLEDGRTLSDYNIQKESTLHLVLRLRGGMQIFVKTLTGKTITLEVESSDTIENVKTKIQDKEGIPPDQQRLIFAGKQLEDGRTLSDYNIQKESTLHLVLRLRGGMQIFVKTLTGKTITLEVESSDTIENVKTKIQDKEGIPPDQQRLIFAGKQLEDGRTLSDYNIQKESTLHLVLRLRGGMQIFVKTLTAKTITLEVESSDTIENVKTKIQDKEGIPPDQQRLIFAGKQLEDGRTLSDYNIQKESTLHLVLRLRGGMQIFVKTLTGKTITLEVESSDTIENVKTKIQDKEGIPPDQQRLIFAGKQLEDGRTLSDYNIQKESTLHLVLRLRGGMQIFVKTLTGKTITLEVESSDTIENVKTKIQDKEGIPPDQQRLIFAGKQLEDGRTLSDYNIQKESTLHLVLRLRGGQ

SEQ ID NO: 24721 - protein, 188 aa, Triticum aestivum
  misc_feature (88)..(88): Xaa can be any naturally occurring amino acid
  misc_feature (122)..(122): Xaa can be any naturally occurring amino acid
  misc_feature (137)..(137): Xaa can be any naturally occurring amino acid
  misc_feature (154)..(154): Xaa can be any naturally occurring amino acid
MSTSSGAKEAPANNPGLQAEADPATKGYIMQQTMFRVKDPKVSLDFYSRVMGMSLLKRLDFPEMKFSLYFLGYEDLSAAPADPVQRTXWTFGQKATIELTHNWGTESDPEFKGYHNGNSDPXGFGHIGVTVDDVYKXACERFESLGVEFVKKPXDGKMKGIAFIKDPDGYWIEIFDLKRIGEVTAAAS

SEQ ID NO: 24722 - protein, 168 aa, Triticum aestivum
  misc_feature (167)..(167): Xaa can be any naturally occurring amino acid
MNALAATSRNFRQAARLLGLDSKLEKSLLIPFREIKVECTIPKDDGTLASFVGFRVQHDNARGPMKGGIRYHPEVDPDEVNALAQLMTWKTAVAAVPYGGAKGGIGCSPGDLSRSELERLTRVFTQKIHDLIGTHTDIPAPDMGTNSQTMAWIFDEYSKFHGHSPAXV

SEQ ID NO: 24723 - protein, 85 aa, Cenchrus pilosus
ECRKVGAPPEVSARLTAMAQELEARQRTALGGLGAATEPELDQFMEAYHEMLVKFREELTRPLQEAMEFMRRVESQLNSLSISGR

SEQ ID NO: 24724 - protein, 373 aa, Zea mays
MITGTDFYHVMTAVVPLYVAMILAYGSVRWWRIFSPDQCSGINRFVALFAVPLLSFHFISTNNPYTMNLRFIAADTLQKLMVLAMLTAWSHLSRRGSLEWTITLFSLSTLPNTLVMGIPLLKGMYGDFSGSLMVQIVVLQCIIWYTLMLFMFEYRGARMLITEQFPDNAGAIASIVVDPDVVSLDGRRDAIETEAEVKEDGRIHVTVRRSNASRSDIYSRRSMGFSSTTPRPSNLTNAEIYSLQSSRNPTPRGSSFNHNDFYSMVGRSSNFGAADAFGIRTGATPRPSNYEDDASKPKYPLPVVNATSGAGAAAAAAHYPAPNPAVAAAPKGARKAATNGQAKGEDLHMFVWSSSASPVSDVFGGGAPDYNDA

SEQ ID NO: 24725 - protein, 85 aa, Cenchrus pilosus
  misc_feature (20)..(20): Xaa can be any naturally occurring amino acid
ECQKVGAPPEVSARLTAMAXELEARQRTALGGLGAATEPELDQFMEAYHEMLVKFREELTRPLQEAMEFMRRVESQLNSLSISGR

SEQ ID NO: 24726 - protein, 446 aa, Debaryomyces hansenii
MSPKREEEESDSLTAVDYIKTRDKLEKEARELMPFDPSECTYGKGELRQPIFACITCSDENNEEIGVCYSCSIQCHSSHELVELFTKRNFVCDCGTTKMSKTIDGGCKLRLKREENERRPSIQKTGYSSTASSKSHDIKMPAEDIPSLSNMYNQNFHGLFCSCEKPYNPLEETGNMIQCYFGFTCGEDWFHDECILGYNPGTIRKQHETKQNETGKNFLHKLSPPGEDAKADIEDKQTTQKTYSVPYFPELEDFDLFVCWKCVKEFRHIFKEIENDKKIILTKLPHFNEVESISDWKEKFEHLVEQDEDAPKTKRIKIDPDHEVLYSVFLQPDFRDRLLELKNTLPQDSKLHEFLCNHDYLYLDDPIYECPEDNDGENSTTGSLYDLGTDALLSMPRDQAIEGLQAYETISSKLKEFFKPFAEQGKVVTEEEVRDFFSEIQKKKDK

SEQ ID NO: 24727 - protein, 409 aa, Unknown
  uncultured archaeon GZfos26E7
MDLEMDVDADIDSTEFSKYVVDRMQQLELKNNLLEKQYQKVETEKQLAEDQRLKYERELRKLRSELDKLKTTPQLVGTLVNVLEEGKSIVRSSTGPEFIVGSSQFIKDGDLKPGVQVALNKEHLSIVAVIPGSEDPLVQAMEVIESPDIDYNQIGGLDKQIEVLRGAVEFALTKPEIFERIGIDPPKGVLLFGPPGTGKTLLAKAVATRTDATFIRVVGSELVQKYIGEGARMVRDVFEMARKKAPAIIFIDELDSIGAVRLDDASSGGREVQRTLMQLLSEMDGFNSRGDVCILAATNRWDILDPALIRPGRFDRLVYVPIPDREARVKILLIHTKKMRLAGDVDFDRIVTLTEDANGATLRAIVMEAGMCAVREDADAVYQKDFEDAIKHIMNPEGMVDRYSEGMFA

SEQ ID NO: 24728 - protein, 492 aa, Exiguobacterium sibiricum
MHKTSEQTLIFEISKAGRVAYSLPLPTVDEVAAEELLPAHLLRQEDVELPEVSELDLVRHYTALSNRNHGVDSGFYPLGSCTMKYNPKINEDMARLPGFAHIHPLQPVESVQGALGLMYDLQEKLAVITGMDEVTLQPAAGAHGEWTGLMLIKAYHHARGDFKRTKVLVPDSAHGTNPASASVAGFDTVTVLSDERGLVDLADLKSKVGEDTAALMLTNPNTLGLFESDIVEIAKAVHEAGGKLYYDGANSNAIMGIARPGDMGFDVVHLNLHKTFTGPHGGGGPGSGPVGVKKDLIPYLPKPIVAKTAEGFVLDYDRPESIGRVKPFYGNFGINVRAYSYIRTMGGAGLARVSKEAVLNANYMLARLKGAYDAPYDVYCKHEFVLSGRRQKALGVRTLDIAKRLLDFGYHPPTIYFPLNVEECIMIEPTETESKETLDDFCDAMLQIAKEVEETPDVVLNAPHTTVVKRMDETLAARKPILRYQPKQEVHV

SEQ ID NO: 24729 - protein, 492 aa, Clostridium perfringens
MSKKAYIIGAGPGDEELLTLKAINALQKCTAVLYDRLVGNNILNYLNDDCEIYYCGKEPGCHYKTQEEINESIVELAKKGHVVGRVKGGDPYVFGRGGEEVLALVEENIPFEVIPGVTSPISVLNYAGIPITHRGLAQSFHIVTGMSARTLNVNWKALSKENGTLVFMMGLSNLETIVEKLLENGKDIETPCGVVMRGTTSKQRKVIGTLENICKKVREAKLESPCIIVVGDVVSLNEKLSWYENLPLFGANICLTRSKEQSKEIKWKLKELGAEVTEINSIKIKETAYNLDEYINTLEKYDHIVFTSVNAVNVFFDYLVKNRVDIRKIKADFAVLGKATKKALIARGIVPSIMAHSFTAEGLFEVLKDNIKEGEEVLIPCSSLSREYLFDNLASLGAKCHRVNIYDTICGDVKNPRAFKEVDMVLYTSPSTVKNMIDMIGLEALKEKVSIAIGPITLKALNESGIEGKMCKTHCGDGFLSEIEGIWQEVKK

SEQ ID NO: 24730 - protein, 448 aa, Exiguobacterium sibiricum
MDFRYLPMTQEDEKEMLQTIGADSIEDLLADIPASVRDQGTLEEVGIPLPETDLIRTLSKLADQNMNTKQYPSFLGAGIYDHYAPAVVNHMLLRSEFYTAYTPYQPEISQGELQAIFEYQTMICELTGMDVANSSMYDGITALAEAAMLACAHKKKKTIVLSDGVHPEAHDVVRTYANGPGLEVETLPLVNGETAIANLDALEDVACVIVQYPNFYGRVEDLQALADATHAKGGLFIVSANPLALGLLEAPGKLGADITIGDCQPFGIPQSFGGPTCGYFTTTKALMRKIPGRLVGQTVDEDGKRGFVLTLQAREQHIRRDKATSNICSNQALNALAASIAMSALGKRGIRELATRNLQTAYALKKSLIQAGFHIVDDGPSFNEFVVELPIDATEAGKQLLQAGIIGGLPLGTFDESRSNQMLVCATELRTKEELDQFVTALGGLTHA

SEQ ID NO: 24731 - protein, 128 aa, Myxococcus xanthus
MRILHTMLRVGDLERSLDFYTRIIGMKLLRRHDYPDGKFTLAFVGFGPEDTHPALELTYNWGVEKYELGTAYGHVALGVSDIHGTCEAIRQAGGKVVREPGPMKHGTTVIAFVEDPDGYKVELIQKDR

SEQ ID NO: 24732 - protein, 312 aa, Aspergillus nidulans
MSKPGDYNAVRRDIAAQLKKPGYDDGSAGPVFVRLAWHSSGTYDAASDTGGSNGAGMRYEAEGGDPANAGLQHGRAFLEPVKEKHPWITYSDLWTLAGVVAIEEMGGPKIPWLPGRTDFVDDSKVPPRGRLPDGAQGADHLRFIFYRMGFNDQEIVALAGGHNLGRCHADRSGFQGPWVNNPTRFSNQFFKLLLNMEWKPKTLENGVSQFVYIDPEAEDHEEPLMMLPTDVALRDDPAFRPWVERYAKDKDLFFDHFSKAFAKLIELGIQRDASGKVTNTDNVKGGYHSAPKKSDEPTGPPRPHTAQRAAKL

SEQ ID NO: 24733 - protein, 659 aa, Thermococcus kodakarensis
MKKVVCPYCGFGCKLLIDPATLKVKPYKGEPNKGKLCPKGLYSTEIVKSRDRLKRPLKRVGSKIVPISWGQAMEEISNKLLEVRELYGPDAVAFLASSKVSNEENYLLQKIARLFGTNNIDNCARLCHEASVHALKLAVGTGAQTNPYEDIPKFKSVLIWGYNPAETHPVVMDYILRAKKSGAKIIVVDVRETRTMAFADHRLIIRPGTDIVLANALAHVIIEEELYNEEFIRSRTTGFSEVRMAVKKYTPEYAERATGVPAEKIKEVARDFSLAGSGAEMWGMGLTQHVSGVENVLALINLALLLGYIGERGGLYPMRGQNNVQGAAYMGALSEFLPGYVPLTDGKFRKRVAGLWGVDDLPTERGLYLTELWDAIEKGDVRALYIVGENPAVSEADFMRVRRALRNLDLLVVQDIFPTRTARYAHYLLPASAFCEKAGSYMNSERRIQWSEKVCEPAYDSKPDWEILTMLGKALGLPGFNYTSVEEITAEYFRLFPELEEKSVEELKNSDGIFLPKKRLHTWEFATPDGKARFMAVEWIPPWEGPDDKYPFVLTTVRLIGHYNTGEMTLRSPSLVRLMGEPKALISREDAERLGIQNGDWVEVETRRGKIRMTAEIGDVPQGVIAVPFHFKANKLTSHALNKAGTPEFKFAAARVRKV

SEQ ID NO: 24734 - protein, 888 aa, Arabidopsis thaliana
MAKSSADDEELRRACEAAIEGTKQSIVMSIRVAKSRGVWGKSGKLGRQMAKPRVLALSVKSKGPRKKAFLRVMKYSSGGVLEPAKMYKLKHLSKVEVITNDPSGCTFTLGFDNLRSQSVAPPQWTMRNTDDRNRLLVCILNICKDVLGRLPKVVGIDIVEMALWAKDNTPVVTTQRSTEDGEPVAESVTESDLKVTVEKELVSQAEEEDMEALLGTYVMGIGEAEAFSERLKRELQALEAANVHAILESEPLVDEVLNGLEAATNIVDDMDEWLGIFNIKLRHMREDIESIETRNNKLEMQSVNNKALIEELDKVIERLRVPSEYAASLTGGSFDEADMLQNIEACEWLAKALRGLEVPNLDPIYANMRAVKEKRAELEKLKATFVRRASEFLRNYFASLVDFMVSDKSYFSQRGQLKRPDHADLRYKCRTYARLLQHLKGLDKNCLGPLRKAYCSSLNLLLRREAREFANELRASTKVSRNPTVWLEGSTGSSQNANTDTSAVSDAYAKMLTIFIPLLVDESSFFAHFMCFEVPALAPPGGAGNDKKSQSNNDDGNDDDDLGIMDIDETDKKPGKNSPDLTALNESLQDLLDGIQEDFYAVVDWAYKIDPLRCISMHGITERYLSGQKADAAGFVRLLLGDLESRVSMQFSRVFVDEACHQIERNERNVRQMGVLPYIPRFAALATRMEQYIQGQSRDLVDQAYTKFVSIMFVTLEKIAQQDPKYADILLLENYAAFQNSLYDLANVVPTLAKFYHQASEAYEQACTRHISMIIYYQFERLFQFAKKIEDFMYTITPEEIPFQLGLSKVELRKMLKSSLSGVDKSIAAMYKKLQKNLASEELLPSLWDKCKKEFLDKYESFVQLVAKVYPSENVPGVTEMRGLLASM

SEQ ID NO: 24735 - protein, 456 aa, Nostoc punctiforme
  misc_feature (10)..(10): Xaa can be any naturally occurring amino acid
  misc_feature (12)..(12): Xaa can be any naturally occurring amino acid
DSCVQPASRXLXESPWLCGVEDSLNLGNGHNLQFIPTPNPRYADQLCTYDPQTEILYTDKLFGAHVCGDQVFDEGWEVYNEDRRYYFDCLMAPHARQVETALEKLADFPVRMYANGHGPLVRYGLIELTKSYREWSQQQTSADLTVALIYASAYGNTATLAQAIARGITKAGVAVESINCEFTEPEEIRAAVEKAGGFIMGSPTLGGHAPTPVQTALGIVLSTATNNKLAGVFGSFGWSGEAVDLIEGKLKDAGYRFGFDTIRVKFKPDDATLQLCEEAGTDFAQALKKARKVRSPSQPATTVEQAVGRIVGSLCVLTAKEGDRSSAMLASWVAQASFSPPGLTIAVAKERAVETLTHTGNKFVLNILKEGNHLGLMKHFLKPFGPGQDRFADVAAQEAENGSPILTEALAYLECSVQNRMESGDHWLVYATVENGKLLDNDGITAVHHRKSATHY

SEQ ID NO: 24736 - protein, 90 aa, Glycine max
HASDEDEKYNRKLESGLYTLQLIAVILGHLWCSEHPQMRGRIELLLKQNKLSKKHIKDILQEYHDNIGDLDGPEEKERAQTKIQKFITAL

SEQ ID NO: 24737 - protein, 312 aa, Arabidopsis thaliana
MVDENVETKASTLVASVDHGFGSGSGHDHHGLSASVPLLGVNWKKRRMPRQRRSSSSFNLLSFPPPMPPISHVPTPLPARKIDPRKLRFLFQKELKNSDVSSLRRMILPKKAAEAHLPALECKEGIPIRMEDLDGFHVWTFKYRYWPNNNSRMYVLENTGDFVNAHGLQLGDFIMVYQDLYSNNYVIQARKASEEEEVDVINLEEDDVYTNLTRIENTVVNDLLLQDFNHHNNNNNNNSNSNSNKCSYYYPVIDDVTTNTESFVYDTTALTSNDTPLDFLGGHTTTTNNYYSKFGTFDGLGSVENISLDDFY

SEQ ID NO: 24738 - protein, 554 aa, Bacillus anthracis
MSRKIVVVGGVAGGASVAARLRRLSEEDEIIMVERGEYISFANCGLPYYIGGVITERQKLLVQTVERMSKRFNLDIRVLSEVVKINKEEKTITIKNVTTNETYNEAYDVLILSPGAKPIVPSIPGIEEAKALFTLRNVPDTDRIKAYIDEKKPRHATVIGGGFIGVEMVENLRERGIEVTLVEMANQVMPPIDYEMAAYVHEHMKNHDVELVFEDGVDALEENGAVVRLKSGSVIQTDMLILAIGVQPESSLAKGAGLALGVRGTIKVNEKFQTSDPHIYAIGDAIEVKDFVTETETMIPLAWPANRQGRMLADIIHGHTDSLYKGTLGTSVAKVFDLTVATTGLNEKILKRLNIPYEVVHVQANSHAGYYPNATPVLIKLIFNKDSGKIYGAQTLGRDGVDKRMDVIATAIKANLTVLDLPDLELSYAPPYSSAKDPVNMVGYAASNIVDGFVDTVQWHEIDRIVENGGYLIDVREPNELKQGMIKGSINIPLDELRDRLEEVPVDKDIYITCQLGMRGYVAARMLMEKGYKVKNVDGGFKLYGTVLPERIVY

SEQ ID NO: 24739 - protein, 162 aa, Triticum aestivum
  misc_feature (105)..(105): Xaa can be any naturally occurring amino acid
  misc_feature (119)..(119): Xaa can be any naturally occurring amino acid
  misc_feature (130)..(130): Xaa can be any naturally occurring amino acid
  misc_feature (138)..(138): Xaa can be any naturally occurring amino acid
  misc_feature (147)..(147): Xaa can be any naturally occurring amino acid
  misc_feature (159)..(159): Xaa can be any naturally occurring amino acid
MATSSGPKEAPANNPGLQTEVDPATKGYFLQQTMLRVKDPKVSLDFYSRVMGMSLLKRLDFEEMKFSLYFLGYEDVTLAPDDHIKRTEWTFRQKATLELTHNWGXTENDPEFKGYHNGXSDPRGFGHIGXLVDDVHKXCEPLNALGXVCEEPDDGKSKXLQQ

SEQ ID NO: 24740 - protein, 552 aa, Aspergillus nidulans
MRVLPATLLVGAATAATPAQQVLGGLQDFGNAVQDAMHENLPKINKPLEAFQEQLKSLYEAREFWEEVANAFPQNLDHNPVFSLPKKHTRRPDSHWDHIVRGADVQSVWVTGENGEKEREIEGKLEAYDLRIKKTDPSSLGIDPDVKQYTGYLDDNENDKHLFYWFFESRNDPKNDPVVLWLNGGPGCSSLTGLFMELGPSSIDENIKPVYNPYAWNSNASVIFLDQPVNVGYSYSGSTVSDTVAAGKDVYALLTLFFKQFPEYAEQDFHIAGESYAGHYIPVFTSEILSHQKRNINLKSVLIGNGLTDGLTQYEYYRPMACGEGGYPAVLDESSCRSMDNALGRCQSMIESCYNSESAWVCVPASIYCNNALLAPYQRTGQNVYDVRGKCEDESNLCYKGMGYVSEYLNKPEVRAAVGAEVDGYDSCNFDINRNFLFHGDWMKPYHRLVPGILEQIPVLIYAGDADFICNWLGNKAWTEALEWPGHKEFAAAPMEDLKIVDNEHTGKKIGQIKTHGNFTFMRLYGGGHMVPMDQPEASLEFFNRWLGGEWF

SEQ ID NO: 24741 - protein, 952 aa, Unknown
  Candidatus Pelagibacter ubique HTCC1002
MLKNAQKDFIQRHIGPSIDEQNVMLKELGYQNLDDLIKDTVPEKILLKDDLDIGDPNSEYKALRKLKDISKKNKIYSSFIGMGYYGTYTPYVILRNILENPGWYTSYTPYQPEVAQGRLEMLLNFQQMIIDFTGMDIANASLLDEGTAAAEAMGLSYRISKSESKKVFVSKNCHPQTIDVIKTRAEPLGLEIIVGDEDKDIKEDIICGIIQYPGTLGDIKDPSEAISKIHKFNGKAVLACDLLALAKLKTPAELGADIAVGSSQRFGIPMGYGGPHAAFFATKDEYKRSMPGRIVGVSVDRHGKKAYRLALQTREQHIRRDKATSNICTAQALLAIVSAAYAVYHGPQGIKKIAESVSQLTKNFADKLKQSGYELYSNEFFDTVTIKTLDKTEKIYKNALDQGVNIRKVNSEMLAVSFDERKNLYRANQLLKIFNCSETIKESMNESLSNIPKNLLRTSTYLDHPVFNSYHSETEMLRYLKKLEDSDIALNKSMIALGSCTMKLNAVAEMIPVTWKEFSQPHPFSPVEQMDGYRELFTDLKNWLRSITGFSGVSLQPNAGAQGEFAGLMVIRKFHEKNGETNRNVCLIPSSAHGTNPASAQMVGMKVVVVKCDQYGNVDYEDLKNKAEEHSENLAALMVTYPSTHGVFEEKITDICELIHNHGGQVYMDGANLNALVGIAKPGNFGPDVCHINLHKTFCIPHGGGGPGMGPIACKKHLEIFLPKHSVIKDCGPVTGMGAVSAAPWGSSSILSISWMYIKMMGSEGLRKASQVAILNANYIAHKLKDSFPILYKGKSGNVAHECIIDIRTIKSETGITEEDIAKRLIDFGYHAPTMSWPVAGTMMIEPTESESLSEIDKFCSTLIKIKQEIDKIQSGEYDKTDNPLKNAPHTHVELTSNKWDHKYEREEAAYPSEFLRTNKYWPPVGRVDNVYGDKNLFCTCPSMEEYEDTAA

SEQ ID NO: 24742 - protein, 112 aa, Unknown
  Rhodococcus sp. RHA1
MKLITAIVKPFTLEDVKTGLEQAGVLGMTVSEVQGYGRQKGHTEVYRGAEYSVDFVPKVRVEVVVDDAAVDKVVEVIVEAARTGKIGDGKVWVSPVESVIRVRTGERGADAL

SEQ ID NO: 24743 - protein, 136 aa, Brassica napus
MADTKPGLRKPEFTKVDQLRPGTSGHNVTVKIVSTKMVLQKGRSDGPQARQMRISECIVGDETGVVVFTARNDQVDVMKEGTTVTLRNAKIDMYKGSMRLAVDKWGRVEVTEPASFKVKEDTNMSLVEYEVVNVVE

SEQ ID NO: 24744 - protein, 418 aa, Streptococcus pyogenes
MIFDKGNVEDFDKELWDAIHAEEERQEHHIELIASENMVSKAVMAAQGSVLTNKYAEGYPGNRYYGGTECVDIVETLAIERAKKLFGAAFANVQAHSGSQANAAAYMALIEAGDTVLGMDLAAGGHLTHGSPVNFSGKTYHFVGYSVDADTEMLNYEAILEQAKAVQPKLIVAGASAYSRNIDFEKFRAIADHVGAYLMVDMAHIAGLVAAGVHPSPVPYAHIVTSTTHKTLRGPRGGLILTNDEALAKKINSAVFPGLQGGPLEHVIAAKAVAFKEALDPAFKDYAQAIIDNTAAMAAVFAQDDRFRLISGGTDNHVFLVDVTKVIANGKLAQNLLDEVNITLNKNAIPFETLSPFNTSGIRIGCAAITSRGMGVKESQTIARLIIKALVNHDQETILEEVRQEVRQLTDAFPLYKK

SEQ ID NO: 24745 - protein, 585 aa, Glycine max
MRPRVAYSFPEEVLEHVFSFIECDKDRGSISLVCKSWYEIERWCRRRVFVGNCYAVSPATVVNRFPKVRSIAIKGKPHFADFNLVPEGWGAYVGPWIKAMAAAYPWLQEIRLKRMVIADECLELIAKSFKNFQVLVLTSCEGFTTDGLAAIAANCRNLRELELRESEVDDICGHWLSHFPDSYTSLVSLNISCLGNEVNLSALERLVSRCPNLQTLRLNRAVPLDRLATLLRGAPQLVELGTGAYTTEMRPEVFTNLAEAFSGCKQLKGLSGFWDVLPSYLPAVYPICSNLTSLNLSYATIQSPDLIKLVGQCESLQRLWVLDYIEDAGLEVIAASCKDLRELRVFPSDPFGLEPNVALTEQGLVSVSEGCTKLQSVLYFCRQMSNAALDTIARSRPNMTRFRLCIIEPRAPDYLTHQPLDAGFGAIVEHCKDLQRLSLSGLLTDRVFEYIGTYGKKLEMLSVAFAGDSDLGLHHVLSGCDNLRKLEIRDCPFGDKALLANAAKLETMRSLWMSSCLVSYGACKLLGQKMPRLNVEVIDERGPPDSRPESSPVEKLYIYRTVSGPRLDMPGYVWRMQDDSALRIS

SEQ ID NO: 24746 - protein, 639 aa, Alkalilimnicola ehrlichei
MCGITGFWGGPAVDEGIAGRMAARIASRGPDDAGAWRDVKAGVALAHRRLSVIELSPAGHQPMRSPCGRYTLVYNGEIYNHLDLRVALETAGGAPDWRGYSDTETLLAALAHWGVPETLTRLNGMFAFALWDNREATLFLARDRMGEKPLYYGRNGGTFLFGSELKALTAYPGWQGQVDRDALALYLRYNHVPAPRSIYRGIGKLPPAHYVAVRDGGRNVGEPQCYWSLGEIAEQGVMQAGGSAHELADELDGLLRDAVGRRMAADVPLGSFLSGGFDSSMVAAQMQAQSERPVKTFSIGFHEAGYNEADHARAVATHLGTDHTELYITPEEAMAVIPELPAIFDEPFGDSSQIPTYLVSRMAREHVTVSLSGDGGDELFGGYNRHVVGPALWGRLARLPAPLRRGLGRAVGVAARIDRLPGAGRVPQLGEKLDKLASAMRASGGTAFYKDLLSHWKTPATVVRGASEPASLPDRIEAMPNLPGLRERMLYLDMMTYLPDDILTKVDRASMAVSLEARVPLLDHRLVAFAWRVPTDYKVRDGQGKWLFRRVLDRYVPRALMERPKMGFAVPIEHWLRGPLRDWAEVLLDERRLEREGFFHPAPIRRMWAEHLSGRRRHHAPLWNVLMFQAWSERQERIG

SEQ ID NO: 24747 - protein, 161 aa, Brassica napus
MAATSASALLSPTTFSTVISQKNPNSISFHGLRPLRLGGSSALPKLSTTSGRRSSSSAVVRAELSPSVVISLSTGLSLFLGRFVFFNFQRENVAKQVPEQNGKTHFEAGDDRAKEYVSLLKSNDPVGFNIVDVLAWGSIGHIVAYYVLATSSNGYDPSFFG

SEQ ID NO: 24748 - protein, 952 aa, Novosphingobium aromaticivorans
MGYERQADFGTPEVRSETEVTCFIDGREVTVPAGTTVMRAAALTGGSIPKLCATDNLKQFGSCRLCLVEIDGMRGTPASCTTPVASGMKVHTQTPRLEKLRRGVMELYISDHPLDCLTCSANNDCELQDQAAAVGLRDVRFGYEGENHLGAATDTSNPYFDFDPSKCIVCSRCVRACDEVQGTFALTIDGRGFASKVSAGLGSDDYLSSECVSCGACVQACPTATLQEKAVKEIGKPERAVVTTCAYCGVGCTFRAEMRGEQLVRMVPWKDGKANRGHSCVKGRFAWGYAQHQERVLSPMIRESIDQPWREVSWEEALSHTAREINRIRETYGRNALGGITSSRCTNEETFLVQKLIRAGFGTNNVDTCARVCHSPTGYGLKTTFGTSAGTQDFDSVEDTDVILVIGANPTDGHPVFASRMKRRLRQGAKLIVIDPRRTDLVRSPHVEADFHLPLRPGTNVAVLTAMAHVIVTEGLADEAFIRERCDWDEYQHWAEFVSAARNSPEFLSPVIGVGADAIRGAARLYATGGNGAIYYGLGVTEHSQGSSTVMAIANLAMATGNIGRRGVGVNPLRGQNNVQGACDMGSFPHELSGYRHVSDAETRALFEAEWGVPIDPEPGLRIPNMLDAATDGVFKAIYIQGEDILQSDPDTRHVAAGLAAMECVIVHDLFLNETANYAHVFLPGSTFLEKNGTFTNAERRIQPVRKVMEPLNGYEDWQVTQELARAIGLDWNYTHPSEIMDEIARLTPTFAGVNYKRLDAEGSLQWPVNDKAPDGSPIMHIDGFVRGRGKFVVTDYVPTDERTGPRFPLLLTTGRILSQYNVGAQTRRTANTVWHPEDVLEMHPTDAENRGVKTGDWVRLASRSGETTLRALVTDRVAPGVVYTTFHHPATQANVVTTDYSDWATNCPEYKVTAVQVTPSNGPSDWQEDYEAQAARSRRIAGHEGAMEPAE

SEQ ID NO: 24749 - protein, 427 aa, Nostoc punctiforme
MTRTNSDFLSSTDPAIAELINDELQRQRDHLELIASENFTSAAVLAAQGSVLTNKYAEGLPGKRYYGGCEYIDKIEQLAINRAKQIFGAAHANVQPHSGAQANFAVFLSLLQPGDKIMGMDLSHGGHLTHGSPVNVSGKWFQVSHYGVSQQTEQLDYDQIRELALRERPKLLICGYSAYPRIIDFEKFRSIADEVGAYLLADIAHIAGLVASGLHPDPIPHCHVVTTTTHKTLRGPRGGLILTSDAELGKKLDKSVFPGTQGGPLEHVIAGKAVAFGEALKPEFKTYSAQVIENARALAEQLQNRGLKLVSNGTDNHLLLVDLRSVNLTGKQADQLVSTVNITANKNTIPFDPQSPFVTSGLRLGSPAMTTRGLGVAEFTEIANIISDRLLSPDSDVVTQDCRQRVAALCDRFPLYPHLEIPVPALA

SEQ ID NO: 24750 - protein, 250 aa, Unknown
  Fragaria x ananassa
MGKCYPTVSEEYKKAIDKAKRKLRGLIAEKNCAPLMLRLAWHSAGTYDVKTKTGGPFGTMKQSAELAHGANNGLDIAVRLLEPIKEQFPILSYADFYQLAGVVAVEVTGGPDVPFHPGREDKPEPPPEGRLPDAGKGSDHLREVFGKTMGLSDQDIVALSGGHTLGRAHKERSGFEGPWTPNPLIFDNSYFTVLLSGEKEGLLQLPTDKALLSDPVFRPLVEKYAADEDAFFADYALAHQRLSELGFAEA

SEQ ID NO: 24751 - protein, 493 aa, Bacteroides thetaiotaomicron
MEKKLKSWQGWLLSGGSMVVVFVLGLCVSALMERRAEVASIFNNRKTVIKGIEARNELFKDDFPREYQTWTETAKTDFESEFNGNVAVDALEKRPEMVILWAGYAFSKDYSTPRGHMHAIEDITASLRTGSPAGPHDGPQPSTCWTCKSPDVPRMMEALGVDSFYNNKWAAFGDEIVNPIGCSDCHDPETMNLHISRPALIEAFQRQGKDITKATPQEMRSLVCAQCHVEYYFKGDGKYLTFPWDKGFTVEDMEAYYDEAGFYDYIHKLSRTPILKAQHPDYEIAQMGIHGQRGVSCADCHMPYKSEGGVKFSDHHIQSPLAMIDRTCQTCHRESEETLRNNVYERQRKANEIRNRLEQELAKAHIEAKFAWDKGATEDQMKDVLALIRQAQWRWDFGVASHGGSFHAPQEIQRILSHGLDRAMQARLAVSKVLAKHGYTEDVPMPDISTKAKAQEYIGLDMDAERAAKEKFLKTTVPAWLEKAKANGRLAQK

SEQ ID NO: 24752 - protein, 451 aa, Thermoanaerobacter tengcongensis
MPKRYVIIGGDAAGMSAASQIRRMDKEGEVLVFEKEGVISYAQCGLPYWVGGVVSEKKKLIARTAEEFLNRYNIDVKLYHEVVKIDPSKKEIKVFRREEKDEIAVPYDVLLIGTGSTAIVPPWEGRNLPGVFTLKTMGDAEKLLDWLSSHTPTKAVVIGGGYIGLETAEALHSRGFKVTVLDLAPQLIPTFDKEIAEIAQDALTRHGVEVHLNEEVVGLEGDEKGVKAVVTKNGKFEADLVIISIGVRPVSELAKEAGIELGPKNAILVNERLETSIPDIYAAGDCATHFNRIKNAPDYIPLGTTANKQGRIAGINMAGGDAKFAGVVGTAIVKVFDRTIARSGLGERDCEALGIPYQVVLIKARPVSHYYPWEDEILTIKLCYHKDNRKLLGGQIAGGLGGVDKRIDVLATALFHEMTIDELQALDLAYAPPYNSVWDPLQQASTVAQRG

SEQ ID NO: 24753 - protein, 250 aa, Unknown
  Fragaria x ananassa
MGKCYPTVSEEYKKAIDKAKRKLRGLIAEKNCAPLMLRLAWHSAGTYDVKTKTGGPFGTMKQPAELAHGANNGLDIAVRLLEPIKEQFPILSYADFYQLAGVVAVEVTGGPDVPFHPGREDKPEPPPEGRLPDAGKGSDHLREVFGKTMGLSDQDIVALSGGHTLGRAHKERSGFEGPWTPNPLIFDNSYFTVLLSGEKEGLLQLPTDKALLSDPVFRPLVEKYAADEDAFFADYALAHQRLSELGFAEA

SEQ ID NO: 24754 - protein, 362 aa, Triticum aestivum
  misc_feature (244)..(244): Xaa can be any naturally occurring amino acid
MASLVQHVAGLACPPLSGASRRPGAPMRPSALVCGTYVLSKDEKERERMRTLFDEASERCRTAPMEGITFSPEDLESAVETTDIDTDIGSLIKGTVFMTTSNGAFIDIQSKATAFLPIDEACLLDIDNIEEAGIRPGLVEQFMIIDENPNDETLILSLQSIQQDLAWERCRQLQAEDVVITGKVIGGNKGGVVALVEGLKAFVPFSQVSSKTTAEELLDKELPLKFVEVDEEQGRLVLSNRKAXMADSQAQLGIGSVVLGTVESLKPYGAFIDIGGINGLLHVSQISHDRVADISTVLQPGDTLKVMILSHDRERGRVSLSTKKVEPTPGDMIRNPKLVFEKADEMGRFSAEITQQSMPLRL

SEQ ID NO: 24755 - protein, 244 aa, Parvularcula bermudensis
MGELPPKRTLSKETRAEADQLAARELTEKVKTARGRKISSKLWLERQLNDPYVARARAEGFRSRAAYKLLELDEKFGLLRPGARVVDLGAAPGGWSQVAGRAVLPGGQVVGIDYLDMPPLDGVTLLKADFLDEDTPGRLRAVLGGPAHLVLSDMAAPTTGHKSTDHLRIVALAEAALDFAETVLAPGGGYVAKVLQGGSEKSLLDRLKADFTDVAHAKPSASRAESAEMYVVATGYRSAKGKPS

SEQ ID NO: 24756 - protein, 98 aa, Arabidopsis thaliana
  misc_feature (58)..(58): Xaa can be any naturally occurring amino acid
MEKWLGVAASVSTVSAVRPVFFLKPTAAIFAPVLGLPPMVKKKGGLRFSLEPNQGTVXSMGAGVQVAEPVFLPAVITNSPLVWVNKRFSPKEPDFPFV

SEQ ID NO: 24757 - protein, 168 aa, Zea mays
MDNNNQQPPPPTSAAVIPPPGSTPVSPSRGASSYHELLQQQLQMFWNYQRTEIEQVNDFKNHQLPLARIKKIMKADEDVRMISAEAPILFAKACEIFILELTIRSWLHAEENKRRTLQENDIAAAITRTDIFDFLVDIVPREEEEEEEAAAPAPYYYPPMGQPAGTMI

SEQ ID NO: 24758 - protein, 153 aa, Pisum sativum
IYDLRGFKNTAGIEAEDVAKRLMDYGFHGPTMSWPVAGTLMIEPTESESKAELDRFCDALISIRKEIAEVEKGNADVHNNVLKGAPHPPSLLMADAWTKPYSREYAAFPAAWLRGAKFWPTTGRVDNVYGDRNLVCTLLPASQAVEEQAAATA

SEQ ID NO: 24759 - protein, 250 aa, Unknown
  Fragaria x ananassa
MGKCYPTVTEEYKKAIDKAKRKLRGLIAEKNCAPLMLRLAWHSAGTYDVKTKTGGPFGTMKQSAELAHGANNGLDIAVRLLEPIKEQFPILSYADFYQLAGVVAVEVTGGPDVPFHPGREDKPEPPPEGRLPDAGKGSDHLREVFGKTMGLSDQDIVALSGGHTLGRAHKERSGFEGPWTPNPLIFDNSYFTVLLSGEKEGLLQLPTDKALLSDPVFRPLVEKYAADEDAFFSDYALAHQRLSELGFAEA

SEQ ID NO: 24760 - protein, 112 aa, Bartonella henselae
MKKIEAIIKPFKLDEVKEALQKIGLHSITVTEAKGFGCQKGHTELYRGAKYVIDFLPKVKIEIVIADEKLEQAIDTIRKAAQTKHIGDGKIFVSSIDHAIRIGTGKSGIDAL

SEQ ID NO: 24761 - protein, 112 aa, Xylella fastidiosa
MKLITAIIRPFKLDEVREALSQVGVSGITVTEVKGFGQQKGHTELYRGTEYVIDFLPKIKIEMVVTDERLDAVIEVIRIAAVTGKIGDGKIFVTKIEQVVRIRTGEIDIDAL

SEQ ID NO: 24762 - protein, 132 aa, Glycine max
  misc_feature (59)..(59): Xaa can be any naturally occurring amino acid
  misc_feature (124)..(124): Xaa can be any naturally occurring amino acid
MGKASRDKRDIYYRKAKEEGWRARSAFKLLQIDEEFNLFEGVKRVVDLCAAPGSWSQGXNLPLIVAIDLQPMAPIEGVIQVQGDITNARTAEVVIRHFDGCKADLVVCDGAPDVTGLHDMDEFXQSQLILSG

SEQ ID NO: 24763 - protein, 470 aa, Triticum aestivum
MALLLVLVGVVVGVVLASSLLLRWNEVRYGRRKEGRLPPGTMGWPLFGETTEFLKQGPSFMKQRRLRYGRLFRTHILGCPTVVCMDPELNRRMLLQGEAGGLVPGYPQSMLDILGRNNIAAVHGQLHRVMRGAMVGLVRPAALRQSLLPKIDAFMRDHLCGWAGTVVDVQAKTKEMALLSALRQIAGVTAGPLSDALKTELYTLVLGTISLPINLPGTSYYQGFQARKKLVSILEQMIAERRSSGDAHDDMLDALLRSGDDGTREKISDEQIIDLLIALIYSGYETMSTTSMMAVKYLSEHPRALEELRREHLDIRKGKSPDEAISYDDVKSMTFTRAAIFETLRLATVVNGLLRKTIKDVEMNGYVIPKGWRIYVYTREINYDPFMYPDPMTFNPWRWLEKNMESHPHFMLFGGGGRMCPGKEVGTVEITTFLHYFVTRYRWEEEGKNTILKFPRVEAPNGLHIRVQDY

SEQ ID NO: 24764 - protein, 418 aa, Unknown
  Oceanobacter sp. RED65
MDVIAYMQSVGDAAKQASSHIAKANSGTKNTALLAIAEAIHEHREALASANAKDMAKGKDNGLDAALLDRLELTPARIDGMIEGLKQVAALPDPVGGMTDLDYRPSGIQVGKMRVPLGVIGIIYESRPNVTIEAASLCLKSGNAAILRGGSEAIESNQALAACIKQGLAKADLPETVVQVIETTDRAAVGELITMTETVDVVVPRGGKSLIERISADAKVTVIKHLDGICHVYIDSDADVSKGVNIAINAKTHRYGTCNTMETLLVNEAIAEKILPQLDAAYSDIGVELRGCEKTMAILGDINAATEEDWATEYLAPVLSIKVVADMDEAIAHINRYGSHHTDSIITENYSKARDFLRQVDSSSVMVNASTRFADGFEYGLGAEIGISTDKIHARGPVGLEGLTSQKWIVLGDGHIRQ

SEQ ID NO: 24765 - protein, 156 aa, Unknown
  Oceanospirillum sp. MED92
MKKATFAAGCFWGIELKFSQLPGVVRTEVGYMGGITDQPSYQDVCRGDTCHAEVVQLEFDERFIDYSTLLDAFWHMHDPTTLNRQGPDIGTQYRSAIFYHDDEQKKLAEESKAQLDTSSAFANSIVTEIVQAKPFWKAEEYHQKYLEKRGMGACGI

SEQ ID NO: 24766 - protein, 195 aa, Burkholderia thailandensis
MRVAEVVRNTSETQIRVKIDLDGTGRQKLATGVPFLDHMLDQIARHGLVDLDIEAHGDTHIDDHHTVEDVGITLGQAVAKAVGDKKGIRRYGHSYVPLDEALSRVVIDFSGRPGLEFHVPFTRARIGTFDVDLSIEFFRGFVNHAGVTLHIDNLRGVNAHHQLETVFKAFGRALRMAVELDERAAGQIPSTKGSL

SEQ ID NO: 24767 - protein, 422 aa, Unknown
  Azoarcus sp. BH72
MKHLILGNGPAGVVAAETLRRAAPQDEIVMVGSEDAPPYSRMAIPYLLEENIDERGTWLRKDPGHFDRLRIRELRGRAVSLDTDQRRVLFADGHFEDYDRLLIATGSHPVRPPIPGVDLPEVQTCWTLADARAIAAHARPGARVLQLGAGFIGCIIMEALAKRGVELTVVEMGDRMVPRMMTPQAGGMIKRWVENKGIRVVTNAGVSRIDRGTDGAPLQVTLTTGATLACDLVIVAAGVAPNVAFLEGTGVHVAKGVLVDARLETSVPGIFSAGDVAEAPDLFTGAHLVAAIQPNAADQARVAALNMAGRETTLNGVLAINVLDTLGLISTSFGQWWGEAADKGGSGVEHVDEARSRYLSLQFKDDVMIGATSIGLTEHVGALRGLIHGRVQLGEWKARLLQNPLAFVDAYIARSQPVALTH

SEQ ID NO: 24768 - protein, 488 aa, Unknown
  Oceanospirillum sp. MED92
MGEEILINFTPMETRVAVIENGMPQEVYVERVHRRGIVGNIYQGKVVRVLPGMQAAFVDIGLERAAFIHVEEVLPQNASHEEKNNTSIAQVLREGQALLVQVTKDPIGTKGARLTTHLSLPSRYLVCMLGNSHVGVSQRIEDLEERDRLRNIVHSLIKEEDGEPAGFILRTVAEGAAEAELKADIQFLRRLWASIKEKISTAKAPSIVYEDLPLNMRALRDMAHSGLERIRIDSRETFQKAEAFVRDLVPEVTDTLEYYPGERPIFDLFNVEEEIQKALGRKVELKSGGYLIFDQTEAMTTVDVNTGAFVGHRNLEETIFKTNLEAATAIGRQLRLRNLGGIIILDFIDMEDPDHQRQVLRTLERVLERDHAKCKVMGVSDLGLVEMTRKRTRESLEQVLCDVCSECQGRGSIKTPETVCYEIFREILRQHRAYDTDSYLVLAAQPVVDYLLDDASNHVAELEAFIGKTIRFQVEPMYNAESFDVVLR

SEQ ID NO: 24769 - protein, 413 aa, Thermococcus kodakarensis
MIKKAVIPIGGDATRLRPLTIETSKGLVRLLNKPILEHSILSLAKDGIEEVYLGVRGYVNYTTLFDYFREGYWLQKKYGLEKEIRIRYMPRYESTTNGDAVWYTMEYYGIKEPVVVIQGDNIYQLNIQDMYKWHRKKNAFMTIALQPVEDVTGFGVAKIDDDYRIEYFVEKPRPEQAPSNLANTGIYILSENFWEFLNEGWAKEMKETRRLDFGGDIIPALIEHGYEVYGYPMEGYWFDVGTPERYLNAAMYLLRHLSPEDMEAVEITHDVYMQGKSEMSEDLRRKFREMIKTGKLIVEGKVLLGRHISIGKGTALEDAVIDNYTIVGRNCEILHSVVMDRVKLGDNVRIVNSIIGRHVEIGNNVRIVNSVIGDNAVIEDNVRMYNVKIWPHEFVERGATLEHYTVRTGVPRR

SEQ ID NO: 24770 - protein, 442 aa, Oryza sativa
MEQTLDVPRSLRLLAPKAQQQMDEFWRDRQKEIETTKDFSEHAIPMARLKKIVSSQKGNMMMTFDMPAFLSKMCELFVQELAVRAWASAQSHNRCIILDTDIAKAIASTESYDFLVDILHNHRVKHKSTPCSTLTTKRCRLVDQPSTSHMPYQHQLPQFAPTYTPAIPITPSLMPPISHYIPFQYPSLSQEVSPMMASAPIVNRSMLLIHNIARGLGLQGNNISTFANNNIPDNIVGCSSPTVLASMMSPALLEVAGTSLNPPNSHSICTMNMINSSDPSGSSIGDINVANQASLAPSGRFNPAILRESSCPSFLHSNNDTIVAIPEGVDISGTMDVASDVAAIVINGQEEHERETNVEHHQQNEIYESIDIGIINASVADDNKYSISWDELGMADDSLLDKFLEEFQVRNDGVLRTGIELHEDPFLGDVMLANPSTSNANK

SEQ ID NO: 24771 - protein, 399 aa, Unknown
  Mycobacterium sp. MCS
MTPERAVIVGASHAGAQLAANLRREGWSGEVVLIGDEGGLPYHRPPLSKGYLAGKNGLDDLLIRGADFYEKQHIRLLNATVEAIHRSAKRVSLSTGDTLTYTKLALCTGARARRLPTPGVDLPGIHYLRTAADVELIRAAATPGRRVVIVGGGYIGLETAASLCSLGMNVTVLEATERVLERVTAPEVSAFYTRIHNGEGVEIRTHALVEAFSGNGRVQEVVLAGGEPIPADLVIVGVGVVPNTELASAAGLSVDNGIVIDDQARTSDPDIVAAGDCTSHTMARYGSRIRLESVSSAGEQAKIAAATICGKHSAIAALPWFWSDQYDLKLQIAGLNTGYDEVVFSGDPSRDRDFSCFYFRDRELIAADCVNRPRDFMFSKRAISQQLRVDRSELLAGSI

SEQ ID NO: 24772 - protein, 481 aa, Alkalilimnicola ehrlichei [sequence omitted]

SEQ ID NO: 24773 - protein, 476 aa, Lactobacillus sakei
MAENEMKRELKTRHLSMIALGGSIGTGLFVTSGSAIAKAGPGGALLAYCGIGIMVFFLMTSLGEMATYLPVSGSFSTYATRFVDPALGFALGWNYWFNWAITLAVDVSTAALVMQFWLPDMPGWIFSLVALLLIFLINITSVKSFGETEYWFALIKVITVIIFLGVGVLTIFGIMGGHRTGLSNFTIKKAPFVGGLPMMLSVFVVAGFSFQGTELIGITAGESKTPEKSIPKAIKQVFWRILLFYILSIFVIACLIPYTSPSLLGASETNIAVSPFTLVFKRAGLASAASIMNAVILTSVLSAANSGMYASSRMLWSMAEDGYAAKIFAKTNKRGIPVMALIGTTIIGALTFMTSVFGTRIYLFLVAASGLTGFIAWLGIAISHYRFRRAFKVQGHQLSELKYHARWFPFGPIFAFLLCVIVIIGQDIQAFAHFDWTAIGISYMSIPLFIILYSYYKIRYKTKVIPLEKVDLSKHR

SEQ ID NO: 24774 - protein, 490 aa, Schizosaccharomyces pombe
MSPKQEEYEVERIVDEKLGRNGAVKLYRIRWLNYSSRSDTWEPPENLSGCSAVLAEWKRRKRRLKGSNSDSDSPHHASNPHPNSRQKHQHQTSKSVPRSQRFSRELNVKKENKKVFSSQTTKRQSRKQSTALTTNDTSIILDDSLHTNSKKLGKTRNEVKEESQKRELVSNSIKEATSPKTSSILTKPRNPSKLDSYTHLSFYEKRELFRKKLREIEGPEVTLVNEVDDEPCPSLDFQFISQYRLTQGVIPPDPNFQSGCNCSSLGGCDLNNPSRCECLDDLDEPTHFAYDAQGRVRADTGAVIYECNSFCSCSMECPNRVVQRGRTLPLEIFKTKEKGWGVRSLRFAPAGTFITCYLGEVITSAEAAKRDKNYDDDGITYLFDLDMFDDASEYTVDAQNYGDVSRFFNHSCSPNIAIYSAVRNHGFRTIYDLAFFGIKDIQPLEELTFDYAGAKDFSPVQSQKSQQNRISKLRRQCKCGSANCRGWLFG

SEQ ID NO: 24775 - protein, 390 aa, Corynebacterium efficiens
MGSDCLHRRTPPMTDMFDLIDDWGPEKIVVVHDHRTRMRGVLVIDNTARGMGKGGTRMQPTVSVGEIARLARVMTWKWAGVDLFYGGAKAGIQADPASPDKEAVLRSFVRKLSNEVPEEYIFGLDMGLTEHDAAIITDELGRGTCMGTPYELGGVPYDQLGVTGYGIAEVADEVAQSQNLAGASVAIQGFGAVGHAVAERLHTLGYRVVAVSTARGAIADPNGLDIPELVRLREEVGDDLVSHYPVLRIDPGEELFMDAEILIPAALQDVINARGAERVTARIVVEGANLPTSPQAQQILHQRGITVVPDFIANAGGVVAAAFAMDNRFSPFRTDPEQIYTSVSSKLRLNATTVLGRAAERSQTSHDAARQLSQERVRAAMEVRGMLPSG

SEQ ID NO: 24776 - protein, 101 aa, Phaseolus vulgaris
MASSMISSPAVTTVNRAGAGAGMVAPFTGLKSLGGFPSRKMNNDITSVANNGGRVQCIQVWPTVGKKKFETLSYLPPLTKQQLAKEVDYLLRKGWVPCLEF

SEQ ID NO: 24777 - protein, 103 aa, Exiguobacterium sibiricum
MAIVHATSQSFKEDTQEGLVLVDFWATWCGPCRMLAPVLEELDADMENVKIVKVDVDANPEVAGAFQVQSIPTLVLFKDGQPVNKTMGFMPKDALKEFVETSN

SEQ ID NO: 24778 - protein, 428 aa, Bacillus anthracis
MVAEKGTQTKTQQQREQHFELLNSTQIVISEALEKLGYPNEVYELLKEPIRMMTVKIPVRMDDGTVKIFTGYRAQHNDAVGPTKGGIRFHPNVTENEVKALSIWMSLKCGIVDLPYGGGKGGIICDPREMSFRELERLSRGYVRAISQIVGPTKDIPAPDVFTNSQIMAWMMDEYSRIDEFNSPGFITGKPLVLGGSHGRETATAKGVTICIREAAKKRDIDIKGARVVVQGFGNAGSFLAKFMHDAGAKVIAISDAYGALHDPNGLDIDYLLDRRDSFGTVTKLFNNTISNKELLELDCDILVPAAIENQITEENANDIKAKIVVEAANGPTTLEATKILTDRGILLVPDVLASAGGVTVSYFEWVQNNQGYYWTEEEVEQRLEKVMVRSFDSIYETAQVRKVNMRLAAYMVGVRKMAEASRFRGWV

SEQ ID NO: 24779 - protein, 139 aa, Unknown
  Candidatus Pelagibacter ubique HTCC1002
MKYLHTMIRISDVEKSLDFYCKGLGLIETRRMENEQGRFTLIFLAAPGDEKAELELTYNWDGDELGDGSRNFGHLAYRVENIYQICERLQDMGYTINRPPRDGHMAFVRSPDNISIEILQEGNLEIKEPWASMKNEGVW

SEQ ID NO: 24780 - protein, 456 aa, Salmonella enterica
MDSQQHSEQLKRGLKNRHIQLIALGGAIGTGLFLGSASVIQSAGPGIILGYAIAGFIAFLIMRQLGEMVVEEPVAGSFSHFAYKYWGGFAGFASGWNYWVLYVLVAMAELTAVGKYIQFWYPEIPTWASAAAFFVIINAINLTNVKVFGEMEFWFAIIKVIAVIAMILFGAWLLFSDTAGPQATVRNLWEQGGFLPHGWTGLVMMMAIIMFSFGGLELVGITAAEADNPEQSIPKATNQVIYRILIFYIGSLAVLLSLLPWTRVTADTSPFVLIFHELGDTFVANALNIVVLTAALSVYNSCVYCNSRMLFGLAQQGNAPKALLNVDKRGVPVSSILVSAVVTALCVLLNYLAPESAFGLLMALVVSALVINWAMISLAHMMFRRAKQQQGVKTRFPALFYPFGNVLCLLFMAAVLIIMLMTPGMAISVWLIPVWLLILGVGYLCKEKTAKTVKAH

SEQ ID NO: 24781 - protein, 487 aa, Mycobacterium tuberculosis
MPPLDITDERLTREDTGYHKGLHSRQLQMIALGGAIGTGLFLGAGGRLASAGPGLFLVYGICGIFVFLILRALGELVLHRPSSGSFVSYAREFYGEKVAFVAGWMYFLNWAMTGIVDTTAIAHYCHYWRAFQPIPQWTLALIALLVVLSMNLISVRLFGELEFWASLIKVIALVTFLIVGTVFLAGRYKIDGQETGVSLWSSHGGIVPTGLLPIVLVTSGVVFAYAAIELVGIAAGETAEPAKIMPRAINSVVLRIACFYVGSTVLLALLLPYTAYKEHVSPFVTFFSKIGIDAAGSVMNLVVLTAALSSLNAGLYSTGRILRSMAINGSGPRFTAPMSKTGVPYGGILLTAGIGLLGIILNAIKPSQAFEIVLHIAATGVIAAWATIVACQLRLHRMANAGQLQRPKFRMPLSPFSGYLTLAFLAGVLILMYFDEQHGPWMIAATVIGVPALIGGWYLVRNRVTAVAHHAIDHTKSVAVVHSADPI

SEQ ID NO: 24782 - protein, 240 aa, Bdellovibrio bacteriovorus
MSAARTIYHMRVEEIIDHTPTVRELVLKTETPNEFGFKAGQFVMLHVPQGEAKPALRAYSIASDDRTKNGFRLLFKFVENGLASTFVWQLKGGELLNFTGPFGKVFFQEPPTEQIVFLNTGTGLSQHLCYLLSKKDQYPNLRYRMLFGVRTEKDMYYQKEIEELQKALPDFKFEFVLSRPQDDWKGKKGYVQNFISEFDYKNIPTTFYLCGNGGMIKDVKHQLLEVDGFDKTRIWAEAFD

SEQ ID NO: 24783 - protein, 135 aa, Yersinia pestis
MSEALKILNNIRTLRAQARECTLETLEEMLEKLEVVVNERREEESQSQAEIEERARKLQQYREMLIADGIDPNELLQASAAAKAAGKAKRAARPAKYQYKDENGELKTWTGQGRTPAVIKKAIEEQGKSLDDFLL

SEQ ID NO: 24784 - protein, 113 aa, Cytophaga hutchinsonii
MKKIEAIVKPSKLKAIQAGLIKIGIPCMTVVPVKGVGLQQGFPEIYRGTEKSIVLLSKVMIICVVSDENLEKCIDVIIETGSEGKVGDGKIFVYDVLDAIRMRTRTRGDDAIR

SEQ ID NO: 24785 - protein, 395 aa, Mycobacterium tuberculosis
MAQREWVEKDFYQELGVSSDASPEEIKRAYRKLARDLHPDANPGNPAAGERFKAVSEAHNVLSDPAKRKEYDETRRLFAGGGFGGRRFDSGFGGGFGGFGVGGDGAEFNLNDLFDAASRTGGTTIGDLFGGLFGRGGSARPSRPRRGNDLETETELDFVEAAKGVAMPLRLTSPAPCTNCHGSGARPGTSPKVCPTCNGSGVINRNQGAFGFSEPCTDCRGSGSIIEHPCEECKGTGVTTRTRTINVRIPPGVEDGQRIRLAGQGEAGLRGAPSGDLYVTVHVRPDKIFGRDGDDLTVTVPVSFTELALGSTLSVPTLDGTVGVRVPKGTADGRILRVRGRGVPKRSGGSGDLLVTVKVAVPPNLAGAAQEALEAYAAAERSSGFNPRAGWAGNR

SEQ ID NO: 24786 - protein, 239 aa, Brassica napus
MSDEETKPFLKSRMYESRYPSRGDIVMGKVKKIEGREAVVWLVEYKKSCKVVLSATVPPVRVLAEKRMEAFRVADVSVEERQIILDETPLSKAEMWAFEKRFNEAKFVHSVLFSVADDLHMNLKDAYKLCDWPSYEELKTLHRDENFLACKNVSFRKLLLDRIGLMKYNSWRVNDPSRLQTSSLKQIRDICYAIALARQAEAFFKKRGDLGKEEHLSIQHILNKGVDYGLVSRDYTLLE

SEQ ID NO: 24787 - protein, 497 aa, Unknown
  Taxus x media
MDSFIFLRSIGTKFGQLESSPAILSLTLAPILAIILLLLFRYNHRSSVKLPPGKLGFPLIGETIQLLRTLRSETPQKFFDDRLKKFGPVYMTSLIGHPTVVLCGPAGNKLVLSNEDKLVEMEGPKSFMKLIGEDSIVAKRGEDHRILRTALARFLGAQALQNYLGRMSSEIGHHFNEKWKGKDEVKVLPLVRGLIFSIASTLFFDVNDGHQQKQLHHLLETILVGSLSVPLDFPGTRYRKGLQARLKLDEILSSLIKRRRRDLRSGIASDDQDLLSVLLTFRDEKGNSLTDQGILDNFSAMFHASYDTTVAPMALIFKLLYSNPEYHEKVFQEQLEIIGNKKEGEEISWKDLKSMKYTWQAVQESLRMYPPVFGIFRKAITDIHYDGYTIPKGWRVSCSPYTTHLREEYFPEPEEFRPSRFEDEGRHVTPYTYVPFGGGLRTCPGWEFSKIEILLFVHHFVKNFSSYIPVDPNEKVLSDPLPPLPANGFSIKLFPRS

SEQ ID NO: 24788 - protein, 221 aa, Zea mays
HFPESFWRQACELAPVFNELVDRVSMDGNFLQNALSKTRQVDDFTSRLLEIHRKMMEINKEENIRLGLHRSDYMLDSETSSLLQIELNTISASFPGLGSLVSDLHRSLIKQYGTSLSLEHKRVPANAASTQFSEALAQAWSEFNIDRGGQKVAVVYFRAGYAPNDYPSEAEWSARLMMEQSSAVKCPSISYHLVGTKKIQQELAKPNVLERFLKSEEEIEK

SEQ ID NO: 24789 - protein, 607 aa, Zea mays
  misc_feature (17)..(17): Xaa can be any naturally occurring amino acid
  misc_feature (598)..(598): Xaa can be any naturally occurring amino acid
MSRKRREGGGGGRGAGXVDHHGGGKGSEAGAAATDAVSMDGGLREVSVPVVFSVWCLLFLLRSQFLHSQADDDPSSEFYEEHGMRDSYCKVRPLEAYVLPYHNDSCQSSYSHSQPPQEAPSSSALASPQYNATTGGNASSPEAAFVGLDEFRSRMMQGKAENDTGPPTDGGVAHRLEPNGAEYNYAAAAKGAKVLAHNKEAKGAANILGGDKDKYLRNPCSAADKFVVVELSEETLVDTVALANLEHYSSNFREFEVYGSTSYPTEAWELLGRFTAENAKHAQRFVLPEPRWTRYLRLRLVSHYGSGFYCILSYLEVYGVDAVERMLQDFIAGAGAGAGAEADASRDRAPIDFANRDADCNDTTAQQDGNGGAGRNDSTAGDGKSNSSRSGDAKLPPQVAALASPTGRIHSDGVLKILMQKMRSLELSLSTLEEYTRELNQRYGAKLPDLQNGLSQTAVALEKMKADVHDLVDGKDSVAKDLDDLKAWKSTVSGKLDDLIKENQEMRQVPFPRGAARRGGSSDRQWSVEEMRGVQETLQNKELAVLSISLFFACLALFKLACDRVFCLFAGKGREEPDAEEHTRSSRAWMLVLASSSXTTLIGLLYN

SEQ ID NO: 24790 - protein, 907 aa, Gibberella fujikuroi
METPTTTITTLLHQEKIPENSEPISAHTHTHSLPPTPPGTAKPSRIGSFHDLRELSSIESPRLDHIKPYPLPPKCSPKSVLKEDLKTPDNFVERDPRLIRLTGVHPFNVEAPLSDLYDEGFLTSENLHYVRNHGHVPRCEDDDILDWEFETGGLVENPIKMNVRDLINAYQQLTYPVTFVCAGNRRKEQNIVRKTKGFSWGAAGLSTALWTGVAIGDLLSAGKPLRGARYVCFEGADKLPNGYYGTSIKLNWCMDPNRGVMVAHKMNGKTLHPDHGKPVRIVIPGQIGGRSIKWLKKITVTQEPSDNWYHIYDNRVLPTMISPEESANLPEVWKDEKYAIYDLSTNSAICYPAHEEKVSLTGAPASYKVRGYAYGGGGRRITRVEVTLDKGKSWRLANIRYPEDDYRNAPEGDTLYGGRVDMWWRETSFCWCFWDLDIPLDELKSADDIMMRAMDEAMNVQPRDMYWSVLGMMNNPWFRIVIHQEDDALRFEHPTHATLKIKGWMERVKEAGGNLTNGYWGEKAPGEVQEVVVKEPEKQICMTNPQINRKITIEELKAHSGEEEPWFVVKGEVYDGTPYLSGHPGGAASIFGAAGQDATEEFMAIHSENAKAMLPTYHIGTLDEESRAILSGDATKTSDDRNREVFLQVKTWSKAILDKKTSISGDTKIFSFKLNHEGQKIGLPTGQHLMMRLRDPATREAVIRSYTRYSDGSDCGRLDILIKIYYDTPQRKGGVMTQALDALPIGHWVDFKGPTGKFVYQGNGLCTINDRERRVRRFIMVCGGSGITPIRQVLRAIMHNPNDTTPCLVFNGNRSVDDILCKEELDQLEAANPARCRVVNALSNPPPKWNGLKGFVNQALVPEEMTLPKASGEGDELVLVCGPPPMVKAVEASFLGMGFKSDDFVFF

SEQ ID NO: 24791 - protein, 531 aa, Xylella fastidiosa
MFDESLKAQLKAYLDRVIRSIHIHASVDESHKSREMLDLLENIVLLSGKKVVLEVHRDDDQRKPSFGLSTPGESISIRFAGLPMGHEFASLVLGLLQVGGHPPKVADDLIERVRNLDGHYRFETYFSVSCQSCPDVVQALNMAAVLNPQIEHVAIDGALFQDEVEARQIMSVPTVYLNGELFGQGRMTLEQIVAKLDSGAAKRTAESIQDKAAFDVLVVGAGPAGAAAAVYAARKGVRTGLVAERFGGQVLDTMTIENFISVPETDGPRMAAALEQHVRQYEVDIMNLQRVETLVPAGENGFIEVRLASGASLSSRTVILSTGARWRQMNVPGEDEYRNKGIAYCPHCDGPLFKGKRVAVIGGGNSGVEAAIDLAGIASYVTLLEFDTKLRADEVLQRKLRSMSNVEVIMGAQTTEVRGDGKKVTGLVYVDRSTGGSFILALEGVFVQIGLLPNTEWLKGRVELSPRGEIVVDERGHTSLPGVFAAGDATTVPYKQIVIAMGEGSKAALSAFDYLIRNVVEITGIAQAQAA

SEQ ID NO: 24792 - protein, 1467 aa, Aspergillus nidulans
MSESELRQRKPAARLRDDPQPSQDAQPRLKHGIPMQVLRSLLLATWFNCCCVVILMTQLIGCPLYIINKHYYYAWMASTKRSFGLVITSLTEWGCPTYVRVSGDESIRGQVRIADDGRLKTTFPERLVMISNHQVYTDWIYLWWIAYSNMMHGHIFIILKESLKYIPIIGQGMTFYGFIFMARKWLSDKPRLQHRLEKLKTQHIGSDSGAPKYDPMWLLIFPEGTNLSINTKRRSDAYGAKNGFPPLKHQVLPRSTGLFFCLQQLRGTVEWVYDCTVGYEGPPKGSYADKYFTLRSTYVQGRPPTSVNMYWRRFAVSDIPLDDQQEFDAWLRARWTEKDELLDEYFETGRFPSALAGSIEVGHGDAQQLNAAEDGYAEAHVRLGHWTEVYDGMLLYLNNSPCLLSDRGTWKDLLLLSSTELLSPRLEGGVAGSRSLRTPAMTSLRNKYSNGIVNGDSLPVTGVLANSRFSDIPSAIDIPASTLDSEVEVSLEGLPDDPTELCTLLENERAAKNFWVIIALAYAKQKQIDHAIDILNKGLASVAQGATKEKLGLLGWVCWLYLLKSREAPRVVSDVGLGTEARTKDYYIQQATGILNEASRLNPSFPPLFLARGVLSLLRASLHPPRPVRPGAVDNSERVESLRQALKQFDESSKAFGGRNAMAILGRARAHYLLGRYAEALEGYQKVLMRMPGLTDPDPRIGIGCCLWQLGFKEQAKAAWERALALNPDSKVANILLAVYYLYDSSRHATTDPAFGSLYKVAMTQYTQKAFKLDKEYPMTCALFGSYFLLRKAYSTVDTLARKSIENTDVMQIASDGWYLLGRKCHYEGDLAKAAEFYHRSDQARGGGDKGYLPAKFGSVQMQVSNKDYDGAKFQLEKIIQQTKNPECMTLLAALYAEEVFAAQKSGMKEDKSAEAKKAITLFEAVRALWKDESKKITPDESVLVYLSRLYEQNAPDKSMQCLTQLEELQLAEISDEERPEGLEDEEMKAALRVNLPPQLLNNMGCFLYQSSQLNMARSMFQAALDSCARSQEREGELDTDALVTTISYNLGRAFEASDMPDEAKKVYEALLERHSDYTEASARLTYLALRRSPTDEGPKKMAKLYETDSTNLEVRALFGWYLSKSKKRAANIAEDHEQRHHKHTLQYFDKHDRYALTGMGNVHLLFARDMRRDTDQEKEKRRKMYERAVEFFDKALQLDPRNAYAAQGIAIALVDDRKDLSTAVQIFSKIRDSLRDASVYLNLGHVYAELRQYTRSIEHYEAALSKDRARDAQILACLGRVWLLKGKQEMSLAAMKTALDYAQRAHSVAPTQAHLEFNVAFVQNQIASLTYSLPETQRTAQDVQDAADGLRTAVETFGRIAQAKNPPYPAESLEQRANMSKTIIKQLERALQSQKEYEEKNAAKLQQAREAREAEIRRREEEVRKAEEAERERKQRIAEERQRLVEEAQRLALSGQKRNGPAKKRR

SEQ ID NO: 24793 - protein, 373 aa, Aspergillus oryzae
MKVRSSKSTPLPSSSSASPSPRPTGSGSFAKADGLQFSIDGETKYFAGTNAYWLPFQMNDADIDSVFDHLEQAGLKILRVWGFNDVNTAPSPGTVYFQLHDKEKGTSTINTGKDGLQRLDYVVAAAEKHGVKLIIPFVNSWDDYGGYNAYVKAYGGSKTEWFTNEKIQSVYQAYIKAVVSRYRDSPAIFAWELGNEPRCSGCSTDVIHGWATKISAYIKSLDPNHMVALGDEGMGLTIGSDQSYPYGTSEGNDFEKNLAIPDIDFGTLHLYTTDWGIKDNAWGNGWVENHAKACKAAGKPCLFEEYGMKGNHCTDELKWQKTSLSSGTAADLIWQYGQQLSTGESPKDAYSIFYGTDEWKCAVMDHMENVNKN

SEQ ID NO: 24794 - protein, 689 aa, Aspergillus nidulans
MATVVVQQPLRHTTPPPGTVAPALTLNRTSSPVPNKHIPVCPTGPSPVSSRTSSPAPKDDVVLPTSSPLHPPDAFPKISESPLLYSIEIEILVAAVDHCSSQPLPDPNLMFPWLHGLHPENHLQVGFFTNRRRSLRRTPKCWRGLTIVKVGGDLSTSRLKGAITPDAILAPSGLEFLATDPREGFSVRNFQIQTAKVAPLSDIVVYGEDGVTAKQLLEVASRIATAQHHWRLKHDHEQTLPSYNTFVVSCPFSDIERRAPNLVAVNSSGQLTNQVVDLCESTECCARIRSNKRLVQLERLEMCTMSRATEFAHNVWQGPTPDYLLQAGASGTPSADAFDLMIDANDLAGIPGPRYLANLAKRLAKEPQRMEFPSSGSLLTPSGESRDLDDLINTLRWIYYLANPEVVETDAEGDVSMDIPPRKTRRILIHCPDGYTESSLLVIAYTMFAEGISASEAWLRLHREKKRNFFAYPSDVAYLKNVQERILQESPANPPTYRVSDPQWFKYCDGSLPSRILPYMYLGNLSHANNPEMLWELGIRRVLSIGEAVTWSDSDIARMGAENLMHITKVQDNGIDPLTQEFDRCLEFIRKGKSDGAATLVHCRVGVSRSATICIAEVMASLNLSFPRAYCYVRARRLNVIIQPHLRFVYELLKWEELQQKKNKQPVKRELEWATVAREIALMNKPYSR

SEQ ID NO: 24795 - protein, 645 aa, Zea mays
  misc_feature (64)..(64): Xaa can be any naturally occurring amino acid
  misc_feature (117)..(117): Xaa can be any naturally occurring amino acid
  misc_feature (186)..(186): Xaa can be any naturally occurring amino acid
  misc_feature (261)..(261): Xaa can be any naturally occurring amino acid
MMGGGLLVDQSVVFPGVHNFVDLLQQNGDKNLGFGSLMPQTSSGDQCVMGEGDLVDPPPDSFPXDAGEDDSDDDVEDIEELERRMWRDRMKLKRLRELQQTRGKDSLASGAGLADGXSKPRQSQEQARRKKMSRAQDGILKYMLKMMEVCRAQGFVYGIIPEKGKPVSGASDNLRAWWKEKVRFDXRNGPAAIAKYQADNAVPGAENELASGAASPHSLQELQDTTLGSLLSALMQHCEPPQRRYPLEKGVPPPWWPTGDXEEWWPELGIPKDQGPPPYKKPHDLKKAWKVSVLTAVIKHMSPDIEKIRRLVRQSKCLQDKMTAKEISTWLAVVKQEEELYQKLNPGARPPASTGGIASAISFNTSSSEYDVDIIDECKGDEAGNQRTAVTDPTAFNLGAAILSDKFLVPTPMKEETADVEFIQKRNAPAAAEPELMLNNRLYTCNNVQCPRSDYSYGFLDRNARNSHQYTCKHKDPTPQSTENKPPSAPPQPQAFQPAFSQPNQALNSLDFSLPMDGQRSIAELMNMYDNNFVPNKNPSSDSVAVMERPNAMPQQRIQMDEGFFVQGNGAFDDVNNSMMQQQQQQAPVQQQQQFFIRDDTPFVSQMGDIAASAPEFRFGPGFNMSSGVDYPGAAQRNDGTNWFY

SEQ ID NO: 24796 - protein, 322 aa, Spirodela polyrrhiza
MAMGEEREPAPETVVVKANGRSAIRSLVATMLWVCPIALTAFLCLVALYCRSTASLWIIGFLLLLVFVPVSDKSKYGRAIGSFVGRYSPGYFHVNVHFEDVKAFDDSRSYVIAAEPHSIFPIGAVSLLNITGLMPLTKSKVLASTAIFCTPFLRQVTTWMGLVPATRKNFVNYLKAGYSCIVIPGGVQEIIYMNKDYEVAYLKKRHGFVRVAIETGSPLVPVFCFGQNEAFSWWKPGGRLYVRLSRAIRFAPLVFWGVLGSPIPYRSPIDVVVGKPMEVKQNPNPSAEEVAELHAQFLSNVETLFSKYRESTGNAGAELRIL

SEQ ID NO: 24797 - protein, 275 aa, Glycine max
IRLEGIGLIEKKLKNRIQWKGLDVSRPGEADDSFASLQAEVENLTMKERQLDEQIREMQERLRDLSEDENNDKLLFVTEEDIKNLPCFQNETLIAIKAPHGTTLEVPDPDEAVDYLQRRYRIVLRSTMGPIDLYLVSQFEEKFEEINGADVAPKLPSSPDVTKQQSTVVPEDRGKHIEVQGQAAPGPSSDFTPSQDFVSGIMKIVPSDVASEADYWLLSDADVSITDMWRTEPGVEWNELEPLQEDYCMTDENTTTPSHPSNVGEVSSASKPTGG

SEQ ID NO: 24798 - protein, 396 aa, Bradyrhizobium japonicum
MTITQRDRDLGTAYAMKPAQTRTELTSVVRGTPMGELLRRYWHPVGLIGDATDTPKKVRALGEDLVLFRDKHGRAGLLHARCCHRGTTLYYGKVEEDGIRCCYHGWKFDTEGHCLEQPCEPDGGQFKDKVRQPWYPVEERYGLIFAYMGPAEKRPVLPRYECLENMDDGEFVEADDSSIGGGGPAVIPCNWLQHFENVVDPYHVPVLHGSFSGPQFTDMMASMPEVKFDKTPRGIAVRSIRRQDDGKVFYRVTEAALPTLRVVPNPRVAQFARVESIGWTLPIDDTSFRIYVAGRVRTSGDIGRMRSKFNGKFWWDMTEAEHQQFPGDYEAQVGQGPLTVHSEEHFGQSDRGILMIRRMLSEQLEAMEADRDPIGVSFDVGAAPVEFEAGNYIRDA

SEQ ID NO: 24799 - protein, 340 aa, Streptococcus pyogenes
MKKQLRARLIYNPTSGQELMRKSVPEVLDILEGFGYETSAFQTTAQKNSALNEARRAAKAGFDLLIAAGGDGTINEVVNGIAPLKKRPKMAIIPTGTTNDFARALKVPRGNPSQAAKLIGKNQTIQMDIGRAKKDTYFINIAAAGSLTELTYSVPSQLKTMFGYLAYLAKGVELLPRVSNVPVKITHDKGVFEGQVSMIFAAITNSVGGFEMIAPDAKLDDGMFTLILIKTANLFEIVHLLRLILDGGKHITDRRVEYIKTSKIVIEPQCGKRMMINLDGEYGGDAPITLENLKNHITFFADTDLISDEALVLDQDELEIEEIVKKFAHEVEDLEQELEE

SEQ ID NO: 24800 - protein, 303 aa, Streptococcus pyogenes
MKTVRIFYNPNSGKKEDQLAGQVKDYFCQHGFSEDSVEIITPKDADQAFQLAKQAAKDKIDLVIPLGGDGTLNKIISGIYEGGAHCLIGLVPSGTVNNFAKAMHIPLQITEALDTILTGQIKQVDICKANQQYMISSLTLGLLADIAADVTAEEKRRFGPLAFLKDSIRILKRNRSYAISLISHNHRIHLKTKFLLITMTNTIAGFPSFSPGAQADDGYFQVYTMKKVSFFKFLWHINDFKQGDFSKAEEISHFQANTLSLLPQAKKQAILPRTRIDGDKSDYLPIQLDIIPKAISIIVPTED

SEQ ID NO: 24801 - protein, 1271 aa, Unknown
  Mycobacterium sp. MCS
MAVTRTACSYCGVGCGIEVHTGSEGGRPVIARVSGDRLHPTNSGRLCTKGATHAEMMNATDGRLTSALLRPTRHEEPVPAPVDDAVAEAGRRLRAIVDEHGADAVALYVSGQMSLESQYLATKLAKGFLRTKYLESNSRLCMASAATGYKQSLGADGPPGSYTDFDVTNLFFVIGSNMADCHPILHQRMVDRLKTGAKLIVVDPRRTATADRADLYLPIRPGTDVALLNGLLHLLVERGDIDEEFIAEHTEGWAHMPEFLADYAPARVAAITGLAEADLHRAAAMIAEAGDWVTCWAVGMNQSTHGTANTNAICNLHLATGAICRPGAGPMSLTGQPNAMGGREMGYMGPGLPGQRSILSAEDRAFVEQRWGLPPGTIRTDAGPGAVDMFERLAAGEIKACWIICTNPVATMPNRRTTIAGLEAAELVITQDVYRDTATNRYADIVLPATLWAESDQVMVNSDRTLTLLQQAVPPPGQTRPDWQLICRIAAELGFGADFAYTDSAQIFDEIREFSNRRTGFDLRGATYDRLRETPLQWPVPPDDGTDRHPIRYLNDGVSQDLHVDASGHRPRLAFPTPSRRAVFYARPHVDAAELPDGDFPFVLNTGRLPHQWHTMTKTGRVRALVKLDGRPFVEVHPHDAAALDIVDGQSVELTSRRGRAVLPAVVCDRVMPGNCFAPFHFNDEHGEYLTVNALTNDAVDPDSLQPEFKVCAVALRPVQTVAAPTEELRTPAPEPVASDGPLVLWASQTGTAEDFATDVAARLPGAQLVTMDELPLPRLAEARDVVVITSTFGDGGPPDNGADFFDRLQGPDAPKLDHIRFAVLGIGDRSYSDFCGHARSLDGRLASLGATRMLDRVDCEAYDQDRMEHWAQQMTHLLNPDGVDSDGGGVTTRRRTTTVAEPFTRARPLLAPLARNTLLTPAESRKEVRHFGFDISEYDVTYAAGDSLGVYATNSAVAVDAWLAATGLDGSEKVDVDGAEHSLRDALTVSYDFCRVTPDLMRFVAEQCRDRSAAKRLRAARADLDAWLVDRNGLDVVREFEVRADPRQWQEVLVRLTPRQFSISSSPLVSPHEVQLTVSVVRYRGSDGGERGGVASTFLADRATAPLPVFLQRSPHFRPPRDGVTPMIMVGPGTGIAPFRAFLQERRALGHTGPNWLFFGDRHRDENFYYRDDLEDMVTDGFLRLDLAFSRDQPKPVYVQHRMLEHGAEVWRWLERGAHLYVCGDAARMAKDVDAALTTIIRKHGGLSESAAREYKKSLVAGKRYLRDVY

SEQ ID NO: 24802 - protein, 819 aa, Unknown
  Mycobacterium sp. MCS
MTRRRLVVIGNGMAGVRAIEEILARGGADMFEITVFGDEPYGNYNRILLSNVLSGSDDTSEIYLNPLDWYTGNGIDLRAGVRVVRIDRYARLVHADDGTALHYDELIVATGSRSFFPPITGLWADDKTLADGVFGFRTLDDCLGMIHEAEHRTKAVVIGGGLLGLEAARGLQNRGLTVDVVHAGATLMNAQLDDTAGAILRRSVERLGITVHMDKRTTEALLGEDGKLRGIGFSDGSTVDCDMLVVAAGIRPNVGLAQRAGLTVERAIVVDDHMRSIDDDHIHVVGECAQHRGQVYGLVAPLWEQAGVLAAHLTGTDPTAAYHGSRTATKLKVAGVDVAAMGLKAPELPDDEFVQYSEPRHGVYKTIVIRDGKLVGATLLGDVSKVSFLTQAFDTGLPLPEERVSLMFDIGTPDVEVGVAELADDAQVCNCNGVSKGTLVGCVRDGEASVSGVMAKTKAGKGCGSCKELVGQIVEWAAGGAVTEDPSASWYVPGVPYDKPTLMRHIRELRLHSVSSVFAALAPDGREDAGSKMALASLLEMMWADEFVDERDARFINDRVHANIQRDGTFSVVPQMKGGVTNPWQLRRIADVADKYSIPMIKLTGGQRIDLLGVRKEDLPAVWADLDMPSGYAYGKSFRTVKTCVGSDFCRFGVGDSTALGIAIEDRYKGLASPAKMKLAVTGCPRNCAESLCKDLGVVAIDGGRWEIYVGGAAGAHIRKGDLLATVDSPDEVMTLTGRFLQYYRENANWLERTYAFVPRVGIEKIRDAIAEDAEGLDQRMQKSVDAYRDPWHDGRAPATEGQFRSSLPLLPLPQVPVR

SEQ ID NO: 24803 - protein, 382 aa, Bacillus anthracis
MVEKMNEEVMDSKELQVGDVVTGSVTKVEEKQVLVNVGYKTDGVIPISELANVHIEKASDVVELDQTLELKVIKLEENDLVLSKRAVDAEKAWVELQEKFNSGHVFDVTVKDIVNGGLVVDLGVRGFIPASLVEVHYVEDFTDYKGKTLAVKIVELDREKNRVILSHKAVVELELDSKKKEAISSLKEGDVVEGTVQRLTDFGAFVNVGGVDGLVHISQISHERVEQPSEVLEQGQKVKVKVLSVDADTQRISLSIKAAQPGPWENVGGEVKAGDIREGVVKRLVTFGAFVEILPGVEGLVHVSQIANRHVKNPNEVLEMGQEVKVKVLEVHVAEKRISLSIKEALEENNVTEDYSQYEPNADSATFQLSDIIGEQLKKLKK

SEQ ID NO: 24804 - protein, 490 aa, Corynebacterium efficiens
MRMIITMTNPDSLAQIGVVGLAVMGSNLARNFARNGHTVAVYNRSTDKTDKLISDYATDGNFIPTKTVEDFVAALEKPRRAIVMVQAGAATDAVINQLADAMEEGDIIIDGGNALYTDTVCREKEMAARGRHFVGAGISGGEEGALNGPSIMPGGPKESWEALGPLLESIAAKVDGVPCVTHIGPDGAGHFVKMVHNGIEYADMQVIGEAYQLLRFGAGMEPAEIADVFAEWNKGDLDSYLIEITAEVLRQVDAETGKPLVDVILDAAGQKGTGRWTVKEALDLGVPVTGIGEAVFARALSSSLDQRKAAQGNLPTGALTTFEELGLDKAEFVEDVRRALYASKLVAYSQGFDEIKAGSDEHNWGVDPRDLATIWRGGCIIRAKFLNRIVEAYDNDPELPSLLLDPYFKGELEDLMDSWRRIVIYVTQLGLPAPVFTSSLAYYDSLRAERLPAAIIQGQRDFFGAHTYHRIDKPGSFHTLWSGDRSELEV

SEQ ID NO: 24805 - protein, 391 aa, Arabidopsis thaliana
MAAPEAPVKYVGICKDSAAFKLMKSMGWEEGEGLGKDKQGIKGYVRVTNKQDTSGVGLDKPNPWAFDTTQFDNILKKLKVQAAPTKTSKNDDDSDKEDESEDDAVKSEPAKLKTVAKVTRPQGRYKRREKGKLVNSYSSKDLEGILVKRTEDPSPAVCDIADSMDIEIISEDQDASIKEQKIEEPSSNWWGFKSGFVSGGLLGAKSGKKKLKASERKMFSENDQENLYNMVQDKATAGKQGLGIKDRPKKIAGVRYEGKKTSFDNSDDDDDDDDDDDEEDEEEDEDESEADDDDKDSVIESSLPAKRKHDEIIEPKIKLKNLCKQIVKKDAGKGGFMKLKQLKSLIDEQAPSVLSEFSSRKDAIAYLKLKLERSGKFVVEGKKISLVSSKK

SEQ ID NO: 24806 - protein, 209 aa, Vibrio fischeri
MSKNKVSASSGRWLKEHFDDKYVLEAQKRGYRSRAIFKIEEIQNKDKLLKPGMTVVDLGAAPGGWSQYAVEQVGDEGQVIACDILPMDSIAGVSFLQGDFREEAVLDALLERIQPDMVDVVMSDMAPNMSGNLAVDQPRAMYLVELALDMCRQVLAPNGSFTVKVFQGEGFDQYLQEVRNMFKVVKIRKPDSSRARSREVYIVATGYKG

SEQ ID NO: 24807 - protein, 286 aa, Salmonella enterica
MAENTMWHETLHDQFGQYFAVDNVLYHEKTDHQDLIIFENAAFGRVMALDGVVQTTERDEFIYHEMMTHVPLLAHGHAKHVLIIGGGDGAMLREVTRHKNVETITMVEIDAGVVSFCRQYLPNHNAGSYDDPRFTLVIDDGVNFVNQTHQTFDVIISDCTDPIGPGESLFTSAFYEGCKRCLNPGGIFVAQNGVCFLQQDEAIDSHRKLSHYFSDVGFYQAAIPTYYGGIMTFAWATDNDALRHLSSEIIQARFHAAGLKCRYYNPAIHAAAFALPQYLHDALSAQ

SEQ ID NO: 24808 - protein, 615 aa, Cytophaga hutchinsonii
MCGITGFISIKWGSDELHSMTRRLQHRGPDAEGFYINESVHLGHRRLSILDLSVAANQPFFSKDKRYVMVFNGEVFNYKELAVKYAIPTDTTSDTEVILELFALQGPAAFQEFNGMFAIAIWDTYEKKLTLLRDRFGIKPVCYYDGPDGFGFASEIKSLLELPIPRLINSEALADYLFLEYIPKPNTIFQNIKKLTNGCYLEVTDGVRVAVKAFYDIREKYDPKPLKEKEGLEEFHHLLSDAVKSRMISDVPIGAFLSGGVDSSLVVSKFQENSTLPVETFTIGFDEKQYDESAYAKKVSELLKTNHHEYRLPAEDVFSVLKDAIEFYDEPFAVSSVLPSLLISKVSRQHTTVALTGDGADELFMGYNTYYWYNRIETLKRIGGKASLKLAGNIFKMFGGKPAIKSRLFEGWADKHPYINLWSQEQQMFTQQEIGKLLNYRYTHETTIPYWESLEKISLNNEQAVSFFDIQHYLADDLMYKMDIASMRHGLEVRCPFLDYNLVEFAVNLPLELKINNGTQKYILKKALEKYIPQSLIYRTKWGFSAPSEEWLKRSHTYLIDHYLDPARISAQGIFNAQEIQKLIASFRSGHYYHGKRLWSLVIFQLWYEQYMVAK

SEQ ID NO: 24809 - protein, 119 aa, Glycine max
  misc_feature (52)..(52): Xaa can be any naturally occurring amino acid
  misc_feature (104)..(104): Xaa can be any naturally occurring amino acid
MAVMAVHQFAQCITCHAWSPDQSMVALCPNNNEVHIYRLVEDKWEKLYVLQXENKFAVGSGAKTVCICYYEQENNWWVIKLIMKRHDSSVTSVSWHPDNILLAXTSTNWKCLIFITFIK

SEQ ID NO: 24810 - protein, 521 aa, Gibberella zeae
MEKFPDFVDTPLGESPSDSPSNTPGWANGAPPRPSDRWLPVSKHDSNWSTASRGHTRQKSLTDAIRTIRGRNGSVSQNAQEIADALRAPVSPKLIILCLMWYASSALTNTSSKSILIAFDKPATLTLVQFAFVSSLCIFMAWLATIFPVLRTKVAALKYPIRKPTRDVIRTTLPLAAFQIGGHLLSSTATSKIPVSLVHTIKGLSPLFTVLAYRFVYDIRYPKTTYLSLIPLTFGVMLACSGKTTYGGELIGVIHALLATVIFVTQNIFSKKLFNEAAKAEAESPHSMSKKLDKLNLLCYSSGMAFLLTLPIWLWSEGFTLLMNLYHEGSIDLNEQPNSMDHGRLTLEFIFNGVFHFGQNILAFILLSIVSPVTYSVASLIKRVFVIVLALVWFRSPTTPIQGVGIALTFLGLYLYDRTKSSNKADQKAQSMQVKRSSLLPTTNGGLRPTPITESPQSTDLNPYPYREGYFGRPTAAEDSKKSDDGGARSRTPATSNGWLPPGTKQEDTWQPGDRVAGVAR

SEQ ID NO: 24811 - protein, 316 aa, Geobacter sulfurreducens
MQATHHRLLILGSGPAGYTAAVYAARANLSPALITGLQQGGQLMTTTEVDNWPGDPDGVLGPDLMDRMRRHAERFNTAMIYDHIHTANLRERPFRLEGDSGIYTCDALIIATGASARYLGLPSEEAFKGKGVSACATCDGFFYRGKPVAVIGGGNTAVEEALYLSNIASHVTLVHRRDKLRAEKILADKLIEKTRGGNVTIEWNHVLDEVLGDQAGVTGVRIRHTSGSTKELDVHGCFIAIGHTPNTHLFEGQLEMDEGYIRTQCGAEGNFTATSIPGVFAAGDVQDQHYRQAITSAGTGCMAALDAERYLDMLKP

SEQ ID NO: 24812 - protein, 236 aa, Zea mays
MAGRVADKDPELKVLGVWSSPFVIRARVALNLKGLAYRYVEDNLDSKSELLLASNPVHGKVPVLLHDGRPVCESRVIVEYIDEAFPASGPCLLPADPYRRAVDRFWASYADDKLFPTWIPVYNGRTSEDRVAAARQVVAVLEKFEQAFDECSGSGGKAFFGGDAAGLVDVVLGGFLGWLRASEAMCGVRVIDPAKTPLLAAWADRFAALDGVREVIPDVQRLLEYNKIRRARRGLP

SEQ ID NO: 24813 - protein, 320 aa, Haloarcula marismortui
MYHQEILLGGMSDSDSFEQFSDVGEAEVTRAIGQEWTEEFMDFSDSDVIIVGGGPSGLMAAKELAERGVQVMVVEKNNYLGGGFWLGGFLMNKVTVRDPAQQVLDELEVDHKRSKDSEGLYVANGPEACSGLIKAACDAGAKMQNMTEFTDIVIREDHRVGGIVMNWTPVHALPREITCVDPIAVEADLVIDATGHDAMAVKKLDERGVLNAPGLEDEASGMDQTDDDTYGAPGHDSPGHDSMWVGESEDAVVEHTGLAHDGLVVTGMATATTYGLPRMGPTFGAMLVSGKRAAQVALDELEVDAEPVDVTSRDATPADD

SEQ ID NO: 24814 - protein, 726 aa, Shigella flexneri
MSTSDDIHNTTATGKCPFHQGGHDQSAGAGTTTRDWWPNQLRVDLLNQHSNRSNPLGEDFDYRKEFSKLDYYGLKKDLKALLTESQPWWPADWGSYAGLFIRMAWHGAGTYRSIDGRGGAGRGQQRFAPLNSWPDNVSLDKARRLLWPIKQKYGQKISWADLFILAGNVALENSGFRTFGFGAGREDVWEPDLDVNWGDEKAWLTHRHPEALAKAPLGATEMGLIYVNPEGPDHSGEPLSAAAAIRATFGNMGMNDEETVALIAGGHTLGKTHGAGPTSNVGPDPEAAPIEEQGLGWASTYGSGVGADAITSGLEVVWTQTPTQWSNYFFENLFKYEWVQTRSPAGAIQFEAVDAPEIIPDPFDPSKKRKPTMLVTDLTLRFDPEFEKISRRFLNDPQAFNEAFARAWFKLTHRDMGPKSRYIGPEVPKEDLIWQDPLPQPIYNPTEQDIIDLKFAIADSGLSVSELVSVAWASASTFRGGDKRGGANGARLALMPQRDWDVNAAAVRALPVLEKIQKESGKASLADIIVLAGVVGVEKAASAAGLSIHVPFAPGRVDARQDQTDIEMFELLEPIADGFRNYRARLDVSTTESLLIDKAQQLTLTAPEMTALVGGMRVLGAYFDGSKNGVFTDRVGVLSNDFFVNLLDMRYEWKATDESKELFEGRDRETGEVKYTASRADLVFGSNSVLRAVAEVYASSDAHEKFVKDFVAAWVKVMNLDRFDLL

SEQ ID NO: 24815 - protein, 220 aa, Debaryomyces hansenii
MARRPARCYRYCKNKPYPKSRYNRAVPDAKIRIYDLGRKKATVDEFPLCIHLVSNELEQLSSEALEAARICANKYVTKISGRDSFHLRIRVHPFHVLRINKMLSCAGADRLQQGMRGAWGKPHGLAARVNIGQILMSARTKDSNKDVVIEGLRRARYKFPGQQKIIISKKWGFTPLNRDEYLAKKNNGEVKDDGAYVKFLTKKGKLEQNLRQFPDYQYQV

SEQ ID NO: 24816 - protein, 572 aa, Saccharomyces cerevisiae
MCGIFAAFKHEDIHNFKPKALQLSKKIRHRGPDWSGNAVMNSTIFVHERLAIVGLDSGAQPITSADGEYMLGVNGEIYNHIQLREMCSDYKFQTFSDCEPIIPLYLEHDIDAPKYLDGMFAFCLYDSKKDRIVAARDPIGVVTLYMGRSSQSPETVYFASELKCLTDVCDSIISFPPGHVYDSETDKITRYFTPDWLDEKRIPSTPVDYHAIRHSLEKAVRKRLMAEVPYGVLLSGGLDSSLIAAIAARETEKANADANEDNNVDEKQLAGIDDQGHLHTSGWSRLHSFAIGLPNAPDLQAARKVAKFIGSIHHEHTFTLQEGLDALDDVIYHLETYDVTTIRASTPMFLLSRKIKAQGVKMVLSGEGSDEIFGGYLYFAQAPSAAEFHTESVQRVKNLHLADCLRANKSTMAWGLEARVPFLDKDFLQLCMNIDPNEKMIKPKEGRIEKYILRKAFDTTDEPDVKPYLPEEILWRQKEQFSDGVGYSWIDGLRDTAERAISDAMFANPKADWGDDIPTTKEAYWYRLKFDAWFPQKTAADTVMRWIPKADWGCAEDPSGRYAKIHEKHVSA

SEQ ID NO: 24817 - protein, 827 aa, Magnetospirillum magnetotacticum
MSLTRRDFIKANAVAATAAAAGLATPAIAQPAKANIRWDKGVCRFCGTGCSVLVGVQDGRVVATQGDPDSPVNRGLNCIKGYFLSKIMYGEDRLTRPLLRMKDGKFDKNGEFQPISWDQAFDIMAEKWKEQLKKPDGVTRVGMFGSGQWTIWEGYAASKLYKAGFRSNNLDPNARHCMASAVAGFMRTFGIDEPMGCYDDIEQTDAFVLWGSNMAEMHPILWSRVTDRRLTHEGCKVAVLSTFEHRSFELADIPMVFTPQTDLAILNYICHYIISKNAYNKEFIDKHVNFKKGATDIGYGLRPTHALEKDQANAATPDKADPMTFDEFKAFVAEYTVEKVSKLSGVPADKLEALAKLYADPKVKVVSFWTMGFNQHTRGTWVNNMIYNVHLLMGKISEPGNSPFSLTGQPSACGTAREVGTFAHRLPADMVVMNDKHREIAEGLWKLPAGTINPKIGYHAVLQHRMLKDGKLNAYWVMCTNNMQTAPNMNEEGYPGYRNPANFIVVSDPYPTVTALAADLILPTAMWMEKEGAYGNAERRTQFWRQQVKAPGEARSDLWQIMEFSKRFKIEEVWPEELIAKKPELRGKTLFEVLYKNGQVDKFPLTELQAGFENDEAKAFGFYPQKGLFEEYASFGRGHAHDLAPFESYHKARGLRWPVVDGKETLWRFREGYDPYVKAGEGVKFYGKPDGKAWIFALPYAPAAESPDKDFDLWLSTGRVLEHWHSGSMTRRVPELHKSVPNAVLYMHPNDAAKRNLRNGDVVKVASRRGEVTTRIDTRGRNKPPEGLVFMPFFDESQLVNKLTLDATCPISKETDYKKCAVKVSKA

SEQ ID NO: 24818 - protein, 186 aa, Antirrhinum majus
MSLDMTSECVCYVHCNFCNTILAVSVPCSNMFTIVTVRCGHCANLLSVNMGALLQSVHLQDFQKQQHAEAAAKDNGSSSKSNRYAPLQAEHEQPKMPPIRPPEKRQRVPSAYNRFIKEEIQRIKAGNPEISHREAFSTAAKNWAHFPHIHFGLKLDSNKQAKLQDHSVAGGSGTTMARAQKSLGFY

SEQ ID NO: 24819 - protein, 277 aa, Burkholderia thailandensis
MAGSEQGSHRKIRRVGDDFSGNRARLRRTAAPGEWPAPHFSRNAVRVAMRRGRRKARRRRDARTRHKPCAAAAGAGAARGPHDERNERKESDMSEATNEIATLGGGCFWCQEAVFLDVNGVTAVESGYAGGHTRNPGYRDVCDGETGHAEVVNVTFDPSRIGYREIVEIFFATHDPTQLNRQGNDVGTQYRSVIFTRSDAQRDVALDVIRALERDKLYDAPIVTQVEPLNDNYWPAEAYHQNYYARNPGQGYCAVVIGPKLAKFRQKFAHRLKSRGA

SEQ ID NO: 24820 - protein, 338 aa, Medicago truncatula
MDTKVLSSGIHYSKLPESYIRPESDRPCLSQVSEFENVPIIDLGSHNRTQIVQQIGEACSSYGFFQVVNHGVPLEELKKTAEVAYDFFKLPVEEKMKLYSDDPTKTMRLSTSFNVNKEEVHNWRDYLRLHCYPLDNYVPEWPSNPPSFKETVANYCKEVRELGLRIEEYISESLGLEKDYLRNALGEQGQHMAVNYYPPCPQPELTYGLPGHTDPNALTILLQDLHVAGLQVLKDGKWLAINPIPDAFVINIGDQLQALSNGLYKSVWHRAIVNAEKPRLSVASFLCPDNEALICPAKPLTEDGSGAVYRGFTYPEYYSKFWSRDLEKEHCLEFFKNN

SEQ ID NO: 24821 - protein, 299 aa, Enterococcus faecalis
MDIGFIGLGKMGLNMALNVHEQGWPIIGFDVTKEARATAREQGLSVVDSLSELLKALNKRKVIFLSTPAGQITNQLVAELVEQLAPEDIIVDSGNSNFHDSVANAQLAKEKGIYFIDCGTSGGIKGAREGACLMVGGAPEAVKVLTPFFEDLACEQGYLYAGKSGAGHYLKMVHNGIEYVMMQAMGEGFNLLEAAEYDFALEKVADVWNHGSIIEARLMGLAKEVFAENPTLANLEGKVAANGEAKWMIEEALRLEMPVPTTALSLFTRNESMLANHFSNKVVASLRQGFGGHEVVKSQ

SEQ ID NO: 24822 - protein, 332 aa, Medicago truncatula
MAKDPVRVLVTGAAGQIGYALVPMIARGVMLGPDQPVILHMLDIAPAAESLNGVKMELVDAAFPLLKGVVATTDVVEACTGVNIAVMVGGFPRKEGMERKDVMSKNVSIYKSQASALEKHAAANCKVLVVANPANTNALILKEFAPSIPERNISCLTRLDHNRALGQISERLNVQVSDVKNVIIWGNHSSTQYPDVNHATVNTPAGEKPVRELVSDDAWLNGEFISTVQQRGAAIIKARKLSSALSAASAACDHIRDWVLGTPQGTFVSMGVYSDGSYNVPSGLIYSFPVTCANGEWKIVQGLSIDEFSRKKLDLTAEELSEEKNLAYSCLS

SEQ ID NO: 24823 - protein, 202 aa, Pinus pinaster
MTTEYDYLFKLLLIGDSGVGKSCLLLRFADDSYVGSYISTIGVDFKIRTIELDGKAIKLQIWDTAGQERFRTITSSYYRGAHGIIIVYDVTDMDSFNNVKQWLSEIDKYASDNVSKLLVGNKCDLTEKQAVDQQMAKSFADELGIPFLETSAKDASNVEQAFLTMAGEVKRRMASQLTEGNRKANTVEMKGQPLQQKGGCCS

SEQ ID NO: 24824 - protein, 242 aa, Idiomarina baltica
MANVSMRDMLKAGVHFGHQTRFWNPKMKPFIFGARNKIHIINLEKTVPMFNDALSYMQHVASNKGKILFVGTKRAAAEPVKEAALNCGQYYVNHRWLGGMLTNWKTVRQSIKRLKDLETMSQDGTFDKLTKKEALVNTREMEKLEKGLGGIKNMGGLPDVLFVIDADHEHIAIKEANNLGIPVVSVVDTNSDPDGVDYVIPGNDDAIRAVQLYLNAAADAIKEAKSAPVEAKDADDFVEATE

SEQ ID NO: 24825 - protein, 434 aa, Unknown
  Bradyrhizobium sp. BTAi1
MTASSAKPASSVDSFFSATLAEADPEIAAAIKGELGRQRHEIELIASENIVSRAVLEAQGSVMTNKYAEGYPGARYYGGCEWVDVAENLAIDRAKKLFGANFANVQPNSGSQMNQAVFLALLQPGDTFMGLDLAAGGHLTHGSPVNMSGKWFKAAHYTVRRDDHLIDMDAVAKQAEEVKPKLIIAGGSAYSRPWDFKRFREIADHVGAYLLVDMAHFAGLVAGGAHASPVPHAHIVTTTTHKSLRGPRGGLILWNDEQFTKKLNSAIFPGLQGGPLMHVIAAKAVAFAEALRPEFKTYAKNIVENAKALAESLRAQGFDIVSGGTDNHLMLVDLRPKGLKGNVSEKALVRAGITCNKNGIPFDPEKPFVTSGLRLGTPAATTRGFGVAEFQQVGSLIAEVLNAIAQAPDGSAPLVEAAVKAKVKALTDRFPIYQ

SEQ ID NO: 24826 - protein, 126 aa, Chlamydomonas reinhardtii
MAMAMRSTFAARVGAKPAVRGARPASRMSCMAYKVTLKTPSGDKTIECPADTYILDAAEEAGLDLPYSCRAGACSSCAGKVAAGTVDQSDQSFLDDAQMGNGFVLTCVAYPTSDCTIQTHQEEALY

SEQ ID NO: 24827 - protein, 811 aa, Alkalilimnicola ehrlichei
MQRERLVLVGNGMAGVKTLEELLAVAPERYEITVFGAEPHGNYNRIMLSPLLSGEKTVDDIMLNRPEWYAENGITLHTGCPVTEINRRHREVISGDGRRTPYDRLLLATGSNPFIIPVPGNDLPGVLAYRDIGDVEAMLEASRQHRHAVVIGGGLLGLEAAWGLHQQGMAVTVVHLAPHLMERQLDALAGGMLEQSLRERGVEFRLEAQTQALLGDDRVEAVRFADGEEIPADLVVMAAGIRPNIHLAKAAGILCERGIVVNDTMQTFDPRIYAVGECVQHRGQCYGLVAPLFEQAKVCANHLAEAGFAAYEGSVTSTKLKVTGVDLFSAGDFSEAEGTEAIVYQDPAGGIYKKLVLQEDRIRGAVLYGDTSDGAWYFQLLKDGTSVSDFRDSLLFGQAHLGDAGHGGQSHAEAMPMDAQVCDCNGVCKGDIVNAIQEQGLFSLEEVQSHTKASASCGSCTGLVEQILQSTVGGGYAEPRVKPLCACTDHSHDQVRKAIREQHLTCLQQVFDTLEWKTPDGCDKCRPALNYYLISTWPEEAQDDEMARLVNERMHANIQKDGTYSVVPRMWGGTTTPAELRKIAEVAERYDVPTVKVTGGQRIDLLGVKKEDLPGMWGELAEAGFVSGHAYGKALRTVKTCVGSEWCRFGVQDSTSLGIALERMCWGAWTPHKVKLAVSGCPRNCAEASIKDLGVVAIESGWEILVGGNGGVKVRACDTLCRVETAEEVMEYAAAYLQLYRETGRYLERTAPWIERVGLSWVREQVVDDDVNRKRLAERFERAQSIYRKDPWATLARQGQRDRFQPLRQVG

SEQ ID NO: 24828 - protein, 168 aa, Clostridium thermocellum
MVKKTLCFVLTLAMLTAFILPQGIVSAAGSYNYAEALQKAIYFYECQQAGPLPEWNRVEWRGDATMNDEVLGGWYDAGDHVKFNLPMAYSAAMLGWALYEYGDDIEASGQRLHLERNLAFALDYLVACDRGDSVVYQIGDGAADHKWWGSAEVIEKEMTRPYFVGKDP

SEQ ID NO: 24829 - protein, 206 aa, Zea mays
MEAGGAGSGLNGAVQAKGTGADGGSAKPLPPCCVKARAAAPESEARCHATVVSGWFTEPRSRCGKASKVQYYNNPMWPGEANSLKVEKILYQGKSLYQEVLVFESSTYGKVLVLDGIVQLTDKDECAYQEMITHLPLCSIPSPKKVLVIGGGDGGVLREVSRHSSVESIDICEIDQLVIDVCKDFFPHLSVGFQDPRVQLHVGDGM

SEQ ID NO: 24830 - protein, 904 aa, Alkalilimnicola ehrlichei
MNTSIQPPRQPGEVHTTCPYCGVGCGVLARMDKDNRVHVRGDPEHPANFGRLCSKGAALGETTGLNGRLLHPRVHGQRTDWDTALATVADGLNRVIRRDGPEAVGFYVSGQLLTEDYYVANKLMKGYIGSANIDTNSRLCMASSVAGHIRAFGEDLVPGCYEDLERADLVVLTGSNLAWCHPVLYQRLEAARARRPGMRVVVIDPRETETAAQADLHLPLRPGSDVALWNGLFRRLVETDQIHRDIRPETEAADSNLKRILHEAGDADAVASACDLNPRALHLFYDWFAGTERTVSVYSQGVNQSSQGTDKVNAIINVHILTGRLGRPGCGPFSVTGQPNAMGGREVGGLSNQLAAHMGFSQGDRIRVQRYWDSPRIARQPGMKAVELFRAAAQGRVKALWIMATNPVVSLPDADLVKRALARCELVVVSDCIANTDTTGYAHVLMPAAAWGEKSGTVTNSERCISRQRAFRTPAGEARPDWWIISQVARLMGFDRGFAYGSPREIFDEHARLTAVHNPGPGMGGRTLHLGALAGMNAKQWDTLQPVQWPCPGPGLDTAGPGRGTQRLATNGGLPTEDGHPRLHPVCAETPGNTPDARFPLVLNTGRTRDHWHTLTRTGLSVSLSTHQPEPRCDLHPEDATRFGLADGHLVRVRSAWGSVLLRARYQTGQRRGELFVPMHWNDCYAAQARIGAVANPITDPISGQPELKHTPVAVEAVPAAAYGFVLSRADDLPPPETAYWVRINGHAHQRFVFASTEAPDSWRDWAGRWLGTEGTVVEMADRARGVYRFARLVDDRLVACLFIAADPAALPGCDWLAGLLDNNRPLGAEERLALLAGRPAGEAETGETVCACFGVGERIIESAVAAGAHDTEAVTRHCKAGGYCGSCRPAINAIIQRLARSAA

SEQ ID NO: 24831 - protein, 178 aa, Salmonella enterica
MKHTVEVMIPEAEIKARIAELGRQITERYKDSGSEMVLVGLLRGSFMFMADLCREVQIPHEVDFMTASSYGSGMSTTRDVKILKDLDEDIRGKDVLIVEDIIDSGNTLSKVREILGLREPKSLAICTLLDKPSRREVDVPVEFVGFSIPDEFVVGYGIDYAQRYRHLPYVGKVVLLDE

SEQ ID NO: 24832 - protein, 346 aa, Burkholderia vietnamiensis
MTAYRSTQTVRRALSRTPRPPFTDSHMSTPKHAKVLILGSGPAGYTAAVYAARANLSPVLITGIAQGGQLMTTTDVENWPADAKGVQGPELMARFQEHAERFNTEIVFDHIHTAKLHEKPIRLIGDAGEYTCDALIIATGASAQYLGLPSEEAFMGKGVSACATCDGFFYRNQEVAVIGGGNTAVEEALYLTGIAKKVTVIHRRDKFRAEPILIDRLLEKEKEGVVDIKWDHVLDEVTGEESGVTGLRIKNVKTGATQDLTVQGVFVAIGHKPNTDLFQGQLEMKDGYILTKSGLQGNATSTSVPGVFAAGDVQDNVYRQAITSAGTGCMAALDAQRYLETLHDKK

SEQ ID NO: 24833 - protein, 379 aa, Legionella pneumophila
MEQRDYYELLEVSRNASDAEIKKAYRRLAMKYHPDRNPGDTSAEEKFKEIQKAYNILSDKQKRAAYDQFGHAGVDPSMGGGPGGFGGFGGFGDVFEDIFENIFSGGRGHGRQSRGQRGADLQFNVQLTLEEAAIGKEVEITVPRHGTCTVCEGSGAKKGTSPKTCETCQGMGQVRIQQGFFSIQQTCPTCHGEGKIISDPCASCHGQGRVRESKKINVKIPAGVDNGDRVRLSGEGEAGVHGGGSGDLYVQISLKKHAIFERHENDLHCEVPISFATAALGGSIEVPTLEGRVTLKIPAETQTGKVFRLRSKGMKSVRGYGQGDLLCKVVVETPVNLSREQKELLNKLQDSLENAKGTHSPKTSSWFAGVKKFFEDMKF

SEQ ID NO: 24834 - protein, 297 aa, Alkalilimnicola ehrlichei
MKELPVYLNRTGRDVLVDGGDATGLGEVYLVGAGPGDPELLTLRAVRLLQQADVVVHDRLVSRAVLDLVSEDVERIFVGKQGFRDGHRQRRINDIMIEKARQGMRVARLKGGDPFVFGRGGEELEALANAGIRFQVVPGVTAATGCAAYAGIPLTHREHAQSVRFITAHTRRGRLDLGRQRLDVAGETLVLYMGLTHVDQLCSELQRLGQPETRPVAVVVQGTTGHQRVIEGTLATLPSRVAETTVGSPGLLIVGEVVRLRRRLAWFEGTGTGNAPFPTLVQALTGTPAGNKRVEVA

SEQ ID NO: 24835 - protein, 709 aa, Vibrio fischeri
MFANPVVKSFQYGNHTVTLETGVIARQATAAVMASMDDTSVFVSVVAKKEAVPGQDFFPLTVNYQERTYAAGKIPGGFFKREGRPSEAETLTARLIDRPIRPLFPDAFKNEVQVIATVVSINPEVNPDMITMIGTSAALAIAGIPFNGPIGAARVGHINGELVLNPSNTELENSKLDLVVSGTEGAVLMVESEADNLTEEEMLSAVVFGHEQQQVVINAINEFAAEVATPAWDWVAPEENTVLNARIAELAEAKLVEAYQITEKMTRYDRIHEIAAEVNEVLVSENEDVNLKEVHTIFHDLEKTVVRRSIIAGNPRIDGREKDMVRALDVRTGVLPRTHGSSLFTRGETQALVTATLGTQRDAQIIDSLMGEKKDHFLLHYNFPPYCVGETGFVGSPKRREIGHGKLAKRGIQAVMPSIEEFPYTVRVVSEITESNGSSSMASVCGTSLALMDAGVPIKASVAGIAMGLVKEGDDFVVLSDILGDEDHLGDMDFKVAGTNEGITALQMDIKIEGITKEIMQIALNQAQGARKHILKVMDEAISGAREEISEFAPRIHTMKISSDKIKDVIGKGGAVIRALCEETGTTIEIEDDGTIKIAATEGAAAKEAIRRIEEITAEVEVGKIYTGKVMRIVDFGAFVTVLGPKEGLVHISQIAEERIEKVADHLQVGQEVKTKVLEIDRQGRIRLSIKEANAELNPAPAAEAKDAE

SEQ ID NO: 24836 - protein, 436 aa, Geobacter metallireducens
MNYVIIGNSVAAVGAIRGIRSIDQQGNITVISRERHVAYGRPLISYLLGGLITEKRMAYLPEDFYEKNRVNLLLNAEVVGVDTDNRKVTIAGGDVIVYDKLLVATGGDPFVPPIEGMAGKDRIFTFTTWDDAAKLKGIADDIEKVVVIGGGLIGLKAAEGLHLIDKKITIVELADRILSAAFDRPAGRVVAKKMKANGIDVITEDTVVRIEGDGAAITGVTLKSGDFIPCDTVVVAIGVRPAAGFLKGSGVEVNRGIVVDDLMETNVKGVFAAGDVAEAKDFFSGVKNPMPIWPDAYIQGDIAGVTMAGGSKGYQGGIAMNSIELFKVSTISMGITNPVEPKEYEILTYQDLENYQYRKIVLKDGILAGAVLVGAVDRAGIFAGLIRDRIEVSSFKDHLLTPDFGFVNLPREIRSTLFAPVGKVTGAYEQARAVGH

SEQ ID NO: 24837 - protein, 610 aa, Pseudomonas aeruginosa
MCGITGWTDWSRDLGEQRSILERMTRTLAPRGPDAEGLWLSRHALLGHRRLAIIDLENGAQPMLAEAGGRVALTYSGEVYNFRELRAELETLGQVFRTRSDTEVVLRAYLQWGEASFARLRGIYGFALWDEREQSLWLVRDRFGVKPLYYYPTAGGVLFASEPKAIFANPEANPVLDASGIAELFALTTAPTPGHGLYKGLRQVRPGQALRFDRNGVRELVYWALRAERHEEGAEDSAERAGQLLREAVAEQLVADVPLGSLLSGGLDSSAISAFAVAALDGDARRLPTFSVDFPGEGRGFVPTPWQSSWDEPYAQLAANFLGTPHRTVLVAPEEVLEQDEAVLQARDLPGWGELDASLYLLFRQVREHTTVALSGESADEVFGGYPFFHDPSALAHDGFPWLAGKSGPWQLLRREVAERVAAPEYIRARYREALAEVPRLDGEDAAQRRQREVAYLALSRWLPAMLERKDRMSMAVGLEVRVPFCDHRLVEYVWNLPWALKSVAGESKSLLRRALRGHLPQAILERRKSGFPANPDPRYLALLRERVGRLLADGRSPLFELVDAGRVRQALEQGTPLPSPRASASPTAGLAYLLNLDRWLTRHGVDISL

SEQ ID NO: 24838 - protein, 110 aa, Unknown
  Magnetococcus sp. MC-1
MSEHVTSTTDSQFETDVLQAETPVLVDFWAEWCGPCKQVAPFLDQLAQDKVGSLKVVKLNIDENPNVPGRFGVRGIPTLMIFKGGQIQASKIGAMPKSKLYEWVDEALAG

SEQ ID NO: 24839 - protein, 232 aa, Aspergillus nidulans
MPQETPPPIQQETDKHDLSDDDDALFKALEEEDNTGYRAHRLEQLSAEFATAQKSSSQKTTLVEDSLYPTLKGDQVLLDYTTQTQRCVIHFAHPEFVRCATMDNHIRALAARHQDVRFARVDVRETPFVVEKLKIRILPCVIGFLDGVAVERVLGFEGLGPGGTAGLEGFNTASLEKRLLGKGILSQARFSADDEEESDRDSDEDNDARQGRRGIRTGITRAYKDDDDSDWD

SEQ ID NO: 24840 - protein, 122 aa, Triticum aestivum
MVGFFRSGNLASRVFDRQFLSPRPGATVNTVRQFYENLVPSYTIYDIDCPDYSFRKFTDDERFESFFKQLYSISLASSNEYICEDFFLYMECHQYGLFATSTARSNESSVTEGAIYGVPSIE

SEQ ID NO: 24841 - protein, 175 aa, Unknown
  uncultured archaeon GZfos26F9
MGKKPARKYTKVTGHAYVRRTYMGGVPGSKIALFDMGNLSMGMDFPVALSLVAKEACQIRHNALEAARIFANRYLVKEVGRNNFYLKIRPYPHHVLRENKIASGAGADRVSSGMRHAFGKAVSSAARVKPGQRILSVGVEAQNFDDAKEALRRASYKLPTPCRFIIDKGEELLGV

SEQ ID NO: 24842 - protein, 447 aa, Escherichia coli
MDQTYSLESFLNHVQKRDPNQTEFAQAVREVMTTLWPFLEQNPKYRQMSLLERLVEPERVIQFRVVWVDDRNQVQVNRAWRVQFSSAIGPYKGGMRFHPSVNLSILKFLGFEQTFKNALTTLPMGGGKGGSDFDPKGKSEGEVMRFCQALMTELYRHLGADTDVPAGDIGVGGREVGFMAGMMKKLSNNTACVFTGKGLSFGGSLIRPEATGYGLVYFTEAMLKRHGMGFEGMRVSVSGSGNVAQYAIEKAMEFGARVITASDSSGTVVDESGFTKEKLARLIEIKASRDGRVADYAKEFGLVYLEGQQPWSVPVDIALPCATQNELDVDAAHQLIANGVKAVAEGANMPTTIEATELFQQAGVLFAPGKAANAGGVATSGLEMAQNAARLGWKAEKVDARLHHIMLDIHHACVEHGGEGEQTNYVQGANIAGFVKVADAMLSQGVI

SEQ ID NO: 24843 - protein, 193 aa, Unknown
  uncultured archaeon GZfos17F1
MRKATINRKTNETEIDLMFVIEGTGRSEIGTGVAFLDHILDSFARHGLFDLTIRATGDTELGDHHLVEDVGIVLGQAISKALGDHAGIARFADVRVPMDEASASVILDLSGRSYLVFDVGFSSDVVGDLTTQMVPHFFHSLITGAGINAHISASGRNDHHIIEAIFKAFGIALRRSATVERSDVPSTKGVLTG

SEQ ID NO: 24844 - protein, 346 aa, Xylella fastidiosa
MIDSKQKIAVLGAGSWGTALAALVARHDYPTILWGRDVRVIQSIDIQHQNFRYLPSIMLPQTLRATTDLAAAVSGADWILVAVPSYAFTETLCRLAPLLSIGVGVAWATKGFEPGSGRFLHEVAREILGGDVPLAVVTGPSFAKEVTLGLPTAVTVHGEDVCFTQMVANAMHGPMFRAYTGNDVIGAELGGAMKNVLAVAIGVADGMQLGMNARAGLITRGLNEMLRLSAVIGARPETLMGLAGLGDLVLTCTGDLSRNRRLGFALGRGQSLSDAIREIGQVVESVQTSDEVMRQAEQNGVELPISEAVRAVLREEITPYAGMKALLAREQKPEYLDILFKANCSL

SEQ ID NO: 24845 - protein, 177 aa, Thermococcus kodakarensis
MRRTTKETDIEVELDVEGTVETGDPVLNHLLMALFHYMGRNARVKANYDLRHHLWEDVGITLGLELREKLPGKFARFGSAVMPMDDALILVALDISGRPYLNLELFPLEEEEGFSVTLVREFLWGLARSLRATIHVKQLGGVNAHHIIEAAFKGLGIALAQAIAESERLESTKGVLE

SEQ ID NO: 24846 - protein, 252 aa, Pasteurella multocida
MEAKPQLKGNIIMAQVSMRDMLQAGVHFGHQTRYWNPKMKPFIYGPRNGVHIINLEKTVPMFNEALVELTRIAGNNGKILFVGTKRAATEAVKAAALDCQQYYVNHRWLGGMLTNWKTVRQSIRRLKDLETQSQDGTFDKLTKKEALMRTREMEKLELSLGGIKEMGGLPDALFVIGADHEHIAVKEANNLGIPVFAIVDTNSDPDGVDFVIPGNDDAARAIQLYLSAAAAAVKEGRHQDAVTEENFVAEAE

SEQ ID NO: 24847 - protein, 249 aa, Listeria innocua
MPVISMKQLLEAGVHFGHQTRRWNPKMKKYIFTERNGIYIIDLQKTVKKVDEAFNFMREVASDNGTILFVGTKKQAQESVRDEAIRSGQYFVNHRWLGGTLTNFETIQKRIQHLKKIEKMEADGTFEVLPKKEVVLLKKEQEKLERFLGGIKDMKGLPDALFIVDPRKERIAVAEARKLHIPIIGIVDTNCDPDEIDYVIPANDDAIRAVKLLTAKMADAIIEVNQGEELTEAEVAPVEEKAAEETTEA

SEQ ID NO: 24848 - protein, 181 aa, Zea mays
  misc_feature (153)..(153): Xaa can be any naturally occurring amino acid
MAGDGTDAAFEDEVEPTVTISEYMDGIEAEELEADLVLGGDDGNECTYGAGYLKRQAVFSCLTCVPDGVAGVCTACCLACHDGHEVVELWTKRNFRCDCGNSKFGGHLCKLSPEKDPENPANSYNQNFKGSYCTCRRPYPDPEAKEQVGMIQXCCICEDWFHEDHIGLDSLEKITRDEEGG

SEQ ID NO: 24849 - protein, 265 aa, Arabidopsis thaliana
MATTNSLHHHHHSSPSYTHHRNNLHCQSHFGPTSLSLKQPTSAATFSLICSASSTSSSTTAVSAVSTTNASATTAETATIFDVLENHFVNQNFRQADEETRRLLIQISGEAAVKRGYVFFSEVKTISPEDLQAIDNLWIKHSDGRFGYSVQRKIWLKVKKDFTRFFVKVEWMKLLDTEVVQYNYRAFPDEFKWELNDETPLGHLPLTNALRGTQLLKCVLSHPAFATADDNSGETEDELNRGVAVAKEQAGVGADKRVFKTNYSF

SEQ ID NO: 24850 - protein, 396 aa, Triticum aestivum
MGKSGKKTKESHRQGRGRRGSQLGDDDLPSSAYDAPPRRQEDSDGDDSDEATAEGEHDGGAEEGDLQGQWQVGSMPSKFHLYQLSVQSPKGDISYLQKFFLMYVGGRVPLHLQEDFCGTALLSTEWLRTDTRRTAVGLDFDRESLEWCLENNLSKIGADGYSRLLLFNGNVLQPNESRLVKQKISDLVQGLNFTSDDDSTEMNSCEQSDSSFTKCAANSTMSDAVLPGRDIICAFNYSCCCLHKRKDLVLYFRHAFNALSKRGGIFVMDVYGGTSSECKLRLQRRFPSFTYFWEQEEFDIITRETRISLHFQVGKKQMIRHAFTYHWRLWSIPEIKDCLEEAGFKSIHVWVREMPDTKSSGNAKEYTADRDVKYEELQHFNQADAWNAYVVGVANI

SEQ ID NO: 24851 - protein, 503 aa, Hordeum vulgare
MDLRVAAPASVAAAARRGALGCARVRPLQGRRQCRPSVRVSVATTESAAAAAAVSASADEDAETTNPRTVVAVILGGGAGTRLFPLTKRRAKPAVPIGGAYRLIDVPMSNCINSGINKVYVLTQFNSASLNRHLFRAYNFSNGVGFGDGFVEVLAATQRPGSEGKRWFQGTADAVRQFAWLFDDAKSKDIEDVLILSGDHLYRMDYMDFVQSHRQRDAGISICCLPIDDSRASDFGLMKIDDTGRVISFSEKPKGADLKAMQVDTTLLGLPKEEAEKKPYIASMGVYIFKKEILLNLLRWRFPTANDFGSEIIPAAAREINVKAYLFNDYWEDIGTIKSFFEANLALAEQPSKFSFYDASKPMYTSRRNLPPSMISGSKITDSIISHGCFLDKCRVEHSVVGIRSRIGSNVHLKDTVMLGADFYETDAERGDQLAEGKVPIGIGENTSIQNCIIDKNARIGKNVTIANTEGVQESDRTSEGFHIRSGITVVLKNSVIADGLVI

SEQ ID NO: 24852 - protein, 112 aa, Bradyrhizobium japonicum
MKKIEAIIKPFKLDEVKEALQEVGLQGITVTEAKGFGRQKGHAELYRGAEYIVDFLPKVKIEIVIGDDLVERAIDAIRRAAQTGRIGDGKIFVSNIEEAIRIRTGESGLDAI

SEQ ID NO: 24853 - protein, 283 aa, Arabidopsis thaliana
MAEASDLLEWPKKDNRRFLHVVYRVGDLDRTIEFYTEVFGMKLLWKRDIPEEKYSNAFLGFGPETSNFVVELTYNYGVSSYDIGTGFGHFAISTQDVSKLVENVRAKGGNVTREPGPVKGGGSVIAFVKDPDGYTFELIQRGPTPEPFCQVMLRVGDLDRAIKFYEKALGMRLLRKIERPEYKYTIGMMGYAEEYESIVLELTYNYDVTEYTKGNAYAQIAIGTDDVYKSGEVIKIVNQELGGKITREAGPLPGLGTKIVSFLDPDGWKTVLVDNKDFLKELE

SEQ ID NO: 24854 - protein, 199 aa, Gibberella zeae
MIGDSGVGKSNLLSRFTRNEFNLDSKSTIGVEFATRSIQVDSKTIKAQIWDTAGQERYRAITSAYYRGAVGALLVYDISKHQTYENVTRWLKELRDHADANIVIMLVGNKSDLRHLRAVPTEEAKSFASENHLSFIETSALDASNVELAFQNILTEIYRIVSSKALDSGDSAQATIGAGTNISLSKPADDDAAKGGKCC

SEQ ID NO: 24855 - protein, 509 aa, Unknown
  Candidatus Kuenenia stuttgartiensis
MEKTTKTKTRMLINAIEPEECRIAILENNILEELYIERSSREQIAGNIYKGRVVNIEPNLEAAFVDIGLKKNGFLHASDVLVPSEGKNQGEEADPPPVRHHRIRDVLQQGKEILVQVTKESLGTKGPSLTTYISLPGRYLVLMPEVKRYGVSKKITEEEERQRLKKILESLNPPKNIGFIVRTAGVQQTKRELQKDFHYLLKLWKNICKKSKEIDAPGVIYQESDLVIRVIRDIFSQDINEIIVDSESVFKRTREFLRIIMPKYEKQLKFYNKEKPLFHNFGIENAIEEINSRKIPLLHGGSIVLEQTEALVAIDVNSGKYKGKCDPEETAFRTNMIAAKEIARQIRLRDLGGVIVIDFIDMRNEKHIQAVEKAIADSLKRHRARTKMLKMSKFGTIEITRQRIRPSLRDVLFEECKFCCGTGYAKTVESLCLNIMRDVKFALHLPQVVRIEITSNNDVVDYLQNQKRKQMAEIEDAYNKKIVIFTDTANEYGKIDIRYFDNKGEPVTV

SEQ ID NO: 24856 - protein, 431 aa, Cytophaga hutchinsonii
MITAPIRTTARDTQIFDLISKEAHRQEEGIELIASENFTSKQVMEAMGSVLTNKYAEGLPGKRYYGGCQVVDQVEQIAIDRLKKLFGAEWANVQPHSGAQANAAIMIACLNPGDSILGFDLSHGGHLSHGSPVNMSGKYFKAHFYGVEKESGLINMDIVEATALKVKPKMIICGASAYSRDWDYARFRKIADSVGAILLADISHPAGLIAKGLLNDPIPHCHIVSTTTHKTLRGPRGGVIMMGKDFENPFGLKTPKGETRMMSNVLDMGVFPGTQGGPLEHVIAAKAVAFQEALSTDYLQYAKQIQKNAQIMAEAFLKKGYDIISGGTDNHLMLIDLRSKNLTGKEAENALIRADITINKNMVPFDDKSPFVTSGMRVGTAAITSRGMVGDDMIRIVEMIDTVLMNQTKDSVIETVRKDVNNWMAQYPLYI

SEQ ID NO: 24857 - protein, 491 aa, Pseudomonas aeruginosa
MHNESRPEAPLRVLVVGAGFAGLGLAIRLRQAGIDDYLVLEKAADVGGCWRENRYPGAACDVPSHLYSFSFEPKADWSRKFAPQAEILDYLRHCADKYRLRGKIRFHCEVEEARFDAGSGEWQVRCADGQTLRARALVCATGQLSRPLLPRLPGLERFQGPAFHSANWDAEVELAGKRVAVIGTGASAIQFVPRIAPQVQRLSLFQRSAPYVIAKPDRAYADWERRLKARWPWLQRLDRGLKYLHHESRMLAFATFPALMKVMRLSFHRHLHRQIADPQLRARLVPDYPLGCKRILISNDYYPALARSNVELVDTGIREVTEDAVVGRDGRRHEVDAIIFGTGFAATEFLAPMRILGLDGRDLRQAWADGAEAYKGISVSGFPNLFILYGPNTNLGHNSIVYMLESQFPYVLGCLRQLQAQGLRYLDVKPEVQRRFNLEVQQGLRHTVWERGCDSWYKTAAGKNTNNWPGYTFVYRWRTRRPELADYDLAR

SEQ ID NO: 24858 - protein, 252 aa, Rhizobium leguminosarum
MRLLQGCARIWAIAGGSAMSPSSHRRSLVVLLAFTLLSLGTGAAGAAEDAVVIPPPAVDEAAGSGTETAIFAGGCFWGVQGVFQHVKGVESAVSGYAGGDAKTAQYETVSTGSTGHAEAVQVKFDPKQITYGKLLQIFFSVAHNPTQLNFQGPDRGTQYRSALFVADPEQRKVAENYISQLDKAHVFPQPIVTKVSETTGFYPAEAYHQDFLTLNPTYPYIVYNDLPKIENLKSLFPADYRGKPVLVMKVKG

SEQ ID NO: 24859 - protein, 508 aa, Burkholderia thailandensis
MRPRRCCARRTSPSEPPYRTMNEEILINITPQETRVALVQQGAVQELHVERTLSRGRVGNIYLGKVVRVLPGMQSAFIDIGLERAAFLHVADIWQPRAGDAPAAAAHHPIEKIVFEGQTLMVQVIKDPIGTKGARLSTQISIAGRTLVYLPQEPHIGISQKIESEAEREAVRARLTAVIPADEKGGYIVRTIAEDATSDELAADVAYLRKTWATIVAQGQRVPPTSLLYQDLDLAQRVLRDFANDDTTRIQVDSRETHQRLVDFAAEFTPAVSPKLHHYTGERPLFDLYNIEAEIQRALSRRVDLKSGGYLMIDQTEAMTTIDVNTGGYVGARNFDDTIFKTNLEAAHTIARQLRLRNLGGIIIIDFIDMENAEHRDAVLAELKKALSRDRTRVTVNTFSQLGLVEMTRKRTRESLAHVLCEPCPTCQGKGQVKTSRTVCYDILREILRESRQFNPREFRVIASQQVIDLFLDEESQHLAMLIDFIGKPVSLQVESNLSQEQYDIVLM

SEQ ID NO: 24860 - protein, 326 aa, Saccharomyces cerevisiae
MSATSTATSTSASQLHLNSTPVTHCLSDIVKKEDWSDFKFAPIRESTVSRAMTSRYFKDLDKFAVSDVIIVGAGSSGLSAAYVIAKNRPDLKVCIIESSVAPGGGSWLGGQLFSAMVMRKPAHLFLQELEIPYEDEGDYVVVKHAALFISTVLSKVLQLPNVKLFNATCVEDLVTRPPTEKGEVTVAGVVTNWTLVTQAHGTQCCMDPNVIELAGYKNDGTRDLSQKHGVILSTTGHDGPFGAFCAKRIVDIDQNQKLGGMKGLDMNHAEHDVVIHSGAYAGVDNMYFAGMEVAELDGLNRMGPTFGAMALSGVHAAEQILKHFAA

SEQ ID NO: 24861 - protein, 259 aa, Bacillus licheniformis
MKLTISCLQFDIAYGNPSENFKKAEQLIEQESRKADILLLPELWTTGYDLKNLGSIADEEGRQTKRWLQETAKANRIHIVCGSVAVKKKSGVYNIMYIADKNGHLIKEYSKAHLFQLMDEHLYLSAGSGDGRFELEGMPAAGFICYDIRFPEWIRKHTSEGAGIIFVSAEWPLARLDHWQSLLKARAIENQCFVAACNRSGKDPANEFAGHSTVIDPLGRTLAEAGRGEAVIRAEIDLRDIEKARGQIPVFEDIRKDLY

SEQ ID NO: 24862 - protein, 104 aa, Guillardia theta
MTVGKGKVGKGLGKRGTKRHKKVLRDSIQGITKPAIRRLARRGGVKRISGLIYEETKIVLKLFLENVVKDAVTYTEHARRKTVTAMDVIYALKRQGRTIYGFGY

SEQ ID NO: 24863 - protein, 621 aa, Listeria innocua
MCGFVGCVHDRITEITGADKETFRQMNSMITHRGPDDEGYFTDDHVQFGFRRLSIIDVENGHQPLTYENERYWIIFNGEVYNYVELREQLVAEGMTFETESDTEVIIATYAKYKEKTAERLRGMFGFVIWDKQEELVYGARDPFGIKPFFYAEEDGKLFMGSEKKSILHALKEKELDEVSLQNYMTYQFVPEPDSLTKNVKRLEPGHQFTKKIGQPMEITTYWKASFAPVTKSEDAWIKEVRDVMYDSVKMHMRSDVPVGSFLSGGIDSSIIAAIAKEYHPAIKTFSVGFERDGFSEIDVAKETADKLGVENISYVISPEEYMKELPKIVWHMDDPLADPAAIPLYFLSREARKQVTVALSGEGADELFGGYNIYNEPNSLAMFNKMPGVFKSMLNSVARIMPEGMRGKSFLERGTTPMEERYIGNAKMFTEKEKQILLPKYQSGHDYTNITDPFYAETKNYHPVERMQYIDIHTWLRGDILLKADRMTMANSLEVRVPFLDKEVYNVARNIPDTMKTTNGTTKYILRKAAATFVPEHVLNRRKLGFPVPIRHWLKDEMNAWVKNIIKESPTDHLINKQYVLGLLDDHCAGKFDYSRKIWTVVIFMIWYDVYVADKYDFGK

SEQ ID NO: 24864 - protein, 615 aa, Oryza sativa
MAASSFSTSFSSSSSHEGDAGSSYIECFKYSRRATLRSVVGRPDGGAGLVGERAVVGGWVRSSAVVRARRAAAGPASPSRKPEVEATGLTCTEVLMSRVPLIRCIARLMAGGITAAASAGGSARRPAVGTALVRINDGSCVADLQIVVDSALLPLDQITATGACVLVEGKIEQVEGTLPQYVVQMKVEKILHIGPVDSEKYPRSNAHSSPDLVRGYPHLAARTATVASTARVRSELVHAVHAFFQSNGFFHVNTPTITTTTATSAGNRGKMLRLTRLFSKSDNGNRITPEAVRAAIKEKTKQVEALKRSESNKEALEAAEQDLQRANALSRQLEQGASAESSQDEFFHRPAYLTPCHTLHLETYACALSSVYTFSPVFQAESESLDSDRSLAERWTVDVELAFAELEDAISCAEDCVKSLCSTVSKDCSDELKFLSSNQAGDATSSVIEAAVSSPWQKIKYTEAVNTLLQVTDKTFESKLELGMPLSRVHLSYLADDLYKKPVIIYDYPKQLKPFYARLKEDLKTVSAFDLVVPKVGIVACGAQKEERMDNLTSRIEESGLQVEQLEWYLDTRRHGTVKHSGFSIDLESLILFVTGLKDVRDAIPFHRTKGHAKC

SEQ ID NO: 24865 - protein, 405 aa, Medicago truncatula
WLKHNSLSYPQIAKLILMSRGKLESIRNRVEWLKSVLVKGEFIGDAMLKSGDNVLLRSDGELDEIVDYLEFNGVRREWMGYVVSRCPKLLSYSLEEVKTRVQFYLDMGLDAKDFGTMVFDFPKALGHYTLEEMNRKVDYLKEFGLESKDVGKLLAFRPQLMACSIEEQWKPLVKYLYYYGITRDGMRRMLTIKPMVFCVDLEMTIVPKVKFFQDLGVRNDGIAKMLVKFPTLLTYSLYKKIRPVVIFLMTKAGVTEENIPKVIALGPELLGCSIVHKLEGNVKYYLSLGIRLQQLGEMIADFPMLLRYNIDVLRPKYTYLRKTMVRTLKDAIEFPRFFSYSLEGRIIPRHKVLVENQINVKLKCMLACTDEEFNNMVKNMIRKRHKLQSTVMKEDTKHPQSTAQT

SEQ ID NO: 24866 - protein, 244 aa, Zea mays
  misc_feature (211)..(211): Xaa can be any naturally occurring amino acid
  misc_feature (220)..(220): Xaa can be any naturally occurring amino acid
  misc_feature (223)..(223): Xaa can be any naturally occurring amino acid
METLLAGNPANGVAKPTCNGVGALPVANSHAIIATPAAAAATLAPAGATLGRHLARRLVQIGASDVFAVPGDFNLTLLDYLIAEPGLTLVGCCNELNAIAGAYSENLPVVCIVGGPNSNDYGTNRILHHTIGLPDFSQELRCFQTITCYQAIINNLDDAHEQIDTAIATALRESKPVYISVSCNLAGLSHPTFSRDPVPMFISPRLSNKAXLEYAVEAAXDFXSQGVKPVMGGGPKIGGQSPGA

SEQ ID NO: 24867 - protein, 240 aa, Triticum aestivum
MTVVDAETRFHVLAVDDSVIDRKLIEMLLRTSSYQVTTVDSGSKALEVLGLRDEGDDSSSSSSPPSSSAPDHHQEVGVNLIITDYCMPGMTGYDLLRRVKGSSSLKDIPVVIMSSENVPARISRCLEDGAEEFFLKPVKLADMKKLKSHLVRRKQPQLQPQTHEKPQPQPQQQQQKPQPEQQLKAEQAPAEPAAEEEAVTAGGITGDCGGGSRKRKAAMMEQDGASTSLSSGSSGLAVET

SEQ ID NO: 24868 - protein, 523 aa, Hordeum vulgare
MARGGGNGEVELSVGVGGGGGGAAAGAAEPAVQISLGRLILAGMVAGGVQYGWALQLSLLTPYVQTLGLSHALTSFMWLCGPIAGLVVQPCVGLYSDKCTSRWGRRRPFILTGCVLICLAVIIVGFSADIGAALGDSKEECSLYHGPRWHAAIVYVLGFWLLDFSNNTVQGPARALMADLSAQHGPSAANSIFCSWMALGNILGYSSGSTNNWHKWFPFLRTRACCEACANLKGAFLVAVLFLSLALVITLIFAKEVPYKAIAPLPTKANGQVEVEPTGPLAVFKGFKNLPPGMPSVLLVTGLTWLSWFPFILYDTDWMGREIYHGDPKGTPAEANAFQEGVRAGAFGLLLNSVVLGFSSFLIEPMCKRLGPRVVWVSSNMLVCLSMAAICIISWWATQDLHGYIQHAITASKEIKAVSLALFAFLGIPLAILYSVPFAVTAQLAANKGGGQGLCTGVLNIAIVIPQVIIAVGAGPWDELFGKGNIPAFGMASVFALIGGVVGIFLLPKISRRQFRAVSGGGH

SEQ ID NO: 24869 - protein, 409 aa, Mycobacterium smegmatis
MTAASTFVIIGGGLAGAKAAEALRDNDFDGQVLLFAAEEKLPYERPPLSKDYLAGKKTLDEFTVAAPAWYRDHDVTLRLGTEVAAINPADHTVTLPDGSAVGYDKLLLATGSASRRLPIPGADASGVHYLRTVDDAAALDAVLTEGASLAVVGAGWIGLEVAASARTRGVNVTVVEAARLPLLGALGAEVAEVFAQLHREHGVDLRLEQTVEEITTADGRATGLRLGDGSTIAADAVLVAVGAAPNIGLAERAGLATADGGVLVDASLRTSDPDIYAVGDIAAAQHPLFGVRIRTEHWANALKQPAVAVAGMLGRPAEYAELPYFFTDQYDLGMEYAGHAPSYERVVFRGDVPGREFVSFWLDGDNRVLAGMNVNIWDVLDDVKALIRSREPVDPDLLADPGRPLNAPG

SEQ ID NO: 24870 - protein, 99 aa, Unknown
  Nostoc sp. PCC 7120
MASYQVRLINKKQDIDTTIEIDEETTILDGAEENGIELPFSCHSGSCSSCVGKVVEGEVDQSDQIFLDDEQMGKGFALLCVTYPRSNCTIKTHQEPYLA

SEQ ID NO: 24871 - protein, 720 aa, Unknown
  Mycobacterium sp. KMS
MVTPGSGPTSPTLHTVWPGEAYPLGATYDGAGTNFSLFSEVAERVELCLIAKDGSEERINLDEVDGYVWHAYLPTVTPGQRYGFRVHGPWDPSAGHRCDPSKLLLDPYGKSFYGDFRFGQALYSYDLDAEDLASGGDPPRIDSRGHTMTSVVINPFFQWGSDRAPRTPYHDTVIYEAHVKGMTRRHPAVPAELRGTYAGLCHPAIIDHLKSLNVTAIELMPVHQFMHDHRLLDLGLRNYWGYNTFGFFAPHNEYAANQHAGGAVAEFKAMVRSFHAAGIEVILDVVYNHTAEGNHLGPTVNFRGIDNAAYYRLLDGDLRLYKDFTGTGNSLNARHPHTLQLIMDSLRYWVLEMHVDGFRFDLASTLAREFYDVDRLSAFFDLVQQDPVVSQVKLIAEPWDIGEGGYQVGNFPGLWTEWNGQYRDTVRDYWRGEPATLGEFASRLTGSSDLYEATGRRPSASINFVTCHDGFTMHDLVSYNEKHNEANGEDNRDGESHNRSWNCGVEGPTDDPDVIALRGKQMRNMLATLMCSQGTPMIAHGDEIGRTQQGNNNVYCQDSELSWMDWSLCETNADLLEFTRKVVAFRKNHPVFRRRRFFEGKPIRSADQVRDIAWLTPAGTEMTPEDWGTGLGKCVAVFLNGEAIPAPNARGERVVDDSFLLCFNAHDHVQDFVTPDGDYAEMWTADLDTADPTGHTDVVVPAGEKISLQPRSLLVLRKTA

SEQ ID NO: 24872 - protein, 350 aa, Arabidopsis thaliana
MVRIIPMAASSIRPSLACFSDSPRFPISLLSRNLSRTLHVPQSQLFGLTSHKLLRRSVNCLGVAESGKAAQSTTQDDLLTWVKNDKRRMLHVVYRVGDMDRTIKFYTECLGMKLLRKRDIPEEKYTNAFLGYGPEDSHFVIELTYNYGVDKYDIGAGFGHFGIAVDDVAKTVELVKAKGGKVSREPGPVKGGKTVIAFIEDPDGYKFELLERGPTPEPLCQVMLRVGDLDRAIKFYEKAFGMELLRTRDNPEYKYTIAMMGYGPEDKFPVLELTYNYGVTEYDKGNAYAQISIGTDDVYKTAEAIKLFGGKITREPGPLPGISTKITACLDPDGWKSVFVDNIDFLKELE

SEQ ID NO: 24873 - protein, 317 aa, Shewanella oneidensis
MSQVRHSNLLILGSGPAGYTAAVYAARANLKPVMITGMQQGGQLTTTTEVENWPGDAEDLTGPALMERMQKHAEKFDTEILFDHINEVTLTERPFRLKGDNGEYTCDALIIATGASARYLGLESEEAFKGRGVSACATCDGFFYRNQKVAVIGGGNTAVEEALYLSNIAAEVHLIHRRDTFRSEKILIDRLMDKVANGNIILHLNQTMDEVVGDAMGVTGLKMKSTKDGAITDLAVAGVFVAIGHSPNTGIFEGQLEMNNGYLKVQSGLQGNATQTSIEGVFAAGDVMDQHYRQAITSAGTGCMAALDAERYLDAKK

SEQ ID NO: 24874 - protein, 830 aa, Oryza sativa
MDSSTVGAPGSSLHGVTGREPAFAFSTEVGGEDAAAASKFDLPVDSEHKAKTIRLLSFANPHMRTFHLSWISFFSCFVSTFAAAPLVPIIRDNLNLTKADIGNAGVASVSGSIFSRLAMGAICDMLGPRYGCAFLIMLAAPTVFCMSLIDSAAGSSALVNGLAAGWGNMGGGATQLIMPLVYDVIRKCGATPFTAWRLAYFVPGTLHVVMGVLVLTLGQDLPDGNLRSLQKKGDVNRDSFSRVLWYAVTNYRTWIFVLLYGYSMGVELTTDNVIAEYFYDRFDLDLRVAGIIAASFGMANIVARPTGGLLSDLGARYFGRRPPLEHLDPPDRRRRAACGAIFGVIPFVSRRSLGIISGMTGAGGNFGAGLTQLLFFTSSRYSTGTGLEYMGIMIMACTLPVVLVHFPQWGSMFLPPNAGAEEEHYYGSEWSEQEKSKGLHGSPWAPSATCSARATAAPSSSCSPRPPSSACRSSTSAAGYIAVRFLIGFSLATFVSCQYWMSTMFNSKIIGLVNGLAAGWGNMGGGATQLIMPLVYDVIRKCGATPFTAWRLAYFVPGTLHVVMGVLVLTLGQDLPDGNLRSLQKKGDVNRDSFSRVLWYAVTNYRTWIFVLLYGYSMGVELTTDNVIAEYFYDRFDLDLRVAGIIAASFGMANIVARPTGGLLSDLGARYFGMRARLWNIWILQTAGGAFCLLLGRASTLPTSVVCMVLFSFCAQAACGAIFGVIPFVSRRSLGIISGMTGAGGQLRRRAQAAALLHVVEWGSMFLPPNAGAEEEHYYGSEWSEQEKSKGLHGASLKFAENSRSERGRRNVINAAAAAATPPNNSPEHA

SEQ ID NO: 24875 - protein, 750 aa, Chlamydomonas reinhardtii
MAGVPAPASQLTKVLAGLRHTFVVADATLPDCPLVYASEGFYAMTGYGPDEVLGHNCRFLQGEGTDPKEVQKIRDAIKKGEACSVRLLNYRKDGTPFWNLLTVTPIKTPDGRVSKFVGVQVDVTSKTEGKALADNSGVPLLVKYDHRLRDNVARTIVDDVTIAVEKAEGVEPGQASAVAAAAPLGAKGPRGTAPKSFPRVALDLATTVERIQQNFCISDPTLPDCPIVFASDAFLELTGYSREEVLGRNCRFLQGAGTDRGTVDQIRAAIKEGSELTVRILNYTKAGKAFWNMFTLAPMRDQDGHARFFVGVQVDVTAQSTSPDKAPVWNKTPEEEVAKAKMGAEAASLISSALQGMAAPTTANPWAAISGVIMRRKPHKADDKAYQALLQLQERDGKMKLMHFRRVKQLGAGDVGLVDLVQLQGSELKFAMKTLDKFEMQERNKVARVLTESAILAAVDHPFLATLYCTIQTDTHLHFVMEYCEGGELYGLLNSQPKKRLKEEHVRFYASEVLTALQYLHLLGYVYRDLKPENILLHHTGHVLLTDFDLSYSKGSTTPRIEKIGGAGAAGGSAPKSPKKSSSKSGGSSSGSALQLENYLLLAEPSARANSFVGTEEYLAPEVINAAGHGPAAVDWWSLGILIFELLYGTTPFRGARRDETFENIIKSPLKFPSKPAVSEECRDLIEKLLVKDVGARLGSRTGANEIKSHPWFKGINWALLRHQQPPYVPRRASKAAGGSSTGGAAFDNY

SEQ ID NO: 24876 - protein, 224 aa, Magnetospirillum magnetotacticum
MNSIFDAIFGSSGKTTMIAPEDALPGRQSPVLQAPRPHTVLGTSITGPWPEGTRVLYLAMGCFWGAEEIFWQVPGVVSTAVGYMGGTTPNPTYEEACTARTGHTETALVAYDPTKVSEEELLKIFWERHDPTQGYRQGNDVGTQYRSAVYWTTPEQGQAVRETAARYSAVLEAKGYDPVTTEMRPAAEAGPFYYAEDYHQQYLDKNPNGYRCHATTGVPFPSAA

SEQ ID NO: 24877 - protein, 203 aa, Poa pratensis
MNPEYDYLFKLLLIGDSGVGKSCLLLRFADDSYLESYISTIGVDFKIRTVEQDGKTMKLQIWDTAGQERFRTITSSYYRGAHGIIIVYDVTDQDSFNNVKQWLNEIDRYASDNVNKLLVGNKCDLTDKKVVSYETAKAFADEIGIPFMETSAKNALNVEQAFMAMSASIKDRMASQPAANNARPATVQIRGQPVEQKTSCCSS

SEQ ID NO: 24878 - protein, 575 aa, Rhodobacter capsulatus
MRILFVHPNYHSGGAEIAGNWPPSWVPYLAGHLKKAGFDDIHFIDAMTLNVSHDELRKKFAELQPDLIGVTSITPSIYEAEETLKIAKEVVPNAVRVLGGVHATFMFRQVLSEAPWVDAIVRGEGEEIMVELAKCVSEGRWPEDRASIKGLAFHDGTEIVATQAAPTVKDIDSLKPDWSLIDWKHYIYIPLGVRVAIPNMARGCPFTCSFCSQWKFWRDYRVRSPKAVVDEIEDLVNNYDVGFFILADEEPTINKKKFVEFCQEMIDRGLNHKVKWGINTRVTDIYRDRDLLKFYREAGLVHISLGTEAAAQLKLDLFNKETTVAENKEAIRLLREADIFTEAQFIVGLDNETKETLEETFQMAWDWQPDLANWSMYTPWPFTPLFQELRDQVEVFDFSKYNFVTPIMKPKALTRGELLDGVMKNYRRFYMRKALFHYPWRGTGFRRRYLLGCLKAFLKAGVGRTFYDLGKAGYWGPQTKDTVDFHFDETRKIAEAQVADWEAAADRSRKHKERQEALRAQMKDRAADRNTANFVMPADAEDEFDLSAETHEARSAEHAAMACGGGKDQMVDAAE

SEQ ID NO: 24879 - protein, 203 aa, Poa pratensis
MNPEYDYLFKLLLIGDSGVGKSCLLLRFADDSYLESYISTIGVDFKIRTVEQDGKTMKLQIWDTAGQERFRTITSSYYRGAHGIIIVYDVTDQDSFNNVKQWLNEIDRYASDNVNKLLVGNKCDLTDKKVVSYETAKAFADEIGIPFMETSLKNALNVGQAFMAMSASIKDRMASQPAANNARPATVQIRGQPVEQKGSCCSS

SEQ ID NO: 24880 - protein, 749 aa, Chlamydomonas reinhardtii
MAGVPAPASQLTKVLAGLRHTFVVADATLPDCPLVYASEGFYAMTGYGPDEVLGHNCRFLQGEGTDPKEVQKIRDAIKKGEACSVRLLNYRKDGTPFWNLLTVTPIKTPDGRVSKFVGVQVDVTSKTEGKALADNSGVPLLVKYDHRLRDNVARTIVDDVTIAVEKAEGVEPGQASAVAAAAPLGAKGPRGTAPKSFPRVALDLATTVERIQQNFCISDPTLPDCPIVFASDAFLELTGYSREEVLGRNCRFLQGAGTDRGTVDQIRAAIKEGSELTVRILNYTKAGKAFWNMFTLAPMRDQDGHARFFVGVQVDVTAQSTSPDKAPVWNKTPEEEVAKAKMGAEAASLISSALQGMAAPTTANPWAAISGVIMRRKPHKADDKAYQALLQLQERDGKMKLMHFRRVKQLGAGDVGLVDLVQLQGSELKFAMKTLDKFEMQERNKVARVLTESAILAAVDHPFLATLYCTIQTDTHLHFVMEYCDGGELYGLLNSQPKKRLKEEHVRFYASEVLTALQYLHLLGYVYRDLKPENILLHHTGHVLLTDFDLSYSKGSTTPRIEKIGGAGAAGGSAPKSPKKSSSKSGGSSSGSALQLENYLLLAEPSARANSFVGTEEYLAPEVINAAGHGPAVDWWSLGILIFELLYGTTPFRGARRDETFENIIKSPLKFPSKPAVSEECRDLIEKLLVKDVGARLGSRTGANEIKSHPWFKGINWALLRHQQPPYVPRRASKAAGGSSTGGAAFDNY

SEQ ID NO: 24881 - protein, 246 aa, Pinus sylvestris
MATAVGCSPAVAPVAFAGAFSSAKSRFFSPTSSLVGRRHGSRVSMSAEWMPGQPRPPHLDGSAPGDFGFDPLRLGVIPENLERYKESELIHCRWAMLAVPGMLIPEALGLGNWVEAQKWAAIPGSQATYFGVPVPWGYLPIVLAVEFLAIAFVESQRNGEPDPEKRKYPGGAFDPLGFSKDPVKFKEYKVKEIKNGRLALLAFVGFCVQASANPGTGPLENLATHLSDPWHRNIAEIIIPRSLFPE

SEQ ID NO: 24882 - protein, 482 aa, Debaryomyces hansenii
MVHLGPKPPQHRKGTFTDVPEDLMKELNELEELLTVSPDTLKKITEHFIGELEKGLSKQGGNIPMIPGWVLDFPTGKEKGDYLAIDLGGTNLRVVLVKLGGNRDFDTTQSKFALPETMRTATSDELWTFIAECLKKFVQEEFPQGCTKPLPLGFTFSYPASQKSINTGVLQRWTKGWDIDGVEGHDVVPMLQKAIEKVGVPINVVALINDTTGTLVASMYTDAETRMGLIYGTGCNGAYYDVVSDIPKLEGKMPSDVDQSAPMAINCEYGAFDNELVVLPRTKYDILIDKQSPRPGQQSYEKMISGYYLGEVLRLILLDLAKEKKLIFKGQDLSKLETEFILDTSFPSRIEEDPFENLSDTAELFQKELGIQTTSPERKIIRRLAELIGERSARLFVCGIAAICKKRGYKTAHCAADGSVYNKYPGVKERTAKALRDIFEWETKEDLITIVHAEDGSGVGAAVIAALTEKRLEQGLSVGIQD

SEQ ID NO: 24883 - protein, 684 aa, Pasteurella multocida
MASMDDTTVFVTVVAKKDVKEGQDFFPLTVNYQERTYAAGRIPGGFFKREGRPSEGETLIARLIDRPIRPLFPEGFYNEIQIVATVVSVNPQICPDLVAMIGASAALSLSGVPFNGPIGAARVGFIDDQFVLNPTMNEQKQSRLDLVVAGTDKAVLMVESEADVLTEEQMLAAVVFGHQQQQVVIDAIKEFTAEAGKPRWDWVAPEPNTALIEKVKAIAEARLGEAYRITEKQARYEQIDAIKADVIAQITAEVAEGEDISEGKIVDIFTALESQIVRSRIIAGEPRIDGRTVDTVRALDICTGVLPRTHGSAIFTRGETQALAVATLGTERDAQIIDELTGERSDHFLFHYNFPPYSVGETGMIGSPKRREIGHGRLAKRGVAAVMPTLAEFPYVVRVVSEITESNGSSSMASVCGASLALMDAGVPIKAAVAGIAMGLVKEDEKFVVLSDILGDEDHLGDMDFKVAGTRTGVTALQMDIKIEGITAEIMQIALNQAKSARLHILGVMEQAIPAPRADISDFAPRIYTMKIDPKKIKDVIGKGGATIRALTEETGTSIDIDDDGTVKIAAVDGNSAKEVMARIEDITAEVEAGAVYKGKVTRLADFGAFVSIVGNKEGLVHISQIAEERVEKVSDYLAVGQEVTVKVVEIDRQGRIRLTMKEVAPKQEHVDSVVADVAAEENA

SEQ ID NO: 24884 - protein, 387 aa, Oryza sativa
MALQVQAALLPSALSVPKKGNLSAVVKEPGFLSVSQKAKKPSLVVRAVATPAAPVASPGAGTSKADGKKTLRQGVVVITGASSGLGLAAAKALAETGKWHVVMACRDFLKAATAAKAAGMAAGSYTVMHLDLASLDSVRQFVDNFRRSGMPLDALVCNAAIYRPTARQPTFTADGYEMSVGVNHLGHFLLARLMLDDLKKSDYPSRRLIILGSITGNTNTLAGNVPPKAGLGDLRGLAGGLRGQNGSAMIDGAESFDGAKAYKDSKICNMLTMQEFHRRFHEETGITFASLYPGCIATTGLFREHIPLFRLLFPPFQRFVTKGFVSEAESGKRLAQVVGDPSLTKSGVYWSWNKDSASFENQLSQEASDPEKARKLWDLSEKLVGLV

SEQ ID NO: 24885 - protein, 549 aa, Lactobacillus sakei
MKWWQKATVYQIYPRSFQDSNGDGIGDINGIIQRLDYLQDLGIELIWLTPMYVSPGRDNGYDIADYYQIDPIFGDLADFERLLKEAHQRGIKIMMDMVVNHTSDQHRWFQESLKGKDNPYHDYYLWRDPVDGHEPNNWLSKFSGSAWEYVPALNQYYLHLYEKRMPDLNWRNPQLREEIYQMMQFWADLGIDGLRLDVINNISKDKDFPNDTFETPSDDGRNFYTNGPHVHEYIHEMYERVFGPNNFVTVGELSSTPVSEAIRYTNPEREELSMAFTFHHVKVDYTGGKKWTLGQYRLSDLKRILSQWQTEMAAGGGWNALFWSNHDQPRAISRFLDDGQYRDQSAKLLALVEFGLQGTPYIYQGEEIAMKNANFTSIDQYQDAESINAYHQMLADGISEDLAIKILQQKSRENCRIPMQWDMTANHGFTTGMPWLQPVVADDYSVATKAQAPDSVFAFYQQLVALRKTEPVLIEGQYQLLAPEDEAVYTYQRQLGDKKVRVIANFTDQTQQRANAAVKAVMMSNYPDQQLTTDQITLRPYEAVMLEIE

SEQ ID NO: 24886 - protein, 443 aa, Mycobacterium avium
MTAAPDARPTASDTASLMSAPLADIDPDIAGLLGQELGRQRDTLEMIASENFVPRAVLQAQGSVLTNKYAEGLPGRRYYGGCEYVDVVENIARDRAKALFGADFANVQPHSGAQANAAVLHALMTPGERLLGLDLANGGHLTHGMKLNFSGKLYDVGFYGVDPTTHLIDMDAVRAKALEFRPKVIIAGWSAYPRVLDFAAFASIADEVGAKLWVDMAHFAGLVAAGLHPSPVPHADVVSTTVHKTLGGPRSGLILGKQEYAKSINSAVFPGQQGGPLMHVIAAKAVALKIAGTEEFADRQRRTLSGARILAERLSGADVAAAGVSVVSGGTDVHLVLVDLRNSELDGQAAEDLLHEIGITVNRNAVPNDPRPPMVTSGLRVGTPALATRGFGDAEFSEVADVIATALAGGRGADLAALRDRVTRLARDFPLYEGLEDWALVGR

SEQ ID NO: 24887 - protein, 112 aa, Pasteurella multocida
MKKIEAIIKPFKLDDVRESLSDVGITGMTVTEVRGFGRQKGHTELYRGAEYMVDFLPKVKMEIVVTDEQVDQCIEAIMETAQTGKIGDGKIFVYDVERVIRIRTGEENEDAI

SEQ ID NO: 24888 - protein, 377 aa, Unknown
  uncultured archaeon GZfos26G2
MEDIFRFADELGPAKVIHVYEPSVGLKAVLVVDNVARGPAIGGLRIAPDVSAEECFRLARAMTLKNAAADLPHGGAKSVIYGDPKMPTKEKESLIRAFASSLREIQEYIFAPDMGTDEECMAWVKDEIGRVVGLPSDFGGIPLDEIGATGWGLSHATEVALEYCDFDMEGARVVVQGFGAVGKHTARFLTEKGAMLVGVADSRGTIYNPQGLDVLALIELKTAGKSVADYPDGKKLDRDAVINIECDVWIPAAQPDVIDENNVNLLKTKLVIEAANIPITEGAEKYLHENGVLYVPDFIANAGGVICAAMEYQGADQSAAFEAIEEKLCRNTRLVLEEAASRGILPREAAVDLAVQRLKKSMSYRRWSLFSSAPGFV

SEQ ID NO: 24889 - protein, 502 aa, Oryza sativa
GHRVACTYGAEMGKEASAMVARRSTSRRDWRRWWWWLLPLACCFVCWVASSAATVAPAAGVAVTSLPGFDGPLPFSLETGYVEVNESTGVRLFYYFVQSEKDPDVDPLLLWLSGGPGCSSLSGLTHEIGPFQFAAKRYYSGGLPKIIYQPETWTKVSNIIFVDSPVGAGFSYAATQEGSKTSDTKTVKQLVIFLRKWLHDHPQFLLNPLYIGGDSYSGYIVPTLALAIDESNDSGDKPILNLMGYVAGNPRTERQFDEGGKIPFLHGMGLISNELYEHAKETCRGKYNAPGNARCEQSMKVIHDCTKDINMLHVLEPFCEDVGSPGIHNNEATDGMIRLMLESASAANDDIIEFKCRKASYVVLQIWANDKTVRESLGVHKGTVGEWIRCNFDVDYIADVYSTVEYHLTLMRKGYRALIYSGDHDCQVPFTGTQAWIRFLNLSVIDDWRPWYAAGQVAGFTRSYANNNLIYATVKGAGHTAPEYKPKECLEMFARWISGNTL

SEQ ID NO: 24890 - protein, 93 aa, Guillardia theta
MIIEKRYRRKIYEELFKEGVYIVKDERFNYNCEKFIALKILKGLLSKGFVNEIYSWKYHYFVLNQEGLEYVRKLLNLPNGVVPNTHKIPNVSN

SEQ ID NO: 24891 - protein, 312 aa, Hordeum vulgare
PPSVESIGVCYGMSANNLPAASTVVSMFKSNGIKSMRLYAPNQAALQAVGGTGINVVVGAPNDVLSNLAASPAAAASWVKSNIQAYPKVSFRYVCVGNEVAGGATRNLVPAMKNVHGALVAAGLGHIKVTTSVSQAILGVFSPPSAGSFTGEAAAFMGPVVQFLARTNAPLMANIYPYLAWAYNPSAMDMGYALFNASGTVVRDGAYGYQNLFNTTVDAFYTAMGKHGGSSVKLVVSESGWPSGGGTAATPANARFYNQHLINHVGRGTPRHPGAIETYIFAMFNENQKDSGVEQNWGLFYPNMQHVYPINF

SEQ ID NO: 24892 - protein, 303 aa, Oryza sativa
  misc_feature (62)..(62): Xaa can be any naturally occurring amino acid
MEEISHHFGVVGASGVHGGHQHQHHHHPWGSSLSAIVAPPPPPQLQQQQTQAGGMAHTPLTXYLDCQKVGAPPEVAARLTAMAQDLELRQRTALGVLGAATEPELDQFMEAYHEILVKYREELTRPLQEAMEFLRRVETQLNTLSISGRSLRNILSSGSSEEDQEGSGGETELPEIDAHGVDQELKHHLLKKYSGYLSSLKQELSKKKKKGKLPKDARQQLLNWWELHYKWPYPSESQKVALAESTGLDLKQINNWFINQRKRHWKPSDEMQFVMMDGYHPTNAAAFYMDGHFINDGGLYRLG

SEQ ID NO: 24893 - protein, 84 aa, Glycine max
IQAGRFVFFNFQRENVAKQVPEQNGLTHFEAGDTRAKEYVSLLKSNDPVGFNIVDVLAWGSIGHVVAYYILATTSNGYDPAFFG

SEQ ID NO: 24894 - protein, 572 aa, Solibacter usitatus
MSNPSMLDQDRATGPESPTNNEPNESFGDILTQYEQSHTHRITEPGKKGLEGTVVAITAEAALLDIGFKTEGIIPLTDFQSTGDTVKVGDKLPVSIKGRDPEGYYELSRLKVERPKDWSALEKAFAEKAAILGTITAVVKGGVSVDVGVRAFMPASRSGARDAAEMEKLVGQEIRCRIIKLDVADEDLVVDRRAVLEEEERASKEQRYSQVKEGEIVHGTIRSLTDYGAFVDIGGVDALLHVADISWGRVNKPADVLNVGDKVEAKILKVDPAKKRISLGLKQLQPHPWDLVADKYKVGERVTGSVTRVTDFGAFVELEKGIEGLVHLSEMSWSKKIRRPADMVKPGDQVEVVVLGVNAADRRISLGLKQALGDPWADAAQKLAVGTVIEGPVTSIQKFGAFVQVAEGVEGMVHVGDISAEKRINHPQDVVKVGQVVKAQVLELDVEKRRLRLGMKQLIPTSLDEYIAEHKEGDVVTGRMTDVSSGRAKVELGEGVHATCRLAAESAPKEEEKAGPDKVDLGSLTSMLQARWKSGQGGGGAGKPEGPRSGQIRSFRITRLDAASKKIELELA

SEQ ID NO: 24895 - protein, 172 aa, Solanum lycopersicum
MARSLEPLIVGRVIGDVIDSFNPTIKMSITYNNKLVCNGHELFPSVVSSRPKVEVQGGDLRTFFTLVMTDPDVPGPSDPYMREHLHWIITDIPGTTDATFGRELVSYETPRPNIGIHRFVFVLFKQKSRSSVSQPTSRDHFNTRNFAQENNLEQPVTAVFFNAQRETAARRR

SEQ ID NO: 24896 - protein, 476 aa, Arabidopsis thaliana
MEDDGYYLDTDLDLSFTSTATDRTFTSSSARSSLARSSLTLSFNDRLSTATTPSTTTSSAATTLHHRRYDPHWTSIRAATTLSSDGRLHLRHFKLVRHLGTGNLGRVFLCHLRDCPNPTGFALKVIDRDVLTAKKISHVETEAEILSLLDHPFLPTLYARIDASHYTCLLIDYCPNGDLHSLLRKQPNNRLPISPVRFFAAEVLVALEYLHALGIVYRDLKPENILIREDGHIMLSDFDLCFKADVVPTFRSRRFRRTSSSPRKTRRGGGCFSTEVEYEREEIVAEFAAEPVTAFSKSCVGTHEYLAPELVAGNGHGSGVDWWAFGIFLYEMLYGTTPFKGGTKEQTLRNIVSNDDVAFTLEEEGMVEAKDLIEKLLVKDPRKRLGCARGAQDIKRHEFFEGIKWPLIRNYKPPEIRGLVKKTKAHAGHVTAAVTPRRNKWLWWALSHLLRSKSLSKSSSKIQSNNNYYHYVGKKL

SEQ ID NO: 24897 - protein, 589 aa, Bacillus subtilis
MMEYAAIHHQPFSTDAYSYDGRTVHIKIRTKKGDADHIRFIWGDPYEYNDGKWSANEQPMRKIAATEMHDYWFAEVVPPFRRLQYAFVVTDDHEDIFFGSSGVCPYNEKTLETIHYYFKFPFVHEADTFQAPEWVKSTVWYQIFPERFANGREDLSPKNALPWGSKDPGVNDFFGGDLQGIVDKLDYLEDLGVNGIYLTPIFSAPSNHKYDTLDYFSIDPHFGDPEIFRTLVSQLHQRGMRIMLDAVFNHIGSASPQWQDVVKNGDQSRYKDWFHIHSFPVTDDNYDRFAFTADMPKLNTANPEVQKYLLDIALYWIREFDIDGWRLDVANEVDHVFWKTFRQAVSTEKPDVYILGEIWHSAEPWLRGDEFHAAMNYPFTEPMIEYFADQTISASRMAHRVNAHLMNGMKQANEVMFNLLDSHDTKRLLTRCRNDEKKARALLAFMFAQTGSPCIYYGTEIGLDGENDPLCRKCMVWEKEKQNQDMLQFMKRLIALRKQENTLLTEGHLEWNLLDDKNDFISFSRTLDEKILIYFFNQGNVVQHISLRELNIDRNNKICDAWTEQPLHYHDVIAVQPGEFLILSAAAPV

SEQ ID NO: 24898 - protein, 228 aa, Glycine max
  misc_feature (187)..(187): Xaa can be any naturally occurring amino acid
  misc_feature (195)..(195): Xaa can be any naturally occurring amino acid
MQRSREALLQRRRAKTQLSLSLLFVLWPLIFLFSRAHGYTPTPSVRLSNWKEDKHRQCKTSNSANKCLLKETHDYILPNYKEDCDTPTVVDAQMSDHLPWAVPLGLDEFKSRAISSKIKSGTSGSSGSVMHRVEPGGAEYNYASASMGAKLLGSNKEAKGASNILSRDKDKYLRNPCSAEDKFLIIXELSEETLXVDTIEIANFEHHSSNLKAFELLGSLSFSTDVWV

SEQ ID NO: 24899 - protein, 207 aa, Pinus sylvestris
GSRVSMSAEWMPGQPRPPHLDGSAPGDFGFDPLRLGVIPENLERYKESELIHCRWAMLAVPGMLIPEALGLGNWVEAQKWAAIPGSQATYFGVPVPWGYLPIVLAVEFLAIAFVESQRNGEPDPEKRKYPGGAFDPLGFSKDPVKFKEYKVKEIKNGRLALLAFVGFCVQASANPGTGPLENLATHLSDPWHRNIAEIIIPRSLFPE

SEQ ID NO: 24900 - protein, 568 aa, Zymomonas mobilis
MATMANPTRDDFAALLNQTLGEEEGFEGRVVKGTITAIENDMAVIDVGLKSEGRVPLREFAAPGQKAELKAGDEVEVFVDRVENSQGEAMLSRDRARREAAWDKLEAEFANSSRVEGVIFGRVKGGFTVDLSGAVAFLPGSQVDIRPVRDVAPLMDIPQPFQILKMDRRRGNIVVSRRAVLEETRAEQRSGLIQSLAEGQVITGVVKNITDYGAFVDLGGIDGLLHVTDLSYRRVGHPSEMIAIGDSVTVQIIRINRDTQRISLGMKQLETDPWEGVGAKYPVGAKFMGRVTNITEYGAFVELEPGIEGLVHVSEMSWTKKNVHPGKIVSTSQEVEVVILEVDAEKRRISLGLKQAQPNPWESFAEAHPVGSTVEGEVKNSTEFGLFIGLDNDVDGMVHMSDIAWGMSGEEALSLHHKGEVVKAVVLDVDPEKERISLGMKQLERGNVPAANAGSSLQRNQVVTVTVLAVTDGGLEVQAGDDGAIGFIRRSDLGRDRDEQRPDRFQAGQKLDAMVIGFDRQKKPNFSIKAMQVAEEKEAVAQYGSSDSGASLGDILGAALNKARDQQN

SEQ ID NO: 24901 - protein, 529 aa, Unknown
  Nostoc sp. PCC 7120
MKALLLYPRFPQSFWSYDRFIEIAGLKALLPPLGIITVAALLPKDWEIKFCDRNVNLETEADWEWCDLVILSAMLVQKPDFHALIQKAVRLGKKVAVGGPYPTSIPQDALNSGAHYLILDEGELTIPQFLEALNQGQEQGIFRSPEKPDVSQSPMPRFDLLQRDAYLMMAIQFSRGCPFNCEFCDIITLYGRKPRTKEPQQTIAELQTLYDLGWRGSLFIVDDNFIGNQRNVKRLLQELIPWMKQHNYPFTFITEASVNLAEDEEMLQLMNEAGFYAVFLGIETPDQDSLQVTQKLQNTRNPLVEACRKINEAGMLIYAGFILGFDGERPGAGERIQAFVEQTNIPQPMLGILQALPNTALWTRLQKEQRLLENQGIGGTEVGDQNTLMNFIPTRSIDAIAREYVDGLWTLYEPSNYLRRCFQQCLSIGVSSKRKQTMQFSPGQGLRLVAQLIWHQGLRRPEIRWQFWQQLWTILVKKPQVLNMYLGLCAAGEHFWEYRTLARERITQQLGYDPLKVSVLPKPELMLTK

SEQ ID NO: 24902 - protein, 246 aa, Unknown
  Oceanobacter sp. RED65
MAQVSMRDLLKAGVHFGHQTRYWNPKMSQYIFGARNKIHIINLEHTVPAFNEALNVVKGLAAKNNKILFVGTKRAASKVMQDQASRAGQPFVAHRWLGGMLTNYKTIRQSIKRLRDLEAQQKDGTFEQLTKKEALMRTREMDKLERSIGGIKDMGGLPDALFVIDVDHERIAIQEANKLGIPVIGIVDTNSNPDGVDHVIPGNDDAIRAIEIFTTAIADACIEGKTEAGAAPAPAQAEEKQEEAAE

SEQ ID NO: 24903 - protein, 726 aa, Oryza sativa
MDASAGSSAPHSHGNPGKQGGGGGGGGRGKAPAAEIRGEAARDDVFFADDTFPLLPDFPCLSSPSSSTFSSSSSSNSSSAFTTAAGGGCGGEPSEPASAADGFGELADIDQLLDLASLSVPWEAEQPLFPDDVGMMIEDAMSGQPHQADDCTGDGDTKAVMEAAGGGDDAGDACMEGSDAPDDLPAFFMEWLTSNREYISADDLRSIRLRRSTIEAAAARLGGGRQGTMQLLKLILTWVQNHHLQKKRPRTAIDDGAASSDPQLPSPGANPGYEFPSGGQEMGSAAATSWMPYQAFTPPAAYGGDAMYPGAAGPFPFQQSCSKSSVVVSSQPFSPPTAAAAGDMHASGGGNMAWPQQFAPFPVSSTSSYTMPSVVPPPFTAGFPGQYSGGHAMCSPRLAGVEPSSTKEARKKRMARQRRLSCLQQQRSQQLNLSQIHISGHPQEPSPRAAHSAPVTPSSAGCRSWGIWPPAAQIIQNPLSNKPNPPPATSKQPKPSPEKPKPKPQAAATAGAESLQRSTASEKRQAKTDKNLRFLLQKVLKQSDVGSLGRIVLPKEAEVHLPELKTRDGVSIPMEDIGTSQVWNMRYRFWPNNKSRMYLLENTGDFVRSNELQEGDFIVIYSDIKSGKYLIRGVKVRRAAQEQGNSSGAVGKHKHGSPEKPGVSSNTKAAGAEDGTGGDDSAEAAAAAAAGKADGGGCKGKSPHGVRRSRQEAAAAASMSQMAVSI

SEQ ID NO: 24904 - protein, 570 aa, Candida albicans
MSEHKWWKEAVVYQIWPASYKDSNGDGVGDIPGIISTLDYIASLGVTTVWLSPMYDSPQDDMGYDVSDYENVYSKYGTLQDMDRLIAGCHDRGLKLILDLVINHTSVEHKWFKESRSSKDNPKRDWYIWKPPRIDSNGNKHPPNNWGSYFSGSAWKYDELTGEYYLHLFAESQPDLNWENKECREAIYNSAIKFWLDKGVDGFRIDTAGMYSKYQHFKDVPVAFPDTEFQPCEIYHKNGPRIHEFHKEMAKVMEPYDTMTVGEVGHSTREQALKYVSAAEKEMNMMFLFDVVELGSDPRDRFRYNGFDLVDLKKAIKSQGEFAEGTDAWSTVFIENHDQARAISRFGNDSPEFRVLSGKAIAMLQCCLTGTLFIYQGQEIGMTNVPRSWPIEEYKDINTINYYRAFKEKYGKDADYKQKEEKLVDVINRLARDNARTPVQWSHQQYAGFSEVEPWMRVNDNYKEINVEDQDGDDHSLLNFYRKLLKLRGEYKDLFVYGEMKFLDFDDKKLFTFAKEAPGSPVAYIVINFSGEDVKFEPLIKGNYKLVLTNVDKDSKDALSPYEARMYVVD

SEQ ID NO: 24905 - protein, 352 aa, Oryza sativa
MGGLSMDQAFVQAPEHRPKASVAEADGIPVIDLSPLLAAGDGDADGVDALAAEVGRASRDWGFFVVVRHGVPAEAVARAAEAQRTFFALPPERRAAVARSEAAPMGYYASEHTKNVRDWKEVFDLVPRQTPPPPTTAVADGDLVFDNKWPDDLPGFREAMEEYGEAVEELAFKLLELIARSLGLRPDRLHGFFKDDQTTFIRLNHYPPCPSPDLALGVGRHKDAGALTVLYQDDVGGLDVRRRSDGEWVRVRPVPHSFIINVGDIIQVWSNDRYESAEHRVAVNVEKERFSIPFFFNPAGHTMVEPLEEVVSDESPARYNPYNWGEFFSTRKNSNFKKLDVENVQITHFRKN

SEQ ID NO: 24906 - protein, 554 aa, Streptomyces coelicolor
MIEPHAPAPPGSPPSWGGPCGPEAPARLPVRPAVGRFLVLAGVFVCAACGLVYELELVALASYLIGDSVTQASVVLSVMVFAMGLGSLAAKRLRGLAAAGFGALEAALALVGGSSAMLLYAVFAWTGGWGGLWADGPRILLVAFSLAIGVLIGAEVPLLMELIQRVRRQDPGGAVADLFAADYVGALVGGLAFPFVLLPFLGQLTGALLTGTVNAVVGAALVLGLFRRDLTRRARWLLLTANAVVLALLATATVLADDFERAARHAVYGQDVRVAVRTGVQEVVLTGDADGRPLDLFLDGRLRVRGSDERSYHEALVHPAMGGPHARVLILGGGDGLAAREVLRHPGVRRVDVLEADPGLARLARHDPGLSTLNEHAYGDARVRVLSGDAFHRLRATPSATYDVVISDLPDPGVTASTKLYSQEFYGLLRRVLAPDGRLAVHAGPVDARPRAFWTVDATLRAAGLPAVAYRVGARDTGPGPGSVPGPRRAAAGPPAPRGWGFLLAARTAPAPRLDPAAPRPHSLTPDSLARGVREAARTQMAGLPPSTLVHPRF

SEQ ID NO: 24907 - protein, 398 aa, Oryza sativa
MGDLSAADPPPVSAIGFEGYEKRLEITFSEAPVFADPDGRGLRALSRAQIDSVLDLARCTIVSELSNKDFDSYVLSESSLFIYSDKIVIKTCGTTKLLLTIPRILELAEGLSMPLAAVKYSRGMFIFPSAQPAPHRSFSEEVAVLNRYFGHLKSGGYAYVIGDPAKPGQKWHIYYATQHPEQPMVTLEMCMTGLDKEKASVFFKTSADGHTSCAKEMTKLSGISDIIPEMEICDLDFEPCGYSMNAIHGLAFSTIHVTPEDGFSYASYEVVGFDASTLAYGDLVKRVLRCFGPTEFSVAVTIFGGHGHAGTWAKELNADAYKCNNMVEQELPCGGLLIYQSFDATEDVPVAVGSPKSVLHCFEAENMVNPAPVKEGKLGNLLPWGEDALEENDRVFDE

SEQ ID NO: 24908 - protein, 372 aa, Unknown
  Halobacterium sp. NRC-1
MDDGTIETFKAFRSQFNGDRGPYKGGIRYHPGVTRDEVKALSGWMVYKTAVADIPYGGGKGGIILDPEEYSDSELERITRAFATELRPFIGEDKDVPAPDVNTGQREMNWIKDTYETLEDTTAPGVITGKALENGGSEGRVNATGRSTMFAAREVFDYLDRDLSDATVAVQGYGNAGSVAAKLIADQGADVVAVSDSSGAVHNPDGLDTRAVKAFKTETGSVSGYEGATEELSNEALLTMDVDLLVPAALENAIDEDLAHDVDADVVVEAANGPLTPDADDVLTERGVTVVPDILANAGGVTVSYFEWVQNRQRFQWTEDRVNEELEAIITDAFDAMTDAHEDAGTPNLRTAAYVVAVQRVVDAYEGSGSWP

SEQ ID NO: 24909 - protein, 857 aa, Oryza sativa
LLEIKKSFRNVDNVLYDWAGDGAPRRYCSWRGVLCDNVTFAVAALDLKSNELSGQIPDEIGDCTSLKTLILKNNQLVGMIPSTLSQLPNLKILDLAQNKLNGEIPRLIYWNEVLQYLRLNICNVGQIVRGLRSNNLEGSLSPEMCQLTGLWYLDLSYNRLTGEIPFNIGFLQVATLSLQGNNFSGPIPSVIGLMQALAVLDLSFNQLSGPIPSILGNLTYTEKLYLQGNRLTGSIPPELGNMSTLHYLNLANNNLEGPIPDNISSCMNLISLNLSSNYLSGAIPIELAKMKNLDTLDLSCNMVAGPIPSAIGSLEHLLRLNFSNNNLVGYIPAEFGNLRSIMEIFLFLCFSDLSSNHLGGLIPQEVGMLQNLILLKLESNNITGDVSSLINCFSLNVLNVSYNNLAGIVPTDNNFSRFSPDSFLGNPGLCGYWLGSSCYSTSHVQRSSVSRSAILGIAVAGLVILLMILAAACWPHWAQVPKDVSLSKPDIHALPSSNVPPKLVILHMNMAFLVYEDIMRMTENLSEKYIIGYGASSTVYKCVLKNCKPVAIKKLYAHYPQSLKEFETELETVGSIKHRNLVSLQGYSLSPAGNLLFYDYLENGSLWDVLHAGSSKKQKLDWEARLRIALGAAQGLAYLHHDCNPRIIHRDVKSKNILLDKDYEAHLADLVCQELVPSKTHTSTYVMGTIGYIDPEYACTSRLNEKSDVYSYGIVLLELLTGKKPVDNECNLHHLILSKAADNTVMEMVDPDIADTCKDLGEVKKVFQLALLCSKRQPSDRPTMHEVVRVLDCLVYPDPPSKPALPPALPQSSTVPSYVNEYVSLRGGSTLSCENSSSASDAELFLKFGEVISQNTE

SEQ ID NO: 24910 - protein, 161 aa, Trema orientalis
MSSSEVDKVFTEEQEALVVKSWAVMKKNSAELGLKFFLKIFEIAPSANNLFSYLKDSPIPLEQNPKLKPHAMTVFVMTCESAVQFRKAGKVTVRESNLKRIGAIHFKNGVVHEHFETRFALLETIKEAVPEMWSPEMKNAWGEAYDQLVAAIKFEVKPSST

SEQ ID NO: 24911 - protein, 975 aa, Burkholderia thailandensis
MKLEHPDRLMKRTPLSLAALETHDAFAERHIGPDAASQQAMLDTLGFATRAALIDAVIPASIRRAETLPLGPFAQPLSEAEALAALRELADKNQVFRSYIGQGYYDTHTPAVILRNVLENPAWYTAYTPYQPEISQGRLEALLNFQQMVADLTGLEISNASLLDEATAAAEAMTLLQRVGKPQSNVFYVADDVLPQTLEVIKTRAKPIGIEVKSGPAADAAAANAFGVLLQYPGVNGDVRDYRALADAIHAAGGHVVVAADILALTVLTPPGEWGADVAVGNTQRFGVPMGFGGPHAAYMAVRDEFKRQMPGRLVGVTVDAQGKPALRLALQTREQHIRREKATSNVCTAQALLAIMASMYAVYHGPRGLKTIALRVNRIAALVAAGVKQLGFATVNDTFFDTLTIDTGARTAQIHALANAKRINLRRVSDTRVGISVDETTTRGDLAELLGVFAQAAGGTAPDVDALDAGLADTAALPAGLQRTSAYLTHHVFNRHHSETEMLRYLRSLSDKDLALDRSMIPLGSCTMKLNATSEMLPVTWPEFGRIHPFAPAEQTVGYREMIDQLEQMLVAATGYAAVSLQPNAGSQGEYAGLLIIHAYHESRGESHRNVCLIPASAHGTNPASAHMAGMKVVVVACDAQGNVDIDDLKAKAEQHANDLAAIMITYPSTHGVFEQNVREICEIVHAHGGQVYVDGANMNAMVGLTAPGQFGGDVSHLNLHKTFCIPHGGGGPGVGPVAVGAHLAKFLPNQRSTGYARAEDGIGAVSAAPYGSASILPISWMYIAMMGAKNLTAATETAILNANYIAKRLAPHYPVLYSGPGGLVAHECILDLRPIKDSSGITVDDVAKRLMDYGFHAPTMSFPVPGTLMVEPTESESQEELDRFVAAMIAIRDEIRAVEEGRADREDNPLRHAPHTAAVVTANEWPHAYSREQAAYPVASLVANKYWPPVGRADNAYGDRNLFCSCVPVSDYA

SEQ ID NO: 24912 - protein, 226 aa, Brassica napus
MAPACSRINSLHVAVIGAGAAGLAAARELRRESHSVVVFERGTQIGGLWVYTPQTEPDPLSLDPNRTIVHSSVYDSLRTNLPRECMGYRDFPFVPRDDDGSRDPRRYPSHSEVLAYLQDFAREFKLEEMVRFETEVVCVEPEGQKWKIRSKSSDGIFKDEIFDSVVVCNGHYTEPRVAHIPGIDSWPGKQIHSHNYRVPDPFKDQVVVVIGNFASGSDISRDITGV

SEQ ID NO: 24913 - protein, 879 aa, Zea mays
  misc_feature (782)..(782): Xaa can be any naturally occurring amino acid
MAASVERHLAPHPWPANAPPKSFDMFRTGSDSDSEDEDSIPAVDWRSLYRPRLEVEPPVHDPRDEATSDAWVRRHPALVRLTGKHPFNSEPPVPRLMAHGFITPAPLHYVRNHGAVPRADWSTWTVEVTGLVTRPAKLTMERLVTEFEAVELPVTLVCAGNRRKEQNMVRQTVGFNWGPGAISTSVWRGARLRDVLRRCGVMGAADGAANVCFEGAEDLPGGGGGGKYGTSLRRGVAMDPARDVILAYMQNGEPLAPDHGFPVRVIVPGFIGGRMVKWLKRIIVASSESESYYHYRDNRVLPSHVDADLANAEAWWYKPECMINELNINSVITTPGHDEVLPINALTTQRPYTIKGYAYSGGGRKVTRVEVTLDGGETWHVCSLDHPERPTKYGKYWCWCFWSVDVEVLDVLGAKEIAVRAWDEAMNTQPEKLVWNLMLKYTHVRLFLYAQGMMNNCWFRVKINACRPHKGEIGMVFEHPAYLVNQPGGWMARQKHLETSESAQSTLKKSTSTPFMNTATAQYTMSEVRRHTSPDSAWIIVHGHIYDCTGFLKDHPGGADSILINAGTDCTEEFDAIHSDKARGLLEMYRVGELDDTGSDYSPQNSHADLKAIVEAPAAAAPISVTSTVALSNPREKVRCRLVDKKSLSYNVRLFRHVYVCASIGGKLCMRAYTPTSPVDEVGHVDLLIKIYFKDEDPKYPNGGLMSQYLDSLPLGATIDIKGPIGHIEYAGRGGFVVNGERRFARRLAMVAGGTGITPVYQVIQAVLRDQPDDDTEMHLVXANRTVDDMLLREEINRWVAAYPARLKVWYVVSKVARPEDGWEYGVGRVDEQVLREHLPLGDSETLALVCGPPAMIECTVRPGLEKMGYDLDRACLVF

SEQ ID NO: 24914 - protein, 129 aa, Burkholderia thailandensis
MRLLHTMLRVGDLDRSIKFYTELLGMKLLRRQDYPDGKFTLAFVGYGDEQDHTVIELTHNWDTKSYELGTGFGHLAVEVEDAYKACEQIKAQGGKVTREAGPMKHGTTVIAFVEDPDGYKIEFIQRKTH

SEQ ID NO: 24915 - protein, 333 aa, Kluyveromyces lactis
MKMNMNMNMNLEMSVNPLQQQFINLPNASSVAADDVAAASTQVKMEPSQNSTMGELIFDKFINHAVEHPHLQQSVSNGSPSGGDADDISPKLFNMNSADPTITSNEISTTELNASIVETFFDAASSTDSTPIFELDNQDLGGVETWTSLFDNDIPVTLEDVSDCANAVTLELESTHNVSVQHPSVVDDLVAPPTNTMALKQNQFLPTPMLEDDLQLPSKPKFSKASGRVSKPTKCENLTRSPSPSETESNKYDNLGVIAYSRKQRAAPLTPVIPESDDPMAVKRAKNTEAARRSRARKLQRMNQLEDKVKELLQRNSDLENEVTRLRSMLGSQ

SEQ ID NO: 24916 - protein, 667 aa, Lactobacillus plantarum
MQTVFLVLLLVAAVVVANAVYARFNQIPVAFLQIGAGLILSLIPLYRNFELEPEIFLFVIISILMFNDGQNTNIRKLSHQFGTTLSLSVVLAIVTILIVGTVTHLLIPEFSLALAFALGAIITPTDAVAVSSITTKVAIPGEVMTTLENESLFNDASGIVAFNLAIAAIVTGKFSVWHGVTNFLYVFAGGIFVGLIIGYIIVAVRIMLIRMRVDTPSVIVPYTLLTPFVVYFLAESLGVSGILAVVATGLIHGVQSDQLRLTTSRLQIVMTTTWSIVASILNGIVFVLLGVSLPSVINHLQQRDTSSVAVLVGLGILLYLIMTFARFLWTRFDLARIRAWDNHEKTRNAFVMGLSGVHGTITLAMAFSLPLTLNGSAFPYRNDIIFVAAVVILTSLMVPTLLLPLTLPKQVVKVTEDELATAKADMVTHAIDLMQARHGNNAGTSKVIAILSGQRVLDGRPKRSQLASLFDATFKVEQTTIDEMVANNEITPQAAEKYMRVASQTRLQNQQTFFERLKLFFRFTLSKWSLSKKARARRKMFRQYRPHGGQSRAELMTRNRQMWQQMRQIEQKPYEAVLAYLADTITADNQQAIGIVRRAYDERHRRLSGERDFQETQNELLIEAFQLEYNFIQTQLANKTFSSELGNQLYEQISTDQLVYLQSINTD

SEQ ID NO: 24917 - protein, 979 aa, Bacillus licheniformis
MDGKPISIRIDGKEFEAVAGATVLDILNKNGFEHPQICHVPETDPIQTCDTCIVEADGKLKRACSLRAEDGMTISLSAERVKAAQKEAMDRLLENHLLYCTVCDNNNGNCKLHNTAEMMGIEDQKYPYTPKEDPSCAVDMSHPFYRYDPNQCIACGQCVEVCQNLQVNETLSIDWELERPRVIWDEGVSINESSCVSCGQCVTVCPCNALMEKSMLGKAGFMTGIKPDVMEPMIDLVKDVEPGYSSIFAVSEVEAAMRSQRTKKTKTVCTFCGVGCSFEVWTKGRDILKIQPVSEAPVNAISTCVKGKFGWDFVNSEERLTKPLIRKNNEFVESTWEEALDYVARRLGSIREQNGKDAVGFISSSKITNEENYLMQKLARQVFGTNNVDNCSRYCQSPATDGLFRTVGMGGDAGTIQDIAKAGLVIIVGANPAEGHPVLATRVKRAHKLHGQKLIVADLRKNEMAERSDLFIRPRQGTDQVWLMAVTKYMIDQGWHDQAFIDENVNFFEEYKQSLETYTLEYAEKITGIHKQTLIQIAEMIRDADGTCILWGMGVTQNTGGSDTSAAISNLLLATGNYRRPGAGAYPLRGHNNVQGACDMGTLPGWLPGYQHITDDKARKKFEQAYGTTIDEEPGLDNIEMLHAVEEGKMKAMYIVGEDMALVDSNANRVHDILSSLEFLVVQDVFLSKTAQYADVVLPASASLEKDGTFTNTERRVQRLYQALPPLGDAKPDWVIIQDIANRLGADWSYSHPGDIFSEMASLSPLFSKADYDAIEGWNSFLWGSLTGESTPLLYEDGFNFPDRKARFAIADWAEPAEFPEEYDLHINNGRMLEHFHEGNMTNKSAGIQAKVPDVFVEVSPELAKERGICDGSQVRLISPFGAVKLTALVTDRVRANELYLPMNSTDKESAINFLTGPAVDARTNTPAYKQTKVRMEVLGGCAEPPLPKTNPRNKKRHPQNGAEVERKWKRPGYVHLTD

SEQ ID NO: 24918 - protein, 167 aa, Brassica napus
  misc_feature (28)..(28): Xaa can be any naturally occurring amino acid
ADLPAYAIGDEKRLMQTILNIMGNAVKXTKEGHVSIIASIMKPESLRELPSPDFYPVPSDNHFYLCVQVKDTGCGIHTQDIPFLFTKFVQPRTGAQRNHSGAGLGLALCKRFVGLMGGCIWIESEGIEKGCTASFIIRLGICNGPGSSSGSMALRLAAKSQTRPWNW

SEQ ID NO: 24919 - protein, 352 aa, Unknown
  Mesorhizobium sp. BNC1
MERPVLVIGAGQAGLAAGYHLKNARVPFVIVDSHRRVGDNWRVRYDSLTLFTPRQFSALPGLDLAGNRELYATRDEFADYLEVYATRFRLPIQLGRRLIRLSKAGDGGFEAALDDGSHISASEVIVATGAFQVALVPKLAAQFGHEVLQLTTETYRNPNQLPDGPVLVVGDGASGRDIAVEVRQRQPAMLATGKPRKLFPERVLGKSIWWWLNLFGVLRAPAESRIGRKLRQSDAFPDRDRSIESLAKRGIRVLPRLIEASGEAARFADGTSANIRTVIWAVGYRDDATWLDIEDAKGPDGAFLHEAGISPVKGIYFVGRPWQRNRASALIMGAGPDGEIVVQRLLSDRAKP

SEQ ID NO: 24920 - protein, 212 aa, Escherichia coli
MSLFDKKHLVSPADALPGRNTPMPVATLHAVNGHSMTNVPDGMEIAIFAMGCFWGVERLFWQLPGVYSTAAVYTGGYTPNPTYREVCSGDTGHAEAVRIVYDPSVISYEQLLQVFWENHDPAQGMRQGNDHGTQYRSAIYPLTPEQDAAARASLERFQAAMLAADDDRRITTEIANATPFYYAEDDHQQYLHKNPYGYCGIGGIGVCLPPEA

SEQ ID NO: 24921 - protein, 970 aa, Exiguobacterium sibiricum
MNRWKSVCAVVLTFALIFSLFPVNGLALEKGKSTLVIIHYKEDKTAPKDWNLWLWANGPDYFPNKAHAFNGQDAYGKIAAYEFPVDQPEKIGFIVRDDSWNKDAGSENDRFITKDMIKDGVAEVWIESGSKDVSPVNPTGGSDVESVNTNIHYYRYDNDYDKYGVWAWPNAQDGKRFEFDGQDAFGAVANVTLTNTTKERLVGIIPHIEGWSEKDGADRFYYAGAKDIWLIEGDQTVYYSQPDIDRTPKFTSFLADDFKTMTLKTNSPIAAEDVKTLTFKGLVNPVVTQVDAKTLHVTVASDIDLANVVTVSHPVFGEGILEAGKVLRSDAFDKKYAYDGKLGTAYQKGKTTFRVWAPTAQSVELELYKLPKKQAATTKDIVREVKMVRGDRGVFSITVNGDLDGTGYTYEVKHAKETTRAVDPYTTAVAVNGDQGVVVDLRETNPKRWTKTKMPLKQATDAIIYETHVRDLSMFDVTGDTYDSGIEQKGKYLGVVKPGTRLMKDGKKTKTKTGLDHLKELGITHVQFIPVYDFNTASVDETNPLKTYNWGYDPKNYNAPEGSYSTNPYDPKVRIKEMKQMIQGLHDNGLRAVMDVVYNHMFDAKASNLDKIVPGYYYRYTEGGDLANGTGVGNDTASERKMMHKLIVDSVGYWAKEYRWDGFRFDLMGIHDVKTMNAVKKTTTKIDPSILVFGEGWSLGTPLPEADKANQTNAKQMPGIAHFNDNLRDALKGSVFEDTDAGFINGKTGLETRIKRGIVGEIAYNKDITGFAAEPNQAITYVEAHDNHTLWDKLNLTNPNDTDATKTKMHRLASSILLTSQGTTFIHAGQDFMRTKGGDHNSYKSPDAVNQLDWKRKMDRQADVDYMKGLIQVRKANPVLHLGTAKDIRRYLTFKDVPEQVVAYQLSDDAPQQKTDLYVVHNAKRQAVKMTLPKGTWSVIVDGKTAGMKTLKKVSGSVTVDPLSSYVLKK

SEQ ID NO: 24922 - protein, 532 aa, Solibacter usitatus
MLTDREAYKKLAAHFEQVKNVHLRELFAADSRRGERLTAEAAGLYLDYSKNRVTDETLGLLLALAEECGLRGRIDAMFRGDKINTTEGRAVLHTALRAPRGKSPAAAQVPEAGEPVQAVLEQMSVFATSVREGRWAGFTGKPIRNVVNIGIGGSDLGPVMAFEALRYYSQRNLTFRFVSNVDGTDFREATRDLDPAETLFIVASKTFTTLETMANAQSARAWTLAALGDPAAVARHFVAVSTAAEKVAKFGIDTANMFGFWDWVGGRYSMESAIGLSTMIAIGPENFLEMLGGSYAMDEHFRTAPFAKNLPVLMGLLTVWYNNLFKAQTVAVLPYDQYLKRFPAYLQQLTMESCGKHVTLGGEPITTYETGPIFWGEPGTNGQHSFYQLIHQGTKLIPCDFIGFRQTLNPLPSPMGNHHDLLMANVFAQSKALAFGKAAPAGQPYREFDGNRPSNTILAERLTPAVLGALVTLYEHSVLTQATIWDINPFDQFGVELGKVLAAEILPSLAKDAPLPDDDSSTVALIKRYKKQ

SEQ ID NO: 24923 - protein, 180 aa, Streptococcus pneumoniae
MLENDIKKVLVSHDEITEAAKKLGAQLTKDYAGKNPILVGILKGSIPFMAELVKHIDTHIEMDFMMVSSYHGGTASSGVINIKQDVTQDIKGRHVLFVEDIIDTGQTLKNLRDMFKEREAASVKIATLLDKPEGRVVEIEADYTCFTIPNEFVVGYGLDYKENYRNLPYIGVLKEEVYSN

SEQ ID NO: 24924 - protein, 193 aa, Arabidopsis thaliana
  misc_feature (29)..(29): Xaa can be any naturally occurring amino acid
  misc_feature (53)..(53): Xaa can be any naturally occurring amino acid
  misc_feature (76)..(76): Xaa can be any naturally occurring amino acid
  misc_feature (115)..(115): Xaa can be any naturally occurring amino acid
  misc_feature (131)..(131): Xaa can be any naturally occurring amino acid
  misc_feature (146)..(146): Xaa can be any naturally occurring amino acid
  misc_feature (151)..(151): Xaa can be any naturally occurring amino acid
KTITVASSMVSSATMVASPAEATMVAPFXGLMSSVAFSATRKVNNEITSITTXNRRANCMQEWPPIVKKKFETLSXYLPDLTESELLNEVEYLIRNNCIPCVEFKLEHFFVYASXHGNSPVYYDGRHLNNXNLPLFSSTESDQVLXTVIEXNNRHPNGFITIIEIELMRQAESIIFIVYEPSSFTGEILSAFA

SEQ ID NO: 24925 - protein, 132 aa, Vibrio vulnificus
MARCLDYLKRYRMNAFREDAMKLINAIIKPFKLDDVREALADVGIEGMTVSEVKGFGRQKGHTELYRGAEYQVDFLPKVKLEIATQAENVDRVIEAITKAAHTGKIGDGKIFVYDLSHAVRIRTGETDVEAL

SEQ ID NO: 24926 - protein, 372 aa, Campylobacter jejuni
MEISYYEILEITQNADKETIKKAYRKMALKYHPDRNQGDKEAEDKFKLVNEAYEVLSNDEKRAIYDRYGKMLKGGGFGSSSSGFGGFEDLGDIFSSFFGEGFGSSRRRKSSNDEKIPSDFIVNLKLSFKEAVFGCKKNIDFTYKCSCKTCNGTGAKDGKLQTCPKCQGRGQVGVSQGFITFAQTCPDCQGIGEKASEKCSDCKGLGYNESKDSVELNIPEGVDTGMKLRVNAKGNILKNGTRGDMYVKIIAAEDDTFIRDDDDIYIEFPVFFTQAILGESIKVPTIRGEATLNLPKGAKDGQRFVLEKEGVKDVHSSRMGNQIVQISIKFPTSLNDEQKELLEKLSESFGIKDGMHQEQKGLFEKITNWFKS

SEQ ID NO: 24927 - protein, 167 aa, Cicer arietinum
MAEQASKSIYDFTVKDIRGNDVSLSEYSGKVLLIVNVASQCGLTQTNYKELNVIYDKYKNQGFEILAFPCNQFRGQEPGSSEEIQNVVCTRFKAEFPIFDKVEVNGKNAEPLYKFLKGQQGGIFGDGIKWNFTKFLVNKQGKVVDRYAPTTAPLKIEKDIEKLIKSS

SEQ ID NO: 24928 - protein, 415 aa, Ralstonia solanacearum
MFERNRYTIDQIDPEVFAAIQQENQRQEDHIELIASENYTSPAVMAAQGSQLTNKYAEGYPGKRYYGGCEYVDVVEQLAIDRVKQLFGAEAANVQPNSGSQANQGVFFAMLKPGDTIMGMSLAEGGHLTHGMALNMSGKWFNVVSYGLNAQEDIDYDALEALAQEKKPKLIIAGASAFALRIDFERIAKVAKAVGAYFMVDMAHYAGLIAAGVYPNPVPHADFVTTTTHKSLRGPRGGVILMKAEHEKAINSAIFPGIQGGPLMHVIAGKAVAFKEAQSPTFKAYQEQVVKNARAMAETLMARGLRIVSGRTESHVMLVDLRAKSITGKEAEKVLGDAHITVNKNAIPNDPEKPFVTSGIRLGSPAMTTRGFKEGEAVKVAHLIADVLDNPHDEANIAAVRAKVAELTKQFPVYA

SEQ ID NO: 24929 - protein, 178 aa, Unknown
  Rosa hybrid cultivar
ECAFWMPSRTGLNLQLSHTLTQVSSGANVSINLPIVTEVFNSARALRIPYTCPLARFRPLVGRYMSPEVVAVRVPLLNLSNFQINDWPELSAKSYAIMVLILPTDSARQWREHELELVEVVADQVAVALSHAAILEESMRARDQLMEQNVALDLARREAEMAIHARNDFLAVMNHEMR

SEQ ID NO: 24930 - protein, 400 aa, Zea mays
MAVLSAADASPVSAIGFEGYEKRLEITFSEAPVFVDPHGRGLRALSRAQIDSVLDLARCTIVSELSNKDFDSYVLSESSLFIYPLKIVIKTCGTTKLLLTIPRILELAEELSMPLAAVKYSRGTFIFPGAQPAPHRSFSEEVAALNRYFGGLKSGGNAYVIGDPARPGQKWHVFYATEYPEQPMVNLEMCMTGLDKKKACVFFKTNADGNTTCAKEMTKLSGISEIIPEMEICDFDFEPCGYSMNAIHGSAFSTIHVTPEDGFSYASYEVMGLDATALSYGDLVKRVLRCFGPSEFSVAVTIFGGRGHAGTWGKALGAEVYDCNNMVEQELPGGGLLVYQSFCAAEDAVATSPKSVFHCFDGENVESAPPPMKKDYKLANLLCWEEEADAMEEKAGVLDE

SEQ ID NO: 24931 - protein, 168 aa, Arabidopsis thaliana
MLLGFGNSDLAQDREECTNQLIELSTCIPYVGGDAKAPTKDCCAGFGQVIRKSEKCVCILVRDKDDPQLGIKINATLAAHLPSACHITAPNITDCISILHLPRNSTLAKEFENLGRIEDNYNSTSPTQIHKDGTGGGKAEPVKSNGWKEKSWLGVELLIYLLVSLIFF

SEQ ID NO: 24932 - protein, 618 aa, Arabidopsis thaliana
MDLNGECKGGDGFIDRSRVRILLCDNDSTSLGEVFTLLSECSYQVTAVKSARQVIDALNAEGPDIDIILAEIDLPMAKGMKMLRYITRDKDLRRIPVIMMSRQDEVPVVVKCLKLGAADYLVKPLLTNELLNLWTHMWRRRRMLGLAEKNMLSYDFDLVGSDQSDPNTNSTNLFSDDTDDRSLRSTNPQRGNLSHQENEWSVATAPVHARDGGLGADGTATSSLAVTAIEPPLDHLAGSHHEPMKRNSNPAQFSSAPKKSRLKIGESSAFFTYVKSTVLRTNGQDPPLVDGNGSLHLHRGLAEKFQVVASEGINNTKQARRATPKSTVLRTNGQDPPLVNGNGSHHLHRGAAEKFQVVASEGINNTKQAHRSRGTEQYHSQGETLQNGASYPHSLERSRTLPTSMESHGRNYQEGNMNIPQVAMNRSKDSSQVDGSGFSAPNAYPYYMHGVMNQVMMQSAAMMPQYGHQIPHCQPNHPNGMTGYPYYHHPMNTSLQHSQMSLQNGQMSMVHHSWSPAGNPPSNEVRVNKLDRREEALLKFRRKRNQRCFDKKIRYVNRKRLAERRPRVKGQFVRKMNGVNVDLNGQPDSADYDDEEEEEEEEEEENRDSSPQDDALGT

SEQ ID NO: 24933 - protein, 290 aa, Yarrowia lipolytica
MRSSSSRQPQMQSYYAIATVWALIIGAATYYFFSNSKPKAVLQRGDTAFKEFPLIQKTVLSHNSAIYRFGLPRPSHVLGLPIGQHVSLSANIGGKEVLRSYTPTSSDLYDKGYFDILIKTYPQGNISKYVSELAIGDTMKVRGPKGNFVYNHGLVESFGMVCGGTGITPMYQILRHIAADPADNTKVNLVYANVNHDDILLKKELDAIAAENDNIKIHYVLNNAPEDWTGSVGFVTKEILEKHCPPPGPNTKLLLCGPPPMISALKKASVELGYEKARPVSKLEDQVFAF

SEQ ID NO: 24934 - protein, 256 aa, Triticum aestivum
  misc_feature (100)..(100): Xaa can be any naturally occurring amino acid
  misc_feature (115)..(115): Xaa can be any naturally occurring amino acid
MLLFLGLFCVSLAGNATALVLFLSPVPTFIQIWKKKTVEQYSAVPYLATLLNCMMWVLYGLPLVHPHSMLVITINGTGMLIELTYVALFLTFSVGAARRXRVLLLLVAEVAFVAXAVGALVLSLAHTHDRRSMVVGILCVLFGTGMYAAPLSVMKMVIQTKSVEYMPLFLSVASLVNGICWTAYALIKFDLYITIPNGLGVMFAVGQIILYGIYYKSTQQILEARKRKADQVPMTEVVVDGKSGSATNSGAANGHY

SEQ ID NO: 24935 - protein, 309 aa, Methanosarcina acetivorans
MKVACIQMDVLQCKKQENLEKALYMALKAVKKGAELIVFPEVFTTGFCYEDLNHAAESLPSPTLENLACFSEANDCIILGSIIQKDSGEAYTEDDGEGSNDKGRDGGKKGSKKEEKGFSGKETEIPGSKAFTERKNSTLYYNLGFCFESGVLAGTYLKTHPFKAENGYFSKGSSIEPISLKKQNLKIGLEICYELRFPEVARKLSIAGSDLLVTIAAFPNPRAEHWKTLAKARAIENQIPHIACNRTGSVPDCTYFGNSMIIDAWGEIKAEAGSKECTIVCDLDLTGKEEIRKAIPVFEDRRIELYSDN

SEQ ID NO: 24936 - protein, 187 aa, Glycine max
  misc_feature (54)..(54): Xaa can be any naturally occurring amino acid
  misc_feature (133)..(133): Xaa can be any naturally occurring amino acid
MRTKKKEVAYSMISCPVVTTRQRAHGDRYWTVPFTGLKSMAGFPTRKTNNDITXIASNGGRVQCMQVWPPIGKKKFETLSYLPHLADAQLAKEVEYLIRKGWIPCLEFELEHRFEYREHNGSPGYYQGLYWTXWKLPMSGCTDASQVLKELQEAKTAYPNGFIRIIGFDNVRQVQCISFIAYKPPGF

SEQ ID NO: 24937 - protein, 259 aa, Zea mays
VRWRATSAAATSPLGSSTVSSSPRSLALPRNHQDLIVYRPIWFTYSCNEECETHELPPKAKKFDSFFKQLYSIPLASSNEYICKDFFLYMECHRFGLFATSTAQSNESTATEGAIHGVPLIEKITFHLVRLEDGVILDEKAFCNDFINLAHSIGAYMYEDLLCIVSLRYQTIHILQIRDSGNLVEVRNIGAFCREDDELFLHSHIQRVQHLKKKFYFHFQDYVDLIIWKVQFLDRHHLFVKFGSVDGGLTANTFWISLG

SEQ ID NO: 24938 - protein, 73 aa, Ralstonia metallidurans
MAKEELIEFGGVVSEALPDNRYRVTLENGVEIWAYASGKMQKHRIRILAGDRVTLEMSPYDLTKGRINFRHKS

SEQ ID NO: 24939 - protein, 399 aa, Streptomyces coelicolor
MSTKDFIEKDYYKVLGVPKDATEAEIKKAYRKLARENHPDANKGNVKAEERFKEISEANDILGDPKKRKEYDEARALFGNGGFRPGPGAGGGGTFNFDLGDLFGGGAQGGGGQGGAGGFGGGLGDVFGGLFNRTGGGPGTGTRTQPRRGQDIESEVTLSFTEAIEGATVPLRMSSQAPCKACSGTGDKNGTPRVCPTCVGTGQVARGSGGGFSLTDPCPDCKGRGLIAEDPCEVCKGSGRAKSSRTMQVRIPAGVSDGQRIRLRGKGTPGERGGPAGDLYVVVHVKEHPVFGRRGDNLTVTVPVTYAEAALGGEVRVPTLGGPSVTLKLPAGTPNGRTMRARGKGAVRKDGTRGDLLVTVEVSVPKDLTGKARDALQAYREATADEDPRAELFQAAKGA

SEQ ID NO: 24940 - protein, 534 aa, Unknown
  Bradyrhizobium sp. BTAi1
MRILLLHPNYHSGGAEIAGNWPPAWAAYISGALKAAGFTDLRFIDAMTNDLSEEQVRAILRSEKPDVIGCTAITPSIYKAERLLEIAKEEHPEALTVLGGIHATFMYQQVLTEAPWIDAIVRGEGEEIIVDLMRAREDGRWERDRRSIKGIAYRDGTEVVATVAAPTVKNLDAITPDWSVLEWSKYIYIPMNKRVAIPNMARGCPFTCSFCSQWKFWRDYRIRDPKKVVDEIETLMREHDVGFFILADEEPTINKKKFVAFCEELIRRDLKILWGINTRVTDILRDEALLPLYRKAGLIHVSLGTEAAAQMKLDRFNKETTVAQNKKAIQLLRDAGIVVEAQFIVGLENETRETLEETYQMARDWKPDLANWAMYTPWPFSDLFRDLGDKVEIFDYEKYNFVTPIMKPDAMDRGELLDGVMNNYRRFYMHKALFSYPWAGSGERRRYLLGCLKAFLKSGFERKFYDLGRVNYWGPQSKGKVDFGFDTSRKRAEPGKVEWKTSHNRKLTGPQQAQVMACGGGTEQMSEEAETRVH

SEQ ID NO: 24941 - protein, 277 aa, Oryza sativa
MAAAAETSAKVGAPRRWSLQGKTALVTGGTRGIGRAVVEELAALGATVHTCSRKEEELSERLKEWEARGFRVTTSVCDLSVRDQRERLLRQVADLFGGKLDILVNNVGTNIRKPTTEFSAEEYSFMMATNLESAYHLCQLSHPLLKASGSGSIVFISSVCGLVAVFSGSLYAMTKGAINQLTKNLACEWARDNIRSNSIAPWYIRTSLTEGLLANKDFEGAVVSRTPLRRVGEPEEVSSLVAFLCMPGSSYITGQTISVDGGNRYKSSVRMMVLAEQ

SEQ ID NO: 24942 - protein, 308 aa, Oryza sativa
MAEAVASGAAGRWTLRGKTALVTGGTRGIGYSPQHPSLVLPSRYPVRSETSTAEPLLLFHDQRGEFMRRHAVVDELAALGAAVHTCSRKEAELGERLREWEGKGFRVTGSVCDVSVREQRERMLREVAGLYGGKLDILVNNVGTNFSKQTTEYSADDYSFIMATNLESAYHLCQLAHPLLKSSGSGSVVFISSVSGVVAVSSGSVYAMTKGAMNQLAKNLACEWAKDNIRTNSVAPWYMKTSLVEDELARKDFADSVVRRTALKRVGEPEEVSSLVAFLCMPGASYITGQTISVDGGMTINGLYPTQD

SEQ ID NO: 24943 - protein, 261 aa, Anabaena variabilis
MQNHVNPLDSAVYIVGAGPGDPDLLTVKAQKLLSVADVILFADSLIPEELLQFCRKDAEIIQTANKTLEEIIPLMIARVRSHKSVVRLHSGDPSLYSAINEQMQLLAAANIPFEVIPGISAFQAAAAKLKVELTVPGLVQTIILTRISGRTQVPQTEELATLAAHQASLCLYLSARHVENAQAKLLEHYPPDTPVAICFRIGWPDERIRVVPLREMAECTQQENLIRTTLYVISPALSHTTGRSRLYHPEHSHLFRTAGDS

SEQ ID NO: 24944 - protein, 416 aa, Moorella thermoacetica
MNLETVAKVDPEIVAAVRGELQRQRTHLELIASENFVSQAVMEAYSCVLTNKYAEGYPGKRYYGGCEWADVVENLARERAKALFGAEHANVQPHSGSQANTAVYLAVLNPGDKALGMNLAHGGHLTHGSPVSLSGKYYNFCFYGVDAKTGRIDYDAVARIAREERPRLIVAGASAYPRVIDFARFREIADEVGALLMVDMAHIAGLVAAGIHPNPVPYAHFVTTTTHKTMRGPRGGIILTTREYARDIDKAVFPGVQGGPLMHVIAAKAVALKEAMLPEFKRYQEQIVTNARTLADALMGYGFNLVSGGTDNHLMLVDLRNKNITGREAEDILASVQITVNKNAIPFDPQKPSVTSGIRLGTAALTSRGMDADAMVQVARAIDLALSYGPDEKKLEEARGIVAELCRAFPLYQELD

SEQ ID NO: 24945 - protein, 909 aa, Oryza sativa
MADADELGRRLAAVAVSDSDSANNNLFQVMRAVEDAEATIRQQLEENSRLKDELMLKTRELDRFRSEATKPTSLADTFSTSPHGTSTCFGTTSSSLNSRTALADQHNGLFHHTDQMLHDAIKLKYLDTDQSNGMPRKLSGEQSAPESRVPSHLSTPSSRSLSPTRHRKEGEYDPKFNLPGQCLLPASEANSTIMWKQDLLAKVKEHEEEIAQLRRHLADYSVKVLKNLLEYNTILQCICFQAFDQQQQDLVDAASKALSYRQDIIEENIRLTYALQAAHQERSTFVSSLLPLLTEYNLQPSVLDAQSIVSNLKVLFKHLQEKLAITEEKLKESQYQLTPWRAESSNSTNIPVQAPSHPPGNAIVTTSKANLDIVPQQAYSHVQSPMSSPVRARRDWDLLGNENHQAIPSEVTAVNTEHENVGTTSPSSSNQIKKDVVAQGTEHDSRAVRFNFESKNQNPSFKDLVRNDVPENLEGAETHISQEPPAQWGPEGSPNLASGVDDANPPYPYLPTVLEEPSSSFSEAADDDPLPAIEGLRITGEAFPGRELQASGYSINGTTSCNFEWVRHLEDGSVNYIEGAKQPSYLVTADDVDSLLAIEVQPLDDRKRKGEIVKVYANEQKKITCDPETKELIKKILSIGHVSYEVLLPVRFLDMWEPAVLAIKREGYSIKCNGQRGVVITEKFQQATAVCFDIEINIPYGRPTEFSILASDGAEYNLKPAENAPSRDTIVLILRLFRMKAVEKSKGRRKGIFFKTLRCYSSHCNHYATCPSRSPMADSGARRQPSFTKVDQLRPGTHGHNLLLKVVDSKMVLQRGGGPQGRHMRIAECLVGDETGIIVFTARNDQVDVMKAGASVDLRNAKIDMFKGSMRLAVDKWGIVKAAESPADFTVKEDNNMSLIEFELVTVVE

SEQ ID NO: 24946 - protein, 515 aa, Paenibacillus polymyxa
MLTMFASSAMAEQDMNGHKPPNSAGSGVFYEIYINSFYDSNGDGHGDLKGITQKLDYLNDGNPRSGKDLQVSGLWLMPLNPSPSYHKYDVTDYYQVDPQYGNLNDFRTLTKEAKRKGVKVIIDLVINHSSSEHPWFKEASANPQSKYHDYYVWADENTNLDEKGSWGQQVWHKNPNGEGYFYGTFWSGMPDLNFDNPKVRKEMIKVGKYWLQQGADGFRLDAAMHIFKGQTKDGADKNITWWNEFRSEMEKINPNVYLAGEVWDKPETIAPYYESLHSLFNFDLGGTILNSVKNGRDQGIATFSEKTLKLYKSYNKAALDAPFLSNHDQTRVMSELGGDVRKAKLAASILLTLPGQPFLYYGEEIGMKGEKPDEYLREPMRWYKGEGLGQTKWEEPKYNKGEVSVEAQLRDNDSLLESYRTLIRLREEHEALRSDSLEPIQAGSASVTAYERSSGKETLYVYHNLSGEPVTIQMKDRDKEKRKVVFSTSKDAKVRKETVTIPAYSSLITQEDRKS

SEQ ID NO: 24947 - protein, 444 aa, Coccidioides immitis
MSHLPIEPEFEQAYKELAFSLENSTLFEKHPEYRKALQVASIPERTIQFRVTWENDKGESRKSLINFPFFLGGWEQQLEVNRGYRVQFNSALVNMGGGKGGADFDPKGKSDNEIRKFCSAFMMELSKHIGADIDVPAGDIGVGGREIGFLFGAYKRQRHIWEGVLTGKGLSWGGSLIRPEATGYGLVYYVQHMIEYATNGQESFKGKRVAISGSGNVAQYAALKVIEFGGTVISLSDSKGALVIRNEGDSITPQEIYEIQQLKDQRKQLSALADAPHFKDRCVYIEGARPWLHVGQVDVALPCATQNEVSGPEALGLIQSGCKYIAEGSNMGCTLAAIEHFEAHRQLHKKGGAVWYAPGKAANAGGVAVSGLEMAQNSQRLTWTAEEVDQKLKNIMKVCFETGVRTSETYTALSEGQLPSLVIGSNIAGFIKVAEAMRDHGDWF

SEQ ID NO: 24948 - protein, 280 aa, Triticum aestivum
  misc_feature (117)..(117): Xaa can be any naturally occurring amino acid
LALRRPWSGSRRTGGACSTSSYRVGDLDKTIKFYTECLGMKLLRRRDIPEERYTNAFLGYGPEDSHFVVELTYNYGVESYDIGSGFGHFGIAVEDVEKTVELIKAKGGTVTREPGPXVKGGKSVIAFIEDPDGYKFELIERGPTPEPLCQVMLRVGDLDRAISFYEKAFGMELLRRKDNPQYKYTIAMMGYGPEDKHAVLELTYNYGVKEYDKGNAYAQIAIGTDDVYKTAEVVRQNGGQITREPGPLPGISTKITACTDPDGWKSVFVDNLDFLKELEE

SEQ ID NO: 24949 - protein, 280 aa, Coccidioides immitis
MAPKFLKALTAAAGLYASLAAAAPLQKRAIVWETVTDIVVETVEVTLTVTGVPGGPKTISPPELTTTTTEQPPPVPTTMYKAPPPPQSPPAPTTTAQAPPPPPPPPPPPPPPAPTTTQAPQYPPPPPPPPPPAPTTSKAAPPPPPPPPPPPPPAPPAPKPSKPAPPPQPPTELPDPSKQVFSGDMTFYNGGLGACGTEIDTQGEDAVAISVDIMGSENNNSPYCGKTITIEYGGVTSKAVVKDKCPTCARGSLDMTRHLFYKFADEAEGRVHGVKWSFDD

SEQ ID NO: 24950 - protein, 374 aa, Hevea brasiliensis
MAISSSTSGTSSSLPSRTTVMLLLIFFTASLGITDAQVGVCYGMQGNNLPSVSEVIALYKQSNIKRMRIYDPNQAVLEALRGSNIELILGVPNSDLQSLTNPSNANSWVQKNVRGFWSSVRFRYIAVGNEISPVNGGTAWLAQFVLPAMRNIHDAIRSAGLQDQIKVSTAIDLTLVGNSYPPSAGAFRDDVRSYLDPIIGFLSSIRSPLLANIYPYFTYADNPRDISLPYALFTSPSVVVWDGQRGYKNLFDATLDALYSALERASGGSLEVVVSESGWPSAGAFAATFDNGRTYLSNLIQHVKGGTPKRPNRAIETYLFAMFDENKKQPEVEKHFGLFFPDKRPKYNLNFGAEKNWDISTEHDATILFLKSDM

SEQ ID NO: 24951 - protein, 159 aa, Shewanella oneidensis
MALATFGAGCFWGVEYFFRQVNGVTNATCGYMGGNNEVTTYEEVKKGKTGHAEVVQVEFDPTIVSYDELLEVFWKNHNPTTLNMQGGDIGTQYRSTIFFHDREQKAAAEASKLAFARSGRWGLRHIVTEIVPLQQFHVAEEYHQNYIDKNNLPSCHLEY

SEQ ID NO: 24952 - protein, 108 aa, Prochlorococcus marinus
MPEYNIKVQFEQKTFNFLCSEDQDIISAAKMNGIDLPSSCCSGVCTDCASMILEGSVDQEDAMGLNDDLREKGFALLCVAYPKSDLNIVIGKEVEDDLYNDQFGKYQK

SEQ ID NO: 24953 - protein, 313 aa, Parvularcula bermudensis
MADKQFGSDGFTAEHLPDLTGKTFAITGANSGIGLEAARYLGGRNATVLMLCRNASKAESARNALRQSAPGGKYETISLDLADFSTLSPATDAIRQATDRLDGLILNAGVMMLPRRQITKDGFEMQYQVNVLSHFALAAALADLVETASGRFVWLSSIAHHYAKHPKLTDLGYAAGYSPTSSYAKSKLADLMLGLELHRRLSAAGKSAGSYIAHPGYSDTNLQSAGPGAILGTLIKPFTMIFSQPAEKGALPTVLAAAYPKAQPGVLYGPTGFQEMKGPVGEAAIKPWAKDPQVAKQLWSVCEEATGREWSMA

SEQ ID NO: 24954 - protein, 103 aa, Cucumis sativus
  misc_feature (78)..(78): Xaa can be any naturally occurring amino acid
MSGSGKGGKGLGKGGAKRHRKVLRDNIQGITKPAIRRLARRGGVKRISGLIYEETRGVLKIFLENVIRDAVTYTEHAXRKTVTAMDVVYALKRQGRTLYGFGG

SEQ ID NO: 24955 - protein, 112 aa, Synechococcus elongatus
MKKIEAIIRPFKLDEVKIALVNAGIVGMTVSEVRGFGRQKGQTERYRGSEYTVEFLQKLKLEIVVEDAQVDTVIDKIVAAARTGEIGDGKIFVSPVDQTIRIRTGEKNADAI

SEQ ID NO: 24956 - protein, 469 aa, Ashbya gossypii
MPYHLSESHKKLISSHLSESDPEVDAIIKDEIDRQKHSIVLIASENLTSTAVFDALGTPMCNKYSEGYPGARYYGGNQHIDRMELLCQRRALEAFHVTPDRWGVNVQSLSGSPANLQVYQALMKPHERLMGLHLPDGGHLSHGYQTETRKISAVSTYFESFPYRVDPETGIIDYDTLEKNAVLYRPKILVAGTSAYCRLIDYKRMREIADKVGAYLMVDMAHISGLVAAGVIPSPFEYADIVTTTTHKSLRGPRGAMIFFRRGVRSVHPKTGEEVMYDLEGPINFSVFPGHQGGPHNHTISALATALKQATTPEFREYQELVLKNAKVLETEFKKLNYRLVSDGTDSHMVLVSLREKGVDGARVEHVCEKINIALNKNSIPGDKSALVPGGVRIGAPAMTTRGMGEEDFARIVGYINRAVEIARSIQQSLPKEANRLKDFKAKVEGGTDEIAQLAQEIYSWTEEYPLPV

SEQ ID NO: 24957 - protein, 392 aa, Oryza sativa
MLIPILSCLFQMQIFVKTLTGKTITLEVEFSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGL

SEQ ID NO: 24958 - protein, 514 aa, Triticum aestivum
  misc_feature (433)..(433): Xaa can be any naturally occurring amino acid
  misc_feature (435)..(435): Xaa can be any naturally occurring amino acid
  misc_feature (478)..(478): Xaa can be any naturally occurring amino acid
  misc_feature (487)..(487): Xaa can be any naturally occurring amino acid
  misc_feature (502)..(502): Xaa can be any naturally occurring amino acid
PRVRLWENNFTGGIPRHLGRNGRFQLLDLSSNRLTGTLPPELCAGGKLETLIALGNSLFGPIPDSLGKCKALTRVRLGENFLNGSIPEGLFELPNLTQVELPLPLLSGSFPAVVSAGGPNLGGISLSNNQLTGALPASIGSFSGLRKLLLDQNAFTGAIPPEIGRLQQLSKADLSGNSFDGGVPPEIGKCRLLTYLDLSQNKLSGDIPPAISGMRILNYLNLSRNQLDGEIPVTIAAMQSLTAVDFSYNNLSGLVPVTGQFSYFNATSFVGNPGLCGPYLGPCRPGGAGTDHDAHTHGGLSSSLKLIIVLVLLAFSIAFAAMAILKARSLKKASEARAWRLTAFQRLEFTCDDVLDSLKEENMIGKGGAGTVYKGTMPDGDHVAVKRLSTMSRGSSHDHGFSAEIQTLGRIRHRYIVRVLGFWSNNETYLRVXNXLPNGSLGEPLPWKEGGHLPWDTRVQIPVEAAKGLCYLHHDCSXPILHRDVQXNNISFDSDFEAHFAXFGAAKFLSGSGH

SEQ ID NO: 24959 - protein, 896 aa, Unknown
  Candidatus Kuenenia stuttgartiensis
MTTVIIDGKRVEADPSQTILEAARRVGIRIPTLCHDPRLKPSGACRICVVEVEGKDNLAASCATPVSEGMKVSTRSEAVLRSRRLNLELLWSNHPNDCLTCDKAGECSLQNLMYEYDVKTSRFVKQNPVPAPDESNPAIYRDMNKCIMCGKCVRICDEVQGQHVWTFSDRGIKTRVSTAFEKSMQDGGCVFCGHCVSVCPVGALMDKPVMKKARSWETRKVRTVCSYCGVGCSLVLHIKNNEILQVTADINSAPNYGSLCVKGRYGFEFYSSKDRLKTPLVRDNINEPFREASWEEAIGLVAKRFSEIKKKYGPDSFGCLSSSRGTNEENFLAQKFTRVVMGTNNMDNCARVCHAPSVTGLRAALGSGAATNSLADIEGAEVLIVSGSNTTEAHPVAALKIKKAVRQNGAKLIVIDPRKIELVKYADIHLQLRAGTNVALINGLLHVIIKEGLQNDDFIERRTENFEMLKQVVSKYTPEETEAITGVPKEDIIKAARMYAGTNKGMIIYGLGMTEHKAGSHGVMSLANLALITGNVGRPNTGINPLRGQNNVQGSCDMGALPDVYACYQRVDDPEANRKHAEAWKVKKLPEKPGLKEPQMYRAIESGDLKAMYIIGYDPAISQADINKVRASISKLEFLVVQELFMTETAKLAHVVLPTSCYFEKDGTFTNAERRVRRLHKAIPLPEGTKSDWDIICSIATAMGYPMSYNHPSEIMDEIAKLTPDMAGINYKRLEGDGLVWPVWDMNHPGTPILHKDTFKRGRGMFNDLMYTPSEELPDEEYPLLLTTGRRLYQYNNGSMSLRNPEICAINSEEFMEIHPADAAKLDIKSGEKVKVSSRRGSLEVKTELTEKSRLGSVFLSFHYPETPTNVLTGPGEDMLALTPEYKVCAVKVEKM

SEQ ID NO: 24960 - protein, 167 aa, Trifolium repens
VIHSRWAMLGALGCTFPEILEKNGVKFGEAVWFKAGAQIFSEGGLDYLGNPNLIHAQSILAIWATQVVLMGFVEGYRIGGGPLGEGLDPLYPGGAFDPLGLADDPDAFAELKVKELKNGRLAMFSMFGFFVQAIVTGKGPVQNLYDHLADPVANNAWAYATNFVPGQ

SEQ ID NO: 24961 - protein, 321 aa, Xylella fastidiosa
MSDYPASAKHSRLLILGSGPAGWTAAVYAARANLQPVLITGLQQGGQLMTTTEVDNWPGDAHGLMGPDLMERMQAHAERFETEVIFDQIYKADLSTRPFTLFGDSGLYTCDGLIIATGANAKYLGIPSEEAFKGRGVSACATCDGFFYRDQDVAVIGGGNTAVEEALYLSNIARKVYLIHRRDKLRAEKIMQNKLFSKAATGKIELIWNNAVEEVLGNDAGVTGVRIRSTQDSSTRDIDVQGLFVAIGHHPNTDLFAGQLAMNNGYLQIHSGTAGNVTQTSVEGVFAAGDVADQHYRQAITSAGFGCMAALDAERFLDKGN

SEQ ID NO: 24962 - protein, 304 aa, Unknown
  Agrobacterium sp. KNK712
MTRQMILAVGQQGPIARAETREQVVVRLLDMLTKAASRGANFIVFPELALTTFFPRWHFTDEAELDSFYETEMPGPVVRPLFEKAAELGIGFNLGYAELVVEGGVKRRFNTSILVDKSGKIVGKYRKIHLPGHKEYEAYRPFQHLEKRYFEPGDLGFPVYDVDAAKMGMFICNDRRWPEAWRVMGLRGAEIICGGYNTPTHNPPVPQHDHLTSFHHLLSMQAGSYQNGAWSAAAGKVGMEENCMLLGHSCIVAPTGEIVALTTTLEDEVITAAVDLDRCRELREHIFNFKQHRQPQHYGLIAEL

SEQ ID NO: 24963 - protein, 377 aa, Solibacter usitatus
MSKRDYYEVLGVGKQAADSELKAAYRELAKRFHPDRNPDDPHAEEKFKECSEAYSVLSDAQKRAAYDRFGHAGVQGAGGGPAGFNPEQFADFGDILGDFFGFGDLFGQGGGAGGRRRTRAQRGEDVRYDLEITFEDAMFGMGADIQVPRMERCERCKGGGSEPGSGPTTCPTCHGRGEILYQQSFLSIRRTCSTCNGSGQIIRNPCGECHGHGYKQVQRKLKVNIPAGVDDGNRLRLAGEGQPGVNGGPPGDLYVFLKVKEHPFFERHEADLHCTIPINMAQAALGCEIEIPTLEQPSKLKIPEGTQNGAQFKLRHKGVAVLNSSSRGDLYVHIAVKTPTRISREQRKMLEQLRDTLPVDNRPAEKGLFEKVKDYFM

SEQ ID NO: 24964 - protein, 457 aa, Listeria innocua
MNQNPVEEGQKFPLTIRRMGINGEGIGYFKKAVVFVPGAITGEEVVVEAVKVRDRFTEAKLNKIRKKSPNRVTAPCPVYEACGGCQLQHVAYNAQLELKRDIVIQSIEKHTKIDPAKLKIRPTIGMEDPWRYRNKSQFQTRMVGSGQVETGLFGANSHQLVPIEDCIVQQPVTIKVTNFVRDLLEKYGVPIYDEKAGSGIIRTIVVRTGVKTGETQLVFITNSKKLPKKREMLAEIEAALPEVTSIMQNVNQAKSSLIFGDETFLLAGKESIEEKLMELEFDLSARAFFQLNPFQTERLYQEVEKALVLTGSETLVDAYCGVGTIGQAFAGKVKEVRGMDIIPESIEDAKRNAEKNGIDNVYYEVGKAEDVLPKWVKEGFRPDAVIVDPPRSGCDQGLIKSLLQVEAKQLVYVSCNPSTLARDLALLAKKYQIRYMQPVDMFPQTAHVETVTLLQRR

SEQ ID NO: 24965 - protein, 221 aa, Ralstonia metallidurans
MAKNKFNQSWLHDHINDPYVKMAQREGYRARAAYKLKEIDDQDKLIQPGQVIVDLGAAPGSWSQYARNKLAASPRAKDGRIDGAVVAIDILPMEPVADVTFIQGDFREEEVFRQLEQVVLDASGGSRIDLVISDMAPNLSGVASADAARIEYLCDLALDFAQAHLKPEGSLLVKCFHGSGYSQIVEKFKRQFKVVASRKPKASRDKSSETFILGRYLKSVD

SEQ ID NO: 24966 - protein, 491 aa, Bacillus clausii
MTQAKDVALIFELSKQGRVGHSLPNLDIEEQPLESLLPEAYVREEEPELPEVSELQIMRHYTALSKRNHGVDSGFYPLGSCTMKYNPKINEDIARLPGLVHVHPYQPEEQVQGSLKMLYSLQTALAEITGMDEVTLQPAAGAHGEWTGLMMIRAYHEANGDKKRTKVVVPDSAHGTNPASATVAGFESVTVRTNEAGLVDLDHLREVVNEETAALMLTNPNTLGLFEADIQEMADIIHRAGGKLYYDGANSNAILGIARPGDMGFDVVHLNLHKTFTGPHGGGGPGSGPVGVKKELVPFLPKPVLVNDDGFFRFDSDRPQSIGRVKPYYGNYGINLRAYTYIRTMGPDGLRQVSENAVLNANYMMRRLESYYDLPYAQHCKHEFVLSGKRQKKLGVRTLDIAKRLLDFGYHPPTIYFPLNVEECMMIEPTETESKETLDEFIEAMIQIAKEAEESPELVQEAPHHTVIKRLDETLAARKPILRYEMKKETV

SEQ ID NO: 24967 - protein, 58 aa, Glycine max
MAMAVSAIGFEGFEKRLEISFFHPGLFADPEGRGLRALTKSHLGEILTPAACTIVSSL

SEQ ID NO: 24968 - protein, 448 aa, Bacillus clausii
MNTHRYLPMTEEDKKEMLATIGVDSIEALFADIPESTRFKSQLAIEAALKEPELIAHFQKLADENQSIKTYTSFLGAGVYEHYIPSIVDHVISRSEFYTAYTPYQPEISQGELQAIFEFQTMICELTGMDIANSSMYDGPTALAEAAMLSCGHTKKKTILVSKAVHPEARAVLKTNAYGQRLNVIEIDANANVTDIESLKAAYNDEVACVIVQHPNFYGSLEPLAEIEEIVHQGKAQFVVSSNPLALGVLKPPGDFGADIVVGDAQPFGIPVQFGGPHCGYFATTKKLMRKIPGRLVGQTVDEEGRRGFVLTLQAREQHIRREKATSNICSNQALNALAASVAMTALGKQGVKEMAKQNVQKSAYLKKQLSLAGIDVVGDGPTFNEFVINCGQPVKDVNRQLLEKGMIGGFDLGSVEPERNGQMLVCVTELRTKEELDLFANEMGALV

SEQ ID NO: 24969 - protein, 383 aa, Lactobacillus sakei
MAEKRDYYDVLGVGRDASDDEIKKAYRKLSKKYHPDINKAPDAEAKFKEVTEAYEALSDPQKRAAYDQYGHAGMNGGFGGGAGAGQGFGGFGGGAEGFGGFDDIFSSFFGGGARQQPNGPRQGSDLQYRMDLKFEEAVFGKETKISYSREAECHTCHGSGAKPGTSAETCHKCHGAGQIQVERQTPLGRMMSRETCDVCGGTGKEIKSKCDTCHGTGREEERHTVKVKVPAGVEDGQQMRLQGQGEAGSNGGPYGDLFIVFRVAPSDEFERDGAQIFVEVPISFVQAALGDEIEVNTVHGPVKLKIPAGTQTNTVFRLRGKGAPKLHGTGNGDQNVTVNVVTPKTLNSKQRDALKAFAVASGDSVNPQDSNLFDKILNKKYKK

SEQ ID NO: 24970 - protein, 242 aa, Brassica napus
KVSDGTSSLAKTSGSRLDFMESGKSSIYRGSTSSDISDESSCSSLSSTVNKPHKANDLSWEAIQAVRARDGVLGLSHFRLLKRLGCGDIGSDYLSELKGTKCYFAMKVMDKTSLASRKKLLRAQTEREILQSLVHPFLPTLYTHFETEKFSCLVMEFCPGGDLHTLRQRQPGKHFSEQAVKFYIAESLLAIEYLHMLGIVYRDLKPENVLVREDGHIMLSDFDLSLRCLVSPTLVKSTAIES

SEQ ID NO: 24971 - protein, 435 aa, Mycobacterium avium
MGLQAPFRSGGGTSRPQGRAAPRAVDLRREVHDAARRARVASRVLALLPTVAKDQALRSAADAIAGHAELILSANAEDLETARAAGTPSAMLDRLALDTKRVEGIAAGLRQVAGLPDPVGEVLRGYTLPNGLQLRQQRVPLGVVGMIYEGRPNVTVDAFGLALKSGNAVLLRGSSSATRSNQALVQVLRASLVSEDLPADAVQLLSADDRATVTHLIQARGLVDVVIPRGGANLINAVVRDAQVPTIETGVGNCHVYVHEGADLEVAERVLLNSKTRRPSVCNAAETLLVDAAIAEEALPRLVTALQDAGVTVHGGFARDATEDDLRREYLSMDIAVAVVDGVDAAIAHINEYGTGHTEAIVTTNMAAAQRFTDGVDAAAVMVNASTAFTDGEQFGFGAEIGISTQKLHARGPMGLPELTSTKWIAWGDGQTRPA

SEQ ID NO: 24972 - protein, 398 aa, Mycobacterium avium
MSSDASASNGIVIVGGGLAAARTAEQLRRSEYSGPITIVSDEVHLPYDRPPLSKEVLRKEVDDTALKPRQWYDDNDITLRLGSAARSLDTAAQTLTLEDGTTLGYDELVIATGLVPRRIPTIPDLDGIRVLRTFDESLALREHASAAQRAVIIGAGFIGCEVAASLRSLGVDVVLVEPQPTPLAAVLGQQIGELVARLHRAEGVDVRLGVGVSEVRGDRHVEAVVLTDGTELAADVVVIGIGSRPATDWLEGSGVAIDSVDRGVLCDEAGRTSAPNVWALGDVASWRDATGHQGRVEHWSNVADQARVVVPAMLGKEVPPVVVVPYFWSDQYDVKIQCLGEPEADDIVHIVEDDGRKFLAYYERDGALVGVVGGGMPGKVMKTRAKIAAAVPIAEMLG

SEQ ID NO: 24973 - protein, 606 aa, Oryza sativa
  misc_feature (471)..(471): Xaa can be any naturally occurring amino acid
MELALVGNPSNGVAKPSCNSVGSLPVVSSNAVIHPPVTSAARATLGRHLARRLVQIGATDVFAVPGDFNLTLLDYLIAEPGLKLIACCNELNAGYAADGYARARGVGACAVTFTVGGLSVLNAIAGAYSENLPVICIVGGPNSNDYGTNRILHHTIGLPDFSQELRCFQTITCYQAVINNLDDAHEQIDTAIATALRESKPVYISVGCNLAGLSHPTFSREPVPLFISPRLSNKANLEYAVEAAADFLNKAVKPVMVGGPKIRVAKAKKAFAGIAESSGYPFAVMPSAKGLVPEHHPRFIGTYWGAVSTTFCAEIVESADAYLFAGPIFNDYSSVGYSLLLKREKAVIVQPDRVVVGNGPAFGCILMTEFLDALAKRLDRNTTAYDNYRRIFIPDREPPNGQPDEPLRVNILFKHIKEMLSGDTAVIAETGDSWFNCQKLRLPEGCGYEFQMQYGSIGWSVGATLGYAPGXPKDKRVISCIGDGSFQMTAQDVSTMLRCGQKSIIFLINNGGYTIEVEIHDGPYNVIKNWDYTGLIDAIHNSDGNCWTKKVRTEEELIEAIATATGAKKDCLCFIEIIVHKDDTSKELLEWGSRVSAANSRPPNPQ

SEQ ID NO: 24974 - protein, 512 aa, Coprinopsis cinerea
MVLNFTSLASIPTSTSFPTPSSFLSLNPGKSATWLYTTGAIVVSLLALEQAVYRYKKRHLPGASWTIPIIGKFADSMSPSMENYKKQWASGDLSAISVFNIFIVMASNNEYARKILNSPSYAKPCLVHVAPQVLCEDNWVFLNGKPHVEYRKGLNQLFTRRALSIYLPIMEGSARKHISKWIEQGKDGKAHAIMMTARFLNMDTSLRVFCGNHLPEHAAAEINEKYWLITQAFELVNFPLAIPGTKVWKAIQARKAAMQWLELAASRSKIAMAEGKEPECMLDEWVTILADPNYKGRKEFSDREMALVLLSFLFASQDAMSSGLIYAFQHLADHPEVMQKVREEQERVRKGNYEIPLTLDLLDQMTYLHAVVKESMRVKPPVVMVPYRATKAFPIAENYTVPAGSMVIPSFFNSLHDSSVYPEPEAFQPERWLDPNSTANAHPKNYLVFGSGPHRCIGIDYAMMNMALVLATASAMMVWEHEITPLSNEVEIIATLFPKDGCRLKFTPCHHG

SEQ ID NO: 24975 - protein, 581 aa, Nicotiana benthamiana
MGNTCVGPSISKIGLFQSVSAAMWRTRMPDDSGSTTNGDSARGETAESSKDPNLVVPSKPPEQITMPKSDQKEEEPAKKEEGPEKPKKPVQMKRVGSAGLRTDSVLQKKTGNLKEFFSIGKKLGQGQFGTTFKCVEKATGKEYACKSIAKRKLLTDDDVEDVRREIQIMHHLAGHPNVISIKGAYEDAVAVHVVMEYCAGGELFDRIIQRGHYTERKAAELTRTIVGVLEACHSLGVMHRDLKPENFLFVNQKEDSLLKTIDFGLSIFFKPGDRFNDVVGSPYYVAPEVLKKRYGPEADVWSAGVIVYILLSGVPPLWAENEQGIFEEVLHGDLDFSSDPWPSISEDAKDLVRRMLVRDPKKRLTAHEVLCHRWVQVDGVAPDKPLDSAVPSRMEQFSAMNKLKKMALRVIAESLSEEEIAGLKEMFRMIDTDNSGQITFEELKVGLKRVGANLKESEIYDLMQAADVDNSGTIDYGEFIAATLHFNKIEREDHLFAAFSYFDKDCSGYITADELQQACEEFGIGDVHLEDMIRDADQDNDGRIDYNEFVAMMQKGNPVIGGGKKGLEHSFSTGFREALRL

SEQ ID NO: 24976 - protein, 463 aa, Mycobacterium smegmatis
MRIARHISELIGNTPLVQLNSVVPEGAGLVAAKIEYLNPGGSSKDRIALKMIEAAEVSGELKPGGTIVEPTSGNTGVGLALVAQQRGYKCVFVCPDKVSEDKRNVLRAYGAEVVVCPTAVPPDHPDSYYSVSNRLVTEIEGAWKPDQYSNQMGPESHYETTGPEIWADTEGKITHFVAGVGTGGTITGTGRYLKEVSGGKVKVIGADPEGSVYSGGTGRPYLVEGVGEDFWPTAYDPSVPDEIIAVSDADSFEMTRRLAREEALLVGGSCGMAVVAAIEVARKAGPDAVVVVLLPDGGRGYLSKIFNDAWMSSYGFLRTRLDGSVEKTVGDVLRGKSGALPDLVHTHPSETVRDAIGILREYGVSQMPVVGAEPPVMAGEVAGSVSERELLSAVFEGRAKLADAVAEHMSPPLPLIGAGELVSTAAKTLRESDAVMVVEDGKPVGVLTRHDLLGFLSEGGYRH

SEQ ID NO: 24977 - protein, 799 aa, Zea mays
MASSLPAPPASPSSSWRGLTPRCPPPRCGPLLARAAARSYRYRFRTDDDGVVDVAVAGKDGDAGYVVAIEAPTHGQRGGLVLRPAGSGEGVPLAPAAPGGALVAELSYDVARAPFHVSFTLADAMGAEIRTHRGTSFRVPVGVGRGCPSPLGLSQSKDGAANFAVYSKIAKGMVLCLFGGGGGDGPALEIELDPYVHRTGDVWHVSMESVEGYARYGFRSGLFAMFGIDRPLLDPYAKVIGDFVAGDSVDEDGLAVPSIRCLASLKNAPNYDWGRDKHPCLPLQKLVVYRANVALFTKDRSSRLADNAAGTFSGMSAKVEHFRHLGVNAVLLEPVFPFHQVKGPYFPYHFFSPMSLYSSECSSVSAIKSMKDMVKTMHRNGIEVLLEVVFTHTAEGGAECQMISLRGIDGSSYYIADGIAGCKASVLNCNHPVTQKLILDSLRHWVLDFHVDGFCFINAPFLVRGPGGEGLSRPPLLEAIAFDPVLSKTKIIADPWSPLDISNVQFPFPHWKRWAEMNTRFSMDVRKFLKGEALISDLATRLCGSGDLFSSRGPAFSFNYVSRNSGLTLVDLVSFSSDELASEFSWNYGEEGPSENNAVFQTRLRQIHNFLFILFISLGIPVLNMGDECGNSAAGSTSYKDRGLLNWKALKTAFVKEVTGFISFLSALRSRRADIFQRCEFLKLENIHWYGSDLSEPCWEDPTSNFLCLHINAELDEKLPDSTGGDLYICFNANEESASATLPAIAEGSMWLRLVDTSLAFPGFFSRGSSHETHQVLGFSSYQVKAHSCVLFESKRVLS

SEQ ID NO: 24978 - protein, 674 aa, Unknown
  Synechococcus sp. RS9917
MCGIGGVFSAQAHQRVDPQLLVNMAAIQEHRGPDGFGYRSLDDAGVGFCHARLSIIDLNETRARQPFLSEAAGPGARLLMAHNGEFYDFQRIRADLTARGVRFDSKSDSEILLRLYEQQGLEATLPQLRGEFAFAIYDEADDALHLVRDRFGIKPQYWALTPAGLVFGSELKVLFAHPAVERRFTSEGLFHQLMQTMVPGTTAFAGVHQVPPGHGITVRRRDGQLTVEHWKYWDLDFPRQGERDASITEQEHIDAIRAALLDAVELRMVADVPVGCYLSGGIDSCSILGLAAAVSQNPVKAFTIGFDDARYDESPIAREMAEATGAEQDLMRLSGKELYGWMERTLWHTERTIYNTLAVAKFLMSRHVNAVDYKVVMTGEGSDELFGGYPAFRRDMFLHGFNDLPEAERRSWEDLLQQSNALVQGAMLAADQVDDPDLDAVVGFTPSCLQPWLACAPLVPDLLSEPHRQALEGYAPGKAIAATLDADQLEGRHALDKAQYVWIKTMLEGQILTWGGDRVDMAHSMEARPAFLDHHLAAAAVQVPPELRIKGKTEKYVLREAMAGLLPEVLYKREKFAFMAPPAHTEPDKWNQMRQLADDYLSDAAIAEAGLLSAEGVRDLFARHEDPATTDADRVQMDALINHLLGVQMLHRMFIATDVPAQARQKADALGWHV

SEQ ID NO: 24979 - protein, 918 aa, Arabidopsis thaliana
MASVYIPVQNSEEEVRVVLDQLPRDASDILDILKAEQAPLDLWLIIAREYFKQGKIEQFRQILEEGSSSDIDEYYADVKYERIAILNALGAYYSYLGKTETKNREKEEQFISATRYYNKASRIDMHEPSTWVGKGQLLLAKGEIDNALQAFKIVLDTAPDNVPALLGQASVEFNRGRFSESLQLYKRALQVFPGCPAAVRLGIGLCRYKLGQLDKARQAFDRVLQLDPDNVEALVALGIMDLQANDSIGMRKGMDRMQQAFEIYPYCASALNYLANHFFFTGQHFLVEQLTETALAVTTHGPTKSHSFYNLARSYHSKGDFEKAGMYYMAAIKETNNNPHEFVFPYFGLGQVQLKLGELKGSVFNFEKVLEVYPDNCETLKALGHLYTQLGQNEKALEYMRKATKLDPRDAQAFVGLGELLISSDTGAALDAFKMARTLMKKGGQEVPIEVLNDIGALHFEREEFESALENFKEALGDGIWISFLDEKENLEQTGVSVLGYKDTGIFHRLIESGHSVDVPWNKVTTLFNLARLLEQIHKTEAATFMYRLILFKYPGYIDAYLRLAASAKAQNNLPLAIELVNEALKVDDKNPNALSLLGELELKNDDWVKAKETFRAANDATDGKDSYAILSLGNWNYFAAMRNEKRNPKLEATHLEKAKELYTKVLTQHNSNMYAANGSGIVLAEKGQFDIAKDVFTQVQEAASGSVFLQMPDVWVNLAHVYFAQGNFALTVKMYQNCLRKFFYNTDSQILLYLARTHYEAEQWQECKKTLLRAIHLTPSNYTFRFDLGAVMQKSSSSTLQKKKRTADEVRSTVAEAENAVRVFTQLSAASDLHVHGFDSKKIQTHVQYCSHLLEAAKVHREAAEQEELQNRQRLEVARQAALAEEARRKAEEQRKYQLEKRKQEEELRRLKQKKKK

SEQ ID NO: 24980 - protein, 176 aa, Vibrio vulnificus
MKHTVEVMISEQTVQERVRELGKQITAHYQGSEDLVLVGLLRGSFVFMADLARAIELTHQVDFMTASSYGNTMESSRDVRILKDLDDDIKGKDVLIVEDIIDTGNTLNKIKEILSLREPKSIEICTLLDKPSRREVPVPVKWIGFEIPDEFVVGVGIDYAQKYRHLPFIGKVVPQE

SEQ ID NO: 24981 - protein, 349 aa, Haloarcula marismortui
MTESVEHRRLIVAGTGAAGLTAAIYAARSNNDPLVLEGDEPGGQLTLTSEVENFPGFPEGLSGPDLINNMKEQAERFGAELEHGIVADIDDSERPFRVELSNGDVYTCDAFIAASGASARTLGVPGEDELMGYGVSTCATCDGAFFRGEDMLVVGGGDAAMEEAHFLTKFADTVYIAHRREEFRAEDYWIDRVQQKVDEGEIEIMRNTELLEMHGSPEDGVDHVTLAQNDEGHPSEKLDADGTETFDFDVGAVFIAIGHTPNTDYLGDTGVELDDTGYIQTHGGTGGDQTATDVDGIFGAGDVVDYHYQQAVTAAGMGCKAAIDADEYLEAQAEATAEAESEAAAEADD

SEQ ID NO: 24982 - protein, 414 aa, Unknown
  Comamonas sp. JS46
MKSAYGLTTPQENAELTHVEPGTPMGELLRRFWQPVALSAELTDLPKKIKIMCEELVVFRTKDGALGCLTPHCSHRGTSLEWGRIEKDGLRCCYHGWLYAPDGRVTEMSCETKEFCARANIQHPAYPIMEYGGLVFIYMGPPEKKPLFPLYDIIDTRERNDVELRGMQLWDGYGIGYVKDCNWLQHHENVVDPWHLLVLHQQISGDQFDGALMQGRSKIDFESTDLGVRYRVIKDLPNGNRLVRYAEVVMPNIILVPNIHEQGTVPKNKDRCTEITWTVPVDNEHLTAFSIVAWPLVDGKPVDDWMPGTDVRIKVRPAGQGERTYEERQRNPDDREAQEGQRPIAIHALERLAPSDRGVVMLRRQLKEQIQIVKDGNDPMNIVRDEGANTRIRTNAWNTVLSPEQATKHQGEEA

SEQ ID NO: 24983 - protein, 526 aa, Mycobacterium avium
MTSPAARLRRYEIGKVIALTNPVSGHGAAVAAAQRAIARLHRRGVEVVEIIGDDAQDARHLVGAALDKGADAVMVTGGDGVFSNALQVLAGTDIPAGIVPAGTGNDHAREFGIPTKDPEAAADIIVDGWAETVDLGRIRADNGFDKWFGTVAATGFDSLVTDRANRMRWPHGRLRYYVAMLAELSQLRLLPFRLVLDGAQEIDAEITLAAFGNTRSYGGGMRICPAADHADGLLDITMVHEASRAKLVRLFPTVMTGTHVELEQVSTVRAKSIHVECPGINVYADGDFACPLPAEISAGSGRAADPAGRSLTHAPAQPGHLAGVAAVAECLERLVPGRPQHGIQLGGQRVGALGHHRAQPHLPDHDVAVGAHRPAPQTQLRGVAEAVAVDSGAGVLGDLEPQHGPGAQRVGQLGAGAHRTDPVGDRAQLSGHRRLGRPGQVGLGPQGRRQRPLDMRAHRRRRGVHVHHASRHVGELVRRSHFLLLRFHEGRLPQRPVDPASRAACANLRFFLCRACLLCPVIPMLR

SEQ ID NO: 24984 - protein, 174 aa, Oryza sativa
FFFFFLKGQHEKSVLYFQRALKLNRKYLSAWTLMGHEFVELKNTPAAIDAYRRAVDINPRDYRAWYGLGQIYEMMGMPFYAVYYFRKSSYLQPNDARLWNAMAQCYESDQLQMIEEAIKCYERSDETGTLRISSTSRAATSELHNVILIVCILARKLHIAGDVDLVCMMISSSC

SEQ ID NO: 24985 - protein, 154 aa, Bacillus cereus
MGYVEELRKIVGHRPLILVGAVVLVINENRYVLLQQRTEPYGKWGLPGGLMELSESPEETAFREVYEETGIRVKNLRLINVFSGANYFTKLANGDEFQSVTTAYYTDEYDGDFVMNKEEAVQLKFFPLTELPDYIVGSHKKMISEYMKIMEKKI

SEQ ID NO: 24986 - protein, 1100 aa, Pseudomonas aeruginosa
MARREKPVFLNDPQWYKDAVIYQVHVKSFYDANNDGIGDFAGLIEKLDYIADLGVNTLWLLPFYPSPRRDDGYDIAQYRGVHSDYGSLADARRFIAEAHRRGLRVITELVINHTSDQHPWFIRARHAKKGSRARDYYVWSDSDEKYQGTRIIFIDTEQSNWTWDPVAQQYYWHRFYSHQPDLNFDNPQVLREVLGVMRYWLDMGVDGLRLDAIPYLIERDGTSSENLPETHQVLKRIRAELDAHYPDRMLLAEANQWPEDTRPYFGGEDGGEGDECHMAFHFPLMPRMYMAIAQEDRYPITDILRQTPDIPANCQWAIFLRNHDELTLEMVTDDERDYLWNHYAADRRARLNLGIRRRLAPLVERDRRRIELLHSLLLSMPGTPTLYYGDEIGMGDNIYLGDRDGVRTPMQWSVDRNGGFSRADPAKLVLPPILDPLYGYQTINVEAQARDPHSLLNWMRRLLAVRSQQKAFGRGSLKMLAPSNRRILAYLREYAEGERQDSILCVANLSRAAQAVELDLASHAGKVPVEMIGGMSFPPIGELTYLLTLPPYGFYWFYLADATQMPSWHVAADERLPELPTLVVKQRLGELLQGASRNILEGETLPAYLPKRRWFAGEKGQPRLCYIVPLDEAEPRCALCEVEIDGLRYQLPLGFLDADQRGDSLPQLLALARLRRGRKVGLLTDAASLPLFARKVLAQLRAEAVIAHGDGEIQFIPAAGLAELDDIADEDVLPFSVEQSNSSIRFGERMVLKVLRKILPGLHPEIEVGGYLTRHGYPGIAPLLGEVRRVGADGEPHTLMILQGYLNNQGDAWNWTLDNLERAVRDEISAASEALEGQYDSLAELRGFAANLGARLGEMHSVLAGESDDPAFGSRESDEASVQAWALRIAEQLREAGKRLSEPPRPLQGEAAEQARRLLERLPALLERLPLLARQAAGGLLIRVHGDLHLGQVLMVQGDARFIDFEGEPARSLEERRQRHSPMKDVGGMLRSFDYAAAMVLRNAQSTDSSEQADSARRKVAMRYRSEARDAFLVGYRAAAAGLAHAWHGREGEGAALVLACLEKAAYELLYEADYRPDWLEVPLAGLAELTEHLLKGKNR

SEQ ID NO: 24987 - protein, 701 aa, Unknown
  Magnetococcus sp. MC-1
MFNIHTKSVQFGEKTITLETGRVARQANGAVMVTYGDTVVLVTAVAETSMRAGQDFFPLSVHYQEKFWAAGKIPGGFIKRETRPSEREVLTSRLIDRPIRPLFPKGFMNETQVVAQVLSYDPDYPSDIAALIGCSAALALSGVPFEGPIGGARVGFIDGKPVLNPTVDQLAASRLDLVVAGTRSAVTMVESEVDFLSEDEMLDCVMFAHESFQPVITAIEELVAEAGKPRWVVEPVQVNEALLAEMNDKFAAQVTEAYAIPEKMARYEAVAQVKAAAMEALGTIEVDGQSVKRSEEVASLFKKIESRTLRQNVLQGKRVDGRGLTDIRPIACEVSILPRVHGTALFTRGETQAIATVTLGTSRDEQIVETLSGEYRDRFYLNYTFPPYCVGETGRMGAPGRREIGHGKLATRALTAIVPSAEVFPYTLRITSEITESNGSSSMATVCGAVLAMQDAGVPIKAPVAGIAMGLVKEGDAYAVLSDILGDEDHLGDMDFKVAGNADGITALQMDIKITGITREIMAKALEQARAGRLHILGEMGKAMTTHRAEMSAYAPRIHTMKIHPDKIREVIGSGGKVIRSITEETGCAIDIEDDGTIRIASSDQASAEQAVKIIKSIVAEVEKGQVYEGKVVRITDFGAFVNILPNKDGLVHISQLANRRVQNVTDVVKEGDVVTVKVLDVDRQGRVKLTMKEMEEGAAE

SEQ ID NO: 24988 - protein, 626 aa, Prosthecochloris aestuarii
MSSDRLAIIAASQQGIMTALRLKQELAACGTTEVALFSPRAGAESTRISSITEWTAEEFHNWDALVYIGALGICVRAVAPVLQSKKSDPAVINCDEQGRFVQSVLSGHYGGANDLARRVSRMLGAQPVITTSSDVQGLWPLDILGRDEGWGAEYRAGLEGRSLTDAQAAFVNHEPTVLLLDVRDELTDRLERTCPDFVTVAYRYEDVDVESCSLLLAVTPFLYEPPVQAVFYRPRVLCVGLGSEKGIDPERFVGSFLHRLREKRLSYQSVTALATVDFKVQEPAFQTLTRELGIGLHGYDAQALEAVGGVPNPSETVFQKVGIHSVSEAASALLAGHEEWIVEKQKVALDYVEKGQPRHFTFAVSMKQDALRRGHISIVGAGPGDPGLVTVRGRELIEAADLVLYAGSLVPEKLTEYAHAGALVRSSASMSLEEQFELMKRFCLQGKQVVRLHTGDPCIYGAIQEQIAWFEAHEMPYDIVPGVSSFQAAAAALNSQFTVPEKVQTIILTRGNGRTPVPEKERLRDLARARATMCIFLSAEWADQVQRELEAEYPPTTPVAVCYRLSWDDQQVWRGELGSLAAMVRESGKTRTVLLVVGEAIGARQNRSKLYDPHFTHGFRRSAREE

SEQ ID NO: 24989 - protein, 155 aa, Zea mays
  misc_feature (45)..(45): Xaa can be any naturally occurring amino acid
  misc_feature (56)..(56): Xaa can be any naturally occurring amino acid
  misc_feature (121)..(121): Xaa can be any naturally occurring amino acid
  misc_feature (143)..(143): Xaa can be any naturally occurring amino acid
MRRMPDIWYLQIKNKTYPKFNYCRGVPDPKIRIYDVGMNIKGVDXFPYCVLLVSCXKENASTEALEGARIACNKYMTKSAGHDAFHLRIRCHPFHVLHINKMLSCAADDMLQTEMKSAFGXPLGTCAMTDIAQDLLSDRCNAXNAAHASESLHHA

SEQ ID NO: 24990 - protein, 511 aa, Glycine max
MEAPSPTKPNDPTKPSNTSTTLSLEAGPAQASPLRKMFAVASIAAGIQFGWALQLSLLTPYVQLLGVPHAAASFIWLCGPISGLVVQPIVGYYSDHCTSRFGRRRPFILGGALAVAVAVFLIGYAADIGYAAGDDISKTTRPRAVGVFVIGFWILDVANNMLQGPCRAFLADLAAGDQRKTRIANGFFSFFMAVGNVLGYAAGSYKGLHKMFPFTETKACDVFCANLKSCFFFSILLLLFLATVALLYVKDKQVEARALDDATQPSCFFQLFGALKELKRPMWMLMLVTAVNWVGWFPYFLFDTDWMGREVYGGQVGEDAYAKGVRVGSLGLMVNAVVLGFMSLAVEPLGKMVGGVKRLWAIVNFILAIGFGMTVVITKVAEHQRKMNPAAVGHPSEGVVVGSMVFFGVLGVPLAITFSVPFALASIYCSASGAGQGLSLGVLNLAIVVPQMVVSTLSGPWDALFGGGNLPAFMVGAAAAALSAIMAIVLLPTPKPADEAKASSMMAGGFH

SEQ ID NO: 24991 - protein, 448 aa, Pyrococcus furiosus
MGKHYIPNSAHKEEMLKEIGFSSIEELFADVPEGFIREFNVPEGKSEYEVFMEMNEILSKNKTVLEMPTFLGAGTYFHYVPAHVKYLIERSEFLTSYTPYQAEISQGMLQALFEYQSLIAELVGLPVVNSSMYDWGSALGEAALMTVRLHRGKRLKFVVPKHTHPERMQVLKTYTRGANLEIVEVKWNDRGQVDLEDLKEKVNDAAGVYVEIPNFFGLLEENIQEIGEIAHEAGAYFVVGVDPTILGVVEAPGELGADIVVGEASYFGSPMNFGGPRAGIFATRNDPKFIRQMPGRIIGMTKDAEGKRAFVMTLQTREQHIRRAKATSNICSNEALVAVAAAIHIASLGPKGMQELGEVILKNTAYLKKRLSEVAEIPFDGVNFKDVLVKFEKPYQEIHEHLLQKNIHGGYYVKPHFPELGESALFAATETTRKEWIDALIDALREVL

SEQ ID NO: 24992 - protein, 636 aa, Blastopirellula marina
MVNRNLIRNLESDDTLTSLIDNWVQDAEANVFDEFEHEESVELNKIVDGTILRVDDEFVLIDVGGKSEGSIPRDEWDEEDEDPPKIGDKIKVLVEDIEDEFGRTDDPHGMITLSKRKAQKIIEWDTTMSSIEEGNVVEGTVVRKIKGGLLVDIGVNVFLPASQVDIRRPSDIADYIGKKVECEVLKIDEERRNIVVSRRSLIEKKRQKDRDSLLQELEIGQRRKGVVKNIADFGAFVDLGGIDGLLHITDMSWGRIGHPTEVVKIDDEVEVQILNIDHERQKIALGMKQMQPSPWDGVEGKYPVGSKVRGQVVNVMSYGAFVKLEEGIEGLVHISEMSWTKRISHPSEVVNIGDEIDVVVLGINKEKQEISLGMKQTQSNPWENIKERYPVESIVKGKVRNLTNYGAFVELEEGIDGLLHVSDMSWTRKIGHPSEMLEKGQEVECKVLNIEEDRRRIALGLKQMDLDPWASSIPDKYQPNQLVKGKVTKITNFGVFVGLEDGLEGLLHISELADEKVENPEDVVKVGDDIEVKILRVDTDERKIGLSRKRVQWAAEDEAAAAAAEATAEKDQQELKGGLGSSGPLFSASAPTEEAEAKPEAAEAEAEPAEAEATTEEADAEAKPAEAEAETKNEEG

SEQ ID NO: 24993 - protein, 502 aa, Pyrococcus furiosus
MFRQAKWDEPLIFELSRPGRVGYTLPKPIEDIKVDIPEKLRRKSKLELPELSEPEIVKHYTRLSEMNYGVDSGIYPLGSCTMKYNPKINEEIATHPKVAYIHPYQDERTVQGALAIMWELEQWLKEITGMDRFTLQPAAGANGEFTGVMIIRAYHLDNGEPQRNEMLVPDSAHGTNPASAAMAGFKVIEIPSNENGTIDLEALENAVSERTAGLMLTNPNTLGIFEDEIVEIAKIIHKAGGLLYYDGANLNGILGKIRPGDMGFDIVHLNLHKTFSTPHGGGGPGAGPVGVKEFLKDYLPVPLVSYDEKSGRYYLDYNVPKSIGKVKELYGNFAVLVRALTYLKIMGRDGLREVSEIAVLNANYLTQKLKGTRGYSLPGKELRKHEVVFSAEPMKKETGVKALDVAKRLLDFGMHAPTIYFPLIVHEALMIEPTETVSKEELDAYVEALKRISEEAYTNPEIVKSAPHNTAVKRVDDVLAAKKPIVTWRMYKELKEKGEVDY

SEQ ID NO: 24994 - protein, 96 aa, Cronartium ribicola
VWIDGDGGLRCKTTTMDLPSSGEVTVADCKEWNFDGSSTNQAAGTDSDVFLRPAAVFKDPFRGGKNVLVLAECYNADGTPNKTNHRYAAKKTMDAA

SEQ ID NO: 24995 - protein, 123 aa, Corynebacterium nephridii
MMFKFALYFLNLEQPYSATIVNTTDENFQADVLDAETPVLVDFWAGWCAPCKAIAPVLEELSNEYAGKVKIVKVDVTSCEDTAVKYNIRNIPALLMFKDGEVVAQQVGAAPRSKLAAFIDQNI

SEQ ID NO: 24996 - protein, 685 aa, Yarrowia lipolytica
METPSLAQSDSSGVSLLQLAGDIEETPRVMTIGSARDTNPTDTCADDAHRPSTNTSTSHPQDTRYNSNLRLETANTDSYVSVCDLDNYGTASLRHSPSRDTTLDPTYTTRHDITTVTTPHTSHTETSPLLKKPTSMTTDVADSEEGEIISLPDLPEDVPHISDKIPYSAYLVAVVELCERFTYYGLSGPFQNYIQNPREGRLPGALGLGQQKAVALLYAFQFWCYLTPIFGAIIADSYWGKYKTILRFAIVNVIGVFVLVISSLPVNIDNGWALPGLLLAMVIIGLGTGGIKANVSPLIGEQYRNEKYRLVYTKNESQAIISPVVTIQSIFMIFYYCINIGCLAPMITSYVEMKVDFWAAYLIPGVFFFFGMAALVMGRNMYYCAPVKGSVVPDAVAVSWMLFKERGNKCDTETSALPRDTDAESSSRTSQESLLSQDLETSPEFISSVDTTISPRAMYVSKASGNKYSASFVQDIIVTLKACRVFLFYPVYWLVYGQMTSNFIAQAGQMNTYSIPNDIMSNIDPITLLLFIPIVEKKLYPWLRSRGYSFGPLARIFTGFLCAALAMVWACGVQVFIYRGQADTKIDEVGVENLVSVFWQVPAYIFIAFSEILASVTGLEYAFLNAPKTMKSLVMSVFLVTNAGGYAMGIVISPWFKDPYMVTCYFWIAALTFATGALFRYCFRD

SEQ ID NO: 24997 - protein, 368 aa, Oryza sativa
MVRRSLRLLLSRGCHRVISIAGSCGVVARSSAPPLSPSSSHLHPRPPCLRHHRASRRRLLLLLRLKGNEREREGRGWKGNMEVDNPLPQRVARARPLTEKEEETRRLGGGRVALWGAGSGGKANENLVLPAPHPRHVTDPRPTHPSRRFRTQRTLPMCSTSSIRGTPPPTNRAPPLHRYKIANSSSPHNTIQSPNQKHTRLASFRSFRPTPPPPPPISMAPKAEKKPAEKKPAEEKAGEKAPAAGKKPKAEKRLPASKGEKGGEGKKERGRKKAKKSVETYKIYIFKVLKQVHPDIGISSKAMSIMNSFINDIFEKLAGEAAKLARYNKKPTITSREIQTSVRLVLPGELAKHAVSEGTKAVTKFTSS

SEQ ID NO: 24998 - protein, 239 aa, Guillardia theta
MIRYWDFVIKKLNFNIKTYNLNFKSLNRNFDPYQNNGGLVLAITGNKFCVMASDTRISMGYSIPSRLNLRILKISNLCLLGSSGMISDINILHQKLRNEIFRLKYLNNTELNLNGIVYLTSSLLYSRRFFPFYTFNILTGINELGKASNYTYDAIGSFDCNHASTVGNCQSSAQCIMDYIEERKIPNDRNYKTILQVVSLIKIIFSTLCNKQVDMGDILQLFIVSKKGILVENSILRLD

SEQ ID NO: 24999 - protein, 579 aa, Legionella pneumophila
MNWGEGEWNSFFHFFTKEFINMSESFKELFEQSIAGAQFYPGAIITAKVIDIDDDFVTLNAGLKSEGIVAVEEFYDKNGELEVKVGDTVEVALDSVEDGHGETLLSREKAKRQEAWRKLSKCHENNETVTGLISGKVKGGFTVEIGSIRAFLPGSLVDVRPVRDPSYLEGKELEFKVIKMDLKRNNIVVSRRAVVEEESSADRQALLESLHDGQELHGIVKNLTDYGAFIDLGGIDGLLHITDISWKRVKHPSEVLSVGQDVKVKVLSFDSERNRVSLGMKQLGNDPWVDLVERYPIGKRLQGKVTNITDYGCFVEIEEGVEGLVHMSEMDWTNKNVHPSKVVSLGDVVDVMVLEIDEERRRISLGMKQCVGNPWQQFASTHNKGEKVKGKIRSITDFGIFIGLDGDIDGLVHLSDISWTVPGEEAVKQFKKGQELEAVILAIDPERERISLGLKQLEGDSFASFAETYTKGSIVKGTVTAVEPKTVTVALAEDVSGTIRVSELSDERVDDATTIVKVGDEVEAKITNIDRKNRTISLSVKAKDAQDEADAIKKYSRTEAASTTLGDLLKEKMASKEGE

SEQ ID NO: 25000 - protein, 445 aa, Bacteroides fragilis
MNIEKIMSSLEAKHPGESEYLQAVKEVLLSIEDIYNQHPEFEKSKIIERLVEPDRIFTFRVTWVDDKGEVQTNLGYRVQFNNAIGPYKGGIRFHASVNLSILKFLGFEQTFKNALTTLPMGGGKGGSDFSPRGKSDAEIMRFCQAFMLELWRHLGPDMDVPAGDIGVGGREVGYMFGMYKKLTREFTGTFTGKGLEFGGSLIRPEATGFGGLYFVNQMLQTKGIDIKGKTVAISGFGNVAWGAATKATELGAKVVTISGPDGYIYDPNGISGEKIDYMLELRASGNDIVAPYADEFPGSTFVAGKRPWEVKADIALPCATQNELNGEDAKNLIDNNVLCVGEISNMGCTPEAIDLFIEHKTMYAPGKAVNAGGVATSGLEMSQNAMHLSWSAAEVDEKLHSIMHGIHAQCVKYGTEPDGYINYVKGANIAGFMKVAHAMMGQGII

SEQ ID NO: 25001 - protein, 560 aa, Propionibacterium acnes
MPTLIDATSTPAWGTLSGLKSRFADGPHKLRRLFDADPHRAERYTLDVADLHVDLSKNLLTDEIRDALLELAAQMRVTERRDAMYAGEHINVTEDRAVLHTALRRSRTDELHVDGQDAVADVHEVLDKIYAFADKVRSGEWKGVTGKPIRTVINVGIGGSDLGPVMAYEALKPYVKDGLECRFISNIDPTDAAVKTADLDPETTLVIIASKTFTTLETLTNARCVRAWLLDGLVAAGAISDTEQARRDAVAKHFVAVSTALDKVEEFGIDPVNAFGFWSWVGGRYSVDSAVGTSLAVAIGPKGFEDFLAGFHAVDEHFATAEPERNVPLFMGLLNIWYTNFWDAHSHAVLPYSQYLHRFPAYLQQLTMESNGKSVRWDGSAVTTDTGEIFWGEPGTNGQHAFYQLIHQGTRVIPADFIAVANPVHPTKDGGTDVHELFLSNFFAQTAALAFGKTADEVRAEGTDEAIVPARVFAGDRPTTSIMADELSPKVLGELIALYEHITFVQGVVWGIDSFDQWGVELGKKLALQIAPAVSGNDEALATQDPSTQGLVTWYREHRR

SEQ ID NO: 25002 - protein, 657 aa, Coprinopsis cinerea
MATDSQMTVARAGKSLPPAPLSKATRQVVPAFLQKLYEMVNDPKNSDLIRWSDTGDSFFVLDHERFAHDVLGRWFKHRNFSSFVRQLNMYGFHKIPHLQQGVLKSDNETEFWNFAHPNFHRGQPDLLCLIQRKKASSQQVNNDDIDLRDSTPTANGQVLDIQSVINGITAIKRHQTTISAELNELKRSNQLLWQDAMAARQRYQKQQDTINRIVKFLAGVFGSTVNRTKDGSPEPHVVIPRRAARFLIEDAKREGKGIVELDDLYAPEDMATPISITSVESDNHVETTPVPQPAPVQPEPEPKPTDRAVTPRQPSPSYDFDPRVHGMLSQLTQSQIQTLLNTLASQPLGDANTASSNPTSSTHLTPYQPPPFDFSMIPSTPGTSNESHVPVVSPPAAPPTEGLISFNSFDGFPTERMERQWQQAEDIDRDVNALNTSIHSLIQTFGLDPNMFDSMDTSTDPTNPTNPAAPNPSVSIDHNAHPPTAPNVSAPSADTMAGPSGALSNDLGPVPPADFDFDAFLNTLPSASANDGMDYTDAASTAFLDEVPSPASTTTSPVQNLRGLSPEISTNGGSGLAVPQPVIPTANAGTKPPTASPGLGRKRKSDVSELDGGALAMQFQTVTPSAILPGVTGSPHLHSASLSTNAANSKSKRRKEK

SEQ ID NO: 25003 - protein, 258 aa, Arabidopsis thaliana
MVFAHLNLLRKIVGIIGNFIALCLFLSPTPTFVRIVKKKSVEEYSPIPYLATLINCLVWVLYGLPTVHPDSTLVITINGTGILIEIVFLTIFFVYCGRQKQRLIISAVIAAETAFIAILAVLVLTLQHTTEKRTMSVGIVCCVFNVMMYASPLSVMKMVIKTKSVEFMPFWLSVAGFLNAGVWTIYALMPFDPFMAIPNGIGCLFGLAQLILYGAYYKSTKRIMAERENQPGYVGLSSAIARTGSEKTANTNQEPNNV

SEQ ID NO: 25004 - protein, 166 aa, Brassica napus
ESNRDESYLRANEDAHDLLMSTHSALSRNSRGTHTSSTRSAMTNKFDVEELEMLLEAYFVQIDGTLNKLSTLREYVDDTEDYINIMLDDKQNHLLQMGVMLTTATLVMSAFIAVAGVFGMNITIELFKDEKAGPTRFAWTVIGGFIGSIFLYVGAIGWWKQKRLLE

SEQ ID NO: 25005 - protein, 335 aa, Alteromonadales bacterium
MSTATSAVTVLGAGSYGTALAICLARNGHKVTLWGRNSDDVATLAAERKNQRYLPDASFPDTLVLEDDLQRAVACSAIVLVVVPSHAFGDTLAQIKPALQIDAKVAWATKGLEPNTGRLLQEVAQQELGDEIALAVLSGPTFAKEMAMGSPTAISVSSTSPEFAQQLADLLHCGRSFRVYNNDDFIGIQLGGAVKNVIAIGAGISDGVGFGANARTALITRGLAELTRLGCALGAKPETFMGMAGLGDLILTCTDNQSRNRRFGLALGKGESVETAIESIGQVVEGFRNTKEVYLLAQRAGVEMPITEQIYKVLYENKDMKAAAMALLGREQRSE

SEQ ID NO: 25006 - protein, 485 aa, Gossypium hirsutum
MPDSEPIFLLLPSILSLILFFILIKRKQRRYNLPPGNMGWPFLGETIGYLRPYSATSVGEFMHQHISRYGNIYKSNLFGEKTIVSADAGLNKFILQNEGRLFECSYPRSIGGILGKWSMLVLVGDMHRDMRIISLNFLSNARLRTHLLREVEKHTLLVLNTWKEKCIFSAQDEAKKFTFNLVAKNIMSMDPGHPETEQLKKEYVTFMKGVVSAPLNLPGTAYRKALQSRSTILKFIEKKMEVRIRKMKEGKENSEEDDLLEWVLKHSNLSTEQILDLILSLLFAGHETSSVAITLAIYFLPGCPLAIQQLREEHLEVARAKNQSGETELNWDDYKKMEFTQCVINETLRLGNVVRFLHRKALKDIRYKGYDIPCGWKVLPVIAAVHLDPCLFDHPQLFNPWRWQQNNGSRGAGTATSSASSSNYFMPFGGGPRLCAGTELAKLEMAVFIHHLVLNYQWELADTDEAFAFPFVDFPKGLPIRVFKS

SEQ ID NO: 25007 - protein, 931 aa, Unknown
  Mesorhizobium sp. BNC1
MTATFSTRHIGPRSDETKAMLAFLGLPSLETLISQAVPKSIRLDRPLNLPEAASEAEALAELQAYMRENKVLKSFIGAGYHGCHVPPVIQRNLFENPAWYTAYTPYQSEISQGRLEMLFHFQTLVTELTGLPVASASLLDEASAVAEAVGIAWRHHKSKRNRIVIAGALNPQTRDVVETRAEPLGIEIATNIELDGDTFALIVPWGDTYGAYEDHSALIGEAKAKDAIVIFVADPLGLLLSDTPAALGAEIAVGPMQRFGVPMGFGGPHAAYCAVSDRLTRLMPGRLVGQSVDAHGRPGYRLALQTREQHIRRDKATSNICTAQALLANMAAAYAIWHGPEGLKAIATHVHGLAARLHAGLKAAGLELAGEKIFDTVTVTVPGKAAAIAAEAEKTGSLLRVIDADRVGITFDEISTEADLESIAKLFGITVPAAAPAIAPSQPRGEHFLTQPVFHEHRSETEMMRFLRRLSDKDLALDRAMIPLGSCTMKLNAAAEMMPVSWPEVNGLHPFAPDAHTVGYRRMVGELEGWLAEITGFDAVSLQPNAGSQGEYAGLLAIRRYFRERGEDHRDVCLIPSSAHGTNPASAAMAGMRVVVVRCLEQGDIDPEDLKAKAEEHSSRLAALMITYPSTHGVFEEGVRDMCALIHEHGGQVYLDGANLNALVGLARPGDLGADVCHMNLHKTFCIPHGGGGPGIGPIGVKAHLQPFLPGHVELGSAHAVAAAPFGSASILPITWMYIRMMGAAGLKRATEMAILNANYIAGRLEAYYPVLYRGRNGRVAHECILDTRVFKERAGIGVEDIAKRLIDYGFHAPTMSWPVAGTLMVEPTESEPKSELDRFCDAMISIAGEAGRVEKGEWPKDDNPLVNAPHTAAELMADTWSHPYSRAEAAFPSGSMDWAAKYWPPVSRVDNVAGDRNLVCACPPIEALAS

SEQ ID NO: 25008 - protein, 608 aa, Unknown
  Frankia sp. EAN1pec
MQNCAPTETPEVDHDALRTKYLGERDKRLRREGQKQYLVTEGDFEEFYEADPYTPVVPRTPIVEDIDVAILGGGWAGLVAAARLKQEGVTNFRIIELAGDFGGVWYWNRYPGIQCDTDAYCYLPLLEEVGYIPKEKYARGDECLEHAQRIGKHFGLYEHGVFSTLVRSQEWDERTNRWKITTNRGDEISARFVVMCQGPFNRPKLPGIPGIADYQGHTIHTARWDYEYSGGDLHGGLDKLAGKKIAVIGTGASGVQVIPHIAQTAEHLYVFQRTASSIDERGDVPTDPEWAATLQPGWQEERRRNFHAAAYEAFAPGQPDLICDGWTEISRNLQAQLDATNGWAALADPAKFMELRELVDYQVMERLRQRIDAIVEDPVTAEALKPYYRFLCKRPCFNDLYLPTFNRPNVTLIDVAETKGVERITAKGIVAHGVEYEVDCIVFASGFEITSDLDRRLAIHPYAGREGRSLYEHWVDGYRTLHGIMTHGFPNQFFTGYIQGGVTAAVPAMFEQQAVHIAHIISETLGRGAVTVEPTFDAQERWVAAVRAAEIDQTNFARECTPGYYNNEGEQRIRSVLGDPYWAGFYAFGELLQEWRDSGDMAGLVLGK

SEQ ID NO: 25009 - protein, 255 aa, Methanosarcina acetivorans
MSENYGKVYLVGSGPGDPELLTLKARRLIDNAEVIVYDQLPGKSILGSMPKSAEKIDVGKYAGNHTMTQSEINEVLVWKAKEGKMVVRLKGGDPYVFGRGGEEAEVLVAEGIEFEIVPGITSAIAVPAYAGIPVTHRESTSMVTFITGHEDPTKEESGLDWETLAKFDGTIVIFMGVKMLRRNTEELMKYGKDPKTPVAVIERGTRPDQRVTVGSLENIADLAEERKVKAPAITVIGDVVNLHAILGEQIAGKDF

SEQ ID NO: 25010 - protein, 120 aa, Vibrio vulnificus
MNAFREDAMKLINAIIKPFKLDDVREALADVGIEGMTVSEVKGFGRQKGHTELYRGAEYQVDFLPKVKLEIATQAENVDRVIEAITKAAHTGKIGDGKIFVYDLSHAVRIRTGETDVEAL

SEQ ID NO: 25011 - protein, 495 aa, Mycobacterium avium
MVTDRFDAIIVGAGFGGIGAAIQLKRLGFDNIVILDREDDLGGTWHVNHYPGIAVDIPSTTYSYWFEPNPGWSRLFAPGGEVKQYAADVADKYDVRRHMRFNTTVEGAQWDEDAEVWRVALAGGESLTTRFLITATGFLSQPHTPDIPGIGSFGGKVVHTTAWDHDYRYQGRRIAVIGTGASAVQVVPELAKEAGELTVYQRTATHVLPKVDFEFDPAVRRLFARVPAAQRALRWVTDVLLEIIMIVGALHFKESRGRGNISASDLAKINRFRWIRDKELRAKLTPDYDCGCKRPTFSNSFYRVLTQPNVHLETNPIERIEPDGIVTADGRKTVIDTLVLATGFDLWEANFPAIEVIGRKGRNLGKWWRETRFQAYQGVSMPYFPNYLSLASPFAFSGLSFFHTIEYQMRHMDRLLGEVKRRGATIFEVTEEANDRFMERMTKLLDNSVFYAGNCATSRSYYFSPSGEASLLRPTSTLNSIREASSFPLSDYVIA

SEQ ID NO: 25012 - protein, 373 aa, Clostridium perfringens
MYTPYGTTYNSYVVKGSEKTAIFETVKAEFFDQYIARLKDLGVEPSEIDYIVVSHTEPDHAGSIGKILELAPNAKIVASPIAINYIKEIVNGDFESIPVKDGDSISLGNKTLKFMSVPFLHWPDTIYTYVEEDKTLITCDSFGSHYSCEEMFDDLIPNEEEYMEALKYYFDCIMGPFKPYVLKALDKIKGLDIEIICPGHGPILRSNPYKVVNLYKEWSTPAPAKEVKKASIFYVSAYGYTKQLAEKIAEGIKSTGNLDINLFNIIEHDMTELVGEVGSSDAILFGSPTIVNELVEPVRDLMAKLNPVVHGGKIAGAFGSYGWSGEAVPRIESRLKELRMKMPVEGLRIKFKPSEEEAQKAFDFGVEIGNALK

SEQ ID NO: 25013 - protein, 253 aa, Prosthecochloris aestuarii
MSETHNGGRVVIAGAGPGDPELLTVKAARRLQQADAVLYDSLVTREILDLAAKGADMVPVGKRCGDGQDQTQRQNAINELMLDYARRGALCVRLKAGDPFVFGRGVEEVRFLTERQVTVEVIPGISAGIAAANLFHVPVTERYRTSSVILSTGHTSTCSMEEFDSVVALLKQGTPLVLYMGMKHLECICQRLLDAGFSPDFPLCAASRVSMPDQQLICATLGTICLLLVKTPLPTPVVFFVGEHAVPISQQTV

SEQ ID NO: 25014 - protein, 500 aa, Prosthecochloris aestuarii
MERVTIALVHADIRHRDVAANRRELLNLNREAAGNGADIIVNTELGLTGYSFRSREDIAPLVEEYDGPVVQELSLIASRYGCYIVFGYAEKDAGTDIYYNAAAVIGPDGRLLLNYRKVTAEVRWACAGSPGQPNTFDTPWGRIAVVICSDTYYGSLARMSALRGADLLLVPANWPAGSLDPRELWQVRARENGVYLAACNRGGHDRTMSCEDAWSSVYSPDGEELFAASSCNSRVFSVQIPLENGMIPSKRARRLASRTPARYAPIYLDMRYATDMTSYCNLPEPGPLTVTCLPADPHDLFIQGRLDMLLDEQAGQRPDLLVLPAGETADRERTAGLVSGMASRLRVAVCTAIPGPEGFSMLCAEASGQLHVVREGCPESVMIDLDKARIALAGREELYHPEYVTALAKQGCDLVVCSTRSCNALDRSVLGSRSIEQVAVAVCSPDNAFICKPPIGHYRWEEVYTVSASHPCTAELDISLLRNKHFYDRLEFDLLLGKQN

SEQ ID NO: 25015 - protein, 339 aa, Zea mays
MPNLECRMYEQRFPEVDAAVMIQVKHIADMGAYVSLLEYNNIEGMILFSELSRRRIRSISSLIKVGRQEPAIVLRVDRDKGYIDLSKRRVSEEEAHACEDRYNKSKLVHSIMRHVAETLEIDLEPLYQRIGWPLYRKYGHAFEAFKLIVADPDAILDALTYEEKEVGPDGQEVTKVVPAVTPEVKDSLVKNIRRRMTPQPLKIRADIEMKCFQFDGVLHIKQAMKKAEAAGNDNCPVKIKLVAPPLYVLTTQTLDKDQGISVLTTAVKACTAEIEKYKGKLVVKEPPRAVSEREDKLFLDQIDSLMEQNAEVDGDADSEEEEDTGMGDVDITNSGVAAY

SEQ ID NO: 25016 - protein, 497 aa, Unknown
  uncultured archaeon GZfos18C8
MRNVMPAGTLPADTLPAGTLPVAVAFGTCLTSCPYFAQASQTFNSVPSRITRCAFPRMLLPHISHCIGIAYHPIFHKGLCVVRIFSLIMDLEMDVDADIDSTEFSKYVVDRMQQLELKNNLLEKQYQKVETEKQLAEDQRLKYERELRKLRSELDKLKTTPQLVGTLVNVLEEGKSIVRSSTGPEFIVGSSQFIKDGDLKPGVQVALNKEHLSIVAVIPGSEDPLVQAMEVIESPDIDYNQIGGLDKQIEVLRGAVEFALTKPEIFERIGIDPPKGVLLFGPPGTGKTLLAKAVATRTDATFIRVVGSELVQKYIGEGARMVRDVFEMARKKAPAIIFIDELDSIGAVRLDDASSGGREVQRTLMQLLAEMDGFNSRGDVCILAATNRWDILDPALIRPGRFDRLVYVPIPDREARVKILLIHTKKMRLAGDVDFDRIVTLTEDANGATLRAIVMEAGMCAVREDADAVYQKDFEDAIKHIMNPEGMVDRYSEGMFV

SEQ ID NO: 25017 - protein, 417 aa, Escherichia coli
MLEQMGIAAKQASYKLAQLSSREKNRVLEKIADELEAQSEIILNANAQDVADARANGLSEAMLDRLALTPARLKGIADDVRQVCNLADPVGQVIDGGVLDSGLRLERRRVPLGVIGVIYEARPNVTVDVASLCLKTGNAVILRGGKETCRTNAATVAVIQDALKSCGLPAGAVQAIDNPDRALVSEMLRMDKYIDMLIPRGGAGLHKLCREQSTIPVITGGIGVCHIYVDESVEIAEALKVIVNAKTQRPSTCNTVETLLVNKNIADSFLPALSKQMAESGVTLHADAAALAQLQAGPAKVVAVKAEEYDDEFLSLDLNVKIVSDLDDAIAHIREHGTQHSDAILTRDMRNAQRFVNEVDSSAVYVNASTRFTDGGQFGLGAEVAVSTQKLHARGPMGLEALTTYKWIGIGDYTIRA

SEQ ID NO: 25018 - protein, 304 aa, Moorella thermoacetica
MVYDLMIIGGGPAGLTAALYGARGGLNTILLEMGAPGGQAGQTDRIENYPGFPDGITGIDLAMKFAEQAQRFGARLEMTTVREVDFSGANKKVITSNGEYEARAVIIASGAHPRPLGVPGEAELRGRGVSYCATCDGAFFRDKKVAVVGGGDSAVEEALFLTRFASQVTIIHRRDALRATRVIQDRARDNPKISFQWNTVVNAIQGKDKVSSLQLKDVRTGALREEPFDGVFIFIGLEPNTDFLGGALTLDPDGYIVTREDLATSIPGVFAAGDVRAKNFRQVSTAVGDGAVAAMAAERYLANL

SEQ ID NO: 25019 - protein, 694 aa, Chlamydophila pneumoniae
MNFQTISINLTEGKILVFETGKIARQANGAVLVRSGETCVFASACAVDLDDKVDFLPLRVDYQEKFSSTGKTLGGFIKREGRPSEKEILVSRLIDRSLRPSFPYRLMQDVQVLSYVWSYDGQVLPDPLAICAASAALAISDIPQSNIVAGVRIGCIDNQWVINPTKTELASSTLDLVLAGTENAILMIEGHCDFFTEEQVLDAIEFGHKHIVTICKRLQLWQEEVGKSKNLSAVYPLPAEVLTAVKECAQDKFTELFNIKDKKVHAATAHEIEENILEKLQREDDDLFSSFNIKAACKTLKSDTMRALIRDREIRADGRSLTTVRPITIETSYLPRTHGSCLFTRGETQTLAVCTLGSEAMAQRYEDLNGEGLSKFYLQYFFPPFSVGEVGRIGSPGRREIGHGKLAEKALSHALPDSATFPYTIRIESNITESNGSSSMASVCGGCLALMDAGVPISSPIAGIAMGLILDDQGAIILSDISGLEDHLGDMDFKIAGSGKGITAFQMDIKVEGITPAIMKKALSQAKQGCNDILNIMNEALSAPKADLSQYAPRIETMQIKPTKIASVIGPGGKQIRQIIEETGVQIDVNDLGVVSISASSASAINKAKEIIEGLVGEVEVGKTYRGRVTSVVAFGAFVEVLPGKEGLCHISECSRQRIENISDVVKEGDIIDVKLLSINEKGQLKLSHKATLE

SEQ ID NO: 25020 - protein, 96 aa, Cronartium ribicola
DWNGAGAHTNYSTEATRAPGGIKAIHEYIEKLGKRHNEHIAVYGEDNDMRLTGRHETGHIGSFSSGVAHRGASIRIPRHVEATGQGYLEDRRPASN

SEQ ID NO: 25021 - protein, 400 aa, Escherichia coli
MKEKTIIIVGGGQAAAMAAASLRQQGFTGELHLFSDEQHLPYERPPLSKSMLLEDSPQLQSVLPAHWWQENNVHLHSGVTIKTLGRDTRELVLANGESWHWDQLFIATGAAARPLPLLDALGERCFTLRHAGDAARLREVLQPERSVVIVGAGTIGLELAASATQRRCKVTVIELAATVMGRNAPPPVQRYLLQRHQQAGVRILLNNAIEHVVDGEKVELTLQSGETLQADVVIYGIGISANDQLAREANLDTTNGIVIDEACRTCDPAIFAGGDVAITRLDNGALHRCESWENANNHAQIAAAAMLGLPLPLLPPPWFWSDQYSDNLQFIGDMRGDDWLCRGNPETQKAIWFNLQNGVLIGAVTLNQGREIRSIRKWIQSGKTFDAKQLTDENIALKSL

SEQ ID NO: 25022 - protein, 266 aa, Brucella melitensis
MEVKPEKENKMALPDFSMRQLLEAGVHFGHQTHRWNPKMAPFIYGERNNIHILDLSQTVPLLNSALKVVSDTVARGGRVLYVGTKRQASDIIADAGNRSAQYYVNARWLGGMMTNWKTISNSIQRLRKLDELLAGEAQGFTKKERLNLEREREKLDRALGGIKDMGSVPDLMFIIDTNKEAIAIQEAKRLGIPVVAVIDSNCDPDQIDYPIPGNDDAARAIALYCDLIARAALDGIARQQGAMGIDVGAQVEAPVEPALQAPAEGA

SEQ ID NO: 25023 - protein, 191 aa, Ralstonia solanacearum
MQESTMTERQALETAVLGGGCFWCTEAVFQQVQGVHSVVSGYAGGHLERPTYRAVCGGDTGHAEVVRVEFDPAVIPYREILDIFFATHDPTTLERQGNDIGPQYRSAVFAQSPEQFAEAGATIRALSAANVFDAPIVTEVVDASGGKVPFWQAEDEHQNYFRDHPAQGYCAFVISPKVAKFRERFAHRLQA

SEQ ID NO: 25024 - protein, 707 aa, Thermoanaerobacter tengcongensis
MEERTFEMELAGRKLVVQTGKVAQQANGAAWVKYGDTVVLVTACASKEPREGIDFFPLTVEYEERLYSIGKIPGGFIKREGKPSEKAILSARLIDRPIRPLFPEGYRNDVQVIATVLSVDPDAQPEIVAMIGSSVALSISDIPFNGPTGSVAVGLVDGKFVINPTYEQREKSLMHLVVSGTKDAIVMVEAGAKEVPEETILDAIVYAHQYIKQIVEFIEGIVKEVGVPKAEVVLHEIDKELEEKVRAYATEKIYNALRTPEKKERNDNLDKVEQEVLEHFKDEYPDNLADIDEVLYKIMKEQMRKMIKEEKIRVDGRGLDDIRPIWCEVGVLPRTHGSAIFTRGQTQVLTVATLGAIGDIQILEGIGDEEFKRYMHHYNFPPYSVGEVRPLRGPGRREIGHGALAERALEPVIPSEEEFPYTIRLVSEVLSSNGSTSQASVCGSTLALMDAGVPIKAPVAGIAMGLIKEEDEVLILTDIQGIEDFLGDMDFKVAGTEKGVTAIQMDIKIPGIDRDILQMALEKARKARLYVLQKMLEVIKEPRKELSKYAPRVVRMVVNPEKIRDIIGPAGKTITKIISETGVKIDIEEDGRLYITAPNLEAGERAKQMIEAITKDIEVGGIYLGKVLRIAPFGAFVEIAPGKEGLVHISNLSKKRVRRVEDVVKVGDNILVKVTEIDKLGRIVLSRKDAMPDEEESDNRKSDNRKK

SEQ ID NO: 25025 - protein, 402 aa, Desulfitobacterium hafniense
MKANIAIVQAGGPTSVLNASLAGFLEAAASSERYHHVLGFCNGIEGLIKNQVMHLEGLSKAQLDALKSQPGAVLGAGRYPLTPERLSKVCCNLQLREISQLVLVGGNGTMWAADQIAEACPDVQIVGIPKTVDNDLWGTDHSPGYLSAAKFIGEAVRSLALDLWAMRNFERVRVVEVMGRNVGWLAAAGSLAQTSLPDYPPLHFYLPEHPFELEKFFTKVDEHLHRHPCLLVIVSEGIRLADGSPVAEFEIGRCKVPGGAAQMLSSELRNRGIPSRSEVLGILQRANTWSVCERDRQEAIFLGKQAIGVLGQGKSKVMLGLPAETVDFAEDSKAQWVDLKSVAGLERPVAPCYLTESGIDPSFTAWLQNKMGEPLAEANSALQVWKLAAEQLSSNPVNRQSR

SEQ ID NO: 25026 - protein, 820 aa, Podospora anserina
MSILQKTYDESYLTCSTAVYYESQGNEDEAMRCWRQALEQLYDPHANRILPNFNPRSETEKALVESLRQLELQCKERIDLLEALRLSRLSAPQHDSLSSSSRPSKSSSDSHDGGISGQQDGGWIGNGTIPAVNYTDLSRPNTLRRLSSQNRTSSSEQAVASSRGPQHGSMPPPLPARKPLPSTASIPSPERKPSRTSSPERHTMRTTLRTGTRDKTPKATLRRQPPKSSEVPVPSKAATLAWGTLGHRGSLDQPSGSSPISRPAPNTPTVPEQSRRSLELSKRLWDSNSRRLVTPRTRSPNKDTDSAPATDPRRSGEYPFPRASSISISAASTALNALALKESSDHRSPEREHITRLRTAPPETPRSRAQRDILNNDSNMSEGLPDKPLTRKTSLDSATVSRRSAGASLSAARIKSTPTRSGNKRKTPQLGNNSDRARPRRSSSPVLSESSSSSFETPARRPSGQHKRSTVERQREASLIVDSIIQPSESSEDDEPTKEVKSWKKRKAELLKKLPPGVDEHAAKQILNEIVIQGDEVHWSDIAGLEIAKNALRETVVYPFLRPDLFMGLREPARGMLLFGPPGTGKTMLARAVATESKSTFFSISASSLTSKYLGESEKLVRALFSLAKVLAPSIIFVDEIDSLLSQRSGSGEHEATRRIKTEFLIQWSDLQRAAAGREVGERDKERGDANRVLVLAATNLPWAIDEAARRRFVRRQYIPLPEAETRAVQLKTLLKQQTHTLSDEDINTLVAMTDALAKDAAMGPLRSLGDALLHMTENDIRPIGLSDFIASLATIRPSVSKAGLKEYEDWAREFGERGG

SEQ ID NO: 25027 - protein, 505 aa, Ralstonia metallidurans
MTAPTSDDAVLDVLIVGAGLSGIGAARQLQDRCPGKRYAILEARQAMGGTWDLFRYPGIRSDSDMYTLGYRFKPWRGAKAIADGPSILSYIRETADEAGITKHIRYGHKVVSAAWDSRSACWTIEAERTADGSRVRLRAHFLYVCAGYYSYAEGHRPTFPGEENFRGRMVHPQFWDPSIDYAGKRVVVIGSGATAVTLVPSMSQTAAHVTMLQRSPTYIVTRPGQDAIAHKLRRMLPEGLAYAATRWKNVLLGMFFFQLARRKPEKVKARMIGMAAEQLAPGYDVDTHFTPRYKPWDQRVCLVPDGDLFREIREGRASIVTDTIERFTEDGIVLASGQTLPADIVVMATGLKLNMLGDIVVTVDGVPRRPAEAMAYKGMMLSDVPNLVLAFGYTNASWTLKADLTAEYVCRLLRYMDRHGYRSAVPHVDPTVQTMPFLDFSSGYVQRAASVLPRQGDRRPWRVYQNYFMDMMTIRHGRIADGVLQFDRQGAATLPQEDALAEVQS

SEQ ID NO: 25028 - protein, 1012 aa, Bacillus cereus
MLINYSTMIITCRNVVRIFSWWSFFYSQKGGKTMNNNMVHITIDGKKYTAEPGSTILGVMNENGIEHPQICYVPEVDPIQTCDTCIVEVDGKLMRSCSTVATEGMNIERNSTRAKEAQTEAMDRLLENHLLYCTVCDNNNGNCKLHNTAELMEIEHQKYPYEPKVDVSEVDMTHPFYRYDPNQCIACGQCVEVCQNLQVNETLSIDWEAERPRVIWDEGVNINDSSCVSCGQCVTICPCNALMEKTMLGEAGFMTGLKPDILEPMVDLIKEVEPGYSGIFAVSEVEAAMRDTRTKKTKTVCTFCGVGCSFEVWTKGRKILKVQPSSDAPVNAISTCVKGKFGWDFVNSKERITKPLIRKNGTFVESTWEEALNVVASKLGAIKEEYGKDAIGFISSSKITNEDNYVIQKLARQVFETNNIDNCSRYCQSPATDGLFRTIGMGGDAGTIKDIAQSGLVIIVGCNPTEGHPVLATRIKRAHKLHGQKLIVADLRKTEMAERSDVFISPKQGTDQVWLMAVTKYMIDQGWHDQRFIDENVNFFEDFKESLTAYTLEYAEEMTGISKETLIQMAEMIRDADGTCILWGMGVTQNTGGSDTSAAISNLLLATGNYRRPGAGAYPLRGHNNVQGACDMGTLPGWLPGYQHVTNDMERAKFEMAYGVKINSEPGLNNIEMLHAIDEGKMKAMYLVGEDMALVDSNANHVHEVLSSLDFFVVQDVFLSKTAQYADVVLPAAPSLEKEGTFTNTERRVQRLYQVLPTLGDAKPDWWIVQEVANKLGANWNYSHPSEIFAEMASLSPLFSQANYEVLEGWNSFLWGSFDGTNTPLLFQDGFNFPDKKARFAIADWVRPAEFPAEFDLHINNGRMLEHFHEGNMTNKSTGIQTKVPGVFVEVSPALAKERGVKTGSLVRLVSPFGALKLRALVTDRVKANELYLPMNSTDNETAINFLTGPAVDTRTNTPAYKQTKVRMEVLEVEGENPMPKANPRNKKRHPQAGIEVHRKWARPGYVHLTDK

SEQ ID NO: 25029 - protein, 156 aa, Ashbya gossypii
MTADHSRDPCPLVVLSDFGGAFAMGVIGGCVWHGIKGFRNSPLGERGSGAMSALKARAPVVGGNFGVWGGLFSTFDCAVKAVRKREDPWNAIIAGFFTGGALAIRGGWKHTRNSAITCAALLGVFEGVGLMFQRYSAWQAKPMAPPLPDQPQPMQA

SEQ ID NO: 25030 - protein, 141 aa, Unknown
  Frankia sp. EAN1pec
MRPMETRVVTDLGWAHPAKARPLMSIYDAIGGASAVQAAVDEFYVRVTADPELAPFFAGKDIPRLKAHQQAFISAAIGGPEVYQGGAIASVHSGLRITDANFNAVVDHLVSALSGLGVPAETTGQIGAALAPLRADIVTAK

SEQ ID NO: 25031 - protein, 440 aa, Burkholderia xenovorans
MSSQQQAAQLAQSAATLHSVPSYLNKDDLGPWGNYLRQVDRVAPYLGSLSRWLETLKRPKRILIVDVPIELDNGTVAHFEGYRVQHNVSRGPGKGGVRYHQDVTLSEVMALSAWMSVKNAAVNVPYGGAKGGIRVDPRTLSRGELERVTRRYTSEIGIIIGPNTDIPAPDVNTNEQIMAWMMDTYSMNQGQTATGVVTGKPITLGGSLGRREATGRGVFVVASEAARRIGVDIEGARIAVQGFGNVGGIAARLFQEAGSKLVAVQDHTGSLYKSTGIDAVALLEHVAKHGGVGGFPEADAVSNEEFWTVESDILIPAALENQITEKNAAKIRTKIVVEGANGPTTTAADDILHDRGILVIPDVVANAGGVTVSYFEWVQDFSSFFWTEDEINQRLERVMREAFAAVWQVSSEQKVSVRTAAFIVACKRILEARELRGLYP

SEQ ID NO: 25032 - protein, 339 aa, Streptococcus agalactiae
MKKQKKARLIYNPTSGQEIMKKNVAEVLDILEGFGYETSAFQTTPTKNSARDEATRAAQAGFDLIVAAGGDGTINEVVNGIAPLKRRPKMAIIPTGTTNDFARALKIPRGNPIEATKLIGKNQIVKMDIGQAQEDNYFINIAAAGSLTELTYSVPSQLKTTFGYLAYLAKGVELLPRVRKVPVKITHDKGEFIGDASMIFVAITNSVGGFEQIAPDAKLDDGKFTLILVKTANLIEIMHLIRLVLAGGKHINDKRVEYIKTSYLTIEPLSDERMMINLDGEYGGDAPITLANLKNHIRFFANTDEISDDALVLDKDELAIEAIAQKFANEVDDLEGLGD

SEQ ID NO: 25033 - protein, 396 aa, Ashbya gossypii
MSDSITNPENSEIQTNYDKIVHKFDELKLKEVLLRGIYGYGFVDPSAIQQRAILPIIEGHDVLAQAQSGTGKTGTFSIAALQRIDESIKAPQALILAPTRELALQIQKVVMALALHMDVKVHACIGGTDPREDAEALRAGAQIVVGTPGRVFDMIERRNFKTDHIKMFILDEADEMLSSGFKEQIYKIFTMLPPTTQVVLLSATMPKEVLDVTDKFMNKPVRILVKKDALTLEGIQQYYINVESEEYKYDCLSDLYDSISVTQAVIFCNTRRKVEELTKRLTDDSFTVSAIYSDLPQAQRDTIMKEFRTGSSRILISTDLLARGIDVQQVSLVINYDLPNNKENYIHRIGRGGRFGRKGVAINLVTDRDVGDMRELERFYSTQIEELPANIADLFD

SEQ ID NO: 25034 - protein, 421 aa, Bacillus clausii
MEKMDENQEDKLDVLAATQSIIHKALKKLGYPDEMYELLKEPVRMLTVRIPVRMDDGSTKIFTGYRAQHNDAVGPTKGGVRFHPDVSEKEVKALSIWMSLKAGIVNLPYGGGKGGIVCDPRQMSFREVERLSRGYVRAISQIVGPTKDIPAPDVFTNSQIMAWMLDEYSRIREFDSPNFITGKPLVLGGSHGREAATAKGVTICIMEAAKKKGIDLEGARVIIQGFGNAGSFLAKFMADAGALVVGIADAYGALYAEEGLDIDYLLDRRDSFGTVTNLFKDTITNEELLEKDCDILVPAAIENQITSHNAGKLKAAIVVEAANGPTTLEATQILAERGILLVPDVLASAGGVTVSYFEWVQNNQGYYWTDEEVEGRLRTVLTEAFNNIYNLALRRKVDMRLAAYMVGVRRMAEASRFRGWV

SEQ ID NO: 25035 - protein, 766 aa, Streptococcus agalactiae
MDNTVIVHYHSRKKNYFNLSLWQWRDGSEGQDAHFSRFDSFGAVAILKYPLPYFLSHYYVIVKDKNWHHKTIDYRIDCTQGGARKEVWIVDGDDNLYYSRQAAVSSHHYSRRQPHAYDMAINSRAFDKKWGFDGWLGFEYSETKTAFRLWAPTAERVELILYHSTDETASVSKVLSMKRGTAVNYKNHKENTHGVWFTELEGNYNYQAYTYRVYYRRRTFKITRDPYSIATTANGKRSIVIAPEALTPEGFKISHGKEAKWRLENPNQAVIYEMHVRDFSISETSGVKTDYHGKFKGLHQKGTVNQHGDKTTFDYVQDLGVNYIQLQPIFDHHQTFDDDGHYAYNWGYDPENYNVPEASFSSNPHEPATRILELKSAIQAYHDAGIGVIMDVVYNHTFSSTDSAFQLTVPDYYYRMNHNGTFQNGSGCGNETASEKEMCRKYILDSVLYWVKEYNIDGFRFDLMGLHDVETMNIIRNELNKIDPRILVYGEGWDMGAGLTPQNKAKKDNAYQMPGIGFFNDDVRDAVKGAEIYGEFKKGLVSGNSTEDIVAKGILGSDELVSYIDPSQVLNYVEAHDNYNLNDLLWELHPNDNEKQHIYRVEVASAMNLLMQGMAFMQLGQEFLRTKCYPTGDKGQLTQADKERAMNSYNAPDQVNQVNWDNVTFHKSTINFIRKIITLKTNSPYFSYSSFEEIRKHVFVESAQYHSGFISFTVEEHKKIKIIFNIKGKRLQNSFIGDIIISNHEEGKAIDSLDDELSVMILDITK

SEQ ID NO: 25036 - protein, 168 aa, Blastopirellula marina
MEAGVRKLATELNRQYADRPLTVLGVLTGSVVLLADLIRQLEMPLRVGVLQARSYRGVATEPGELVVNLELMPAVAGCDVLLLDDIFDTGRTLDELARRLEACGATSVSSMVLLTKVGRCEVEYRPDYSAFEIPNEFVVGYGLDYQDHYRNLPFVAALDPEEIAAGTQ

SEQ ID NO: 25037 - protein, 379 aa, Streptococcus agalactiae
MKNEMLALILAGGQGTRLGKLTQSIAKPAVQFGGRYRIIDFALSNCANSGINNVGVITQYQPLELNTHIGNGSSWGLDGIDSGVTVLQPYSATEGNRWFQGTSHAIYQNIDYIDRINPEYVLILSGDHIYKMNYDDMLQTHKDNLASLTVAVLDVPLKEASRFGIMNTDSNDRIVEFEEKPEHPKSTKASMGIYIFDWKRLRTVLIDGEKNGIDMSDFGKNVIPAYLESGERVYTYNFDGYWKDVGTIESLWEANMEYIGEDNKLHSRDRSWKIYSKNLIAPPNFMTEDANVKDSLVVDGCFVAGNVEHSILSTNVQVKPNAIIKDSFVMSGATIGEGAKINRAIIGEDAVIGDGVVIDGSKEVEVIGYKEVAGVPNED

SEQ ID NO: 25038 - protein, 378 aa, Oryza sativa
MASALGAQASVAAPIGAGGYGRSSSSKGSNTVNFCNKSWIGTTLAWESKALKSRHMNKIFSMSVQQASKSKVAVKPLELDNAKEPPLNLYKPKEPYTATIVSVERLVGPKAPGETCHIVIDHGGNVPYWEGQSYGVIPPGENPKKPGSPNTVRLYSIASTRYGDSFDGKTASLCVRRAVYYDPETGKEDPTKKGICSNFLCDSKPGDKVQITGPSGKIMLLPEDDPNATHIMIATGTGVAPYRGYLRRMFMEDVPSFKFGGLAWLFLGVANTDSLLYDEEFTNYLQQYPDNFRYDKALSREQKNKNGGKMYVQDKIEEYSDEIFKLLDGGAHIYFCGLKGMMPGIQDTLKRVAEQRGESWEQKLSQLKKNKQWHVEVY

SEQ ID NO: 25039 - protein, 880 aa, Physcomitrella patens
MTETWKDQTMDASGKYVRYTQEQVEALERVYHECPKPSSIRRHQLIKESPILANIEPKQIKVWFQNRRCREKQRKEATRLVSVNAKLTALNKLLMEENERLAKHTSQLTLENHALRQQIPNLPFPDGRHRLPSQILQSPLKKEGAVNGGDESSTQGGICVKVHGQAGIASTDTSCDSAVTGGLPHRLTPQHSPRDSSPAGLLATAEETLTEFLAKATGTAVDWIQLPGMKPGPDAIGIIAISHGCVGIAARACGLVALDISKVTEVLKDRPRWLQDCRRMEILGALPTGNGGTIELLYTQMYAPTTLAPARDYCTLRYTTILEDGNVVICERSLSGVQGGPTMPPVQSFVRGEMYPSGYLIRPCDGGGCIIHVVDHYNNEPRSVPEVLRPLYESPAVLSQKSTLAALRHLRRLAAEESGEGVPRNGQHPAVLRTLCQRLTKGFNNAVNGFPDDGWEATISDGLDDVSVMLNATPKSMEGQIASDKLLYSLGGGILCAKASMLLQNVPPSLLIRFLREHRSEWADYDIDANVASFRSNGNGYVPRCGGVSHVQLPLPLAYSGESGEILEVVKVEGHSSVQHMVLSRDTFLLQLCSGVDESAVGACAQLVFAPVDVALADDIPLLPPGFCVSPIDTNVVDGFGLDRTLDLASTLEGGNDLRSNGDAKSSNSPGQMRSVLTIAFQFAYEVHTRETVAAMARQYVRNVVASVQQVAMALAPSRGAPPPRQVPSNPDALSLVRHVLSSYRFHMGIDLIRPENGSDEALFKAFWHHTDAIVCCALKGIPEFVFANRSGLEMFETATASSLKDLDWEKTLNENDRKLSYATFTHVLQQGYCSLPAGVRMSSTGRTATYEQALAWKVLNDSEAVECIAFLFINWSLAT

SEQ ID NO: 25040 - protein, 430 aa, Oryza sativa
RYLRNKHRLTLCQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGQ

SEQ ID NO: 25041 - protein, 609 aa, Unknown
  Synechococcus sp. CC9311
MATSNLEAPVAVSRQVISLPIDEGLTCLRGLSPQRLRFELEYALERGSTANSFLFDAGTDCEGQHQTAVLVHPPGKAYDKAFLPALAGLLPAQTIALKVVVGHVNPNRVALLRDLASLYPELELIASNAGAKLLEELWSQRKPAAPGQASEQPAIPELPAIQVIRHEQTLPLSYHHKLQLVPAPTPRWPGGLLAFEQSLGLLMSGKLFSAHICTHEWAESGRSATEEERRHFYDCLMAPMAGQVDSLVERLEELDITTVAPGHGPAIDTSWRSLFNDYRRWGESQQQASLSVALLFASAYGNTAAIADALAQGVGRTGIRITSLNCEFTPPDELINTIKQADGILIGSPTLGGHAPTPIVSALGTLLAEGDRSKPVGVFGSFGWSGEAIDLLENKLRDGGFHFAFDPIRVKFSPDAAMIRTLEETGTRFGRELHREQRKQQRRSGGGLSESRSDPAVLALGRVVGSLCVLTARKGELSGAMIASWVTQASFTPPGFTVAVAKDRAVEALLHIGDCFALNVLAEGRESGPMKQFLQPFEPGADRFAGLELKASPHEQPLLPEALAWMEATVKQRMECGDHWLIYAEVSHGGLLDSVGGTAVHQRRSGANY

SEQ ID NO: 25042 - protein, 359 aa, Unknown
  Nostoc sp. PCC 7120
MSKSRRIGILTSGGDCSGLNAVIRAVVHCASGKGWEVFGIRQATLGLMARPPQVSKLEIDQVDPLLTSGGTMLGTTNKGDPFAFPMPDGSFCDRSSEIIAGYHQLDLDALIGIGGDGSLAILRRLAQQGAINLVGIPKTIDNDIGITEHAIGFDTAVNIATEALDRLHFTAASHSRVMILEVMGRDAGHIALAAGIAGGADVILIPEILYSMDDICYHIKHRQEEGKNYCLIIVSEAVRTQDGEILTLTNRLGQSRYGGIGEYLADQISDRIGAETRVTVLGHIQRGGIASPLDRLVASAFGVAAVNLIEAAKYDYMVAWQNRQVITVPIEEAIAQYKAVNPEDALVKTARGLGIYLGE

SEQ ID NO: 25043 - protein, 503 aa, Zea mays
LRRVPRPPQPPIGSGGPAPLRTIARDPGSPPAGEQKPYVGGRQRQPRRPAQKILEVAANRPLSFATAVAGRPFAAPDDYHRFPTPAAATAPAATSGGVGAGAPPRDTIEEGLVIRTPLKRKATSEENDAAAEPSDCIITSPMPTSVSGKTVKASKAKAKNSKTGPQTPTSNVGSPLNPPTPVGTCRYDSSLGLLTKKFINLLKQAPDGILDLNNAAETLEVQKRRIYDITNVLEGIGLIEKTLKNRIRWKALDDSSVQLDNGISALQAEVENLSLQEQALDERISDMREKLRGLTEDENNKRWLYVTEDDIKGLPSFQNETLIAIKAPHGTTLEVPDPDEAGDYLQRRYRIVLRSTMGPIDVYLVSQFDEKFEELGGVATPVKHSSVPRHQPAEDFNTYAGQSSTPMDVAHDVQHGQKIPQDPSALHDFGGMTRISPSDVHTDSDYWLLTEGDVSMTDMWKTGQEVQWDQMDFLSEDVVTPRAHNQQPVTVDGPHMEVPSMDP

SEQ ID NO: 25044 - protein, 528 aa, Lactobacillus plantarum
MMVSSFILVLAAVVSIFISRVMPQISVNYLSLIVGIGLFFIPVLSNHIENFNSEIFIGLIVAPLLFFEGQATRLNAVGKELKHIIQTTVGLVILALIVAGFSLAGLGLVGLPLAFILAAISTPTDATAMESVTNGLEMPSTEGTFLKMESLFNDASGIILLNMAVLWYANGYINYGQTIIDFIISAVGGVLFGFVSAWIMVLFRQVLLRSSYNSLNASLLMYVITPFILYYAAEAIHVSGIITVVVAGLVHNAEAQRSRLINAQQVHFAFDLVSMITEIFNSMVFVVLGFMFIKILVNEQFGHGSLNFLLIGLVLYISNVLVRYSYGRLRLSFKNRPAWIFALGGVHGAVTLALAYTLTDTAVGRGDFNLVLMAASTLIILSMVVPTIIFRWLLKPALTDDEATSEIDQIRVAMVHHAIDTVQKMYLPPNVKESVIFDLMTQKQRTRTRDFARAWVDVVRRPEFTGAEKELEMRAFMNALEQERQYLDMISQREVKYQKYVFKLYNETLLAESLVIGPTIFDKDKATE

SEQ ID NO: 25045 - protein, 131 aa, Bacillus clausii
MPDQRNEQSPFEALGGEEKISELVDAFYRYIAAHEDVRHLFPEDLTHTAYKQKRFLTQFFGGPPLYTEEFGHPRLRARHMPFVISPVQAEAWLSCMERAMDDVHLSGDIRDYMMHRLRLTAHHMVNHPTPG

SEQ ID NO: 25046 - protein, 264 aa, Lactobacillus sakei
MAVLSMKQLLEAGVHFGHQTRRWNPKMKKFIFTERNGIYIIDLQKTVRMVDDAYDFVKEEAANEGVFLFVGTKKQAQDAIAEESVRAGQYFVNHRWLGGTLTNWDTIQKRIKRLKEIKAMDEDGTFERLPKKEVALLKKQQEKLEKFLGGIEDMPRIPDVMFVVDPRKERIAIKEAQKLNIPVVAMVDTNSDPDDIDVIIPSNDDAIRAVRLITAKMADAIIEGRQGEDDVEEATFAAENKSADSMEEIVEAVEGNNDTNTDAK

SEQ ID NO: 25047 - protein, 464 aa, Pseudomonas fluorescens
MKYLPLFHNLRGSRVLVVGGGEIALRKSRLLADAGALLRVVAPEIEAQLRELVAASGGECLLRGYAEADLDGCGLIIAATDDEALNAHVSADAHRRCVPVNVVDAPALCSVIFPAIVDRSPLIIAVSSGGDAPVLARLIRAKIETWIPSTYGHLAGLAARFRDQVKGLFPDVQQRRGFWEDVFQGPIADRQLAGQGAEAERLLQAKIDGEAMVTTGEVYLVGAGPGDPDLLTFRALRLMQQADVVLYDRLVAPAILELCRRDAERVYVGKRRADHAVPQDQINQQLVDLAKAGKRVVRLKGGDPFIFGRGGEEIEELAAHGIPFQVVPGITAASGCAAYAGIPLTHRDYAQSVRFVTGHLKDGSTDLPWSDLVAPAQTLVFYMGLVGLPIICEQLIKHGRAAETPAALIQQGTTVNQRVFTGTLADLPRLVAEHEVHAPTLVIVGEVVQLREKLAWFEGAQGQI

SEQ ID NO: 25048 - protein, 385 aa, Methanothermobacter thermautotrophicus
MFMTSVVVMAGGKGTRIRPLTFSRPKPLVPVANRPILDYIIHRVLDSGYSKVVMTLGYLKDQIRSHVLAEYPEIDFRFSVEKKPLGTAGGVKAAASEINETFIVLSGDVIFDLDLREMVKFHRKKNALVTVALTPVEDPSHYGIAVLDDDGKIKRFHEKPRPEEVFSKIANAGIYVMEPEVIEHIPQGSSDFSADIFPVLIERDAGMYGFLFDGYWNDAGKPNTFLRANHDVLNGTVTPEPDGEIAEEVPGRFGKIWIGRDVVIGDRVRIVGPAVLGDGSRVDDGAYIGKNTVIGSRVNVGENSFIRGSVILDGCVIGRGSQLLNCVVDEDCEIGAGCAIDRCAIIGRGAFIGPSTVIRSHCSVSNRLRILSGSLVDSDYPLVPE

SEQ ID NO: 25049 - protein, 441 aa, Xanthomonas campestris
MSSTVPKLSFARILALNAGFFGVQYSFGLQQSNMSPIYNYLGADHANLPYLWLAGPITGLVLQPFVGAWSDRSVTRWGRRMPYMVLGALVCSLCLLAMPFSTALWMAVCLLWVLDAANNVAMEPYRALVSDVLAPPQRPLGYLTQSAFTGLAQTLAYLTPPLLVWMGMNQDAANAHHIPYVTIAAFVIGAGFSAGSILLTARSVREPAIAPAEIARIRQRGAGLGATVREIGSALREMPPTMRQLAPVMLFQWYAIFCYWQYIVLSLSTTLFGTTDPTSHGFREAGLVNGQIGGFYNFVAFLAAFAMVPVVRRFGPKYTHAACLVAAGIGMWLLPGIENRWLMLLPMIGIGLAWASMMGNPYLMLADSIPSERTGVYMGLFNLFIVLPMLIQIVTLPLYYEHVLHGDPRNVVRLAGALMLAAAAAMLCVRGRKQGTSPAGA

SEQ ID NO: 25050 - protein, 259 aa, Unknown
  Halobacterium sp. NRC-1
MGNRKDHYYNKSKQEGYRSRAAYKLQQLDDRFDVLFGGASVVDLGAAPGGWLQVAAERAGARGKVVGVDFQSITQFETDAGLETVRGDMTEDETRQRVRDAANGSADVVVSDMAPDMTGEYDLDHARSVHLARQALETARELLDAGGHFVVKVFDGRDFQDLLADIEDEFAFVATHSPDASRDASSELYVVGKNHIVAPIAEGDEHTVEIVDTGDEGDGIARIEGYTLFVDDAAEGDTVDVTVTDLKPNYGFAERRDGA

SEQ ID NO: 25051 - protein, 417 aa, Escherichia coli
MLKREMNIADYDAELWQAMEQEKVRQEEHIELIASENYTSPRVMQAQGSQLTNKYAEGYPGKRYYGGCEYVDIVEQLAIDRAKELFGADYANVQPHSGSQANFAVYTALLEPGDTVLGMNLAHGGHLTHGSPVNFSGKLYNIVPYGIDATGHIDYADLEKQAKEHKPKMIIGGFSAYSGVVDWAKMREIADSIGAYLFVDMAHVAGLVAAGVYPNPVPHAHVVTTTTHKTLAGPRGGLILAKGGSEELYKKLNSAVFPGGQGGPLMHVIAGKAVALKEAMEPEFKTYQQQVAKNAKAMVEVFLERGYKVVSGGTDNHLFLVDLVDKNLTGKEADAALGRANITVNKNSVPNDPKSPFVTSGIRVGTPAITRRGFKEVEAKELAGWMCDVLDSINDEAVIERIKGKVLDICARYPVYA

SEQ ID NO: 25052 - protein, 399 aa, Zea mays
  misc_feature (139)..(139): Xaa can be any naturally occurring amino acid
MAAVEQKDEKRWAHISESIDLLFTRLGDVTRVQEQIQVNQELGAKAMDQVLKDQSLLAQQIAATGKAVAHLSMEREVEADLETYSRDSRDARPPFHRRQPRPFPQPQGMATGSEASKAAETVVDWHKQDSKRMLHAVYXRVGDLDRTIKYYTECFGMKLLRKRDVPDEKYTNAFLGFGPENTNFAVELTYNYGVDKYDIGTGFGHFAIANDDVYKLAENIKSKGGKITREPGPVKGGSTVIAFAQDPDGYMFELIQRADTPEPLCQVMLRVGDLERSIKFYEKALGMKLLRKKDVPDYKYTIAMLGYADEDKTTVLELTYNYGVTEYSKGNAYAQVAIGTNDVYKSAEAVDLATKELGGKILRQPGPLPGINTKIASFVDPDGWKVVLVDNTDFLKELQ

SEQ ID NO: 25053 - protein, 112 aa, Escherichia coli
  misc_feature (46)..(46): Xaa can be any naturally occurring amino acid
MKKIDAIIKPFKLDDVREALAEVGITGMTVTEVKGFGRQKGHTELXRGAEYMVDFLPKVKIEIVVPDDIVDTCVDTIIRTAQTGKIGDGKIFVFDVARVIRIRTGEEDDAAI

SEQ ID NO: 25054 - protein, 110 aa, Bacillus thuringiensis
MGYIEELRKVVGTRPLILVGSAIIILNDKQEVLLQYRSDTYDWGVPGGAMELGETTEETARRELFEETGLTAKIMQFLGVLSGKEVYFRYPNGDEIFNVIHLYQDIYGVS

SEQ ID NO: 25055 - protein, 311 aa, Solibacter usitatus
MLTNSSQIVLITGGTGGIGQAIAVRMAKLGATTIVVGRDQARGEAAKAEIRTQSGNRSVELMLADLSSQGDIRRLAGEFMARYGRLDVLVNNVGGLYGKRWETVDGIECTLALNHLCPFLLTHLLLPVLRAGAPSRIVNINSEGHRAAKSVNFGDFDAARWKRGFLIYSQSKLANLLFTFEMARRLSPSEITVNAVHPGIVDTQLFRRFIEERFTLIGGVLSKAAAFVARKVAYRISHFDTVETAAECPVYLASSSEVAGITGKYFGLNKKIVETSAASLDADLSREVWRMSAEMVGLSGNEASQVQRRFA

SEQ ID NO: 25056 - protein, 384 aa, Synechococcus elongatus
MMAAQGSVLTNKYAEGLPSKRYYGGCEFVDQAEELAIERAKELFGAAHANVQPHSGAQANFAVFLTLLQPGDTFLGMDLSHGGHLTHGSPVNVSGKWFNAGHYGVNRETERLDYDAIRELALQHRPKLIICGYSAYPRTIDFAKFREIADEVGAYLLADMAHIAGLVAAGLHPSPIPHCDVVTTTTHKTLRGPRGGLILTRDAELGKKLDKSVFPGTQGGPLEHVIAAKAVAFGEALRPEFKTYSAQVIANAQALARQLQARGLKIVSDGTDNHLLLVDLRSIGMTGKVADLLVSDVNITANKNTVPFDPESPFVTSGIRLGTAAMTTRGFKEAEFAIVADIIADRLLNPEDSSMEDSCRRRVLELCQRFPLYPHLSPATPVAV

SEQ ID NO: 25057 - protein, 328 aa, Oryza sativa
MAKSSADDAELRRACAQAVAASGARGEEVSFSIRVAKGRGIFEKLGRLAKPRVLALTVKQSTKGEAAKAFLRVLKYSSGAVLEPAKLYKLKHLTKVEVISNDPSGCTFVLGFDNLRSQSVAPPQWTMRNIDDRNRLLFSILTMCKEILSYLPKVVGIDFVELALWAKENTVTLDNQSSTQDGQEKSVTTQTERKVTVTVENDLVSQAKDEEEDMEALLDTYVMGIGEADAFSERLKQELVALEAANVYQLLQSEPLIDEVLQGLDAASATVDDMDEWLRIFNMKLRHMREDIASIESRNNGLEMQSVNNKGLVEELEKLLDRLRIPQE

SEQ ID NO: 25058 - protein, 101 aa, Zea mays
FLFNNGGSPIGGEIHGGPSNFIKNGNSPGFVGPLPNGLGKWGASKVRGGGGRPAALGPALGGKKDSLCFFGGFAPKDAPPKERLEWGFRVFAPNSRPPNPH

SEQ ID NO: 25059 - protein, 982 aa, Bacillus subtilis
MNMMDVKSISVRVDGTEIQARAGATILDILNENGIEYPQICHVPEVDPIQTCDTCIVEANGKLVRSCATVAENGMSIDLSGNRVKEAQTEAMDRLLENHLLYCTVCDNNNGNCTLHNTAEMMGIEHQKYPYTPKEDPSCAVDMSHPFYRYDPNQCIACGQCVEVCQNLQVNETLSIDWERERPRVIWDEGVPINESSCVSCGQCVTVCPCNALMEKSMLGQAGFMTGIKEDVMEPMIDLVKNVEPGYGSIFAISEVEAAMRETRTKKTKTVCTFCGVGCSFEVWTKGRDILKIQPVSDAPVNAISTCVKGKFGWDFVNSKERITKPLIRKNGAFVESSWEEALDLVASRLGSIKEQYGKGSVGFISSSKITNEENYVIQKLARQVFETNNVDNCSRYCQSPATDGLFRTVGMGGDAGTIKDIAKAGLVIIVGANPAEGHPVLATRVKRAHKLHGQKLIVADLRKNEMAERSDLFISPKQGTDQVWLMAVTKYMIDQGWHDQAFIDENVNYFEDYKETLKTYTLDYAERITGLSKENIIQIAEMIRDADGTCVLWGMGVTQNTGGSDTSAAISNLLLATGNYRRPGAGAYPLRGHNNVQGACDMGTLPGWLPGYQHITDDKARAKFEEAYGVEIDGKPGLDNIQMLHAIEEGKMKAMYLVGEDMALVDSNANHVHDILSSLDFFVVQDIFLSRTAQYADVVLPATPSLEKDGTFTNTERRVQRLYQALPTLGDAKPDWWIIQEVANRLGANWNYSHPSDIFSEMASLSPLFAKASYEVLEGWNSFLWGSFTGESTPLLYEDGFNFPDKKARFALSDWTEPAAFPEEYDLHINNGRMLEHFHEGNMTNKSKGIQAKVPNVFVEISPELAQERGVCDGSLVRLVSPFGAVKLNALITDRVRKNELYLPMNSTDKESAINFLTGPAADKRTNTPAYKQTKVRMEVLGGCETAPLPKTNPRNKKRHPQNGVEAERKWNRPGYVHLTD

SEQ ID NO: 25060 - protein, 592 aa, Ashbya gossypii
MFIRRTVLKSIPPLQFHLLRRYTMATDPKLATFPAGSPANVGIDGAAAEMKRPGSPTDLKTQPKKKARKPKKYKAKPVDPTSPAGVLQFEIDELLREQGLSRVQVETDVTPILNDVRGGPMQQKYNRRLIDVHVLKLTSSGDGLAIVDSPEDSNKKQLVLVPFGLPGDVVTIQVHKTHPHYAEASLLEVQTSAEMRHDDLINCKYFGKCSGCQYQFLTYDQQLQLKQRTVSNAFKFFAPQLLAEGLLPTVGETVASPLQFAYRTKLTPHFDMPRKVKQLETRPPLGFGQKGRPTWRHSDAGGSAAILDIEDCPIGTEIIRRGMRNERARFEETFKNYKKGATILLREHTKVLNPAAPVEEQLDPGSCDPVSGQVSHLRVDADPPLLKLCTTNTRQIVTEYVDGCTFEFSAGEFFQNNSSILPVVTAYVRDNVRIPNSGPEDKHYLVDAYCGSGLFSITASKGVDRVIGVEVSADSVAFAERNAKTNGVTNCTFIVGKAEKIFASIDTPCDRTSVILDPPRKGCDDVFLKQLAEYNPARIVYISCNVHSQARDVQYFLKETPNGARYKVDSIRGFDFFPQTHHVEGVCVLSRD

SEQ ID NO: 25061 - protein, 212 aa, Zea mays
MDRPINICTSPRMPLSLYEQQTIKEFWRKKQEEIEAIEDFGEHTIPVTCLKKVICAKKGKMMMTSDTPTFMTKACKIFVQELSLRAWMCANSHNRSIILDSDIAEAIASIESYDFLNDVLCVHLEKYKSDPHLQSIKNPHHNRVINQSPTPLQPLSHQYQMTQFIPQSTRYCPFIHIPPILPQTNAIHMHLPLPLPPITYMTKDLCVLWKTH

SEQ ID NO: 25062 - protein, 439 aa, Agaricus bisporus
MKPAIRFIILAISISLATADVPVWGQCGGRDWTGETACASGSSCVVQNEWYSQCLPGSTTPTNPPPATTTSQTTAPPTTSHPVSTGFVKASGTRFTLNGQKYTVVGGNSYWVGLTGLSTSAMNQAFSDIANAGGTTVRTWGFNEVTSPNGNYYQSWSGARPTINTGASGLLNFDNVIAAAKANGIRLIVALTNNWADYGGMDVYVNQMVGNGQPHDLFYTNTAIKDAFKSYGRAFVSRYANEPTVMAWELANEPRCKGSTGTTSGTCTTTTVTNWAKEMSAFIKTIDSNHLVAIGDEGFYNQPGAPTYPYQGSEGVDFEANLAISSVDFATFHSYPEPWGQGADAKAWGTQWITDHAASMKRVNKPVILEEFGVTTNQPDTYAEWFNEIESSGLTGDLIWQAGSHLSTGDTPNDGYAVYPDGPVYPLVKSHASAMKNRA

SEQ ID NO: 25063 - protein, 220 aa, Burkholderia xenovorans
MAKNKFNTAWLHDHINDPYVKMAQREGYRARAAYKLKEIDEQDKLIRAGQVIVDLGSTPGSWSQYARNKLAKGAQRDAEREGGIDGTIIALDLLPMEPIADVHFIQGDFREDSVIAQLEELVGERQVDLVISDMAPNLSGVAVADAARIEHLCDLALEFSQNHLKPDGALLVKCFHGSGYSQIVEKFKRQFRVVAARKPKASRDKSSETFILGKHLKRPA

SEQ ID NO: 25064 - protein, 170 aa, Zea mays
MAPTVMMASSATAVAPFQGLKSTASLPIARRSSRSLGNVSNGGRIRCMQVWPAYGNKKFETLSYLPPLSTDDLLKQVDYLLRNGWIPCLEFSKVGFVYRENSTSPCYYDGRYWTMWKLPMFGCNDATQVYKELQEAIKSYPDAFHRVIGFDNIKQTQCVSFIAYKPPGSD

SEQ ID NO: 25065 - protein, 423 aa, Bacillus licheniformis
MTATSESISAQIEEKAIKAKTAAKSLRLATEKEKNEALAALADHLKQNMSYILTENAKDIEAGRKKGYDAAYIDRLSLNEDRVLDFADGLLEVAELDDPVGETLSSWTLDNGLKAEKVSVPLGVIGMIYEARPNVTVDATGLALKSGNAIVLKGGSSAIHSNTAIVSVMHQALDSTNIPRDAVQFIESTDRSATKQLFKMKEHIDVLIPRGGGALIQEVVENATVPVLETGVGNCHIYIDREADPEKAIDVMINAKTDRPAVCNALETLIVHEKWLEENSAALINALNEHGIQVHGDEKAVQMIPGARPAGEADWQNEYLSLDLAVKVAGSLEEACDHIETYGTKHSEAIITENPETAKAFLNTVDAAALYHNASTRFTDGGALGFGAEIGISTQKLHARGPMGLKELTTCKYIMRGDGHIRR

SEQ ID NO: 25066 - protein, 384 aa, Bacillus clausii
MVEEMNDGMDEIKSFSVGDIVTGKVTKVEDKQAFVDVGFKVDGIVPISELSSLHVEKASDVLSVDDELELKVTKVEDDELILSKKAVQAEKAWEQLEEAYEKGEVIEAEVAEVVKGGLVVDVGVRGFIPASLVERHYVEDFSDYKGKPLRLKVTEIDKDNNKLILSQRAVLDAEIEEKKKQVLHSLSTGDVVEGKVQRLTSFGAFVDVGGVDGLVHISQIAHERVEHPSDVLSEGQEVRVKVLSVDPDSERVSLSIKEMLAGPWENIESKFSAGDIVTGTVKRLVSFGAFVEIAPGVEGLVHISQISKRHIGTPQEVLEEGQQVQAKVLEVSEADRRVSLSIREASEEQERKETRAYEKPANDEPSGFSLGDMIGDQLKKYRDQ

SEQ ID NO: 25067 - protein, 420 aa, Gibberella zeae
MADTTNADPSATAAPAPEILAGITEESLAKGENPLPKEEHPSGKDGYGTFMQIVRGSCFALYFNTCIVIIFLTQLIGLPLYFVNRDWYYAYVAMTKGFFGLTITLMTQIWGPTTIRVSGDESVAGQIKLRSDGGVQFEFPERLVLIANHQIYTDWLYLWWIAYANSPSMHGHIYIILKESLRRIPIVGLGMQIYGFIFMSRKMASDQPRMAYRLNKLKQPKVDPNGKSYMNPMWLLLFPEGTNLSNNGRRKSAGWAAKMDLKDPEHVLLPRSTGMFFCLNELKGSLDYVYDCTVAYEGIPRGGFGEQYFGLVSTYFQGRPPKSVNFHWRRFRLSDIPLDDQKAFDLWLREEWYKKNALMEEYMTTGRFPRMEGGKVDYIETEVKTRQPWEILQLFTVVGTAALIWHNVKKTFTTVTTVFQ

SEQ ID NO: 25068 - protein, 1574 aa, Coccidioides immitis
MDGQRQQPYVPGPPPQTIQQTASQGHVMQLPPPPPQPPPPRVTHAASHGGLPPPPPVPPRVSGYGNQPGWQQAWSRQQGMGQSFYLPPPPSMLSSNQVYNQPLAYNPHQPPNSGSLSIQPPPTNDQPLTSATYIPGGSSFGPGVGIPPLDSYDNFSRADRAGYPPDSDTMRYIPQSYADQMNRSHQVPSSFREQSDSGNPLALNQNVHGQSSLQHSQGPTRENSSRHATSAISSGLSIHEADERWPLDRVLQWLVHNGFSTEWQETFKSLDLKGADFIDLGCGGANGMGNLGKMHQDIYPQLAKECVKSGTGWDQSREREEGVRMRKLIRGINSENAPSARFYENLHPSASTDGGVETSPHLRADSFPFDPSSTESGYQEPSSRSELSRNILVNAFGEWRRHSPSASSDHGAGLRASSNSRAGSPATQFASMATAEPAFLTGEFGHAKRNSSDSIISRGLRQAQGSSNPDHSTKQTELSTKDHKGFLNAIRKKIGPSHPSEEPHHDASISPVRNNQSFPYSGKPSLNASETSLVMGMSLPSSESHARKAISNLPPKKFIFVTLDGWNYRLVDVTDVDAADLLRARLCNGVGIKDPSSALIYVTEPGQVDHEEPLSDTMLVVNRRSRSDAQGSLKLYIQSMTPSAFNVSQYAGLGLSFSDRVANGAKPQRNILEDDTRNRTNQPSHTRRVSPSLAHRSSMQNLPSYSPFPEDDRLGENLSEDKERNAAILAAHEEHRRITEQKQQAFLQSRREQLQKKQASTVTTYGIKRGGFIDFDLPRTSPYEDKRTDDLVPRREPPTAPSASSTLTKVNSLNKKPGEKATDNTCHQRRSSKDFLSDNRQRSSSFSPKNASPSMGIAAAIANMGKISGSIAKPLASSTSFGHSPRTPSGSEFGRFSTESVDAGSASPHCGSSSSPRPSAFARSVSANSEIIARKSTPTQAESTPPDKSVHSFSASPSRASAIPPSRLSHGPDFDFQETEVSFVKSPQPAPQDSDEDSDEGLFAIPLANGKNKPQVNKKPPATRSRLAKPALTVNTNSRAAKGLSVTFESPGPCDSFTPLTDHSDSRSGHYSGDPDTDDLSPEDSRSARRRSFVRDDVWASRPPVEGMIEHLDDFFPNIDLDEPYLEAMPLTPPISPTATSSHPDTEPEQSFTLRDRVGQGGPPTTSIPRNASDTLGSDESTLKGKAAPKTVAHRNVGRSTGLSRMKSIREVAKGAHQIRRNQSIAASKNAQSGMLRRKSTKMFGARIMQISPKPGSRLSDLDPLPQHPVPQEKLPQRQATFRIIRGQLIGKGTYGRVYLGMNAETGEILAVKQVEVNQKAAGYDKDRIKEMVQAMDHEIDTMQHLEHPNIVQYLGCHRSELSMSIYLEYIPGGSIGSCLRKHGKFEESVVQSLTIQTLRGLAYLHDKGILHRDLKADNILLDLDGTCKISDFGISKKSDNIYGNDVTNSMQGSVFWMAPEVVQSQGQGYSAKVDIWSLGCVVLEMFAGRRPWSKEEAIGAIFKLGSLNQAPPIPEDVSMNICPAAIAFMYDCFTINTFDRPTAETLLSQHPFCIPDPNFNFLDTELHAKIGHL

SEQ ID NO: 25069 - protein, 429 aa, Unknown
  Synechococcus sp. CC9311
MTDRSAAPINASLKAADPAIAGLIDQEQMRQETHLELIASENFTSKAVMEAQGSVLTNKYAEGLPHKRYYGGCEHVDAIEELAITRAKQLFGAAWANVQPHSGAQANFAVFLALLQPGDTILGMDLSHGGHLTHGSPVNVSGKWFNVVQYGVDKETQRLDMEAIRKLALEHKPKLIICGYSAYPRSIDFAAFRSIADEVGAYLLADMAHIAGLVAAGVHASPVPHCDVVTTTTHKTLRGPRGGLILCRDAEFARRFDKAVFPGSQGGPLEHVIAAKAVAFGEALQPDFKAYSRQVVANAQALAARLQERKIDVVSGGTDNHVVLLDLRSIGMTGKVADLLVSDVHITANKNTVPFDPESPFVTSGLRLGTAALTTRGFDEKAFHEVADVIADRLQNPEDDAIQARCLERVSDLCKRFPLYAPALEPALA

SEQ ID NO: 25070 - protein, 829 aa, Unknown
  Shewanella sp. ANA-3
MNRRDFIKANAVIAAAGAAGLALPASASNLITSSEQTKLEWNKAPCRFCGTGCSVIVATREGKVVATHGDANSEVNRGLNCIKGYFLSKIMYGSDRLTTPMLRMTDGKYDKHGEFTPISWDSAFDIMAQKWKETLKAKGPTAVGMFGSGQWTVWEGYAAVKLMKAGFGSNNIDPNARHCMASAVVGFMRTFGIDEPMGCYDDMEAADAFVLWGSNMAEMHPILWTRVTDRRLSASHVKVAVLSTFEHRSFDLADLPIVFTPQTDLAILNFIANYIIQNDKVNWDFVKKHVNFRQGTTDIGYGLRPTHPLEQKAKNVKTAGDSTPIDFDTFKAFVAEYTVEKVSKMSGVPEAKLIELAKLYADPETKVTSFWTMGFNQHTRGVWCNNLIYNIHLLTGKISTPGNSPFSLTGQPSACGTAREVGTFSHRLPADMVVTNPEHRKHAEEIWKIPSGIIPPKPGYHAVEQNRRLKDGDLNCYWVQVNNNMQAGPNINEEGLPGYRNPANFIVVSDAYPTVTTQAADLILPTAMWVEKEGAYGNAERRTQFWHQMVQAPGESHSDLWQLMEFSKRFTTDEVWSKEVLAANPQFKGKTLFEVLYKNGNVDKFPLADTDPKYLNNEAKHFGFYVQKGLFEEYATFGRGHGHDLAPFDAYHEAHGIRWPVVDGKETKWRFREGSDPYVKPGSGFEFYGKPDGRAVIYALPFEPPAESPDTEYDMWLSTGRVLEHWHSGSMTQRVPELYRAFPDAVCFMHPEDAKKRGLRRGDEVRVVSRRGEIKTRVETRGRNKPPVGLVFVPWFDASQLINKVTLDATDPLSKQTDFKKCAVKIVKV

SEQ ID NO: 25071 - protein, 436 aa, Prochlorococcus marinus
MTVESPTEKAITPSVGLLGWYSVCASQLLKQNELYHLSMYNEPLVIYRDKENKPRCIKDSCPHRSASFRGGESKNGEIICPYHGARYTTSCNQDGFDRITCNHIVDSDYDNFAKYLHLRQYPCVEQGDYIYIYYTGEAKTSPNDFKINSELEPSLPETYGFDLADSKFEEVFIDFKCDWSRIIENHLDILHIFWLHGNTLPGNDVNRETIKSFNQTINKDQYHLRSVYNEKGNKKEEFISQIFIPPGRVIIFKGSPEQARYVQVLDHIPLAHNRARIIVRHYRKFLKNKFLCKLLLFKQRQQQVFYKIFSEDYLVLQTQTFNEQMGYMHQGQNKLLAEDKMIKHFWDWHQQSIEKESPWTIHPTSAHTNTIHQDMLMVYPPANPQLSHDVQRIIDRKVAVRLFSIVIIILAFIFAPNLVQQIKSGNDSIPMVETQE

SEQ ID NO: 25072 - protein, 72 aa, Moorella thermoacetica
MAKEDVIEVEGKVIEPLPNAMFRVELANGHRVLAHVSGKIRMNFIRILPGDRVTVELSPYDLNRGRIVYRYK

SEQ ID NO: 25073 - protein, 569 aa, Coccidioides immitis
MTDLATKELKNPVDVAEYLFTRLHQLGIRSIHGVPGDYNLVALDYIPKCGLRWVGNCNELNAGYAADGYARINGISALMTTFGVGELSALNAVAGAFSEFVPIVHIIGQPSTISQKDGMLLHHTLGNGDYNAFANMSANISCAVAKLNDPHQAATYIDSALRECWIRSRPVYIALPTDLVQKKVDGERLKTPIDLSPPANEEEKEEYVVDVVLKYLHAAKNPVILVDACAIRHRVLDEVHDFVKKSGLPTFVAPMGKGAVDETLPNYGGVYAGDGSNAGVKDRVESSDLILSIGAIKSDFNTTGFTYRIGRMNTIDFHSNYVAVRYSEYPGVGMKGVLRKVVQRMGKVNVAPGPKVINEPHEDPSASNPAITHEWFWPIVGKWLQENDIVITETGTANFGIWETRFPKGVTAVSQVLWGSIGYSLGACQGAALATQEGLKRRTILFIGDGSFQMTGQELSTMIRRKLTPIIFVICNEGYTIERYIHGWESSYNDIQEWKFKDLVPAFGAKPENYRTYQIRTKQEVLDLFANKEFAAAEVLQLVELYMPLEDAPAALRLTAEASARRNAE

SEQ ID NO: 25074 - protein, 429 aa, Lactobacillus plantarum
MSENENSQEKNELLDALNSVEEVNVGDVVKGEVLAIDDDKQVIVGIQGTGVEGVVPLKELSTQRVDDVNEAAKVGDVLDLVVISRIGSDKENGSYLLSHRRLEARKVWDDVEKEYEAGHTIKAPVTQVVKGGLVVDAGVRGFIPASMIDDHYVEDLNAYKGQELELKIIEIEPSENRLILSHRAVVEKQREAQREEALKTLQAGDVVEGKVARLTNFGAFVDLGGIDGLVHVSEISYERVEKPADVLKVGQEVTVKILSVDADRERVSLSIKATLPEPWDGIEEKAPQGAVLDGKVKRLTSFGAFVEVFPGVEGLVHISQISHQHIATPNDVLKVGQEIKVKVLDVRPDEKRLALSIKALEEKPQTADDDNESQPERRSNNNRRRNNNRDNRTASERSTANAPEESTGFTLGDLIGDELKNAESNNDEN

SEQ ID NO: 25075 - protein, 850 aa, Pseudomonas aeruginosa
MKKVWFQLHWFFGISAGLVLALMGVTGATLSFQDELMRALNPDVLVVQKRPEGVLPLDELVRRIEGAEPGRKVAFVWVEMDSDKAGRIFYTPPPGQRRGESRWIDPYTGAFVGEPRGEGFFNLMMQLHRFLAMGEYGKQVTAACTLILIFFCLSGLYLRWPRKVFDWRAWLTLDWSRKGRSFNWDLHAVAGTWCLALYLLAALTGLYWSYEWYRNGLFKLLDDAPAGQQAQRGKPGGRGERPADAAPLVVDYAAVWNSIRQAGGDRLQAYNLRLPPAGGQPATVFYRLTDAPHERAFNTLTLDPANGQVKSDQRYSDRSFGSQLLASVYALHVGSYFGMAGRILMMLASLAMPLFFITGWLLYLDRRRKKRAVRASRADLGGSAGASGEPWLIGYASQSGFAEQLAWQSAGQLQAAGLPVRVESLARLDAGQLAEARKALFVVSTFGDGEAPDSARGFERKVLGQAASLDGLSYALLALGDRQYEQFCGFARRMQGWLQGQGARSLFAPVEVDDGDAAALRQWQESLAEVTGGAAPAAWEAPAFEVWSLARRECLNPGSQGESTWLLDLRAPANSAIQWRAGDLLEIVPHQAPVRIREWLQRHNLDGQARVAVEGVEQSLEQALAGRLLPDSFEHLVGLHPQALLDALIPLSVRQYSIASLQSDGDLQLIVRQEQHADGSLGICSGWLTEYLPLGAALTLRLRRNAGFHLPEDDVPLILIGNGTGLAGLRSLLRASIAAGRKRNWLLFGERNFAHDYYCRAELEQALARGELQRLDLAFSRDQAEKIYVQDRLHEAADELRRWIDEGAALYVCGSLQGMAGGVDRVLREVLGEEALQRLADEGRYRRDVY

SEQ ID NO: 25076 - protein, 623 aa, Oryza sativa
MKAWGVMRERAYAFDLVLTEVTMPTLSGIELLSRIVASDECKNIPVIMMSSQDSIGTVLRCMQKGAVDFLVKPVRKNELRNLWQHVWRRHAMNSQTNASENNAASNHLSANGGNGSKTGEHSDEESDAQSSGSKREVEIQSAEKLPEVVADGGAGSSREHKIQNGFIDGMNTKSHALKGNDDAPSGNACGDSELQVLSTEKNVRSKFLNGITSAKVAGQIMDNALRFADSSSLRSSDPGKDLLVVAQTTADRKCKSSALENNAVMENNLSENSKGTATGHAESCPSHFVEINLEKQHHLNGYTNHKLNEKDIFNHSNSSAFSRYGNKRIESSAQRPFPPSFRVVHQQPVYDKNPQSSRVLLSCEHNTRESTVQAQVPLDRSTEGAAILCSSSVREDAGTSSSSPRKDSLTHPSYGFIPVPIPVGAAIPYHYGAIMQPMYYPQGAFMHCDSAAINKTAIQHVSCQSNYHENLGKPPQIDEHKQPEENHQLHHSRQILRESGEPVDLAKAHMERINQSASCSQDIRKGSGCTGSGETDANTNTVIALESGNESGVQNCSNNVLDGDRSRREAALLKFRMKRKDRCFEKKVRYHSRKKLAEQRPRVKGQFVSQKLKSAITTEAETD

SEQ ID NO: 25077 - protein, 508 aa, Theobroma cacao
MANPKILYPFSVSLLFLISISSAAASSFLDERRLGGSSFPSIHAKKLIRELNLFPKEEVNVVDGGQVSLPEDSRLVEKRFKFPNLAVPGGVSVEDLGHHAGYYKLANSHDARMFYFFFESRNSKKDPVVIWLTGGPGCSSELALFYENGPFTIAENMSLIWNQYGWDMASNLLYVDQPIGTGFSYSSDRRDIRHNEDEVSNDLYDFLQAFFAEHPEFEKNDFYITGESYAGHYIPAFAARVHQGNKAKDGIHINLKGFAIGNGLTDPAIQYKAYTDYALDMGVIKKSDYNRINKLVPVCEMAIKLCGTDGTISCMASYFVCNAIFTGIMALAGDTNYYDIRTKCEGSLCYDFSNMETFLNQESVRDALGVGSIDFVSCSPTVYQAMLVDWMRNLEVGIPALLEDGVKLLVYAGEYDLICNWLGNSRWVHAMEWSGQKEFVASPEVPFVVDGSEAGVLRTHGPLGFLKVHDAGHMVPMDQPKAALEMLKRWTKGTLSEAADSEKLVAEI

SEQ ID NO: 25078 - protein, 487 aa, Unknown
  Frankia sp. EAN1pec
MRVLLVHPSALMYSEIFLRLEPLGLERVAASLLMAGHEVRLIDLQTADIRDYTRALVDFRPQTVMFGLNYLANVPEVIMLAKQAKITRPGCLVIAGGHSVSFIAQHLLENCDEAIDAVARGEGEVVAPRILEADWDSLTEVPGAVTRAGSGPPPTMLPTLDEPLPARYLLARRNRYFIGELDPCASVEFTRGCPWDCSFCSAWTFYGRSYRRMSADAAGHELASIREPNVFLVDDVAFIKPDHGNAIADQIERRGIRKRYYLETRADVLLRHPEVFQRWRRLGLTYMFLGMEALDAEGLDLFHKRISPDENIKALELARKIGITVAVNLIADPAWSRDQFRLVRQWALSVPEIVHLTVMTPYPGTEIWHTQSQKLTTLDYRLFDIQHAVTPTSLPLDEFYRELVATQAVLNRKHLGVKALAATARIVAGHLTHGQTNFLRMLWKFPRVYNATRLHAEHGQPARYCLPAPTHAGVSRRRRELYIHQPI

SEQ ID NO: 25079 - protein, 424 aa, Unknown
  Halobacterium sp. NRC-1
MARAPPPESMAYDEVREVDPEVADALTGERHRQNDTLAMIASENHVSEAVMEAQSSELTNKYAEGYPGSRYYGGCEYADDVEELAVARAKELFGADHVNVQPHSGSSANMGVYFATLAPGDKILSLDLTHGGHLSHGHPANFAGQLYEVEQYEVDAETGRLDYEALREHADAFEPDMIVSGFSAYPREVEWERIQAAADAVGALHMADIAHITGLVAAGEHASPVGVADFVTGSTHKTIRAGRGGIVMCDEAFADDIDSAVFPGAQGGPLMHNIAGKAVGFNEALDPAFEEYAAQVVENAAVLGERLQEHGFSLVSGGTDTHLVLVDLRESHPDISGGDVEGELEDVGIVLNANTVPDETRSAFDPSGIRIGTPALTTRGFDADAMETVADCIARVIDNLGDESVYADVADTVADLCEQYPQYE

SEQ ID NO: 25080 - protein, 334 aa, Prochlorococcus marinus
MGKSIKGLVLITGTTSGVGLNTLKPLLKFGWEVIAVNRSNKRAVEIAQQSLTDSQIKNIHFIEIDLSDLDDVRNGCSEILKKFKKPINSIICNAAVYKPRLRKPERSPQGFENSMAVNHFGHFLLINLLLDNILSSEKEIDLNGRTIKFKPRITVLGTVTANYSELGGRIPIPAPADLGNLSGFKNGFLSPISMANGKKFKPGKAYKDSKLCNMVTVQELSKKYPKERIIFNSLYPGCVADTKLFRDTPWLFRFLFPIFQKFITKGYVSQRLAGERVAQVATLKEYAKPAVHWSWGNRQKLGRKAFSQKLSKRIIDSNISRQTYELTRKLVGLA

SEQ ID NO: 25081 - protein, 257 aa, Unknown
  Synechococcus sp. CC9311
MTIQRLKSTDPVSIEGWSWQPFLEDAIKSLGGLNFEPYPVPDRFLQREDQTGSKSKPISVTTATWACKTEKFRQVRAACVSAGSAASVLNFVINPNSTYDLPFFGGDLVTLPSGHLLALDLQPAIKTDEVHTTHVWDQLIPIFERWRDQLPYGGPIPEEAQPFFSPGFLWTRLPLGEEGDDLIQSVVRPAFNEYLELYLQLAASAERVNAERSDFLLQGQRKYTDYRAEKDPARGMLTRFHGSEWTEAYIHTVLFDL

SEQ ID NO: 25082 - protein, 116 aa, Lolium perenne
DEWLNAGFIATVQQRGAAIIKARKLSSALSAASSACDHIRDWVLGTPEGTFVSMGVYSDGSYGVPAGLIYSFPVTCCGGEWTIVQGLPIDEFSRKKMDATAQELSEEKALAYSCLE

SEQ ID NO: 25083 - protein, 190 aa, Brassica napus
MSMDVRWEAIKHVKLQCGGSLGLRHFNLLKKLGCGDIGTVYLAELIGTNCLFAIKVMDNEFLARRKKSPRAQAEREILKMLDHPFLPTLYAQFTSDNLSCLVMEYCPGGDVHVLRQKQLGRCFPEPAARFYVAEILLALEYLHMLGIIYRDLKPENILVREDGHIMLTDFDLSLRCAVNPTLLTSTSPPD

SEQ ID NO: 25084 - protein, 352 aa, Desulfitobacterium hafniense
MIFLIIDEKSYDLDKDNFRLASPSYALRREDSMTVDKTNLGIATFAGGCFWCMESVYSPLPGVLEVLSGYTGGHVENPTYNEVCSHTTGHREAIQIKFNPNIVSYKELLALFWRQIDPTDPGGQFHDRGESYQTAIFYHSEEQRRLAEESKQALISSSHFDKPIVTEILPAAPFYPAEDYHQGYHQKNAFRYALYRQGSGRDAFINKHWAKEKEQLKKRLTPLQFHVTQEKGTEPPFQNEFWNNKQEGIYVDVVSGEPLFSSRDKFDSGCGWPSFTRPVLKSNILEKIDLSHNMTRTEVISRNSESHLGHVFDDGPGPDGLRYCINSAALRFIPKEDLEREGYGDLLRLFRD

SEQ ID NO: 25085 - protein, 337 aa, Gibberella zeae
MGKAEVGSTKFVANRMKAKGLQRLRWYCQPCEKQCRDANGFKQHTMSESHVRQMLLVGEDPKKYINDYTKQFLSDFILLLRTGHGEKQVHINRFYQEYIANKEHIHMNSTKFGSLTELAKHLGREGICRVEETEKGIHISWIDKSPEALRRQDALRRKEAQDQGNEELEQRMIREQIKRAQAAAGNDEEKEEDPEARELKRQEGEKIKLSFGAKPAAPDTKASESPAPDTATAEADTLKTEEIATEKRKEPDTAPAKPSGFGGISMKLAGKPQTKNVFTQAKKNALSSGSKKPAKIEQPKKMSEAERIMKEEMEKKRPRDSTGFSFGMGSNKKQKNN

SEQ ID NO: 25086 - protein, 1037 aa, Mycobacterium smegmatis
MAEDAHTEDLSTQTPQQEGLPERLRVHSLARVLGTTSRRVLDALAEFDGRQRSAHSTVDKADAERVRAALTESPAAETPPEEAPAAETPVADLVVVQAEQVEVVTVSEAGPAEPAEPAEPEAPAAEAEAEAETEVADEAETPEPTFRGAVLVGDEPESRLILEHANIPPARETQTERPDYLPLFVAPQPVSFEPAVVDDEDEDDDTETGAESDFDSGADSDSDDDQADRPRRRRRGRRGRGRGRGEQNDDATSDADTDSTEDQTDGDEQESGEDSDDSGDEDSTTTEGGTRRRRRRRRRKSGSGDSDDAVSPDDPPNTVVHERAPRTERSDKSDDSEIQGISGSTRLEAKRQRRRDGRDAGRRRPPILSEAEFLARREAVERTMIVRDKVRTEPPHEGARYTQIAVLEDGVVVEHFVTSAASASLVGNIYLGIVQNVLPSMEAAFVDIGRGRNGVLYAGEVNWEAAGLGGQNRKIEQALKPGDYVVVQVSKDPVGHKGARLTTQVSLAGRYLVYVPGASSTGISRKLPDTERQRLKEILREVVPSDAGVIIRTASEGVKEEDIRSDVERLQKRWSEIEAKAAEVTEKKAGAAVALYEEPDVLVKVIRDLFNEDFSSLIVSGDEAWNTINSYVEAVAPDLMPRLTKYEPAGPDAPDVFAVHRIDEQLAKAMDRKVWLPSGGTLVIDRTEAMTVVDVNTGKFTGSGGNLEQTVTRNNLEAAEEIVRQLRLRDIGGIVVIDFIDMVLESNRDLVLRRLTEALARDRTRHQVSEVTSLGLVQLTRKRLGTGLVEAFSTACTHCGGRGIVLHGDPIDSASSNGGRKSDSSGGGGSGGGRRGKRGKKGAARTEEVHVAKVPDHTPGEHPMFKAMAAANGKHEGDEDHEDHEDHETAEDTTAAEVRDDTRDEHDADERAHVVTAAVGAAGDEDLDDSDEDSDLDSDEESDDESDEDEIELDDDEDELDEDIEVIGDSDDSDDSDDSDEDDDSDDSDDDSDEDEDSDSDEDEEPVREVYEPPVTAPRARVRRRAAARPAGPPSHD

SEQ ID NO: 25087 - protein, 274 aa, Pinus contorta
MASCGIGSCAFAGGQISSLKPHTNQLLGVGAGVHGEARVTMRKAATKKVSVSASTSPWYGPDRVLYLGPFSGEPPSYLTGEFPGDYGWDTAGLSADPETFAKNRELEVIHSRWAMLGALGCVFPELLARNGVKFGEAVWFKAGAQIFSEGGLDYLGNPSLVHAQSILAIWACQVILMGAVEGYRIAGGPLGEVTDPIYPGGSFDPLGLADDPDAFAELKVKEIKNGRLAMFSMFGFFVQAIVTGKGPIENLADHLADPVSNNAWAYATNFVPGK

SEQ ID NO: 25088 - protein, 235 aa, Thermoanaerobacter tengcongensis
MSIVSMKQLLEAGVHFGHQTRRWNPKMAPYIFTERNGIYIIDLQQTVEKLEQAYEFVKKLVMDGGTILFVGTKKQAQESIKEEAERCGMFYVNQRWLGGTLTNFKTIKTRIQRLKELKRMEEDGTFEVLPKKEVIRLRKEKERLQKFLGGIENMESLPSALFIVDPKKEAIAVSEARALEIPIVAIVDTNCDPELIDYPIPGNDDAIRAVKLITSKIADAVLEGKQGEQFEAAEE

SEQ ID NO: 25089 - protein, 575 aa, Podospora anserina
MAIDIRTQGLKKPVPVAQYLFARLYEIGIRSVHGLPGDFNLVALDYIPKAKLKWVGSVNELNAAYAADGYARALGISALVTTFGVGELSAMNGVAGAYSEHVPVVHIVGCPSTISQRNGMLLHHTLGNGDFNVFANMGSQIACNTARLNNPAEIAEQIDFALRECWIHSRPVYIMLPTDMVEKQIEGARLDTPIDLSDPPNEPEREDYVVDVVLRYLHAAKNPIILVDACAIRHRCLEEVRNLVDKAKLPVFVTPMGKGAVNESSPTYGGVYAGTGSQPAVQELVESADLVLSIGALKSDFNTTGFSYRTSQLNTIDFHSDHCKVRYSEYPGVAMKGVLRKLIERVDTTKLSSEKLAPKVVNEVSENRDSTETITQAWFWPRVGEYFKEKDLVVTETGTSNFGIWESKFPPDVVGITQILWGSIGWSVGAAQGVAQAVKDMGEDRRTILFVGDGSFQLTVQEVSTMIKHKLRVTIFLIYNEGFTIERCIHGMEAEYNDIRRWNYTEIPTVFGATDKEVRKHIIKTKSELEKLLADKDFNDAKGLQLVELWMPKHDAPRALKLTAEQSAKNNARME

SEQ ID NO: 25090 - protein, 264 aa, Arabidopsis thaliana
METDKRWSLAGKTALVTGGTRGIGRAVVEELAKFCAKVHTCSRNQEELNACLNDWKANGLVVSGSVCDASVRDQREKLIQEASSAFSGKLNILINNVGTNVRKPTVEYSSEEYAKIMSTNLESAFHLSQIAHPLLKASGVGSIVFISSVAGLVHLSSGSIYGATKGALNQLTRNLACEWASDNIRTNCVAPWYIKTSLVETLLEKKEFVEAVVSRTPLGRVGEPEEVSSLVAFLCLPASSYITGQVISVDGGFTVNGFSYAMKP

SEQ ID NO: 25091 - protein, 57 aa, Zea mays
  misc_feature (43)..(43): Xaa can be any naturally occurring amino acid
SPSLFQGWLYLISPMWPCEAHSSMVEKVLFQWMLDYQNVIVLXSSTFGKVLVLYGSI

SEQ ID NO: 25092 - protein, 263 aa, Oryza sativa
MLHVVYRVGDLDKTIKFYTECLGMKLLRKRDIPEERYTNAFLGYGPEDSHFVVELTYNYGVESYDIGTAFGHFGIAVEDVAKTVDLIKAKGGTVTREPGPVKGGKSVIAFIEDPDGYKFELIERGPTPEPLCQVMLRVGDLDHAINFYEKAFGMELLRKRDNPQYKYTIAMMGYGPEDKNAVLELTYNYGVKEYDKGNAYAQIAISTDDVYKTAEVIRQNGGQITREPGPLPGINTKITACTDPDGWKTVFVDNVDFLKELEE

SEQ ID NO: 25093 - protein, 243 aa, Synechococcus elongatus
MTGKVYLVGAGPGDPEYLTLQAQQCLQSAEVLIYDALIDPRILDLVPANCDRIAVGKRGGAESTPQATINQLLVEHCQQGRKVIRLKSGDPFVFGRAASELDALERSGCDYAVLPGLSTALAAPLLAGIPITDPVLSRGFAVYTVHEPDALNWEALAQLETLILLMGSRHLLTIGHELIRHGRSPDSPVALIQWAGHPQQTVLESSLSRMAQQWGDQPLSPCVIVIGEVVRLRKYWAHYRYDG

SEQ ID NO: 25094 - protein, 315 aa, Brassica napus
  misc_feature (129)..(129): Xaa can be any naturally occurring amino acid
MRIRSSFFSIFLLSSSSSSPSPSPSPSSSFFSSSRFSSLSAMSPGANGDFKSRVTVVGSGNWGSVAAKLIASNALKLPSFHDEVRMWVFEEVLPNGEKLTDVINKTNENVKYLPGIKLGRNVVADPDLXNAVKEANMLVFVTPHQFMGGICKKLKGKVTGEVEAISLVKGMEVKKEGPCMISSLISKELGINSCVLMGANIANEIAVERFSEATVGYRESREIADTWVQLFSTPYFMVTPVHDVEGVELCGTLKNVVAIAAGFADGSEMGNNTKHIVTKKEVTIYRWNPDKPNSKPLFQSFFGDVPTCGPMVIVV

SEQ ID NO: 25095 - protein, 130 aa, Sinorhizobium meliloti
MTEPQTTTLYEAIGGDATVRALTQRFYELMDSLPEAARCRAVHPPDLTGSEEKFYEYLTGWLGGPPIYVQKRGHPMLRRRHFIAGIGPAERDEWLFCFTRALEETVSHPKLREIILEPITRLAHHMQNKE

SEQ ID NO: 25096 - protein, 189 aa, Haloarcula marismortui
MTSVDDLWFLSDKACQTAEQTYHDLRKRYTDFIEFTRHRNVPRSRFRDVATGARDHGAPYGAHTLAYRPSGELLLVRHEGVDMWVLPGGELDRGESFQEAALRELGEESGIEATIEGLGMLGRVEFYCDGNMAWGVLPVYEAQAETTDIAVDDPDHEISEAQWFDKLPADTRDREEILQWRGQRFSGRA

SEQ ID NO: 25097 - protein, 315 aa, Unknown
  uncultured crenarchaeote DeepAnt-EC39
MNEPIKNIRLLLEEITIKCDASWIAFSGGLDSSILAEIKKEQNLNAITIISKDFLATDLSYSQITAKHIDIPLEIKYVSIDQMLGAIESTIKILKNFNDIEIRNSIVPYLYMNALKEKNITNVITGDGADEIFAGYNFLLKKDHNELKNELKRIKKIMHFTSQKIANKLGMSIQMPFIDEKIIELVETLPINLLINQKNGIKFGKWVLRKAFENTLPTNVIWRKKTAMQDGSGTTNLTKLFDSIITDDIFTKKVKKIKSECNIKIRTKESLYYYELFKENFIIPECEDKKNICPDCNAEIVSNSKFCRMCGKFPI

SEQ ID NO: 25098 - protein, 209 aa, Vibrio vulnificus
MSKQKHSASSSRWLKEHFDDKYANEARRKGYRSRAIFKLEEIQQKDKLLKPGMTVVDLGAAPGGWSQYAIGVVGDSGRVIACDILPMDSIAGVSFLQGDFREDAVLEALLERIQPDMVDVVMSDMAPNIAGNNSVDQPRAMYLVELALDMCRQVLAPNGSFVVKVFQGEGFDEYVKEVRNMFKVVKIRKPDSSRARSREVFVVATGYKG

SEQ ID NO: 25099 - protein, 532 aa, Unknown
  Synechococcus sp. CC9605
MSFPDFSASDAHIQWQRFCDLSWYHDDLGVWLDISRMHVNASDLQQLQPRMDKAFAAMQELEAGAIANPDEQRQVGHYWLRTPELAPSSELQQHISREIDLIAAFGRDVVNGTIKAPNGEAFTDVLWIGIGGSGLGPALMIKALQNPGEGLPFHFFDNVDPNGMSNVLAGLEGRLDRTLVVTVSKSGGTPEPHLGMEQARHRLEAAGGQWAGQAVAVTMLDSKLDQQAQKEGWLKRFDMFDWVGGRTSITSAVGLLPGALIGCDIRDFLSGASQMDAATRMADLRRNPAALMAASWHVAGGGRGQRDMVVLPYRDRLEVFSRYLQQLVMESLGKRLDRNGDVVHQGIAVYGNKGSTDQHAYVQQLRDGVDNFFATFIEVLEDVSDIPTISGECPGDFLDGFLQGTRSALTESGRQSMTISMRCFDARRLGALIALFERAVGLYGELVNINAYHQPGVEAGKKAAAAILNLQGRVEAILADGVARSADEIRLALGDGTDESIFWILRHLTGNQRGFSAQGDWSQPASMRFSKG

SEQ ID NO: 25100 - protein, 360 aa, Streptomyces coelicolor
MTEAILLVGGKGTRLRPLTVNTPKPMVRAAGVPFLTHQLARAKAAGVEHIVLATSYLAEVFEPYFGDGSTLGLHLEYVTEEEPLGTGGAIRNVASRLHSGPDEPVLIFNGDILTGLDIGALVRTHETTGADVSLHLTQVTDPRAYGLVPTDDTGRVLAFLEKPQTPEEIVTDQINAGAYVFRRSVIDTIPAGRPVSVERETFPELLATGAHLQGMVDSTYWLDLGTPAAFVRGSADLVLGRAPSPAVPGRCGDRLVLPTAQVAPDAKLTGGTVVGEGAFVAEGARVFGSTILPGAVIEPGAVITDSLIGTRARVGTRSVLADTVIGDGAVIGADNELRSGARIWCDAHIPPASLRFSPDT

SEQ ID NO: 25101 - protein, 340 aa, Bacillus clausii
MQKIAVIGAGSWGSALAMVLADNGHDVRLVGRRQEQMDELNERHTNESYLPNIELPTTIRGYTGMEEALGGVEAIVLVVPTKAMRETVRKIVPYLQKAVPVIHASKGIEPATHKRISEMIAEEDASTNRISSITVLSGPSHAEEVALRQPTTVTVASADDEAAKYTQNLFMNQQFRVYTNPDLIGVEIGGALKNIIALACGVTNGLGYGDNTKAAIMTRGLAEISRLGTTMGAKPLTFSGLSGLGDLIVTCTSVHSRNWRAGRMIGEGLSMDEVLEKMGMVVEGIRTTQAAYELSEKLEIDMPVTKALYSVLFNGIDPYQAAEELMGRVKRHEVESLYRS

SEQ ID NO: 25102 - protein, 417 aa, Pseudomonas syringae
MFSKQDQIQGYDDALLSAMNAEEQRQEDHIELIASENYTSKRVMQAQGSGLTNKYAEGYPGKRYYGGCEHVDKVEQLAIERARQLFGADYANVQPHSGSQANAAVYLALLQAGDTVLGMSLAHGGHLTHGAKVSFSGKLYNAVQYGIDTATGLIDYDEVERIAVECQPKMIIAGFSAYSKTLDFPRFRAIADKVGAYLFVDMAHVAGLVAAGLYPNPLPYADVVTTTTHKTLRGPRGGLILARANEELEKKFNSAVFPGGQGGPLMHVIAAKAVCFKEAMEPGFKAYQQQVIDNAQAMAQVFIDRGFDVVSGGTDNHLFLVSLIRQGLTGKDADAALGRAHITVNKNSVPNDPQSPFVTSGLRIGTPAVTTRGFKVTQCVELAGWICDILDNLGDADVEADVASQVAALCADFPVYR

SEQ ID NO: 25103 - protein, 255 aa, Glycine max
MAAYSSHALKTIPFSSFVKPVSTKPTSFFTPSPTKPFLPFTSPNHSLTKNLKLNSTLPHFCLSSVPKKSFTCRSQAEPVDSEKVQELSVYEINERDRGSPVYLRLSYKSVNSLGDLVPFSNKLYTGDLQKRIGITSGICILIQNKAEKKGDRYEAIFSFYFGDYGHIAVQGPYLTYEDTYLAVTGGSGIFEGVKGQVKLRQIVYPFKILYTFYLKGIKDLPQELLVKTVEPIPSVEPSPAAKALEPNATIAGFTD

SEQ ID NO: 25104 - protein, 333 aa, Idiomarina baltica
MKQAEVAILGAGSYGTALAICFARKGVKTLLWGRDEVQVAAMREHRENAHYLPGCKFPESLTVTADIKAAVDGVKNVVVVVPSHAFADILNTINPLLATHARVAWATKGLEPESGRLLYEVAEDVLGNTHALAVLSGPTFAIEMAKGLPTAISMSSTDQDFVDELSEMLHCERSFRVYTNDDFIGVQLGGAVKNVIAIGAGMADGIGFGANARTALITRGLAELTRLGLKLGAKSETFTGMAGLGDLILTCTDNQSRNRRFGLALGQGKSVDDALESIGQAVEGYRNTREVVSLAHREDCEMPICEQIYKVLYEGKAPEEAAIALLSRAKKNE

SEQ ID NO: 25105 - protein, 947 aa, Oryza sativa
MASKEYLQENMLTWISCREPIDTITGALRAGTEGGHGGVERKEQQQQRGYQLPRDSRGSLEVFNPSSASSFRTAAAAPKSASPFLAIPDREEDNVVAQQRAAEWGLVLQTDHHTGLPQGVSARPSSGSARTSSEDNPQQQQSAAAIPRVSEELRAALSVFQQTFVVSDATHPNHPIMYASAGFFNMTGYTSKEVVGRNCRFLQGSGTDPHEIDKIRQSLANGSNYCGRILNYKKDGTPFWNLLTIAPIKDEDGRLLKFIGMQVEVSKYTEGKKDTVVRPNGLSESLIKYDARQKDHARSSVSELLLALKNPRSLSESSNNTLKRKSQESLSMSMSEVPSKRSSESGSRRNSRSGTRSSLQKINEVPDQVNRTRKSGLRAFMGFLGMGHGSVEKNMLKPRDEDPLIDSDDERPESFEDEFRRKEMRRGIDLATTLERIEKNFVITDPRLPDNPIIFASDSFLQLTEYNREEILGRNCRFLQGPETDRATVRKIRDAIDNQAEVTVQLINYTKSGKKFWNLFHLQPMRDQKGDVQYFIGVQLDGTEHVQDDAAKEGVVLVKKTADNIDEAAKELPDANLRPKDLWANHSKVVLPNPHMKDTASWRAIQKVLESGESIGLKHFRPVKPLGSGDTGSVHLVELLNTGEYFAMKAMDKSIMLNRNKVHRATAERQILDLLDHPFLPTLYASFQTKTHICLITDYCPGGELFVLLDNQPLKVLHEDAVRFYAAEVVVALEYLHCQGIIYRDLKPENILLHRDGHISLTDFDLSCLTSCRPQVFLPENADEKKGRKNGSYPIFFAEPMRASNSFVGTEEYIAPEIITGAGHTSAVDWWALGILLYEMLYGYTPFRGKTRQRTFANILHKDIRFPASISVSLAARQLMYRLLHRDPANRLGSYEGANEIKGHPFFRGINWPLIRAMAPPKLEIPLFSKDDMEKKGLVTNNRTDMF

SEQ ID NO: 25106 - protein, 282 aa, Chlamydia trachomatis
MEFPCTLTLKELLESGAHFGHQTSRWNPRMKPFIFEEKNGLYIIDLAKTLAQLKKAVACIQTTIGQEKSILFVGTKKQAKQIIREAAIECGEFFASERWLGGMLTNMATIRNSVKTLNRIELDLEASNSGLTKKELALLAKRHRKLLNNLEGVRHMNSLPGLLIVIDPGYERIAVAEAGKLGVPVMALVDTNCDPTPINHVIPCNDDSMKSIRLIVNVLKDAVIDAKKRLGVEILSPVRPAERPAEEAVEELPLPTGEAQDEASSKEGVLLWADIDNCEALK

SEQ ID NO: 25107 - protein, 114 aa, Oryza sativa
  misc_feature (2)..(2): Xaa can be any naturally occurring amino acid
  misc_feature (12)..(12): Xaa can be any naturally occurring amino acid
  misc_feature (21)..(21): Xaa can be any naturally occurring amino acid
  misc_feature (30)..(30): Xaa can be any naturally occurring amino acid
  misc_feature (32)..(32): Xaa can be any naturally occurring amino acid
  misc_feature (83)..(83): Xaa can be any naturally occurring amino acid
  misc_feature (92)..(92): Xaa can be any naturally occurring amino acid
  misc_feature (95)..(95): Xaa can be any naturally occurring amino acid
  misc_feature (98)..(98): Xaa can be any naturally occurring amino acid
  misc_feature (103)..(103): Xaa can be any naturally occurring amino acid
  misc_feature (108)..(108): Xaa can be any naturally occurring amino acid
MXAMATTASSLXKTSFAGARXPAAARNPTXSXAPAPAAAICNSISSSSSTPPYDLNAIRFSPIKESIVSREMTRRYMTEMINXGDNDVVVVXGGXPGXFSSGXEFSKXPSVKFG

SEQ ID NO: 25108 - protein, 696 aa, Kluyveromyces lactis
MAPVATVGLNNTLDGVAHALKQTKSSEGTFPEAENVQDMKKILHEEDFYNKEVYPPILHEAVSDDLPLEKVYGVNVTASPELIADESKIGPLVDEWFEQFNVLMNKINSGSTSVSEEDWSRLFGNHGTWRDHLGVTFDLHSFIGLENLSNDLQPLLSKAKLSNFQLDKLADYRYTSGYGKVLMHEPKSGRPPVEWVQVYYTFENKLGSGKGIARLTAVYDEKLQKSTLKAFTFYTGLEDYKEYPEAIFGNRPEGVNHGQHVGRESWVERRAKESTFTEDHQPTVLIVGGGQGGLTVAARLKMFGVNSLIIEMNPKIGDNWRNRYKFLVLHDPVWYDHLPYLNFPPSWPIFTPKDKIGDWFEGYAKTMDLNYKCSSMVTGATFDDVSNKWTVQVKDFNTGKIITYTPDHLVMATGHSGEPRMPKFQDQELFKGKIVHSSKHGSGAEFSGGKALVVGGCNSAHDICQDFYEQNVDVTMLQRSSTCVITVEHGMYHNIRGVYDETGPLTETADRIFHSMPLSLLNGVMQQQYRASCQDDVELLKALERRGFKTNAGYGGTGLFGLYFRQGSGYYIDVGCSKLICDGKVKIKQGQSIKRFLPSGTGVEFTDGTILEGLDVIVMATGYTNMKETARRLFGDRVADRLDPVWGLDKEGELKTIWRDSGHPNFWYMGGNLAVSRYYSKRLALRIIQQVKGLEY

SEQ ID NO: 25109 - protein, 894 aa, Oryza sativa
  misc_feature (289)..(289): Xaa can be any naturally occurring amino acid
MPPWWGKSFSKDAKKTTKENLIDTFHRLISPNDQKGSTKSKRSCRRGNDSSVEKSCRSTTVSRPTSPSKEVSRCQSFSADRPHAHPLPIPGVRPPVTRTVSDITESKPILEKRGKPPLLLPLPKPNRPPRRHGNSEVVSEIVVASPSSNCSDSDDHGDSQLQSPVGNDAENATLVTLKNKSSNARKECPGPITAKNMKEIHRPANQVHGSHILSTSPRGVAADSYQSNLQNPRPLVLDSAPNSLMSSPSRSPRRICPDHIPTSAFWAVKPHTDVTFVTRGQCSSPGSGXTSGHNSVGGDMLAQLFWQPSRSSPECSPIPSPRMTSPGPSSRVHSGSVSPLHPRSGGMAPESPTNRHDDGKKKQTHKLPLPPLSISHSSFHPNNSTPTSPISVPRSPGRTENPPSPGSRWKKGKLIGRGTFGHVYVGFNSDSGEMCAMKEVTLFLDDPKSKESAKQLGQEISLLSRLQHPNIVQYYGSETVDDKLYIYLEYVSGGSIHKLLQEYGQLGEQAIRSYTQQILSGLAYLHAKNTVHRDIKGANILVDPSGRVKLADFGMAKHINGQQCPFSFKGSPYWMAPEVIKNSNGCNLAVDIWSLGCTVLEMATSKPPWSQYEGIAAMFKIGNSKELPPIPDHLSEPGKDFIRKCLQRDPSQRPTAMELLQHPFVQKAVSLEKSVLSEPLEHLAVISCRSSAKMAAHTRNISSLGLEGQTIYQRRGAKFSSKHSDIRIRSNISCPVSPCGSPLLKSRSPQHSNGRMSPSPISSPRTTSGTSTPLSGGNGAIPFNHLKQSTYSNEGFAIPSRSPDDLFASRPTDPDLGQFIRVHQVSQGLQERVVSEADILSPQFGKRLGNVFDLRDKLSPSERFTHHAFVDHVKLNPSLDLTSGSPHLGLKHGN

SEQ ID NO: 25110 - protein, 355 aa, Paxillus involutus
MAASTYHNDLLAPFLALPQGDKVQAEYVWIDGDSGLRSKTTTVSKKVTDIGQLRIWDFDGSSTNQAPGHDSDVYLRPAAIFKDPFRGGDNILVLAETYNSDGTPNRTNYRHHASKVMDLAKDSVPWFGLEQEYTLFDADGSPFGWPKGGFPGPQGPYYCGAGTGKVVARDLIEAHYRACLYSGINISGINAEVMPSQWEFQVGPYEGISMGDHLWMARYLLVRIAEQWGIKVSFHPKPLQGDWNGAGCHTNYSTLPMREPGGMKHIDAAIEKLAKRHNEHIAVYGEDNELRLTGRHETGHIGDFSSGVANRGASIRVPRHVAAQGYGYLEDRRPASNIDPYRVTGIIVETTLLDK

SEQ ID NO: 25111 - protein, 173 aa, Oryza sativa
  misc_feature (17)..(17): Xaa can be any naturally occurring amino acid
  misc_feature (25)..(25): Xaa can be any naturally occurring amino acid
  misc_feature (53)..(53): Xaa can be any naturally occurring amino acid
  misc_feature (57)..(57): Xaa can be any naturally occurring amino acid
  misc_feature (70)..(72): Xaa can be any naturally occurring amino acid
  misc_feature (78)..(79): Xaa can be any naturally occurring amino acid
  misc_feature (85)..(87): Xaa can be any naturally occurring amino acid
  misc_feature (89)..(89): Xaa can be any naturally occurring amino acid
  misc_feature (100)..(101): Xaa can be any naturally occurring amino acid
  misc_feature (104)..(104): Xaa can be any naturally occurring amino acid
  misc_feature (106)..(106): Xaa can be any naturally occurring amino acid
  misc_feature (108)..(108): Xaa can be any naturally occurring amino acid
  misc_feature (114)..(115): Xaa can be any naturally occurring amino acid
  misc_feature (118)..(118): Xaa can be any naturally occurring amino acid
  misc_feature (122)..(123): Xaa can be any naturally occurring amino acid
  misc_feature (125)..(125): Xaa can be any naturally occurring amino acid
  misc_feature (127)..(127): Xaa can be any naturally occurring amino acid
  misc_feature (131)..(131): Xaa can be any naturally occurring amino acid
QDSARARAEFGTNSSVXGLSAVLPXAVKGRSLQIQAPRRVALRVRAAAAAVAXEAAXVDYNSNISVFPMXXXDLIGGXXCNVHMXXXAXLSSSAAVAVSXXAAXEXHXDYLSYXXPTXVFPXXAXDXLGGXFCKATLSPSHPWKNWLLSSFLLCSTTLIFLQIYLILLWYIPC

SEQ ID NO: 25112 - protein, 664 aa, Unknown
  marine gamma proteobacterium HTCC2207
MFLKRKLSFMCGILGLSEVLQETLYTRRDRQETISRCFEEGLAILSHRGPDASGAKYFFDEGVFLGHTRLSIQDLSPAGTQPMMSLDEKYAITFNGEIYNFPVLKEKLEFLGYNFSSNTDTEVILNLYQEYGLDCFAMLDGIFALGIFDKEKNQLIISRDGLGIKPLYYYQDESRLVFASEIKAIEIFLKDVVLTLQKSNINKYLTFQWCPGEGTPFAEIKKHIPGETLVVTDGKIVDRKTFYRLPIFRPPAKNLKTSVRSIISGLDANLRIAVHDQMLSDAPVGAFLSGGLDSTSIVAFAKEIDPNITCFTIDAGNAANDGMADDLPYARAAAEHLKVPLEIVKVNPESLVQNLEKMVWMLDEPLGDPAPLNVFYISQLAKDNGIKVLLSGAGGDDILTGYRRHHAIMIDRQIQRLPKVLLSAVELFSGKLDKRVTLFRRLAKLFNGISLAGESRIINYFKWADQGQLLSLYTNDFRNEIKNELAEQPMLDFLAHAHPDSTDLDKMLALEQRFFTTDHNLMYTDKMSMAAGVEVRVPLLANNLIEYAATIPDNLKQNGRQGKWIFKKTMEAYLPKEIIYRPKTGFGAPLRSWLKVELRDYLEDLLSRKSLYSRGLFDPEAVHALISRNDEGQVDASYTIFSLMCIEIWCRQHVDSVKLSTGST

SEQ ID NO: 25113 - protein, 211 aa, Methanothermobacter thermautotrophicus
MGKRWQAERKRDHYYRSAKKENYRSRASYKLLQLNNKYKLIKKGDRVLDLGAAPGGWSQVALDKVGEEGLVVAVDLQRIKGFPAENFRAIRGDFTDPEVKDKIIRELGGRADVVISDAAPSLSGIRDIDHLRSVDLVENVLDIAYRVLDRKGNILIKAFQGPELDRVIKELRKDFWKLKTTKPASSRKASAEMYIVGRDFKGKEKWERIIH

SEQ ID NO: 25114 - protein, 397 aa, Pyrus pyrifolia
MATTKFLLSLLLLVQLAATAYSIGVNYGTLGDNLPPPAKVADFIKTQTNIDAVKIFDTNPDIIKAFANTNISLTITIPNGDIPKLIKLRTAPRWVVDHVKPFYPASKIKYIAMGNEVLHWGDDALKSNLVPAMKTLHNALVREGIKDVKVSTPHSLGIMLSSDPPSMGRFRPEVIPILTQMLRFCRQTKSPFMVNPYPYFGWSPEKESYALFRPNNGAHDKFTGKFYTNMFDGLMDAVYSAAKAIGFGDVNLIAAETGWPSACEFPVCSVQNAVDYNGHLIKHIESGRGTPLMPNRKFETYIFALFNENQKPGPAAEKNFGLFKPDMTPVYNAGVMRNQQGGATPGPTMQIPTRPSTPAGPTTPAAPKRGKKGKPAGPAKSTTPATPATPASGGKKP

SEQ ID NO: 25115 - protein, 526 aa, Chlamydophila pneumoniae
MERKRFIDCDSTKILQELALNPLDLTAPGVLSAERIKKFSLLGGGFTFSFATERLDDAILAALISLAEERGLHESMLAMQQGQVVNYIEGFPSEMRPALHTATRAWVTDSSFTGEAEDIAVRSRVEAQRLKDFLTKVRSQFTTIVQIGIGGSELGPKALYRALRAYCPTDKHVHFISNIDPDNGAEVLDTIDCAKALVVVVSKSGTTIETAVNEAFFADYFAKKGLSFKDHFIAVTCEGSPMDDTGKYLEVFHLWESIGGRFSSTSMVGGVVLGFAYGFEVFLQLLQGASAMDQIALQPNARENLPMLSALISIWNRNFLGYPTEAVIPYSSGLEFFPAHLQQCCMESNGKSIAQDGRRVGFSTSPVIWGEPGTNGQHSFFQCLHQGTDIIPVEFIGFEKSQKGEDISFQGTTSSQKLFANMIAQAIALACGSENTNPNKNFDGNRPSSVLVSSQLNPYSLGELLSYYENKIVFQGLCWGINSFDQEGVSLGKALANRVLELLEGADASNFPEAASLLTLFNIKFR

SEQ ID NO: 25116 - protein, 328 aa, Chlamydophila pneumoniae
MAFKEVVRVAVTGGKGQIAYNFLFALAHGDVFGVDRGVDLRIYDVPGTERALSGVRMELDDGAYPLLHRLRVTTSLNDAFDGIDAAFLIGAVPRGPGMERGDLLKQNGQIFSLQGAALNTAAKRDAKIFVVGNPVNTNCWIAMKHAPRLHRKNFHAMLRLDQNRMHSMLAHRAEVPLEEVSRVVIWGNHSAKQVPDFTQARISGKPAAEVIGDRDWLENILVHSVQNRGSAVIEARGKSSAASASRALAEAARSIFCPKSDEWFSSGVCSDHNPYGIPEDLIFGFPCRMLPSGDYEIIPGLPWEPFIRNKIQISLDEIAQEKASVSSL

SEQ ID NO: 25117 - protein, 130 aa, Arabidopsis thaliana
MIREISNLQKDIINIQDSYSNNRVMDVGRNNRKNMSFRSSPEKSKQELRRSFSAQKRMMIPANYFSLESLFLLVGLTASLLILPLVLPPLPPPPFMLLLVPIGIMVLLVVLAFMPSSHSNANTDVTCNFM

SEQ ID NO: 25118 - protein, 46 aa, Brassica napus
GTPESSREPCPDRILDDIGGAFGMGAVGGGAFHFIVTIVMVGRAIW

SEQ ID NO: 25119 - protein, 415 aa, Thermus thermophilus
MLRLDTRFLPGFPEALSRHGPLLEEARRRLLAKRGEPGSMLGWMDLPEDTETLREVRRYREANPWVEDFVLIGIGGSALGPKALEAAFNESGVRFHYLDHVEPEPILRLLRTLDPRKTLVNAVSKSGSTAETLAGLAVFLKWLKAHLGEDWRRHLVVTTDPKEGPLRAFAEREGLKAFAIPKEVGGRFSALSPVGLLPLAFAGADLDALLMGARKANETALAPLEESLPLKTALLLHLHRHLPVHVFMVYSERLSHLPSWFVQLHDESLGKVDRQGQRVGTTAVPALGPKDQHAQVQLFREGPLDKLLALVIPEAPLEDVEIPEVEGLEAASYLFGKTLFQLLKAEAEATYEALAEAGQRVYALFLPEVSPYAVGWLMQHLMWQTAFLGELWEVNAFDQPGVELGKVLTRKRLAG

SEQ ID NO: 25120 - protein, 320 aa, Lactobacillus plantarum
MKRIGILTSGGDAPGMNAAVRAVAGKAMAEGLEAYGINYGFAGLVAGDIHKIEAADLDGVIQRGGTLLYSARYPEFAHEEGQLKGIEQLKRFGIDALVVIGGDGSYHGALRLTEHGYNTIGLPGTIDNDIPYTDFTIGFDTAVNTNVQALDRIYDTAHSHDRTFVVEVMGRGAGDVALWSGVSIGATAIVVPEVDWDMEEIANKIKHNRANGHRSNLIVLAEGVMGAQEFVEKLSEYGDFDARGNTIAHMQRGGNPTAKDRVMASKMGAYAVELLLAGKGGLAVGIQNNQLVNHNILDLFESKHDVEVSLDKLNEEISFK

SEQ ID NO: 25121 - protein, 131 aa, Prunus mume
MAKFNEVQKRKRAQNAERKRAVHGDPSTGKLKNKPQPLSISGKRKRKLLKKWRRDQNEAVQKGLITMQDVEMAAADGGEESTDTKKNCSKFPMKKGLKLKQLKRKGRNKGKSSSKPAATAEASLDANAMLE

SEQ ID NO: 25122 - protein, 518 aa, Oryza sativa
MVGAGEGDRVGGGAAVGEGQQFVDRSKVRILLCDSDPSSSREVLRLLCNCSYQVTCAKSPRQVINVLNCEAGEIDIILAEVDLPVSKCFKMLKYIARNKELRHIPIIMMSNRDEVSVVVKCLRLGAAEYLVKPLRMNELLNLWTHVWRRRRMLGLSEKNFFNDNFELALSEPSDANTNSTTLLSDDTDDKPKENINQETSTSNQHEYESNPSDAEPKQKGTPEGLLVSTEGGDQASSPGVMFSRPIKTNLRVAESSAFLAYVKSSTPTTSSFDSELQKGGNRLDSSDHRGNFSSTTDRSDTGTDVNIRDKEAFEMPVQYPVVCFSSSNLHLERSNEGQNDASGTPPVYHFPFYYPGMMDHGMTHPPVQNFQGNINNAQVHTPQTLLPQYNVYPQCHGVSMMPPFQYNPAGMSIQSNQLPTQNMWPQASSTPMPEETCSRSERRAAALAKFRLKRKERCFDKKVRYVNRKKLAETRPRVRGQFVRQANYTDITSTGDDISEDEDDDPSSREVEMVSSPE

SEQ ID NO: 25123 - protein, 1405 aa, Mycobacterium avium
MNTMCAYCGVGCGMVLQITTDPQTGRRHVAKSVGNKEHPANFGRLCTKGATTADLLAAPGRMDSAHARAGRGEPLEPIGTDQAITRCAKQLRAIIDEHGPDAFAMYVSGQMSLEAQYLANKLTKGFIGTNQIESNSRLCMASAGSGYKLSLGADGPPGSYQDFEHADVFFVIGANMADCHPILFLRMMDRVKAGAKLIVVDPRRTATAEKADLFLQIAPGTDLALLNGLLHLIVENGHTDGEFIAEFTEGWEVMPSFLEQYTPDRVSEITGIPEQDIRAAAQLIGEADNFMSCWTMGLNQSTHGTWNTNAICNLHLATGAICKPGSGPFSLTGQPNAMGGREMGYMGPGLPGQRSVASAADREFVEDVWGVPRGRLRTEVGTGTIDMFSRMADGQIKACWIICTNPVASVANRKTVLAGLERAELVIAQDAYLGTETSEYADVLLPAALWAETEGVMVNSERNITLSQPAVAAPGGAMPDWQIIARIACEMGFSEAFSYSCAEEVFEEIKRFWNPTTGYDLRGVSYERLRRQPLQWPCPPQSTADRNPIRYLNDGVSQTQLVREDGTVPRLAFPTPSGRAVFFARPHLQPEEMPDDDYPFLLNTGRLPHQWHTMTKTGKVAKLNKLNPGPFVEIHPDDAARLGIGEHDRVEIASRRGRAVLPAVVSDRVRPGNCFAPFHWNDAFGEYLSINAVTNDAVDPISNQPEFKACAVTLTKVAVSHPDSAIGTGPSAGHDTPESAPTEVREISVSQVDALGELLGVATSFKPEFNELGRSYLAGMLTGLRSDVGRRAGGVPTLPPSAPFDSRTRLWVDGLLAGLFSRADASQQAALPEPPQPAAQQPPAAPAGATPAPERAPVVVLWASQTGNAEELAADVAAQLAAAELPVALHSMDDFPAAELAATRELLLITSTTGDGDAPDNGSGLWRALTGDAAPRLGNTRYAVLALGDSNYDDFCGHGRKLDARLAELGATRIAERVDCEPDYEQAAAKWVADVIEALTRTPTAVGGDGGATVSARTSPVAAPSRPNTPAPHTYSKKHPLITDMVRNTTLNGPKSTKDVRHLVFNLPEDAVSYEAGDALGVWPRNSDELVDEWLAVTGLDGQTPVEVGEHGLMSLRSALTERIEIAHISRDLVRFVQERTGDAKLAELLKPENKRALADWTWGRQSIDLLAQLPVSASAHEWLRVLKRLQPRLYSISSSPKACPGEVHLTVSPVRYNFQGVPRRGVCSTYLAARSPGDRVAVYLQPSSNFRPPSDPDTPMIMIGPGTGIAPFRGFLQERRALGHRGPNWLFFGEQHAATDFYYRDELEQMREDGFLTELDLAFSRDQQHKVYVQHLMRNRGKQLWSWLQDGAQLYVCGTADPMAKDVDRALCDIAAEFGNLDPDAAKAYVQSLSADKRYHRDVY

SEQ ID NO: 25124 - protein, 186 aa, Streptomyces avermitilis
MRVDAKDMGTDLKSVLITKEEIDAKLAELAAKIDAEYAGKDLLIVGVLKGAVMVMADLARALSTPVTMDWMAVSSYGAGTQSSGVVRILKDLDTDIKGKHVLIVEDIIDSGLTLSWLISNLGSREPASLKVCTLLRKPEAAKVAIDVEWVGFDIPNEFVIGYGLDYAEKYRNLPFVGTLAPHVYGG

SEQ ID NO: 25125 - protein, 132 aa, Unknown
  Synechococcus sp. RS9917
MRMLHTMLRVGDLERSLRFYTEVLGMQLLRRKDYPSGRFTLAFVGYGEESDHTVLELTHNWDTDHYALGDGYGHIALGVDDIQATCAAIADKGGRVVREPGPMKHGSTVIAFVEDPDGYKVELIQLASRASS

SEQ ID NO: 25126 - protein, 174 aa, Xanthomonas axonopodis
MPLNDLQHVPGANDAPAETHGFVFNHTMLRVKDATQSLDFYTRVLGFRLLDARDFADAKFSLYFLALLPEGTAIPDDDAQRRLWMAGIPGVLELTHNHGTETQDGPVYHDGNSDPRGFGHLCISVPDIHAACARFDSLNVPYQKRLEDGRMKHLAFIKDPDGYWVEIISNTPLA

SEQ ID NO: 25127 - protein, 405 aa, Fusobacterium nucleatum
MHNVRNITEDLYWIGANDRRLALFENIHPIPEGVSYNSYMLLDKETVVFDTVDWSVTRQYIENIEYLLNGRELDYLVVHHMEPDHCASIEELAFRYPKMKIISSEKGFMFMRQFGYKSINGHQLIEAKEGDKFKFGKHEIVFLEAPMVHWPEVLVSLDITNGALFSADAFGSFKSLDGRLFNDEVNWDRDWLDEGRRYLTNIVGKYGPHIQHLLKKAGPVVDKIKFICPLHGVVWRNDFGYIIDKYDKWSRYEPEEKGILIAYASMYGNTENAIEILAKKLAEKGITNIKMFDVSNTHVSYLISNLFKYSHLVIASPTYNLGIYPVIHNFVMDMKALNLQNRTVAIVENGSWARKSGDLLQEFFETQIKDITVLNERVGLTSSANNVNLDEMDALVDALVESLNK

SEQ ID NO: 25128 - protein, 318 aa, Nostoc punctiforme
MLNGQRYFIALSKHSSECANLVWLTNLAHLRIRVFPDWEIHLDGGLTRIGVEKYMPVVSLAQMMESGVHFGHQTRRWNPKMSPYIYTSRNGVHIIDLVQTAQLMDNAYNYMRSHAEQGKKFLFVGTKRQAAGIIAQEASRCGSHYINQRWLGGMLTNWATIKTRVDRLKDLERREETGALDLLPKKEASMLRREMTKLQKYLGGIKTMRKVPDIVVIVDQRREYNAVQECQKLNIPIVSMLDTNCDPDVVDIPIPANDDAIRSIKLIVGKLADAIYEGRHGQLDAEDDYEDYDGSEYDDDYEETEYTDAVIPDEETEE

SEQ ID NO: 25129 - protein, 506 aa, Prunus mume
MASTFSHISLSLLSLVLLAFFSAAFPNNGPLQLSSTPKLQAEKFIRGLNLFPTDEINTVPHKTSLDEAFAGPMLVEKQFKMPFLGAASGPSVQELGHHAGYYRLPNSKAARMFYLFFESRTDKNNPVVMWLTGGPGCGSEIAVFYENGPFQIANNLSLAWNDYGWDKASNLLFVDQPIGNGFSYTSDEGDIRHDEEGISNDLYDFLQAFFAQHPQFAKNDFYITGESYAGHYIPAFGSRIHKGNKAKEGMYINFKGFAIGNGLTNPEIQYKAYPDFALQTGLIKKADYDRISKTIPDCEQAIKTCGSEGGEACASSYEVCNSIFEKIINIIGGTNYYDIRKQCEGDMCYDFSNMETFLKKKQVRDALGVGDIDFVSCSSTVYDAMLMDWMRNLEVGIPALLEDGIKVLLYAGEYDLICNWLGNSKWVHAMEWSGQKAFGASSTVPFKVGATEAGLLKSHGPLTFLKVHNAGHMVPMDQPEAALQMLTSWMQGKLAIAESVERIAPK

SEQ ID NO: 25130 - protein, 177 aa, Hordeum vulgare
MAGRDRDPLVVGRVVGDVLDPFVRTTNLRVTFGNRAVSNGCELKPSMVAQQPRVEVGGNEMRTFYTLVMVDPDAPSPSDPNLREYLHWLVTDIPGTTGASFGQEVMCYESPRPTMGIHRFVLVLFQQLGRQTVYAPGWRQNFNTRDFAELYNLGQPVAAVYFNCQREAGSGGRRMYN

SEQ ID NO: 25131 - protein, 499 aa, Alteromonadales bacterium
MNNQNNNTDKPNLSFWQIWNMCFGFLGIQFGFALQNGNVSRIFQTLGAQVDDIPILWVAAPLTGLIVQPIIGYWSDKTWGRFGRRRPFFFVGAVLTTLSLFIMPHSPTLWIAAGMLWIMDASINVTMEPFRALVGDNLPEKQRATGYGLQSFFIGIGAVLASALPWMMTNWFDVSNTAAAGQIPESVKYSFYWGGVVLLVAVLWTVARTKEYSPEQLAEFEQQTAKSTTAIIADINFNKGAIIFVVLGLATLALVMGLSLEKELYLLAGGLLAFGIVQWIAAALKSANKTQGGFYQVVQDVFTMPEAMKQLAWVQFFSWFTLFAMWIYTTAAVTSFHYGSSDATSKAFNDGADWVGILFAAYNGFAAIAAMCIPFLVKKMGLKGAHCFNLLLGALGLASFIFIQDPKMLLIPMIGVGFAWASILSLPYAMLSNALPSNKMGVYMGIFNFFIVIPQLLAASILGLILRFVFSNQPIYALLIGAASFVVAAIAVMRVKNSN

SEQ ID NO: 25132 - protein, 326 aa, Unknown
  Azoarcus sp. BH72
MTHWYEDNARSIGHTPLVRLNRVTDGAPATILAKIEGRNPGYSVKCRLGAALIWDAEKRGLLGPGKELVEPTSGNTGIALAFVAAARGIPITLTMPETMSIERRKLLLAYGAKLVLTEGPKGMSGAVAKAEEIAASDPSRYVLLQQFKNPANPAIHEETTGPEIWNDTEGAVDIFVSGVGTGGTITGVSRYLKKTRGKDVLSVAVEPAASPILTQKRSGQELKPAPHKIQGIGAGFVPEVLDLSLVDQVETVGNEEAVDYARRLAREEGILSGISSGAAVAAAVRLARDPQHAGKTIVVVLPDSGERYLSSVLFEGVFDATGLPTA

SEQ ID NO: 25133 - protein, 570 aa, Aspergillus oryzae
MFSGSSSPPKDKSNSVPHSGAVDTQSLSVHPEEGSAAQTSKSLLSGGFFTRRTSEDQAPAGEKKRRSSTVTKAATFFTNAKNSLSLSSSPRESSSFNYTVRSPQTLQSLGSMDPALSVPQGSLNNSAGDSLPTPRSSFKVGVTEDRNRKCRRTMEDTHAYLYNFLGTPAPLARADGENEAGSSLAPDEASSVVETDNGYFAIFDGHAGTFAAEWCGKKLHLILEDIMKKNPNTPVPELLDQTFTTVDQQLEKLPVKNSGCTAVIALLRWEDRIPSSHSATGSSALAPAAAAAAAAKGDSNSEADDTPTQATSSGPSILPKLQEKAIRQRVLYTANVGDARIILCRNGKALRLSYDHKGSDENEGKRIANAGGLILNNRVNGVLAVTRALGDAYLKDLVTGHPYTTETVVQPDSDEFIILACDGLWDVCTDQEAVDLVRNVPDAQEASKILVDYALARFSTDNLSCMVIRLDTNRVKEVINKTAEPIGVAGDPSMDVEHGVSEADKIIEGARKSMANADIADDGETAEKGKNDILHKMVDGEPGPEMSLDDSNDAPTVSHLNKTNANNGIP

SEQ ID NO: 25134 - protein, 340 aa, Aspergillus oryzae
MGQTLSEPVVDKTSSEGEDDCCIYGVSAMQGWRISMEDAHAAVLDLHAKYTSPEETSTDPAKRLAFFGVYDGHGGDKVALFAGENVHKIVAKQDSFAKGDIEQALKDGFLATDRAILEDPKYEEEVSGCTAAVSVISKHKIWVANAGDSRSVLGVKGRAKPLSFDHKPQNEGEKARISAAGGFVDFGRVNGNLALSRAIGDFEFKKSPELAPEQQIVTAYPDVTVHELSDDDEFLVIACDGIWDCQSSQAVVEFVRRGIAAKQELYRICENMMDNCLASNSETGGVGCDNMTMIIIGLLNGRTKEEWYNQIAERVAKGDGPCAPPEYGKSLEDSTASNPY

SEQ ID NO: 25135 - protein, 521 aa, Zea mays
MQFSSVLPLEGKACMSPVRRGSGGYGSERMRINCCSIRRNKALRRMCFSARGAVSSTQCVLTSDAGPDTLVRPNHPFRRNYADPNEVAAVILGGGTGTQLFPLTSTRATPAVPIGGCYRLIDIPMSNCFNSGINKIFVMTQFNSASLNRHIHRTYLGGGINFTDGSVEVLAATQMPGEAAGWFQGTADAVRKFIWVLEDYYKHKAIEHILILSGDQLYRMDYMELVQKHVDDNADITLSCAPVGESRASDYGLVKFDSSGRVIQFSEKPKGAALEEMKVDTSFLNFATCTLPAEYPYIASMGVYVFKRDVLLDLLKSRYAELHDFGSEILPKALHEHNVQAYVFTDYWEDIGTIRSFFDANMALCEQPPKFEFYDPKTPFFTSPRYLPPTKSDKCRIKDAIISHGCFLRECAIEHSIVGVPSRLNSGCELKNTMMMGADLYETEDEISRLLAEGKVPIGVGENTKISNCIIDMNCQGWKERLHNKQRGRSKSPDRPGRRILIRSGIVVVLKNATIKDGTVI

SEQ ID NO: 25136 - protein, 575 aa, Anabaena variabilis
MTIATSSRPRDVQVADIGENTLILRSRTWERLKFEVEYSRQRGTTANSYLIQADKKALIDPPGESFTAIYLEQLAQYLDFTTLDYIILGHVNPNRRVTLQELLSKAPQATLICSRPAANALKTAFPEWESRIQAVRFEDILDLGQGHQLTFVTAPTPRWPDGLFTYDSATKILYTDKFFGAHICEDTLFDEDWRKLDAERHYYFDCLHAPQAKQVEAALDKVVMLGARYYAPGHGPVVRYSLSRFTYDYRQWCQGQKAQDLNVALLYTSAYGNTGILANAIAQGLVQNDVNVQSVNCELADTAEITRIVEACDGIIIGSPTLGGHAPTQIQTALGIVLSTAAKTKLAGVFGSYGWSGEAIDLIESKLKDANYRLGFDTIRVRFSPTPEILQQCQAAGATFAQTLKKNKKLRTPRQVIPEAKIDRTEQAVGRIIGSLCVVTTRDQESHKGILTSWVSQATFNPPGIMMAIAQEQNADLMSHIGDQFVLNILKEGRNVRRYFSRQSTLGDNPFANLETKTADNGCLILTEALAYLECTVTNQLECGDRLLIYAVVDKGEVLANDGVTAVEHRKSGSH

SEQ ID NO: 25137 - protein, 154 aa, Oryza sativa
MLNIVTVRCGHCTSLLSVNLRGLVQALPAEDHLQDNLKMHNMSFRENYSEYGSSSRYGRVPMMFSKNDTEHMLHVRPPEKRQRVPSAYNRFIKEEIRRIKANNPDISHREAFSTAAKNWAHFPNIHFGLGSHESSKKLDEAIGAPSPQKVQRLY

SEQ ID NO: 25138 - protein, 576 aa, Anabaena variabilis
MVALTEDTQANANRGRLTVQTVEIAAETTAIRCLDWDRERFDIEFGLRNGTTYNSFLIQGEKIALVDTSHRKFEKLYLEIVAGLIDPNTIDYLIISHTEPDHSGLVKDILQLAPSITIVGAKVAIQFLENMVHQPFKSLQVKSGERLDLGNGHNLEFVSAPNLHWPDTILTYDHKTGILYTCDVFGMHYCDDQTYDENFFAIEEDFKYYYDCLMGPNARSVLAALKRIENLTINTVATGHGPLLQNHISEWLGKYQNWSLEQAKTETLVALFYAEDYGYSEHLVHTLGHGCTKTGVAVELIDLNTAEPQEVRELVAQASGLVIAMPSQYSLTAQAALNTILAAVHHKQAIGLLESGGGEDEPVFPLRNKFQELGLVEAFPPILIKEAPTQTTEQLCEEAGTDIGQWLTRDRTIKQIKSINTDLEKALGRISTGLYIITTKKGEIQGAMFASWVTQASLNPLGVAIAVSKERAIESLMHVGDRFVLNVLEEDNYQGLMKHFLKRFAPGADRFAGIKTYPATDGSPILAESLAYTECEITSRIDCGDHWIIYSTVQVGRVANVHAMTAVHHRKVGNHY

SEQ ID NO: 25139 - protein, 307 aa, Anabaena variabilis
MSLTFVPPPIQKINSEIANNAGVEIDVLRLDLMHPWVNGNKWYKLKYNLLEAKEKGYTTLLTFGGAYSNHIFATAAAGNLLGFQTIGVIRGEETLPLNPTLSFATKQGMQLVYVDRETYRQRNSATLHADLRKRFGEVFIIPEGGSNLNGVRGCLEIISAATQAFNIVCVACGTATTLAGIALALEAKQRVIGFPVLKNGGFLAEEITQFMNNYVAAGLPISSSSPAHWELVCDYHFGGYAKVKDDLIVFSQQFTQTHGVPLDYVYTAKMFYGVMDLLKQRYFTKGDRILMIHTGGLQGNIGMSERL

SEQ ID NO: 25140 - protein, 334 aa, Prochlorococcus marinus
MASSQASPGTVLITGTTSGVGLYACKALVYRGWQVITANRHPLRAVAAAERVGIPAAQLQHLRMDLSDLQSVRDGVETLLGSLEQPLDALVCNAAVYQPRLRKPKRSAQGYELSMATNHFGHFLLIQLLLENLGKAKVFQSARGSYLSAARVVILGTVTANYKELGGKIPIPAPADLGNLSGFEQGFHAPISMASGKSFKPGKAYKDSKLCNMITTQELHRRLHEESGILFTSLYPGCVADTPLFRYTPKIFRFLFPIFQRLITGGYVTQAKAGQRVAQVVTNPEFGVSGVHWSWGNRQKKNRESFRQELSERATDPITAKRVWELSMKLVGLT

SEQ ID NO: 25141 - protein, 250 aa, Triticum aestivum
  misc_feature (208)..(208): Xaa can be any naturally occurring amino acid
  misc_feature (213)..(213): Xaa can be any naturally occurring amino acid
  misc_feature (216)..(216): Xaa can be any naturally occurring amino acid
  misc_feature (223)..(223): Xaa can be any naturally occurring amino acid
  misc_feature (225)..(225): Xaa can be any naturally occurring amino acid
  misc_feature (237)..(237): Xaa can be any naturally occurring amino acid
  misc_feature (243)..(244): Xaa can be any naturally occurring amino acid
  misc_feature (247)..(247): Xaa can be any naturally occurring amino acid
YLGGDAVAKNRDILRKNGITHVLNCVGFVCPEYFKSDLVYRTLWLQDSPTEDITSILYDVFDYFEDVREQAGRVFVHCCQGVSRSTSLVIAYLMWREGQSFDDAFQFVKAARGIANPNMGFACQLLQCQKRVHAIPLSPNSVLRMYRLAPHSPYAPLHLVPKMLNEPSPAALDSRGAFIVHVLSSIYVWVGIKCDTVMEKDARAAAFXVVRYXKVXGQIKVVXEXLEQPEFWDAFSXAPINSXXKMXLGK

SEQ ID NO: 25142 - protein, 708 aa, Vibrio vulnificus
MFEKPVVKTFQYGNHTVTLETGVIARQATAAVMVTMDDTAVFVSVVGKKEAVPGQDFFPLTVNYQERTYAAGKIPGGFFKREGRPSEGETLTARLIDRPIRPLFPEGFNNEVQVIATVVSVNPDVQPDIPTMIGTSAALAISGIPFNGPIGAARVGHIDGQLVLNPSNTELNASRLDLVVAGTESAVLMVESEADNLTEEEMLSAVVFGHDQQQAVIKAINEFAAEVATPSWNWVAPEANTALNEKVADLAEAKLVEAYKITEKMARYDRIHEIAAEVNAVILAEDPEADAKEIHTIFHDLEKTVVRRSIIAGNPRIDGREKDMVRALDVRTGVLPRTHGSSLFTRGETQALVTATLGTQRDAQIIDELTGEKKDYFLLHYNFPPYCVGETGFVGSPKRREIGHGKLAKRGIAAVMPSIDEFPYTVRVVSEITESNGSSSMASVCGTSLALMDAGVPIKASVAGIAMGLVKEGDDFVVLSDILGDEDHLGDMDFKVAGTSTGITALQMDIKIEGITKEIMQIALNQAQGARKHILSVMDQAISGARDDISEFAPRIHTMKISADKIKDVIGKGGAVIRALTEETGTTIEIEDDGTIKIAATEGAAAKEAIRRIQEITAEVEVGVIYTGKVARLADFGAFVTILPGKDGLVHISQIADKRVEKVSDYLTEGQEVQVKVLEIDRQGRVRLSMKEAVEKPVEAEAPAAEEE

SEQ ID NO: 25143 - protein, 733 aa, Propionibacterium acnes
MEGPGLEFTEAIIDNGKLGKHVVRFEAGLLAQQADGSAAVYLDGDTMLLSATTAAKTPRDSIDFFPLTVDVEERMYAAGRIPGSFFRREGRPSEGAILACRLIDRPLRPSFVKGLRNEVQVVVTVMALNPAVYYDVVAINAASMSTQLAGLPFSGPIGGVRMALIDDQWVCFPSVDQRKESTFDMVVAGRVLADGDVAIMMVEAESTPATWGLVRGGRTAPTEEVVATGLEAAKPFIKVLCDAQVALAAKLPKETYDFPVFKDYEDDVYAAVEEKAADELSRIEQIAAKLERQEAESELKARIKAELAETFPEREAEISGAFKAVMKKIVRKRVLDEGVRIDGRGPRDIRSLSAEVGIIPRVHGSALFQRGETQILGVSTLNMLDMEQKLDTLSPENTRRYMHNYNMPPYSTGETGRVGSPKRREIGHGNLAERALIPVLPTREEFPYAIREVSEAIGSNGSTSMGSVCASTLALLNAGVPLRASVAGIAMGLMSETDEDGKTKYLALTDILGAEDALGDMDFKVAGTSEFVTALQLDTKLDGIPADVLAGALKQAKEARTAILEVMNEAIDSPDEMAPTAPRIITVHIPVDKIGEVIGPKGKMINQIQDDTGANISIEDDGTIFIGADNGDSAESARSMINAIANPQMPEVGERYLGTVVKTTSFGAFVSLLPGKDGLLHISKMRDLNDGKRVEAVEDVLSVGQKIQVEIAEVDDRGKLSLVLASDEDDADE

SEQ ID NO: 25144 - protein, 373 aa, Candida albicans
MTTSLTEQTAILAKYLELSQNGKILAEYVWIDAEGNTRSKCRTLSKKPTSVDDLPEWNYDGSSTGQAPGHDSDVYLRPVAFYPDPFRKGDNIIVLNECWNNDGTPNKFNHRHECAKLMKAHASEEVWFGLEQEYTLFDQYDYPYGWPKGGFPAPQGPFYCGVGTGKVVARDVIEAHYRACLYAGINISGINAEVMPSQWEFQVGPCEGIEMGDQLWIARYLLQRVAEEFAVKISFHPKPLKGDWNGAGCHTNVSTKSMRVPGGMKVIESALSKLAKRHKEHMLLYGADNDQRLTGRHETGHMDTFSSGVANRGASIRIPRQVAKEGYGYFEDRRPASNIDPYLVTGIMVETICGSIPDADMAKEFLRESSDDN

SEQ ID NO: 25145 - protein, 490 aa, Ipomoea batatas
LNNNVLLSQSRKSLRLDGNKRKIKPGVAFSVLTRENGTETLTVEAPILERRRANPKNVAAIILPGGAGTQLFPLTNRAATPAVPLGGCYRLIDIPMSNCINSGVNKIFVLTQFNSASLNRHISRTYFGNGVSFGDGFVEVLAATQTQGETGMKWFQGTADAVRQFTWVFEDAKNKDIDNIVILSGDQLYRMDYMDLVQNHIERNSDITLSCATVGDSRASDFGLVKIDRRGRVVQFCEKPKGTDLKAMQVDTTLLGLPPQDARLNPYIASMGVYVFKTDVLLRLLRWRYPTSNDFGSEILPAAVMEHNVQAYIFRDYWEDIGTIKSFYDANLALTEEFPKFEFYDPKTPFYTSPRFLPPTKIDNCKIKDAIISHGCFLRECTVEHSIIGERSRLDCGVELKDTLMMGADNYETESEIASLLADGKVPIGVGENTKIRNAIIDKNVRIGKHVVITNKDGVQESDRPDEGFYIRSGITIIMEKATIRYGTVI

SEQ ID NO: 25146 - protein, 461 aa, Methanothermobacter thermautotrophicus
MDVVLINPEDRTAVKNKLGFVLPPLNLMYLGASLERASFSVKIIDDDLRRMGVEGVARLVERINPFIVGITATTATIRTSLEYIKAIKDRLPNVLTVIGGPHPTFLPVDTLRECRDLDVVVMGEGEATIVDLAENHERGGSLDGVAGITYREGDRIRTNEPRPLIEDLDEIPFPARHLVPFRDYETSSQDAGGMITSRGCVYPCRYCSSSLIMGKKFRFRSPENVVDEVEELVEVYGLHDIAFLDDTFMLHRPRAREISEEIRRRNLDVSFVTSSRVDMVQESLLRDLRNAGMSTIYYGVESGCQRVLDMMKKGITVKQAEDAVRVTKKVGVDVITSFILGYPGEKPSEMDRTIDFSIKLDPDYSQYSILTPFPGTPIYAELKSQGLIEDDWENYTVIKPVIKYEKLGLSRELIQKKLVKAYIKFYSRPRYLLKHSYMIRVFFETLYRTYIEPKIPFKKDR

SEQ ID NO: 25147 - protein, 159 aa, Unknown
  Synechococcus sp. CC9311
MAPNISNVSVNTPDGANKTLGSYSGKVLLIVNVASRCGFTRQYSGLQALQDSYAAQGLQVLGFPCNDFGGQEPGSLEEIKSFCSTTYNASFELFDKVHATGSTTEPYTTLNKTEPAGDVAWNFEKFLVGKDGTVIARFKSGVEPDSDELKTAIESALNA

SEQ ID NO: 25148 - protein, 462 aa, Unknown
  Shewanella sp. ANA-3
MGKLSIKQWLVFSAMLVAVLLAMFPLQQHPALFSYSASVVLITLLFWSTGFIPPFMAGLIFFALATIFKLIDPSALFSGFGSAAVWLIISGFVIGSAISESGLSRRLAAVIAPALTMSYPRMIAGLVISAMLLGFVMPSSVGRAVVMLPIGMALADQLGFSRGSNGRIGIATALALACNMPSLAVLPANIPNMILAGASENLFNVHFGYAEYLFLHFPILGLLKSAIIVALVVYLFPAKINKNQIAAATDIEAYDVVKQVKLALLLIITLLFWITDSWHGINPAWVGLTTAIILLLPKWGIIEPKRFNQSVDFSTVIFVAAALGLGALVNQSGLGSALGQAFSQYLPLSQGASFLNFISLSLISTLTGLVATVPGVPTVLTPMAADLANATGFSLPAVLMTQVIGFSTVIFPYQAPPLILAMQLSQESLAHLLKVTLPLALITLLVLMPLDYLWWHLLGWIS

SEQ ID NO: 25149 - protein, 717 aa, Arabidopsis thaliana
MEELDRSRAFARDVKRIVVKVGTAVVTGKGGRLALGRLGALFEQLAELNSDGFKVILVSSGAVGLGRQRLRYRQLVNSSFADLQKPQTELDGKACAGVGQSSLMAYYETMFDQLDVTAAQLLVNDSSFRDKDFRKQLNETVKSMLDLRVIPIFNENDAISTRRAPYQDSSGIFWDNDSLAALLALELKADLLILLSDVEGLYTGPPSDPNSKLIHTFVKEKHQDEITFGDKSRLGRGGMTAKVKAAVNAAYAGIPVIITSGYSAENIDKVLRGLRVGTLFHQDARLWAPITDSNARDMAVAARESSRKLQALSSEDRKKILLDIADALEANVTTIKAENELDVASAQEAGLEESMVARLVMTPGKISSLAASVRKLADMEEPIGRVLKKTEVADGLVLEKTSSPLGVLLIVFESRPDALVQIASLAIRSGNGLLLKGGKEARRSNAILHKVITDAIPETVGGKLIGFVTSREEIPDLLKLDDVIDLVIPRGSNKLVTQIKNTTKIPVLGHADGICHVYVDKACDTDMAKRIVSDAKLDYPAACNAMETLLVHKDLEQNAVLNELIFALQSNGVTLYGGPRASKILNIPEARSFNHEYCAKACTVEVVEDVYGAIDHIHRHGSAHTDCIVTEDHEVAELFLRQVDSAAVFHNASTRFSDGFRFGLGAEVGVSTGRIYARGPVGVEGLLTTRWIMRGKGQVVDGDNGIVYTHQDIPIQA

SEQ ID NO: 25150 - protein, 253 aa, Coprinopsis cinerea
MSCVKIATIMPSHYTTIGAVPTKDLKLHVHPASSSSPMAFPTAARTKPRRPSLQQSTWPLMTNTIAVSGPPSASPFSPSSNAPNLRNVSEIIPRLYISDLAFAENPSALSSYRITHVLSTLPDTIFCPPPTLLPLQPARLQIRVDDLPFAELAAHLPTTTAFIRDALAHNPEARVLVHCVEGISRSVSVVAAYLMAQYGWTPVEAVQFVKSKRVVADPNFGFVQQLHEYARTALGRQQCVAPGVPQYCGGSTT

SEQ ID NO: 25151 - protein, 545 aa, Pseudomonas putida
MATCGEVLVKLLEGYGVDHVFGIPGVHTVELYRGLAGSSIRHITPRHEQGAGFMADGYARTRGKPGVCFIITGPGMTNITTAMGQAYADSIPMLVISSVQTRDQLGGGRGKLHELPNQAALVAGVAAFSHTLMSAADLPQVLARAFAVFDSARPRPVHIEIPLDVLVEPADFLLPGRPVRGSRAGAAPQAVAQMAERLASARRPLILAGGGALAAGAALARLAEHLQAPVALTINAKGLLPASHPLQIGSTQSLPATRELVAEADVVLAIGTELAETDYDVTFKGGFEIPGSLLRIDIDPDQTVRNYLPELALVADAELAAEALFGALQAQPQPVHESTWGEARVAKLRQALAADWDQPTLSQTRLLNAILERLPNAILVGDSTQPVYTGNLTLDMHQPRRWFNASTGYGTLGYALPAAMGAWLGSAEQADQRAPAVCLIGDGGLQFTLPELASAVEAQVPLVVLLWNNQGYEEIKKYMVNRAIEPVGVDIHTPDFIGVARALGAAAEHVTDVVQLQAALGLALERKGPTLIQVDQNQWQETVLR

SEQ ID NO: 25152 - protein, 679 aa, Staphylococcus epidermidis
MEIFETLLIFVALVIVSSFVHTFIPKVPLAFIQIFLGMILYLTPIPVEFNFDSELFMVTLIAPLLFVEGVNVSRVHLRKYIKPVMMMALGLVITTVIGVGLFIHWIWPELPIGAAFAIAAILCPTDAVAVQAITKGKVLPKGSMTILEGESLLNDAAGIISFKIAVGVLITGTFSIFDAIQQFLIASIGGAIVGLIIGMALVRFRLTLMRRGIENINMFTFIQLLTPFVTYLIAELFHASGIIAAVVAGLVHGFERDRIAQTRTQLQMSYNHTWSILGYVLNGFVFSILGFLVPEVIVKIIKTEPHNLLFLIVITLLVALAVYLFRFVWVYVLYPYFYLSVSPFQKMISKNDEDKVTESKPKRSLYALIMTLCGVHGTISLAIALTLPYLLANHETFAYRNDLLFIASGMVILSLIIAQVILPLVTPDSPEVKIGNMSFKEARIYILEHVIDYLNQKSTFETSYRYGNVIKDYHDKLTFLKTVEKEDENSKELERLQKIAFNVETKTLEKLVDDGEITESVLENYMRYAERTEVYKQASLLRRIIVGLRGMLLKRRVKTKINSASSLSVTDNLLELGKINKLVHYNVVSRLAKEATTDNKLEVGMICDGYLMRIDNLTPNNFFNSRHEDTLTKIKLNALREQRRILRELIENDEITEGTALKLRESINYDEMVIVDSMT

SEQ ID NO: 25153 - protein, 129 aa, Brassica napus
QALVEKPFFETLARALKPGGVLCNMAESMWLHTHLIEDMISVCRQTFKTVHYAWSSVPTYPSGVIGFILCSTDGPAVDFKNPINPIEKLDGAMTYKREMKFYNSDMHRAAFALPTFLRREVASLLSSSS

SEQ ID NO: 25154 - protein, 511 aa, Haemophilus influenzae
MIIVNAFKKSLIVAASFASLSLFNSATAELVYKPLEQPVEPAKPDLKIESVNEKFAEKYPNQYNSWRSTANGNGEKIIYADEEDPRLIVLWGGYAFAKEYNAPRGHFYAVTDVRNILRTGAPKTANDGPQAMACWTCKGPDVPRLIAEWGEKDYFNAKWAKGGPEIVNSIGCADCHDTTSKDFAEGKPALRIARPHVLRALDALEKATAAKDKAEGRPHNNLSFNSAARTEKRAEICANCHVEYYFAGDIKQVTFPWDNGQTADDIEKYYDDIGFTDWTHSLSKAPMLKAQHPDFEIWSLGMHGKNGVTCVDCHMPKVQGADGKVYTDHQIQNPFDAFDHTCANCHDQSKEKLRDIVTSRKKEVKDVMGRLEDQVVKAHFEAKEAWDAGATKKEMEAALMDIRHAQWRWDYTAASHGGHMHAPEVVLRVLASGLDKVADARTKLAVILTKHGVKTPVQIPDISTADKAWKVMGIDIEKERKAKEEFLKTVVPQWEQQAREKGLLVDPPAQK

SEQ ID NO: 25155 - protein, 636 aa, Podospora anserina
MLEDPSYNSVVRWSPEGDSFVVLEKFTKTILPKHFKHSNFASFVRQLNKYDFHKVRHNEESGEAPYGRDAWEFKHPEFRADRKDQLDNIRRKAPAPRKPPPTEDAFPASQQIVVLSESLNATNVQIQTLQEQYLELDRTNRLLVAEVLSLQKMLRAQSQASNELISHLNNMEDRRRNSRHSAQSSHSSHSGTNYHQGTLGLLPDGTDEPAPELRRAREILNGVSPDSQADRELERLSMAYHQNGSPAESAGSSVMFTHAGPQTSMNVVHDPFSDPRHLVYPVGQTQGIDPFHADHIHNIPYSRPLSNPNVMTEAPSQISPPPGKEQNGSLWRGKKPQILLVEDDKTCARIGSKFLTNMDCSVETARDGLEAVEKINTDADRFDLVFMDIIMPNLDGVSATAMIRMVTPQIPIIAMTSNIRQEDIQTYFQFAKPFTRDGMVRILKKHLTRMLKDPQSAGVLNDPNDPTSAGNGGGGQQTAGGPGPPTGGYANANMAASMQAAINQAAQVQVKYEQTPIPSPSTTASWHSPGTTMQQVQHQQVQQQQQHASPRLDQGGYMNAVGSGQGVGGMVLTPGGSQRGPGPGQQQQQQYAGYMQAGPGPVTRLPEMGGMGGGAGDDRPEKRQRLYGPGQGGYVG

SEQ ID NO: 25156 - protein, 715 aa, Yersinia pseudotuberculosis
MKKILTVCPYCGSGCKLNLLVEDGEIVGAEPADGVTNQGALCLKGYYGWDFLNDTRLLTPRLTTPLLRRQRGEAFQPVSWEAAIAFITAKLSAIKERHGPDAIMMTGSSRGPGNEANYVMQKFARAAIGTNNIDCCARLCHGPSVAGLQQTLGNGAMSNSIGEIENTDCILVFGYNAADSHPIVARRILKAKNKGAKLIVCDPRHIETARIADQWLPLKNGANMALVNAFIHVLIEEKLYDANYVRDHTRGFDELKAGVAAYRPEDVEPITGLSAKAVRQAMRTYAAAPAATLLWGMGVTQWGQAVDVVKGLSSLALLTGNLGRPNVGVGPVRGQNNVQGACDMGVLPNTFPGYEKVTDSEARARFAHAWGVAELPAHVGYSITDVPHKVAEGKLKAYYVFGEDPIQTEPDLAAMRAAFAALDLVVVQDIFMTKTAELADVVLPATSWGEHEGVYTSADRGFQHFNKAIEPKGDVKPDWEIISLISTAMGYPMAYQNTQQIWDEMRGLCPPFAGATYDKLAGLGYVQWPCPTEDHPGTPYLYTDNQFATADGKGLLSCAPWQPPHEQTDSDYPLALCTVREVGHYSCRSMTGNCATLKILADEPGYVQIHPEDASYLGVIDQALIWISSRRGRVIARASVTERANRGAVYMTYQWWIGACNELTVDHVDPVSKTPEFKHCAVKVEAISDQTAAEQYVEQQYSQLKKRLSDAAVVP

SEQ ID NO: 25157 - protein, 510 aa, Unknown
  Burkholderia sp. 383
MDALQAAAETAAPSGTALKRRLQGRHIAMIAIGGSIGTGLFVASGASVAQAGPGGAIAAYIAIGLMVYFVVTGLGEMAALMPVSGSFAIYGEKYVDEGFGVALGWTYWYSWAVTIAIELVAAQIVMRYWFPTIPGIWWGAGFLVLIFLLNTLSVRGFGESEYWFSLIKVVTVVAFIAAGLLIAAGLIGNGHPVGMRNFTTGDAPFVGGVHAMMSVALIAGFSFLGTELVGITAGESENPRKTIPRAVKQIFWRIMLFYVFAIFVIGLLVPYTDPNLLKSDVTDIGVSPFTLVFSHAGFRLAAGAMNLVILTAVLSAGNSGTYAATRMLYNLAAEGRAPAMFATLSPGGVPRNALYATMAVGGLCFLTSLTNNQSIYLWLLNTVGITGFIAWLGIAVCHYRFRKGFLKQGYRLDQLPYRAKWFPFGPLFAIAICIVISLGQDYQAFFAARIDWMEVLSIYVWIPLFVAIWWAYRRARKSRLVRYEEMDIGPWLTRSVEAVDATVTQHGQPH

SEQ ID NO: 25158 - protein, 633 aa, Phalaenopsis equestris
MEGCDCIEPQWPADELLVKYQYISDFFIALAYFSIPLELIYFVKKSSFFPYRWVLIQFGAFIVLCGATHLINLWTFTMHSRTLAIVMTVAKVSTAVVSCATALMLVHIIPDLLSVKTRELFLRNKAEELDREMGLIRTQEETGRHVRMLTHEIRSTLDRHTILRTTLVELGRTLDLVECALWMPSRTGLNLQLSHTLNNQIPVGSVVSINLPVVNQVFNSSCAVRIPHTCPLARFQPHTGRYVPPEVVAVRVPLLHLSNFQINDWPELSAKNFAVMVLMLPSDSARKWHVYELELVEVVADQVAVALSHAAILEESMRARDQLMDQNVALDLARREAEMAIRARNDFLAVMNHEMRTPMHAIIALSSLLLETELTPEQRLMVETILKSSNLLATLINDVLDLSKLEDGSFELEVTVFNLHTVFREVVNLIKPIAAVKKLSLIVFLSPDLPSCAVGDEKRLMQTMLNVVGNAVKFTKEGSISITASIAKPDSLRDPRDPEFYPIPSDGHFYLRVQIKDTGCGISPQELPHLFTKFAHAQNGSDKGYNGSGLGLAICKRFVNIMKGHIWPESEGIGKGCTTIFIVKLGISEDPAHRFQHKLLPPIRAGQSEADAFGSKPTPTDLIPLKNRYQRSL

SEQ ID NO: 25159 - protein, 554 aa, Pseudomonas fluorescens
MAYYRTPHDVTALPAWQALKDHRQAMQDFSMREAFNADPQRFNQFTLSSCGLFLDYSKNLINAETRNLLVGLANEVDLKGAIKALFDGEIVNSSEGRPALHTALRRPVGDKLSVNGVNVMPEVHKVLNQITDLVGRIHDGLWRGYTEKPITDVVNIGIGGSFLGPELVSEALLSYAQKGVRCHYLANIDGSEFHELTQKLRAETTLFIVSSKSFNTLETLKNAQAARAWYLAQGGSEAELYRHFIAVSSNNAAAVAFGIREENIFPMWDWVGGRYSLWSAIGLPIALAIGMSNFKELLSGAYTMDQHFQSAPFEQNMPVLLALLGVWYGNFWGAQSHAILPYDHYLRNITKHLQQLDMESNGKSVRQDGTPVSTDTGPVIWGGVGCNGQHAYHQLLHQGTQLIPADFIVPIVSFNPVSDHHQWLYANCLSQSQALMLGKTLPEAEAELRDKGMSEDQVQKLAPHKVIPGNRPSNTLVVERISPRRLGALVAMYEHKVFVQSVVWGINAFDQWGVELGKELGKGVYNRLVGSEETAAEDASTQGLINYFRGRHRG

SEQ ID NO: 25160 - protein, 434 aa, Oenococcus oeni
MGETKVIRIEDVSKFVGQTVKIGVWLRQKRGSGKIAFLQLRDGTGFMQGVVSVGDVDEATFKLAEHLKQESSFYVTGEIHQDSRSEFGFEMAVSDIEIVGESEDYPITPKEHGTDFLFDERHLYLRHQKPFATMKIRDEIIRAIYDFFHKDGFLKLDSPIITDSAPEGTTELFPVKYFDKDAYLSQTGQLYAEAGAMAFGKVYDFGPTFRAEKSSTRRHLTEFWMIDAEMAWMHQEDSLKVQERFIAYLIERVVDNCQVELKMLGRDVEKLRAYTKLPYPRISYDDAVKLLQDNDFKIEWGVDFGSPEETFLAKRFNSPFFIVNFPKAIKAFYMKRPPSRDDVVISADMLAPEGYGEIIGGSERDTDYDYLKQQIISQHLDLSEYSWYLDLRKYGTVPHSGFGLGLERLIRFIAGEDHIRETIPFPRTLNRLHP

SEQ ID NO: 25161 - protein, 483 aa, Ashbya gossypii
MTNTIPTLPEWSAEEVEQRLLPELLQWSLANGGTIYPPGFNINQAEALTMTLFPTPLPRKALEKAVRVQTTYNELYARIAQDKNGWLSEVTEQLANFDANFTGRLWKLYLEAQAIGISQKIGLGVFRSDYLLDADSGDLKQVEFNTVSVSFAGLSTKVGAVHNFLNESGKYSRNGGRFYESEVPISESAFLLPRALASAADKYNSLTGSRDTIVAFIVQRGERNVVDQRILEYNLFERQGVKSVRLMLHEVHERTRLDPITKRLYLTSTGQEIAVVYFRTCYSPQDFASEQDWKNRLSLELSYAIKAPNLLTQLSGTKKVQQLLSEEAVLAKFLPADRRSDIGATFVNLYPLDDSPLGKEGKRLALEMPERYVLKPQREGGGNNIYKEDIPAFLGTIPEEEWNGYVLMELINPKLNENVLVRGQELFQEPLISELGIYGTILFSDEEIYSNDYAGWLLRSKLPSSNEGGVAAGFGCVDSMVLY

SEQ ID NO: 25162 - protein, 117 aa, Triticum aestivum
  misc_feature (39)..(39): Xaa can be any naturally occurring amino acid
  misc_feature (47)..(47): Xaa can be any naturally occurring amino acid
  misc_feature (58)..(58): Xaa can be any naturally occurring amino acid
MQRPELTNMPSLQKPLPPQLADNALTSLPECLRRAKFIXGNQLATDXLLSSMATQQFXKNMHETDPEKIRNMDDYATRGLISLILYESEKMTRRKFSGEDSAGLGWPLPSVFAVYTV

SEQ ID NO: 25163 - protein, 330 aa, Chlamydophila abortus
MVMKLTRTVSVAVTGGTGQIAYSFLFALAHGDVFGSDCGIDLRIYDLPGLERVLSGVRMELDDGAYPLLQSLRVTTSLEDAFDGIDAAFLIGAAPRGPGMERSDLLKRNGEIFSLQGSVLNTSAKRDAKIFVVGNPVNTNCWIAMSQAPRLNRRNFHSMLRLDQNRMHTMLAHRAEVPLDEVSHVVIWGNHSAKQVPDFTQALISGKPAVEVIGDRDWLENIMLPSIQNRGSAVIEARGKSSAASAARALAEAARSIFLPKDGEWFSTGVCSDYNPYGIPEDLIFGFPCRMLPSGDYEIVPGLLWDTFIKNKIQISLDEISQEKANVSLL

SEQ ID NO: 25164 - protein, 934 aa, Chlamydomonas reinhardtii
MASMAAELRPSDGGSSLHMLDSLLMMGLSSGGGVGGGGSSQSQILDSAGAAELAALLLPQHSNDPLHLMSTGDAALGLAGPMAAAEHHQHHPHHQHHSVPATAGFPSQTPPPPLFSNATAGAAPATRVRAAGSCGSGGVAGGTTSHSSEDGVFHSADPHHHHQQHLQQPQPQQQQQQQQQPQHQQQQQQQQQQQPQQPQFHHHQPQQHQAQQAVAATAPAAAADHLFLPPAAAGAAGQQQAGWGAATGAHLFHSDAPNRPNGPKTPTNRNGYAMKPPPPAAAAAVMSGHAMAASGVVAGRGGGGGGCDAEEDELTFAAAAAAEVSSDDEVMGGRGGAVMGRAAVGGFRTPAPAPASAGAAVNVAAAAPAAPAGTWVPKGKPAVEVSAWAPAPAAPVAAAAAAAVAVSPTVAAFAAAPVVEAVALVRSQQRQEQEHQLVQVAAAEQQDQQQAKRPVRSSRRRAQESQQAAAEAQQAAQQAAAAQQQQQHTGSGNIVGDKQGKPQGGLQQGRPVATQPSPPPPAVATAAAAAAATAPVATAPVATVATAATADTMPQRLTAVQQHEAYPAVVRGTLDVRKACLPRFPLVAREQAEAELQSVATAALQQAAAAPGASAAVTAAAAAAAAAATAAGEGKAGEGKAATARRGGRGAAEAEAAAALPAVGASGNPGLDEAMGAYVRVAALYGDEAAAAVAECESLMADFDNKLQLGNLATTFAAAASPTAAASGRARGGARSGGVGGGGTKRVASGANASGANSSGMSGGGGGDSAGAEAAAGDEMEWAPGATSVDTATGGADDEDGEEEEGQQPGGAAAAAAVAAAGGEASQLAASIAATYGSQLVQVAASLAQRPKVGKLPPAATQLLKGWWDDNFVWPYPSEEDKKQLGEAAALNNTQINNWFINQRKRHWHKHFPNRRPPSTREEAERLLRAAGAI

SEQ ID NO: 25165 - protein, 706 aa, Trichodesmium erythraeum
MLQERIDIHPTHSHGDFKLRSGKPFPFGATMVSGGVNFSIFSSYATSCTLVLFQKGALKPMAEIPFPEEFRIGNVYCMIVFDLDVENIEYGYRMDGPNNFHEGQWFDKSKILMDPYAKIIGGRDVWGKTPNWDDIYQHRGRIPYDDFDWENDRPLEIPPQDQIIYEMHVRSFTAHPSSGVKHPGTFAAIREKIPYLKELGVNAVELMPIYEFDEFENSRPSPITGEMLYNYWGYSTVGFFAPKAGYAATGKLGMQMDELKTLVKDLHKNGIEVILDVVFNHTAEGNENGPTISFRGIDNKTYYMLTPEGYYFNFSGCGNTINCNNPIVRNVVLDCLRYWASEYHIDGFRFDLASILGRDPWGAPLANPPLLETLAFDPILANCKLIAEAWDAGGLYQVGSFPAFGRWAEWNGKYRDAIRKFIKGDCTVGEMAQRIQGSPDLYAWQGRGPATSINFITAHDGFTLADLVSYNDKHNEANGENNNDGANDNESWNCGAEGWSDDPGINALRSRQMRNAIAIMMVSQGVPMLLMGDEIGRSKNGNNNTYCHDSELNWLNWELLETNAELFRFVKNCVAFRKAHPILKNQNHFRNQDYVGSGKSDITWHGTQAWNADWSDNSRTLAFMLCGKHATEVTKQDNDIYVAMNMHWDSLWFNIPGLSDGKHWHIFVNTACASPEDVWELGSEPVLENQHGLLLGDRSIVILVSK

SEQ ID NO: 25166 - protein, 464 aa, Alteromonadales bacterium
MNTLFWFRRDLRLFSNEALIEALNNGAKHAIFFVCEKQWQQHQAAPIQIDLLKRRVTYLQEQLANFGITLNVINAPSFSDCESELLSFCETHDIQHIIANTEYELNEVNRDKAVLAQCDKRSITFTLYEGDLIAPVGSIKNQSNEMYKVFTPFKRAWLKQYQDTHFSLAQWPQEQNPIKIEKSQHLESDGSSDKWPVDDETLLSVVDNFICDKLTSYDDQRDIPSIKGTSGLSPYLALGIVSPKQLLINIQQRYPDILTTSKSKTFTWVNELIWREFYRHLIAEYPKLSRGENFNEKYNPVEWRKSEKEFNAWCEGRTGYPLVDAAMLQLKQTGWMHNRLRMVVASFLTKHLLIDWREGERFFMQHLIDGDLASNNGGWQWAASTGCDAQPYFRIFNPITQSERFDPTGKFIRKYLPELENVPDKHIHFPHTYLAATGKGSECYWPAIVDHKAARERALAAFKV

SEQ ID NO: 25167 - protein, 357 aa, Zea mays
  misc_feature (203)..(203): Xaa can be any naturally occurring amino acid
MACLTDLVNLNLSDTTEKIIAEYIWIGGSGMDLRSKARTLSGPVTDPSKLPKWNYDGSSTGQAPGEDSEVILYPQAIFKDPFRRGNNILVMCDCYTPAGEPIPTNKRYNAAKIFSSPEVAAEEPWYGIEQEYTLLQKDTNWPLGWPIGGFPGPQGPYYCGIGAEKSFGRDIVDAHYKACLYAGINISGINGEVMPGQWEFQVXGLPVGISSGDQVWVARYILERITEIAGVVVTFDPKPIPGDWNGAGAHTNYSTESMRKEGGYEVIKAAIEKLKLRHREHIAAYGEGNDGRLTGRHETADINTFSWGVANRGASVRVGRETEQNGKGYFEDRRPASNMDPYVVTSMIAETTIIWKP

SEQ ID NO: 25168 - protein, 531 aa, Chlamydophila abortus
MMDRKGFLDSPSTKILQDLAVAPVDLTTPGIISQERVERFSLSIGGFTLSYATERVDEGVVSALTDLASERGLVSSMQAMQSGEVVNYIDNFPSESRPALHTATRAWVKEIPLTGNAEDIALRSKIEAQRLKDFLHQYRDAFTTIVQIGIGGSELGPKALHRALKGCCPSDKKVYFVSNIDPDNAAEVLQEIDCSKTLVVTVSKSGTTLETAVNEEFIADHFLKQGLHFRDHFIAVTCEGSPMDDRSKYLEVFHIWDSIGGRYSSTSMVGGVVLGFAYGFDVFFQLLEGAAAMDLAALAPQMSENLPMLAAMLGIWNRNFLGYPTSVIVPYSAGLEYFPAHLQQCGMESNGKSIAQTGEIIGFATSPILWGEVGTNSQHSFFQCLHQGSDVIPIEFIGFLDNQRGRDIVISGSTSSQKLFANMVAQSIALAKGRENTNPNKSFRGNRPSSLLVAERLTPYTMGALLAFYEHKIVFQGFCWGINSFDQEGVTLGKDLANQVLGIMQGQAKEGACLEAEALLKLFNSTQKKKS

SEQ ID NO: 25169 - protein, 282 aa, Chlamydia trachomatis
MELSCKLTLKELLESGAHFGHQTSRWNPKMKPFIFEEKNGLYIIDLAKTLGQLKKAVSCIQKTIEQERSILFVGTKKQAKQIIREAAIECGEFFASERWLGGMLTNMATIRNSVKTLNRIELDLEASNSGLTKKELALLAKRHRKLLNNLEGVRHMNSLPGLLIVIDPGYERIAVAEAGKLGIPVMALVDTNCDPTPINHVIPCNDDSIKSIRLIVNTLKDAVIDAKKRLGVEILSPVRPAERPAEEAVEELPLPTGEAQDEASSKEGVLLWADIDNCEALK

SEQ ID NO: 25170 - protein, 370 aa, Thermotoga maritima
MRVLGLILAGGKSDRLWPLTKVRASAAVPVFGKYRAIDFTLSNMVNSGIRKVGILTQYNPRSLMDHLGSGKEWDLDRKSGGLFILQPYVGPNREVWYRGTADAIFQNMTILRRGEEDHVLIGSGDHIYKMIYRDLFNYHLKKGADITLVVKELDETYNLSEYGIVQLDDDMRVVEIEEKPAHPKGNIAFLGVYFMNKELLKELLYATVPQGKYDLLLDIVIPNLDRLKVYAYRFDGYWRNVKKGIKEYYRINMDILKKEVRDELFYRNGKVYTKLKDLPPPKFTTTAVVENSLIADGSIVSGTVRNSVIFRNVRIKVGAVVENSIIMENTVVEEGAVLRNVILDKNCIVREGRVIEGDTELPVFEKRAVL

SEQ ID NO: 25171 - protein, 892 aa, Chlamydomonas incerta
MASILPAELRPSDGGSSLHMFDSLLLGLSSGGGGGGGGGGGGGSHSQILDSASAAELLMSQHSGDQLHLLSTGDAAGAMEADPQHQTTASAAAAAPAAPAPAAGGSFPALPPPPFRGTITTTIGTAPAAPASAAGSGGSVAGGGGGGGGGTASQSSEGGVFHPHRYHHQQQVVTPTSAQATAAATAAATAVAAATAEHLFLPPVALGAVSAGHAAGWGAATGAHLFHSDVPSHLTGHSHPNNNRNGHGVQPTQPALAAALMPARTRGGGVDDGCGEGDTEEGELTFAAAAAAADLSFDEEVIGARRQGPAAASGPGGGGASSGQVAAPDAAPAATPMVPKGKRALAAGALAAAPAPAPTAAVAAAKAVAPAAPVVEAVALVQSPPHPESSQGLQAEQQDPQQLQGKRPPVRSSRRVQEAAAQQQQVAQAAAQQAAVQSHAAGDKRQQATRGSRVAVKQEKDGEEASRLPGPKSSPPRAKGAAAAAPAPTGVTAAAATAAAGVAGAAAAAAATADTPSQRLARVQQHPAYPAVVRASLDVRKACLPRFPMGARDQAVGELQAAAVAALHQAAAAPGAPAAVAAAAVEAAAVVAVGEGKAAAAATAKRGGRGATGPEAAAAALSALGGSGNSELDEAMATYVRVAAVYSDEAAAAVAECESLMQDFDDKLQLGNLATTFAVATPAANGRPRGGVNGGATRAGGVGGGGMKRGAASCSEDLNGSVSNGGDAAGAGVGAAAEEAMDWAPGAGAASVDTAAGGGAEDEDGDEEGQMDGDRAAAGGEAPQLAASIAATYGSQLVQVAVNLAQRPKVAKLPEAARRLLTAWWEQHFVWPYPTEDDKKQLGGAAELNNTQINNWFINQRKRHWHKHFPNRRPPATREEAERHLRAAGVVG

SEQ ID NO: 25172 - protein, 423 aa, Thermotoga maritima
MGNTVAMILAGGQGTRLGVLTERIAKPAVPFGGKYRLIDFTLSNCVNSGIYRVGVLTQYRPHVLSKHIGIGRPWDLDRKDGGVEILPPYVGRHESDWYKGTANAVYQNLEFLEENDAELVLILSGDHVYAMNYNDLIDYHLLKEADGTIACMEVPIEEASRFGIMITDVDGRIVDFEEKPAKPRSNLASLGIYVFNYEFLKKVLIEDENDPNSSHDFGKDVIPRILRENLGSLYAFRFDGYWRDVGTLRSYWEANLELVLPVPPFNLYDPNWRFFTHTEEMPPAYVAPGSKVSTSLVSEGAEVYGNVFNSVIFQGVKIGRGTVVKNSVIMTRTEIGENCYLENVIIAENVKIGSNVRMGVGEDAESKLDPKVYSGLLTVVGMNSVIPDDMVIGKNCVIGIGVRPEDFKSKTLESGDYVIVREE

SEQ ID NO: 25173 - protein, 317 aa, Chlamydomonas incerta
AMPLDLGRLASVREFAEAWRRRGLPLHLLVCNAGIMSPLTRSTTADGLEVQFQVNFLSHWLLTNLLMEHEHARRSKARTAVGGGSSSSSSSGSSSSSSSSSSSSSSSSSSSGTRVVVVSSVVHRAGPLQWPDLNSERCYEPYVTYGLSKLADVMLAAELQRRFDRHPEAPPSTPSAKPSKPATTTTTTNSRSNNSNSNDPFASDAAVALHPGLVRTHLADSFFRNYGGAQLGGARPLVAAWHTFLDTVGRALLASPEVAARRMLEACLGPAGRLGGRYMALGVPYPAAADARDPAKAAELWEVASRLTGHTPAPSLS

SEQ ID NO: 25174 - protein, 313 aa, Bdellovibrio bacteriovorus
MAQVTMKEMLDAGVHFGHQTQRWNPKMKPYVYTARGGIHIIDLQKTVVRANKAAEFVKEIAANGGRLIFVGTKKQAIEPIQEAAAKCGQYYVTKRWLGGMMTNFETIKSSIDRLRKIDTMKEKGEFNYLTKKERAKLEKEYLRLTDFLAGIRDMKEMPSAMFVVDLPKEHIAVAEAKRLGIPVVAIADTNSDPESVDFAIPGNDDAIRSIKLFSNLVADAYLEGAKEWEGKLRTMTDKQSDVAKEAKADGKEEAPKRRGAGAKAGAKEAPKKSAGPAVVKATKSRKLVAAGTAEEVEIQAELEQGQSTDESAE

SEQ ID NO: 25175 - protein, 282 aa, Chlamydia trachomatis
MELPCKLTLKELLESGAHFGHQTSRWNPKMKPFIFEEKNGLYIIDLAKTLGQLKKAVSCIQKTIDQERSILFVGTKKQAKQIIREAAIECGEFFASERWLGGMLTNMATIRNSVKTLNRIELDLEASNSGLTKKELALLAKRHRKLLNNLEGVRHMNSLPGLLIVIDPGYERIAVAEAGKLGIPVMALVDTNCDPTPINHVIPCNDDSIKSIRLIVNTLKDAVIDAKKRLGVEILSPVRPAERPAEEAVEELPLPTGEAQDEASSKEGVLLWADIDNCEALK

SEQ ID NO: 25176 - protein, 387 aa, Triticum aestivum
  misc_feature (323)..(323): Xaa can be any naturally occurring amino acid
MALALRAPRFQPLPASIPATSTAFASTARPSSSAATATAICATASPFTEATSSSRYRRDAWSYTAQDSSSSSSAAAAAAAAASGRRDDEIALQLPELRRLLEALRASRGKGLEGEGGGGGPGRVALVGTGPGDPELLTLKAVRAIEAADLVLYDRLVSNEVLDLVADGARLLYVGKTAGYHSRTQEEIHELLLSFAEAGANVVRLKGGDPLVFGRGGEEMDFLQQQGIRVEVIPGITSASGIAAELGIPLTHRGVATSVRFLTGHSRNGGTDPLHVAENAADPETTLVVYMGLSTLPSLAPKLMKHGLPPDTPAVAVERGTTXPQQRMVFAMLKDLVNEVHSADLVSPTLIIIGKVVALSPLWVESSEHDALNNENSSQPSPTVSPV

SEQ ID NO: 25177 - protein, 531 aa, Unknown
  Shewanella sp. ANA-3
MSADQQTVTPLENFSPKVAQRAVHRVQPELNFWQIFNMCFGFLGIQFGFALQNANVSRIFQTLGASIDDIPILWIAAPLTGLLVQPIIGYLSDNTWGRLGRRRPYFLIGAICTTLAIFVMPHSPTLWIAAGMLWIMDASINIAMEPFRAFVGDNLPPKQRTQGYAMQSFFIGIGAVVASALPYVLSNYFDVANTAPAGEIADSVRYAFYFGGAVLFLSVAWTVVSTKEYSPDELAAFHGNADAGADEQQHRTRTHKNYQFAAIVWMAVGALLTFAVWAQDLDKQLYILTLGIFVFGPLQLYCALRLGKSTPSQRAQLGIVFNVVDDLFHMPKAMHQLAIVQFFSWFALFAMWIYTTSAVTSYHFGSSDVLSKAYNDGADWVGVLFASYNGFSAIAALFIPLLAKRIGIKLTHTFNMFCGGFGLISFYFIKDPSLLWLPMIGVGIAWASILSVPYAMLSGALPPKKMGVYMGIFNFFIVIPQLLAASVLGLILNGLFDGQPIYALITGGVLMLCAGIAVLFVEQPNTQHTQA

SEQ ID NO: 25178 - protein, 160 aa, Arabidopsis thaliana
IFFFFIKSHKSSTLNHKSQSFGYQMARTKQTARKSTGGKAPRKQLATKAARKSAPATGGVKKPHRFRPGTVALREIRKYQKSTELLIRKLPFQRLVREIAQDFKTDLRFQSSAVAALQEAAEAYLVGLFEDTNLCAIHAKRVTIMPKDIQLARRIRGERA

SEQ ID NO: 25179 - protein, 528 aa, Paxillus involutus
MAHTSALHAQYQQDILKAINDQLTISDDTLLNITRTFLREVTDGLSSYGHPMAMIPTFVKGVPDGSETGTFLALDLGGTNLRVCEVTLHGDKSFSLRQQKYKVSETLKTGEVTTLFDYLADSVDAFLTDSGSPTAALPPSLTHESHANVLGNGDTDQPYISLALTFSFPVEQTALDSGKLLTWTKGFAAKNAIGKDVVKLLQDAFDRKHIHVKCVALVNDTVGALLSRAYTSGGCILGAIFGTGTNGAYVEDVANITKLGNEPTVAEGGYMIVNTEWGGFNNTRSALPSTPYDNKLDRESINPRFQAFEKFISGMYLGEITRNIILSLIDSSPKPLLFGGRSTGLLNKQWGLDTAVLSEIEEAWQGIGRFASSKAATTDASDEVELSRVRDVIVQRLGFSDARASDVSLADADTVRQVCTLVAARAARLSACAVAAVLVQTGRAQLVGSGAPGSGSLRDDGKRIGVGVDGSLVEFYPQFEPKLRASLRVLIGPEVESRVDIGMAKDGSGAGAALCALVAQRQDRAKRS

SEQ ID NO: 25180 - protein, 2799 aa, Ustilago maydis
MSIDMTGGAAPTDDDFTKLPIHDRLASKLWKARVSAYEELSKAFPNTSSEDDPIFRQYTRNPDILKSIVVDTNAVAQEKGVDAVRAFVEFGAKPAGSTRELVVPALVEKCLGSTRAGTKNNALQLISFYAEMEDVLGCEPLLADLLDGLKAKQPKVVAGCVTAIMHLVRDFGHKQVSPKPILQRLPDMFAHSDKNVRAEASLLALQLHRYIGAALEPTIDTLKDIQAKELRQQFAEIDAAAASKPLPTRFLLSQREKLQAAAAPISQPGTDAAASISAAQQDHRDDDDDDVDPYDLAEPVNVFGSRDYPADFEEMIVSKKWQERKETLETILKILSSSPKIQPDNRFDGLVDHLALKISKDANINVVLVSCQCLNAMAKGLRDNFARYKDKVVPPIIEKLKEKKPATVEVLAKALDAIFQTVSFSEILEHIFTGIKHKNPAVKTESIRFLVRCLRTTKLAPAKADIKPIGDALVVAMADGSPDVRDAGAAGLGTLMKLIGERPMNIFLDGLDDIKKAKIQDECNTAEVKVKMGAGAGARPPLSSAARPTAPIPASAPSAVTNRAAPPAAVRAKPPSATQAMATGKENQAPRPVARPTPSMAARPIGTRPAAATSSAVSSAPAPARKATPAAAAGSSKVAASATEPVKYRFHPDDAEARAADLIPAAIATQLASSAWKERLAGMTQFNDWLKVEAESVESEIIVRALGKKPGWKESNFQVMAEVYKALQLLANDCPTFSRPSVALSVQPLCDKLGDIKLKTPAGETLVTFAEKTSFGFLLAQALGPLGSLKAPKAIADSVLWVDQTLLEFGTAGVDVRSLIDYLITCLKSANAAVRINATKAIGTLARFLGTALNSFLADLNPQLRTTIEAEIEKAASNPPPAPVRFSDETKAPAGKAAVAGGEDAAGPAAQDNAADEDMLDQLVPRVDLDRLVSAAAIARMGDANWKERKEGLEEVLAVVNANSRLKGNMAELANALKMRCSDSNIMCKSMALDAIAKIATAMNKHFEPQARILAGPVTQVLADAKAPVRASATTALTAIAEQVGAGPLLPGMSTVVEGKTANPMLKQELFGWLAAWFELHPPEKGMDLAPLALPCVQCLDDKLAAVRKASLACLPHIITRAGYKHVMEQANQLKTASKNTAIPLIDAAKIQAQNSARAAGATATAAPAATATVPAPTARVAAVSARTATASPARAAGVGSTSSVAPATSSPRTSAIARPGGIKPPSAVGRSLKAPSSIIARQARLASDSSNGAVPSRNALASANGAASQGAGPGGAMEGSAPLISADTKAKALREKREGKAANWIGADGAPRPELVEVLRQQCDGQLSRGITDSMFSKSHSSEKDYYAALTLLSDFISSPTFAEEQYGLSRQETIERTLANSDLIFKYVSIRLTDNNTSLSLKCLDILEHLVALLSEQQYHMSDYEAACILPCLTAKFGDAKVAFRDRIREIFRKMTFIFPPSKLLTSYLENGLPSKNARVRTECLSEVGYLFSKNGLQVCSPSRTLPVIAKQISDRDANVRTAALSAIGEVYKIIGDEVYKLVGALPGKEMSMLEERLKRTTAPPASVAVAVAKSAGAASTAGRAGPRASVVPSSAPGPSSPGRLSAGAPSSRLARPGSALQQPAAPSAGVRSRLAAPGAARRESAIGLPRAAKPPSVASPRASMLRAPSEAAARATSIIAPGRNKVLADELPEEEDEELSVDQAINLVVNDNFEQSVFAIKHVEAFIQEEEPQLISYVDQIAIVLSKQMQKAFSLDPSDLGNERLRKHLLVANISLFDKDRVWEDGRTLGSYLSRSALIPLLTVLVQQLIQSSFRAEDPSAQNESKYLNIILLRCFSACSLNLLYGACLQMLSEATEDLRELEGDVLETRYEFAKLLIKCLWKIAKRLEDDLSQRKVEPQQLFVDIESFLQTIEPFEWRQRAEDGVPLADVPLRTVKIILSSVVNHFGEEALGMLDMIPQPENSYVYKYLVRMLNFAFGDGGVDEEGDAVGSNAGTRTRTDAKAPSQAVNEADTVVEAQRNIAPEDRGVDKAAVVDEEGDAVGSNAGAGANAPSQAVNAADTVDGAQQNSQNGHAADAAVDEESSIRLAELHAELHEIFKRISDKKLSRQGLQEMYEFRKRYPYLESYIQSLLQTTGPMFQRYIKRVFANYAAEDPDVINAAQPPPVDAYIIALIDTHRTSRQLHSQPVVVHTFAAILLLPSRLLSAEMNVQQSHRIEPGRAVHMMCTCSRAEHRSEDMRPNVQGEHQQYDEHEYDGHGAESKPVQLDQLLQILEHDFTVQLALTLLAQTEAERNFCDIGTVQSDFETLGIDMMIGCVEAVFCDSKESTHGVRGGCERTREHARTGRNDSSMQGPVLVHADTDAVACTEDERLLPVEREQKRGYRLRRMLQVSVHTDHSLAASFAKSSNHSGRKPAFRRAHNDAGRRLRFSRNAGTITEQLGVEDVDHPEDPGCFRILADASMSRAIDIEILDVSAADPSQRPRRRESRTVNRESRIACFVTRGSWFVRAVRTLSECYIASQRMYLFPVSRVVCLFNDSRLYISSPCTLDSPLDCESRIHKTSNSTDQDASYRRDCQLPTQPSARTLYRASLDSVMLRVKDPKISLDFYENVLGMDLIDKHDGGDFTLYFLAYQHQKGITQRGEREAILELTHNHGTENDADFSYHNGNQEPKGFGHLCVAVDDIHKACDRFEKLGVKFQKKLTDGKMKNIAFILDPHTPEAGWLKLTLSLVCLVGATNACSHARACASSVVGNLRNDISSPNRPPQSKSPRPTEDHQCVPALRDPASVLQNVSVA

SEQ ID NO: 25181 - protein, 282 aa, Chlamydia trachomatis
MELPCKLTLKELLESGAHFGHQTSRWNPKMKPFIFEEKNGLYIIDLAKTLGQLKKAVSCIQKTIDQERSILFVGTKKQAKQIIREAAIECGEFFASERWLGGMLTNMATIRNSVKTLNRIELDLEASNSGLTKKELALLAKRHRKLLNNLEGVRHMNSLPGLLIVIDPGYERIAVAEAGKLGIPVMALVDTNCDPTPINHVIPCNDDSIKSIRLVVNVLKDAVIDAKKRLGVEILSPVRPAERPAEEAVEELPLPTGEAQDEASSKEGVLLWADIDNCEALK

SEQ ID NO: 25182 - protein, 471 aa, Kluyveromyces lactis
MFKRYLLQYPRQFHTARLLRQEFKDPYKVLGINKNSSQSDIKKAYYKLAKKYHPDINKEEDSQKKFHDLQNAYEILSDEDKRKQYDQFGAAAFSQAGGAGGPGGAYGGAGAGGAQGFGGFGGFDFGGLNFEDLFGSAFGGGGGGGAGGRRAGSHGAGFGGSDFVREYKGENVTVPFQVSFKDAVFGVKNVKLNYQCYDPCSSCDGSGLKAGHSRSVCPTCHGTGTQVHVRAGFQMASTCQTCDGEGSTIKDSDKCGTCHSHGFKLNSNKTITVDLPHGLQDGDTIRVPNQGSYPGMAIDPSMKSELHLTRGDLLIRVRVRKDTRFQVSNNYDIIYTQEIPITTAALGGVIEVPTVEEEKIRLKVSSGTQHDQVIRIPNKGVPRGARGDRGDMLVKFKIVIKKPKDETERYLWETLAHLTNDTTARRTITPSGSSAKDNSSSADKDTVENNEGTIKKLENFLSNTLKKIRGE

SEQ ID NO: 25183 - protein, 462 aa, Xanthomonas axonopodis
MPLPTDSVAETAAPAAPALRHALKPRQLMMMGLGTAIGAGLFLGSGVGIHAAGPAVLISYLIAGALVIIVMNALGEMAAAKPASGAFSVYAADAMGPTAGATVGWLWWFQIVVVIAAEAVGAAGLLATVWPALPVPLLSLLFMATFTAINLLGVRNFGEFEFWFAILKVLAIVVFLLIGVALLAGWLPGVASPGLSNFTQNGGFAPKGLAGIGSALLVVVFAFGGTEIVAVAAAETADPGRSLARTIRTVAWRILVFYIGSISVIVAVVPWTSAALSSPFAAVLEVARIPGAATAITLVAVVALLSALNANLYGASRMIFSLAQRGEAPRLLARTSGEQVPLVAVIASVLFGFAAAALELLYPNKVLPMLLNIVGATCLLVWTISLVSQLILRARADRAGLALPFRMRGYPFLTVLALVILAVIFVLLASSADTRAQFLSMVALTAVIAAVSEIARRVRARM

SEQ ID NO: 25184 - protein, 363 aa, Oryza sativa
  misc_feature (34)..(34): Xaa can be any naturally occurring amino acid
  misc_feature (81)..(81): Xaa can be any naturally occurring amino acid
GSTTGAARTGGSGGDAAAGGGGGSAGNGKPLPPXCVKARAAAPESEAKCHATVVSGWFTEPRSRGGKTSKVQYYNNPMWPXSTYGKVLVLDGIVQLTDKDECAYQEMITHLPLCSIPSPKKVLVIGGGDGGVLREICRHGSVESIDICEIDQLVIDVCKDFFPDLSVGFKDPRVRLHVGDAVEFLRNAPEGTYDAIIVDSSDPIGPAQELVEKPFFDTIARALRPGGVLCNQAESMWLHTHLIQDMLSICRETFKGSVHYAWTSVPTYPSGVIGFLLCAKEGPPVNFLTPANPIEKLEGAMEAGRDIRFYNSEMHRAAFVLPTFARRELEAYCTTVEREQQEETTAEPLKMNIMPNSEILTAS

SEQ ID NO: 25185 - protein, 568 aa, Solanum demissum
MTLGIEHAFSSFIWLCGPITGLVVQPCVGIWSDKCHSKYGRRRPFIFIGAVMISIAVIIIGFSADIGYLLGDTKEHCSTFKGTRSRAAIVFVVGFWMLDLANNTVQGPARALLADLSGPDQRNTANAVFCSWMAVGNILGFSAGASGGWHRWFPFLTNRACCEPCGNLKAAFLVAVVNIDNPAIAEYLYRSFTTDNYPSSFCHSKCSLDCEQVFLTLCTLVTLYFANEVPLSPKQYKRLSDSAPLLDSPQNTGFDLSQSKRELQSVNSVANNESEMGRVADNSPKNEEQRPDKDQGDSFADSPGAVLVNLLTSLRHLPPAMHSVLIVMALTWVSCNLSTAANYLSFFSFNQLSWFPFFLFDTDWMGREVYHGDPKGEADEVNAYNQGVREGAFGLLLNSVVLGVSSFLIEPMCKWIGSRLVWAVSNFIVFVCMACTAIISVVSISAHTEGVQHVIGATRSTQIAALVVFSLLGIPLAVTYSVPFSITAELTADAGGGQGLAIGVLNLAIVVPQMVVSLGAGPWDALFGGGNIPAFVLASLAALAAGIFAMLRLPNLSSNFKSTGFHFG

SEQ ID NO: 25186 - protein, 461 aa, Arabidopsis thaliana
MEVFRLGELRHLLVTVFLSGLAEYLIRPVMTDVTVAAVCSGLDDSCSLAVYLTGVQQVTVGMGTMVMMPVIGNLSDRYGIKAMLTLPMCLSVLPPAILGYRRDTNFFYAFYVIKTLFDMVCQGTIDCLANAYVAKNVHGTKRISMFGILAGVSSISGVCASLSARFLSIASTFQVAAISLFIGLVYMRVFLKERLQDADDDDEADSGGCRSHQEVHNGGDLKMLTEPILRDAPTKTHVFNSKYSPWKDVVSLINNSTILIQALVVTFFATFSESGRGSALMYLSESSFWVQQNDFAELFLLVTIIGSISQLFILPTLSSTIGERKVLSTGLLMEFFNATCLSVAWSPWVPYAMTMLVPGAMFVMPSVCGIASRQVGSSEQGKVQGCISGVRAFAQVVAPFVYSPLTALFLSENAPFYFPGFSILCIAISLMIGFLQSLLIKDHPSLPLVNITINNPSKAEA

SEQ ID NO: 25187 - protein, 455 aa, Synechococcus elongatus
MSSSAVLTWRQGDRLSLTIESLCDSGDGLGRVEGRVVFVPDTVPGDRIQAKLLQVRSRYARAELEGVLEASPDRIRPACIVADKCGGCQWQTVDYPAQVEAKTVIVQDAMQRLGQLETEVQPTIAAPYPLGYRNKVSYPLRRSDRGEVQAGYFRKGSHRLINLNQCPVQDDRLNPLLAGIKADIAARDWPIYDEQTRSRGLRHLGLRIGQRTGEILITLIATDDQLPEVEAQAEQWLTDYPNVVGVCLNLNPSHGNRILGDETHCLAGRPYLIECLDDLEFAIGPETFFQVNTEQAERLLPILKDFLRGSDRLFDLYCGVGTLTLPLASEVGSVLGLEILPESVVQAQQNADRNGISNVEFRAGAVEILLAQIPESPDAVLLDPPRKGCEPAVIEVLRDRQPQRIAYVSCNPATLARDLQALCAGDRYRLLLVQPLDFFPQTAHVETVALLELQD

SEQ ID NO: 25188 - protein, 523 aa, Triticum aestivum
MARGGGNGEVELSVGVGGGGGGAAGGGEQPAVDISLGRLILAGMVAGGVQYGWALQLSLLTPYVQTLGLSHALTSFMWLCGPIAGLVVQPCVGLYSDKCTSRWGRRRPFILTGCILICIAVVVVGFSADIGAALGDSKEECSLYHGPRWHAAIVYVLGFWLLDFSNNTVQGPARALMADLSAQHGPSAANSIFCSWMALGNILGYSSGSTNNWHKWFPFLRTRACCEACANLKGAFLVAVLFLAFCLVITVIFAKEIPYKAIAPLPTKANGQVEVEPTGPLAVFKGFKNLPPGMPSVLLVTGLTWLSWFPFILYDTDWMGREIYHGDPKGTPDEANAFQAGVRAGAFGLLLNSVVLGFSSFLIEPLCKRLGPRVVWVSSNFLVCLSMAAICIISWWATQDLHGYIQHAITASKEIKIVSLALFAFLGIPLAILYSVPFAVTAQLAAKRGGGQGLCTGVLNIAIVIPQVIIAVGAGPWDELFGKGNIPAFGMASAFALIGGIVGIFLLPKISRRQFRAVSGGGH

SEQ ID NO: 25189 - protein, 546 aa, Lophopyrum elongatum
MGLDLGAIALKYTGLAVSDHGSIVAINIFIALLCGCIVFGHLLEGNRWVNESTTALVLGLITGGVILICSKGVNSRILIFSEDIFFIYLLPPIIFNAGFQVKKKQFFRNFATIILFGAAGTLISFVIITFGAMGLFSKLGVGPLELGDYLAIGAIFSATDSVCTLRVLNQDEAPLLYSLVFGEGVVNDATSVVLFNAIQNIDINHFDVFVLLQFIGKFLYLFFTSTVLGVAAGLLSAYIIKKLCSARHSTDREVAIMILMAYLSYMLSMLLDLSGILTVFFCGIVMSHYTWHNVTESSRVTTKHTFATLSLIAEIFLFLYVGMDALDIDKWKLASSSPKKPIALSAVILGLVMVGRAAFVFPLSFLSNLSKKESHPKISFNQQVIIWWAGLMRGAVSIALAYNKFTTSGHTAVRVNAVMITSTIIVVLFSTMVFGLLTKPLINLLIPPRPGTAADISSQSFLDPLTASLLGSDFDVGQLTPQTNLQYLLTMPTRSVHRVWRKFDDKFMRPMFGGRGFVPFVPGSPIERSVHGPGLLGTVTEAEDRS

SEQ ID NO: 25190 - protein, 325 aa, Nicotiana tabacum
MAGEKNGIAKDVTELIGNTPLVYLNNVVDGCVARVAAKLESMEPCSSVKDRIGYSMITDAEEKGLIKPGESVLIEPTSGNTGVGLAFMAAAKGYKLIITMPSSMSLERRIILRAFGAELVLTDPAKGMKGSIQKAEEIKAKTPNSFILQQFENPANPKVHYETTGPEIWKGSNGKVDALVSGIGTGGTITGSGKYLREQNPDIKLYGVEPVESAILSGGKPGPHKIQGIGAGFIPGVLEVGLIDEVIQVSSEEAIETAKLLALKEGLLVGISSGASAAAAIKLAKRPENAGKLIVVVFPSFGERYLSSVLFESVRREAENMTVEP

SEQ ID NO: 25191 - protein, 352 aa, Solanum demissum
MASLVSSWSSEVNSIPEKYVVPLEKRVNADVPIGKHIPVIDLSQSSTQSIQQIIKASADFGLFQVINHGVSETLMVDALSVCKEFFKLPIEDKAKFVEKDEGLSDFEPSIDQRPKLYIEKEYTPNKNGSNTNNGKDTVFWKDTFGHGCHPLTQDVINSWPEKPQKYREVIGEYALELRKLSLRILDLMCEGLGLEVGYLTREHSQTQLMVTHHYPQCPDPNSTIGIGEHCDGALINLVQQELSGLHVRDKDGKWFGVEPIPGALVVINGLILKVVTNGKLSSGVHRVVTNSTSDRTSLGSLISPIECIIEPAKLLINESNPPLFKSFSYTEYLGYYFSDTTEIEAALKPYKL

SEQ ID NO: 25192 - protein, 601 aa, Mycobacterium avium
MCGVTGEVRLDGRAPDVAAVSAMAAVLTPRGPDAGGAWSQGRVALGHRRLKIIDLTEAGAQPMVDSELGLSIAWNGCIYNYKELRSELSGYGYRFFSHSDTEVLIKAYHRWGDDFVSHLFGMFAFAIVERDSGRVLLGRDRLGIKPLYLTEDSHRVRFASTLPALLAGGGVDTRIDPVALHHYMSFHSVVPAPATILRGVRKVPPASLVAIEPDGKRTVTTYWAPDFTRHADRADWSERDWEDAVLSTLRLAVKRRLVADVPVGCLLSGGVDSSLIVGLLAEAGQHGLSTFSIGFESAGGVKGDEFQYSDIVAQRFETNHHQIRIDSDRMLPALDGAIGAMSEPMVSHDCVAFYLLSQEVARHVKVVQSGQGADEVFAGYHWYPPMGEPAAATLDGAVAQYRRAFFDRDTAGVAQLVGPGILAPGDPSLRFVTEHFAQAGAETGIDRALRLDTTVMLIDDPVKRVDNMTMAWGLEGRVPFLDHELVELAATCPPEYKIAHEGKGVLKQAARRVIPSEVIDRPKGYFPVPALTHLEGPYLDMDRDALYAPTAKERGLFNTDAVDALLANPNGKLTPLRGNELWQIALLELWLQRHGVTGPVA

SEQ ID NO: 25193 - protein, 974 aa, Trichodesmium erythraeum
MVATYKSNIQSSYQIQLANQNQGQRPIDFSQRHIGLTSSEIQQMLEVLGISSLEDLIDKTVPEKIRFQKPLNLPKSLSENAALAQIKEIISKNQIFRSFIGMGYYDCITPPVILRNILENPGWYTAYTPYQAEIAQGRMEALLNFQTMITDLTGLEIANASLLDEATAAAEAMSMTYGLCKTKAEVFFVDSACHPQNIEVVKTRAQPLGIEVIVGDFRTFTFDKPIFGALLQYPATNGAIYDYREFVEKVHKVGGLVTVAAELLSLTLLTPPGEFGADIAVGNTQRFGVSLGYGGPHAAYFATKEAYKRQTPGRIVGVSQDANGNPALRLALQTREQHIRREKATSNICTAQVLLAVIAGMYAVYHGPGGLKQIAENIHNLTFKLATGLKQLGYQIGAELFFDTIEIKLGADSPVKSAKEIIDAAENLGINLRTFDEQTVGISLDETTTEVDVQNLWQIFASGEKFPNIENENISTLSQSYYARTSNYLTHPVFKSYHSETNLLRYIHRLQSKDLSLTTSMIPLGSCTMKLNATAEMIPVTWPEFANIHPFSPISQTQGYQIIFQQLEEWLAEITGFAEISLQPNAGSQGEYTGLLVIREYHAHRGEAHRDICLIPESAHGTNPASAVMSGLKVVVVKCDAQGNIDIADLQTKAEKHKDNLAAIMITYPSTHGVFEEEILDICEIIHAHGGQVYMDGANMNAQVGLCRPAEIGADVCHLNLHKTFCIPHGGGGPGMGPIGVKSHLAPFLPGHSVINLGGENSSGAVSAAPWGSASILPISWMYIAMMGTDGLTEATKIAILNANYIAQRLGSYYSVLYKGKYGFIAHECILDLRPLKKLAGIEVEDIAKRLMDYGFHAPTVSWPVAGTIMVEPTESESKDELDRFCDAMISIRQEIEEIETGKADKNDNLLKNAPHTAESLMVDEWKHGYSRQRAAYPAPWTREHKFWPAVGRVDNAFGDRNFVCSCLPIEAYS

SEQ ID NO: 25194 - protein, 807 aa, Oryza sativa
MEMEMEDNKAPSPPSPMESDVAGEKRKREDDASSSAVLAAANNTGGAQHPMWKTSLCSFFRRRAASSADGCSHGDSCRYAHSEEELRPRPDGTWDPTSDRAKKLRKVAADEVEEEVVTIDDKALDKCLVGLPRGWANDRLKTFLQDKARTNYSSILPPALLLGISYATAKKKKGMTVGFVTFENIEQLKNAIEVLTENQSGGKEIKIADANRRSHQKLHTEKPVSDNGVTTENGTSVDVPPGETSAPEAAISNKKSVRDAVTPLAHMSYNDQLEHKKNSVAQILKRLTRNARKACPTGIPLPDWVFKSKEIGGLPCKLEGILESPVINGYRNKCEFSVGFSLEGKKTVGFMLGNFREGVTAVEEPVDCPNVSEISCKYALMFQDFLQSSSLPVWNRVDNCGFWRQFTVREGRCQAQAVAQNAENQISEVMLIVQVCSTGVDDAVMKDEFDKLTVALQQGAATCSPPLPLTTIVVQDHKGISNAAPADCPLIPLLVPKVDQSEGTVDKTRIHDHIGNLWFSISPTAFFQVNTLAAERLYTLAGDWANLNSGTLLFDVCCGTGTIGLTLAHRVGMVVGIEMNESAVSDAERNALINGVSNCRFVCGKAEDVMGSLLTEYLGSPQQDIPVSEGAVSGTVKDEEVIDSSKNSGENLDSSMQKNDNGESQQLGDAPADSSSSAIDEIKGNSNDRVGNGLEGSHDEYNEVAGEDIHGEASLINESVDLKVSDCLEDRKTSDDGSSISNNDVTAATACQFEDIVAIVDPPRVGLHPTDQAYTLNLIGDQGIEDSSTNSTSSVNPKRGQGVAVFI

SEQ ID NO: 25195 - protein, 187 aa, Oryza sativa
MSDSNPGAANPALGPDADAAAGEGLELAQFAAGCFWSVELTYQRLPGVARTEVGYSQGHRHEPTYRDVCSGGTGHAEVVRVHYDPKACPYEVLLDVFWAKHNPTTLNRQGNDVGTQYRSGIYYYTAEQEKAARDSLAEKQKEWKERIVTEILPATRFYPAEEYHQRYLEKGGQSAKKSCNDPIRCYG

SEQ ID NO: 25196 - protein, 190 aa, Oryza sativa
MSNDTGADGGAANPDLGPDADAAAGEGLELAQFAAGCFWSVELTYQRLPGVARTEVGFSQGHHHEPTYDDVCGQGTGHAEVVRVHYDPKACPYGVLLDVFWAKHRPTTLIRQGDEAGTQYRSGIYYYTAEQERVARESLEAMQEEWKEKIVTEILPARRFYPAEEYHQRYLEKGGQSAQKGCTDPIRRYG

SEQ ID NO: 25197 - protein, 380 aa, Hordeum vulgare
VAGTRGFARADGARFTVGGRPFYPNGFNAYWLMYMASNPGDRSKVLDTLDQASRVGATIIRTWAFNDGGSNRPLQITPGVYSEEVFVGLDFVVAEAKKRGLYLILSLTNNWGDFGGKRQYVQWAKEQGHNLGSDDDFFTDRLTQRFYMNHIKRVLTRVNNFTGVAYKDEPTIFAWELMNEPRVPSDLFGKTMQAWVALMSSYVKSIDDKHMVEIGLEGFYGDTAPERRRFNPGGSYSAGTDFIGNNRIPTVDFATIHSYPDQWVPGSTSEQQVEFMKKWMASHIEDAAAALRKPLLVAEFGWKSSGNAAVAARDDYLRMVYDAIYASVKGGGPCAGGLFWQVMAPGMESWADGYEVVLERSSTTAAVVSQECARIGGITP

SEQ ID NO: 25198 - protein, 285 aa, Chlamydia trachomatis
MEFPCTLTLKELLESGAHFGHQTSRWNPRMKPFIFEEKNGLYIIDLAKTLAQLKKAVACIQTTIGQEKSILFVGTKKQAKQIIREAAIECGEFFASERWLGGMLTNMATIRNSVKTLNRIELDLEASNSGLTKKELALLAKRHRKLLNNLEGVRHMNSLPGLLIVIDPGYERIAVAEAGKLGIPVMALVDTNCDPTPINHVIPCNDDSMKSIRLIVNVLKDAVIDAKKRLGVEILSPVRPAERPAEEAVEELPLPTGEAQDEASSKKGGGRVLLWADIDNCEALK

SEQ ID NO: 25199 - protein, 465 aa, Prochlorococcus marinus
MTSSTNSSLTSTPTPGDKVEITCVDLDRHGNGLARWNNWVVIVNDLLPGERAQIEFVRRHRNQFLARKVHSIETVSSRRQPPCKIAKECGGCSIQHLNDHGQSLLKQSHLREILLRLGQLDNKIEPIMTDYTRALGYRNRALIPLYRNREGQLLMGYYRRGSHQIIDLNRCPVLDRGIDQYLAWIKDDLQQQNWPADSDLSSGEGVRHLGIRIGQKTRQVLITLVSSTTELSGLHQQANDWYRRWPEVKGITLNIQRQRNNLVLGQETILLAGDLDIEEHFCNLSLLLSTTTFFQVNTIQAERIVLKLLKWLSTTLPDINIIDAYCGIGTISLPIAAAGYHVIGLELHAEAIAQANKNALRNNLGNASFLCGDVSLLLAKILQHHDVLVLDPPRKGLDQMVIKTILSVRPERVAYLSCDPATLARDLKQLIVPNGPYQIDQLQPIDFFPQTMHIECLALLIRISS

SEQ ID NO: 25200 - protein, 327 aa, Triticum aestivum
  misc_feature (303)..(303): Xaa can be any naturally occurring amino acid
  misc_feature (313)..(313): Xaa can be any naturally occurring amino acid
VTLQNKFVQKSRLVPVRNSRDIVDPRVRLQGPARALMADLSAQHGPSAANSIFCSWMALGNILGYSSGSTNNWHKWFPFLRTRACCEACANLKGAFLVAVLFLAFCLVITVIFAKEIPYKAIAPLPTKANGQVEVEPTGPLAVFKGFKNLPPGMPSVLLVTGLTWLSWFPFILYDTDWMGREIYHGDPKGTPDEANAFQAGVRARAFGLLLNSVVLGFSSFLIEPLCKRLGPRGVWVSSNFLVCLSMAAICIISWWATQDLHGYIQHPITASKEIKIVSLALFAFLGIPLAILYSVPFAVTAXLAAKERRWQXLCTGVLNIAIVIPK

SEQ ID NO: 25201 - protein, 152 aa, Photorhabdus luminescens
MELTTRTMATAKNIALIAHDHCKTSLLAWSKKHKSLLKKHHLYATGTTGNLIQNETGLSVTNMLSGPMGGDQQIGSLISEGKIDVLIFFWDPLNSVPHDPDVKALLRLATVWNIPVATNLASADFIVSSPLFSESVDIQVPDYQHYLNGRLK

SEQ ID NO: 25202 - protein, 729 aa, Synechococcus elongatus
MFDLSKFLPVITPLMIDTAKTLCPYCGVGCGLEAVPPAQPGRATVRDREGTPIWQIRGDRQHPSSQGMVCVKGATVAESVSKSRLKYPMFRASLDDPFTEISWDEALDRLCDRIQQTQADYGKDGICFYGSGQFQTEDYYIAQKLVKGCLGTNNFDTNSRLCMSSAVSAYSLCLGSDGPPACYEDLDLADCLLIVGSNTAECHPILFNRYRKRHKQGGTNLIVVDPRCTPTAEVADLHLALKPGSDVALLNGLGWLLYQMGYVKKDFIANQTEGFEDWLAIIEDYPPQRTAELTGLAVAELVRAADLIASAQRWLSLWSMGVNQSIQGTAKATSLINLHLLTRQIGLPGCGPFSLTGQPNAMGGRETGGLAHLLPGYRKVIDPQHRADVETIWGLPMGSISPQPGRTAWQMIEGLEQGAVGFLWVAATNPAVSLPDVKRAQAALKRSPFTVLQDAYHPTETTTYAHLLLPAAQWSEKTGTMTNSERRVTLCQAFRQPPGEARADWQIFAEVGRRLGFAFDYTDAAAVFAEYVQVTAGRLCDLSGLSHELLAQAGPQQWPFPAGAEPTTESKRLYTKHHFAYADGRARFQPFHHLGVAEPPDDRYPLVLTVGRLYPDWHTQTRTGRIDKINKLHPSAFVEIHPRDADRYNISEGQAVVIRSRRGEGCFPAKVTTAISPGVLFVPMHWGALWGDRTEANALTHPAACPISGEPELKACAVQIEAASSTFTI

SEQ ID NO: 25203 - protein, 253 aa, Pseudomonas syringae
MSAKVWLVGAGPGDPELLTLKAVRALHEADVVLIDDLVNTAVLEHCPQARVIAVGKRGGCRSTPQEFIHRLMLRYVRQGKCVVRLKGGDPCIFGRGGEEAQWLQERGVAVELVNGITAGLAGATQCGISLTLRGISRGVTLVTAHTQDDSSLNWQALAQGGTTLVVYMGVAKLAEIRESLLAGGMIGDMPVAMIENASLPWQRECRSTLNAMQRDAAAFELKSPAILVIGAVAAFSNELLNQTLVEQAQLQAS

SEQ ID NO: 25204 - protein, 908 aa, Pseudomonas syringae
MRMTSMAIQTTQVTASTCCYCGVGCGVLIEHDGQRILGVSGDPQHPANFGKLCSKGSSLHLTGDIEARALYPELRLSKGLARSVTDWDTALEHAATVFAESIREHGPDSVAFYISGQLLTEDYYAFNKLARALVGTNNIDSNSRLCMSSAVAGYKRSLGADAPPCSYEDLELSDCVMIVGSNMAYAHPILFRRLEEAKSRRPAMKLIVIDPRRTDTCELADLHLAIQPGTDVALFHGILHVLMSENLIDPQFIAAHTLGYDELAALVCDYPPERVANICGISQQHLHTCARWLGKSAGFLSLWCMGLNQSTAGSAKNSALINLHLATGQIGRPGAGPFSLTGQPNAMGGRETGSLSNLLPGHRDAANPEHRAEVAEYWGIDSLPATPGLSAIELFEQLQNGTIKALWIACTNPAQSLPDQNRIRQALETCPFVVLQEAFKTTETARFADLLLPAASWGEKEGTVTNSERRISNVRKAIQAPGEARSDWAITVDFAQRLQKRLQPEAPALFDFQTPKSLFDEFKGLTVGRDLDMSGIDRELIDRQGPQQWPFPTGASVGTPRLYLDGIFPTASGRAQFLAEPYIAARELRDAEYPLTLNTGRLRDQWHGMSRTGTAARLFGHVSEALLSLNPKQMLGHDLQNGDLVKLISRRGELLLPVSSDDSVVAGQAFLPMHWGERFLKGGVNVLTQPAFDPLSKQPELKHSGVRIEKARLPWQFFALIEGNVQQHMERLRPLCEAFTYLSMGLIGRERPALVVRAASTEAPDSTLLQRIDSLLNLDEGPVMAYDDPKRSIGKRVRIDNGRITAIRLAGETLAQHWLQTLWLQERADPALRRWLLAPLSSEPGKDSTLSRDKTLCNCMNVSQSTVMSGIERGLNLNQLKTQLGCGTQCGSCVPEIKRLINAVAVTE

SEQ ID NO: 25205 - protein, 409 aa, Pseudomonas syringae
MKKLKLVMIGNGMAGVRTLEELLKLSEDLYDITVFGAEPHPNYNRILLSPVLAGEQNFEDIVLNDLAWYQSNGIQLLLNRRVVKIDRIKRLVIADDGTQAHYDRLLIATGSRPFILPIPGNTLDGVIGYRDIGHTRQMIDTAVTHKHAVVIGGGLLGLEAANGLSLRGMQVTVIHNGQTLLERQLDKTSGLMLQAALELRGLSFRLNEQTQALLGDDQGRVRAVQLKNGDVIDADLVVMAAGIRPNTELAEQAGLPCNRGILVNDTLQTFDPRIYAIGECVSHRGIAYGLVAPLFEQARVCANHLAQLGSARYPGSVTSTKLKVTGIDLFSAGDFLGGEGTESITLSDPIGGVYKKLVIKNDILVGACLYGDTADGSWYLQQIRDGQGIDAIRNHLMFGKPAATPAACA

SEQ ID NO: 25206 - protein, 194 aa, Arabidopsis thaliana
MFQATSTGAQIMHAAFPRSWRRGHVLPLRSAKIFKPLACLELRGSTGIGGFHEIELKVRDYELDQFGVVNNAVYANYCQHGRHEFMDSIGINCNEVSRSGGALAIPELTIKVNVCIYVDIFEQSGCRFVVKTRISGISLVRIYFEQFIFKLPNQEPILEAKGTAVWLDNKYRPTRVPSHVRSYFGHFQCQHLVD

SEQ ID NO: 25207 - protein, 232 aa, Oryza sativa
MAGGGDELKLLGMWASPYVLRVKFALSLKGLSYEYVEEDLMNKSDLLLSSNPVNKKVPVLIHNGKPVCESQVILQYLDEAFPGAGATLLPADPHERAVARFWAAFNDDTLVEASQAASWGKTEEERAEGEKKVVEALEKMEVGLRECSKGKPFFGGDTVGYLDVVLGGFLAWVRATDVMRGVKRFDPATTPLLAAWAERFVELDAAKAVMPDMDKMIEFGKVLQARAAAATN

SEQ ID NO: 25208 - protein, 422 aa, Salmonella typhimurium
MEPITLTLCLLVFAIVMFVWEKVPLAVTSMIVCVALVITGVLNIKQAFAGFIDTNVILFVAMFIVGGALFETGMANKVGGVITRFAKTEKQLIFTIMVVVGLMSGVLSNTGTAAVLIPVVIGVAAKSGFSRSRLLMPLVFAAALGGNLSLIGAPGNLIAQSALQNIGGGFGFFEYAKIGLPMLICGILYFLTIGYRFLPNNATGGEVGSVGVQRDYSHVPQWKQRLSLVVLIATILGMIFEKKIGVSLAVTGCIGALVLVVSGVLTEKQAYKAIDSQTIFIFGGTLALAKALEMTGAGKLVADYVIGMLGQNSSPFMLLIAVFALSVVMTNFMSNTATTALLVPVSLSIAAGMGADPRAVLMATVIGGSCAYATPIGMPANMMVLSAGGYKFVDYAKAGIPLIIVSTIVSLILLPILFPFHP

SEQ ID NO: 25209 - protein, 131 aa, Arabidopsis thaliana
  misc_feature (83)..(83): Xaa can be any naturally occurring amino acid
ARVGTEESELVPALKWLESEDCATLRRKDCINGFVGSMESDGSNVFVDWVKEKQIKVVSICTHICVFDFVATLLSARNHSVLXCSTFDLPLHVAKDIKGAQAHPQELMHHVGLYMAKGRGAQVVSKISFET

SEQ ID NO: 25210 - protein, 78 aa, Triticum aestivum
MVGFFRSGNLASRVFDRQFLSPRPGATVNTVRQFYENLVPSYTIYDIDCPRLFVFASSTDEWESYPCGPLSPKTNQRF

SEQ ID NO: 25211 - protein, 162 aa, Clostridium acetobutylicum
MKKIIFAGGCFWGVEAYFNTIDGVLNTKVGYANGNTEDPTYEDVCTDSTGYAEACYIEYDEKQLKLEKLIDAYWKVVDPTLKNRQGHDEGTQYRTGIYYVDEEDLKVILESKDKEQEKYDAPIVTEILPLKNFYDAEEYHQKYLDKNPNGYCHIPKELLKKH

SEQ ID NO: 25212 - protein, 263 aa, Triticum aestivum
HYRTSLYKKAGWYRSGIPGISSTHASAGASAYDVFAGAASVLQAPPDDKQQGVVVELAVAAMEERLRMARLDDPLWATTVDQALALDEEEYARMFIDPRGSLGPKQYGLVSEASRDAAVVIMTPASLVEILMDVNQYAAVFSSIVSRAATLEVLSTGVAGCYDGALQVMSVEFQVPSPLVPTRESYFVRYCKRNADGAWAVVDVSLDGLQGVKCRRRPSGCLFRKGPKGLLQGDGGGTPWKGGQKVPWTIFSKPAGPALGLPP

SEQ ID NO: 25213 - protein, 348 aa, Bdellovibrio bacteriovorus
MSHIYDSILETIGNTPIVRLKNVTKGSKHQFFAKIEYFNPGGSIKDRVAVAMIEEAEKRGDLKAGGTIVEATSGNTGVGLALAAAVKGYKCIFVMPEKMSEEKRAILRAYGAKVVITPMVDPEHPLSHYSVSQKIAKETPGAFLTNQYHNPDNPQRHYQTTGPEIWKQMDGKVDVVVGGAGTGGTLSGVAKYLKEMNPNIKAICADPIGSILYDLYYHKKIVDPPGSYKVEGVGEDMLPDNVHLNIYDGFERVSDPEAFTMTRRLVAEEGLLVGPSSALALVGAMKAAEKIEKPSNIVVVFPDSGRAYLSKAFNDTWMIENALLKPEEAKNVFNRVVNAADFLAELNK

SEQ ID NO: 25214 - protein, 328 aa, Trichodesmium erythraeum
MANYAPAIETMTANYLEKWVEMGTLTWYPEIRNYTFDIASLLFMGSDESSQTKLVSLFEEWVKGLFSIPLSLPWTRFGKSLRCRQKLLQHIEEIILQRQQQQNLGEDALGILLQAQDKEVNGLSLDELKDQILLLLFAGHETLTSAIASFCLLTSQHLDVLTRLRQEQKQFSAIEPLTLENLKRMTYLDMVLKEVLRLIPPVGGGFRQVTQDCEFCGYSIPKGWLVQYQIAKTHQDETLYPDDKNFDPERFAPENAVDKQKVFGYVPFGGGMRECLGKEFARLEMKIFAVMLLRGYEWELLPEQDLSVVAAPTPYPRDGLKVKFRKVE

SEQ ID NO: 25215 - protein, 315 aa, Glycine max
RIEEDVALYWRISTKHHLGSLCTKPQSANCFLLLSLLPNPSLSHSSAPFNLFPLLAISISTLPHPVPFCVFLSSTLSSPAKAKLLPSFSVFSVKCCCFCSQTYPNIACNKSPMNLLSRIVGLGSPRAAQNMNSTTAQGPDDEIPAPGQQFAQFGAGCFWSVELAFQRAAGVTKTEVGYSQGQLPNPSYEDVCMGTTHHSEVVRVEYDPNECSYESLLDVFWARHDPTTLNRQGNDVGTQYRSGIYYYTPEQEKAAIESLEQQQKKLNRKIVTEILPAKKFYRAEEYHQQYLEKGGRFGSKQSASKGCNDPIRCYG

SEQ ID NO: 25216 - protein, 142 aa, Bacillus clausii
MKIALIAHDKKKQELVDFCVAYEPILKEHELYATGTTGTRIMEATELVVTRFKSGPLGGDQQIGALVAENQFDLILFMRDPLTAQPHEPDVTALIRLCDVQSVPLATNMGTAEILIKGLERGDFAFRDIIHEQEKANPLKEG

SEQ ID NO: 25217 - protein, 798 aa, Hordeum vulgare
MASLLAPPASTRVFPPPPAPPRRPAVVARAARSRYRFRTDDDAVVDVAVAAAEGGGYTVGVEVPPLPGARRREGGLALRPAGSGEAVPLAPPGDGACPAAELSFQASRAPFCLSFLLTDDEGAEIRTHRGTAFRVPVGVGPGSPAPLGLSLSEAGAANFALYSRGAEGVLLCLYGRGGGGGEPALEIELDPFVNRTGNVWHVSLESVEGYFSYGFRCGLFGADHPLLDPYAKLIGDFVAADPVHVKEGTVPSSVSCLGSLANPPSYNWGRDKRPCLPLENLVVYRANVALFTKDKSSGLPNNVAGTFSGMAAKIHHFGSLGVNAVLLEPVFPFDQVKGPYFPYHFFSPMNSYSAEGCSASAITAMKDMVKAMHRNGIEVLLEVVFTHTAEGQADGQMISISGIDKSSYYIADEIAGCKSGILNCNSPVTERLILDSLRHWVVDFHVDGFCFINAPFLVRGSRGEYLSRPPLLESIAFDPVLSKTKIIADPWSPLGISNVQFPFPHWKRWAEMNTRFSIDVRNFLKGEALIGDLATRLCGSGDLFSNRGPAFSFNYVSRNSGLSLVDLVSFSNGDLASESSWNCGEEGPSENSAVLQTRLRQIRNFIFILFVSLGIPVLNMGDECGHSSAGSTSYKDRVPLKWKALKTSFVKEVTGFISFLAALRSRRGDVFQRREFLKLENISWHGNNLSEPRWEDPTSKFLCMHIIAENDGNTPELTKGDLYICFNASEEPASATLPAPAEGSVWLRLVDTSLTFPSFFTTESNLEVQQVLGYSSYEVKAHSCVLFESKRDLPQFLG

SEQ ID NO: 25218 - protein, 957 aa, Gluconobacter oxydans
MADTISNTGLNEVGSVLRDLEKYGQSPWLDFIQRSFTEDGSLSKLVEEDGLRGVTSNPAIFEKAIGHGTEYDPQIRKLLEGEGLSPGELYEHLAIDDIRSACAVLDPVFEKTKGLDGYVSLEVSPYLAFDAHGTITEERRLWKAVGRPNLMIKIPGTVEGTGAIREAIADGINANVTLLFSLDAYKAVLEAYISGLEARVARGEEISRISSVASFFVSRIDAKIDAEIDRRVAAGDPEAEAPKAIRGKVAIANAKMAYQYYLEVRNSPRWKALAEKGANPQRLLWASTGTKDKAYSDVLYVEELIGPETVNTIPPATFDAYRDHGKSRASLTENVDQARHVMAEAERLGLGPDGITAKLVKDGCAAFSVSFDTLLTAVATKREAVLGDRLLRVSADLPPDLRDDVAAAEKDWSHSGGLRRIWKKDPSVWTNGPEAGWLNWLTVVQDRLWHIEELEVLARDVRSRGFKDILLLGMGGSSLGPEVLAETFGKREGWPKPHVLDSTDPQQVTAFEKAIDPKNTLFIVASKSGGTLEPNILFAHFWQVAGQALGKKPGDSFIAITDPGSHMQKVAEENGFWRIFYGDPKIGGRYSVLSNFGLVPAAASGIDVRKLLTVTRLMVESCGGSAPPSANPGAVLGLILGHAAHCFNRDKVTILASEGIASLGAWLEQLIAESTGKKGLGLIPIDEEELGTPDVYGTDRVFVDLLLGDDAPDSRLGALRAAGAPVVTIRLADKAQIGQAFFLFEFATAVAGAVLGIDPFDQPDVEFSKLETRKLTSAYAETGSLPPETPFAKDGPLSFYADAKNTEASGNKGDAVSILKALFDRVKPGDYVGLLAYIRRDQQTRDWAQSVRMELRDALKVATAAEFGPRFLHSTGQAYKGGPDSGVFLQVTATDAADVPVPGHGFSFSVVKAAQARGDFEVLAARGRRALRVHIDGPLEDGLKALETAIHKALAGA

SEQ ID NO: 25219 - protein, 375 aa, Kineococcus radiotolerans
MSDYYDVLGVSRDASAEDIKRAYRKLARKLHPDVTSDPDAGEKFKEVSQAYETLSTPDKRAAYDRGGSMPGGAAGGFGAGFGFSDIMDAFFGQGGGGRPGAPASRTQRGQDALIRVDVDLAEAAFGGERSIQVDTAVLCTTCQGSCCQPGTSPATCDICHGQGSVQRVVRSLLGQVMTTAPCPTCHGYGTVLPSPCLECNGEGRTRARRPLTIRIPAGVDTGTRIQLASQGEVGTAGGPPGDLYVEIHERPHPVFSRNGDDLLCTLHVPMTAAALGASIPLETLDGSAEEVDVRPGTQGGEVITLKQKGAEHLRAQGRGDLLVTLEVTTPRDLDDEQEELLRRLAELRGEVRPAGKLAPAHQGVFSKLRGKFSGR

SEQ ID NO: 25220 - protein, 352 aa, Nicotiana tabacum
DQPEPVAENGYNEQLEKYAAVVSPPRLCQLGLTYLGKYEMPILFPIASRLTKLDLLYALLDTAAHCFLLQRCPNLEILETRNVVGDRGLEVLGQYCKRLKRLRIERGADDQEMEDEQGAVTHRGLTDLAKGCLELEYMAVYVSDITNEAFENIGTYLKNLCDFRLVLLDREERITDLPLDNGVRALLRGCYKLRRFALYVRPGGLTDVGLSYVGRYSQNVRWMLLGYVGESDEGLLEFSKGCPSLQKLEVRGCCFSERALALAAMQLKSLRYLWVQGYRASSTGRDLLAMARPFWNIELIPARRVVASEGNNGEIIVAEHPAHILAYYSLAGQRTDFPDTVRPLDPTYLLAE

SEQ ID NO: 25221 - protein, 105 aa, Triticum aestivum
  misc_feature (13)..(14): Xaa can be any naturally occurring amino acid
  misc_feature (42)..(42): Xaa can be any naturally occurring amino acid
  misc_feature (47)..(47): Xaa can be any naturally occurring amino acid
  misc_feature (49)..(49): Xaa can be any naturally occurring amino acid
  misc_feature (53)..(53): Xaa can be any naturally occurring amino acid
  misc_feature (58)..(58): Xaa can be any naturally occurring amino acid
  misc_feature (61)..(61): Xaa can be any naturally occurring amino acid
  misc_feature (64)..(65): Xaa can be any naturally occurring amino acid
  misc_feature (67)..(68): Xaa can be any naturally occurring amino acid
  misc_feature (70)..(70): Xaa can be any naturally occurring amino acid
  misc_feature (76)..(76): Xaa can be any naturally occurring amino acid
  misc_feature (82)..(84): Xaa can be any naturally occurring amino acid
  misc_feature (89)..(90): Xaa can be any naturally occurring amino acid
  misc_feature (92)..(92): Xaa can be any naturally occurring amino acid
  misc_feature (94)..(94): Xaa can be any naturally occurring amino acid
  misc_feature (97)..(97): Xaa can be any naturally occurring amino acid
  misc_feature (99)..(99): Xaa can be any naturally occurring amino acid
  misc_feature (101)..(102): Xaa can be any naturally occurring amino acid
EPCGYSMNAINGXXVSTIHVTPEDGFSYASYQVMGMDASALXYGDIXKXVLRXFGPSXFSXAVXXFXXRXHAATWXKKLHAXXXYCNNXXVXEXPCXGXLXXQKF

SEQ ID NO: 25222 - protein, 340 aa, Lactobacillus plantarum
MRKRARLIYNPTSGREALAHDLVEILGIFEQAGYETSAFATTPAPNSAADEARRCAKDGFELIVAAGGDGTINQVVNGLAGLKRRPKMAIIPAGTTNDYARGLRIPRNDPVAAAKVVLKNQTVKMDIGQAGEQYFINIAAGGMLTELTYDVPSQLKSIFGYAAYLAKGAELLPRVKPVEMDLKYDGGHYQGKASMFFLALTNSVGGFEQLVPDASLDDGKFTMIIVKTSNLAKMLHLMTLVLNGGKHINDPSIIYVKTSKVVAKPADKDRLMINLDGEYGGDAPMTFRNLKQHIEMFADTDRIPDEAITDTDPELEDAERHFVSAVDQLPAATEDDEKTE

SEQ ID NO: 25223 - protein, 416 aa, Solanum tuberosum
MGICLSNEIKAETTIFTGTGVGSRNVSGNGTETSNSNSKVSSGSVPPTPRSEGEILQSSNLRSFTFNELRASTRNFRPDSVLGGGGFGSVFKGWIDEQTLLASKPGAGIVIAVKKLNQEGLQGHREWLAEINYLGQLRHPNLVRLVGYCLEDDHRLLVYEFMPKGSMENHLFRKGSYFEALSWSLRMKVALGAARGLAFLHNAEASVIYRDFKTANILLDSNFNAKLSDFGLARDGPTGDKSHVSTRVMGTYGYAAPEYLSTGHLTAKSDVYSFGVVLLEILSGKKAIDKNRPTGEHNLVECSRPYLTSKRRVFRVLDSRLEGQYSLTRALKVANVALQCLAMDPKSRPTMDEVVTALEQLQESKDRVKNDKNKDQQLNRLSSQSSGELNKSFRSNSEETPRVANYPRPSASLRSI

SEQ ID NO: 25224 - protein, 320 aa, Solanum chacoense
MEKNQEAEVMWKRGRTLGQGGFGFVSLACTTHSDDSPLIPSLIAVKSCMLSHSESLEDEIEFLRMCQDCPHVIRSFGVKVTQEDDILLYNLLLEYASAGSLADRLLNNDQLGLPEFQVQNHTKSVLLGLRFIHRKGIIHCDIKPHNILLTSTDDDDAEEVAKIADFGLSLTLEQSWTQTQGMRGTKRYMAPESLLKQEYGPEADIWALGCTVYELITGTPLWESSNSDPEFDDVLHRIMYEEPNLENDKLSTEAKDFMSYCLIKNPKSRWSAGLLLNHSFLKSADSVLPPKKRKRQQVTCPGYRGERKHSGHSHTFVIWL

SEQ ID NO: 25225 - protein, 356 aa, Pyrococcus furiosus
MFYGITHKCSKMLLSRHHQVRAGGEDMFSLGGLTKSSVDTSKVWDVIIIGAGPAGYTAAIYAARFGLDTLIITKDLGGNMALTDLIENYPGFPEGISGAELSKRMYEQVRKYGVDVIFDEVVRIDPAECAYYEGPCKFTIKTANGMEYKSRTVIIAVGAEPRKLNVPGEKEFTGRGVSYCATCDGPLFVGKEVIVVGGGNTALQEALYLHSIGVKVTLVHRRDKFRADKILQDRFREAGIPAILNTVVTEIRGKDKVESVVLKNVKTGETFEKKVDGVFIFIGYEPKTDFVKHLGITDEYGYIKVDMYMRTKVPGIFAAGDITNVFKQIAVAVGQGAIAANSAKEFLENWNKKDVE

SEQ ID NO: 25226 - protein, 484 aa, Synechococcus elongatus
MAAPILFWHRRDLRLSDNIGLAAARAQSAQLIGLFCLDPQILQSADMAPARVAYLQGCLQELQQRYQQAGSRLLLLQGDPQHLIPQLAQQLQAEAVYWNQDIEPYGRDRDGQVAAALKTAGIRAVQLWDQLLHSPDQILSGSGNPYSVYGPFWKNWQAQPKPTPVATPTELVDLSPEQLTAIAPLLLSELPTLKQLGFDWDGGFPVEPGETAAIARLQEFCDRAIADYDPQRNFPAEAGTSGLSPALKFGAIGIRQAWQAASAAHALSRSDEARNSIRVWQQELAWREFYQHALYHFPSLADGPYRSLWQQFPWENREALFTAWTQAQTGYPIVDAAMRQLTETGWMHNRCRMIVASFLTKDLIIDWRRGEQFFMQHLVDGDLAANNGGWQWSASSGMDPKPLRIFNPASQAKKFDATATYIKRWLPELRHVHPKDLISGEITPIERRGYPAPIVNHNLRQKQFKALYNQLKAAIAEPEAEPDS

SEQ ID NO: 25227 - protein, 669 aa, Glycine max
MVMASWKKLVLLLLIFLCTCKAQEEQSSTPVYLYHNCSGGNTTANSAYQLNLRTLLTSLSSNATTTEFSNNTVGLGTSPSDRVYGLFMCRGDVPSALCQQCVVNATGRLRSQCSLAKQAVIWYDECTVRYSNRSFFSTVDTRPRVGLLNTANISNQDSFMRLLFQTINRTADEAANFSVGLKKYAVNQANISGFQSLYCLAQCTPDLSQENCRSCLSGVIGDLPWCCQGKQGGRVLYPSCNVRYELYPFYRVTASPPSSSPSPPTLLPPPTSPISPGSSGISAGTIVAIVVPITVAVLIFIVGICFLSRRARKKQQGSVKEGKTAYDIPTVDSLQFDFSTIEAATNKFSADNKLGEGGFGEVYKGTLSSGQVVAVKRLSKSSGQGGEEFKNEVVVVAKLQHRNLVRLLGFCLQGEEKILVYEYVPNKSLDYILFDPEKQRELDWGRRYKIIGGIARGIQYLHEDSRLRIIHRDLKASNILLDGDMNPKISDFGMARIFGVDQTQGNTSRIVGTYGYMAPEYAMHGEFSVKSDVYSFGVLLMEILSGKKNSSFYQTDGAEDLLSYAWQLWKDGTPLELMDPILRESYNQNEVIRSIHIGLLCVQEDPADRPTMATIVLMLDSNTVTLPTPTQPAFFVHSGTDPNMPKELPFDQSIPMSVNDMSISEMDPR

SEQ ID NO: 25228 - protein, 304 aa, Solanum chacoense
MASIRWSRGRTIGKGAEGTVTLATTHNNFSIAVKSSLFSCSKSLQKEREFLNEFQDCSQIIRCFGADVTEEDNNILYNILLEYAIGGSLAHRIGKKSGLPDFEVKKYSKPILLGLRVVHGKGFVHGDIKPHNILLVGTEKRAKIADFGFASKVGIGSKKRKLRGTPMYMAPESVLDDEYGTPADIWAFGCTVFEMITGKKVWDCTGINDPLHLLCKIGMQSPDLHDDKMSKQAEDFLNKCVDRDPHSRWTADLLLNHPFLSSDNNDVHQRKRKELNLVDLCNSTELKPMKLLTNKRRRKLVERC

SEQ ID NO: 25229 - protein, 268 aa, Physcomitrella patens
MATAATAMNSTVLAGQALLKPVSELSRKVNAGEARVTMRKTVSKSSGSDSIWYGADRPKFLGPFSGETPSYLNGEFAGDYGWDTAGLSSDPETFARNRELEVIHARWAMLGALGCLTPELLAKSGVKFGEAVWFKAGAQIFSEGGLDYLGNPSLVHAQSILAIWACQVILMGAVEGYRVAGGPLGDVTDPIYPGGSFDPLGLADDPDTFAELKVKEIKNGRLAMFSMFGFFVQAIVTGKGPLENLNDHLADPVANNAWAYATNFVPGN

SEQ ID NO: 25230 - protein, 123 aa, Ipomoea nil
VTVRCGHCTNLLSVNMRGLLLPTAPNQLHLPHSFFSPQNLLDEIRNTPPSLLMNQPNPNESLMPIRGVDELPKPPVANRPPEKRQRVPSAYNRFIKDEIQRIKAGNPDISHREAFSAAAKNWA

SEQ ID NO: 25231 - protein, 317 aa, Methylococcus capsulatus
MSEPKHSRVLILGSGPAGYTAAVYAARANLRPVLVTGIQMGGQLTTTTEVDNWPGDADGVMGPDLMERMRRHAERFDTEIVFDHIHTADLSERPFTLTGDAGVYTCDALIIATGASARYLGLPSEEAYKGRGVSACATCDGFFYKGKHVAVIGGGNTAVEEALYLSNIAAKVTVVHRRDKFRSEKILSDKLLERAANGNVSIEWNSVLEEVLGDDMGVTGMRIRNVQDGTSKDIALEGVFIAIGHSPNTEIFAGQLGMRNGYIVVKGGSEGGATATTVEGVFAAGDVSDSIYRQAITSAGSGCMAALDAEKFLDSLG

SEQ ID NO: 25232 - protein, 106 aa, Unknown
  Sulfitobacter sp. EE-36
MATVAVTDATFDAEVKNSDIPVVVDFWAEWCGPCKQIGPALEELSSEMDGKVKIVKVNVDENPNSPAQMGVRGIPALFIFKNGEVVSNLAGARPKAALQGWIEESI

SEQ ID NO: 25233 - protein, 203 aa, Cryptococcus neoformans
MGKSQSKLSSEELAELQKNTYFDKKVRDICIDWRTELQQWYKGFLKDCPSGQLNKEGCTEFKKIYRQFFPFGDPSQFADYVFNVFDEDKSGTIEFKEFICALSVTSRGRLDEKLKWAFQLYDINQDGYITYDEMLQIVRSIYKMTGQMVQLPEDEDTPEKRVDKIFRNMDLNKDHRLTYDEFKEGSKQDPTIVQALSLYDGLV

SEQ ID NO: 25234 - protein, 463 aa, Yersinia pestis
MELPVKNKLKRGLTTRHIRFIALGSAIGTGLFYGSADAIRMAGPSVLLAYLIGGVVAFVIMRALGEMSVNNPQASSFSRYAQDYLGPMAGYITGWTYCFEILIVAIADVTAFGIYMGLWFPDVAHWVWVLSVVLIIGAVNMMSVKVFGELEFWFSFFKVATIIIMILAGIGIIVWGIGNGGQPTGIHNLWTNGGFFSNGFVGMLLSLQLVMFAYGGIEIIGITAGEAEDPKKSIPKAINSVPWRILVFYVGTLFVIMSIYPWNQVGTNGSPFVLTFQHMGITIAAGILNFVVITASVSAINSDVFGVGRMLNGMAEQGHAPKAFTAISKRGVPWVTVLVMMCAMLIAVYLNYIMPENVFLVIASLATFATVWVWIMILFSQIAFRRSLSKDQVKALDFPLRGGTFTSVLAIIFLVFIIGLIGWFPTTRISLYVGLVWIVLLLVGYYFKVKYQKKQATLIKNAD

SEQ ID NO: 25235 - protein, 187 aa, Oenococcus oeni
MNALVSHPAIKGVLATETDISAVVQRIADQLDAKFSQSSQRPLFISVLKGAAIFTTDLLRKMTLDVDLDYIDVKSYNHAQSTGNIRVTHDVDTDLTDRDVVIVDEIVDTGRTMKWLTDYFKLKGARSITTVVLTDKKDARILDVEIDFTGIQVPNEFLVGYGMDYNSYFRNLPVIAVIDTNKLDTIK

SEQ ID NO: 25236 - protein, 112 aa, Salmonella enterica
MKLVTVIIKPFKLEDVREALSSIGIQGLTVTEVKGFGRQKGHAELYRGAEYSVNFLPKVKIDVAIADDQLEEVIDIISKAAYTGKIGDGKIFVAELMRVIRIRTGEADEAAL

SEQ ID NO: 25237 - protein, 369 aa, Leptospira interrogans
MSERSYYDILGVSKSANDEEIKSAYRKLAIKYHPDKNKGNKESEEKFKEATEAYEILRDPKKRQAYDQFGKAGVSGGAGGFGQGAYTDFSDIFGDIFGDFFGGGRSSGFGGGRRSGPQRGSDLRYNLEVSLEDAALGREYKIEIPRLESCVDCNGSGASKGSSPATCPDCGGSGQIRRTQGFFSVATTCPTCRGKGTIISNPCRSCGGQGLQEKRRTINIKIPPGVETGSRLKVSGEGEAGPNGGPHGDLYVVTHIKKHELFERQGNDLILVRKISLAQAILGAEIEVPTIDGKKAKMKIPEGTESGQVFRLKGHGMPYLGAYGKGDQHVIVKIEIPKKITRRQRELIEEFARESGENIPGSKGKIFTK

SEQ ID NO: 25238 - protein, 625 aa, Aspergillus oryzae
MFSSISRGFAKSETGDTFSFSFKSSWLLSLLVLWGPPLTTAKSAADYYVRSLPGAPDGPLLKMHAGHIEVDPQNNGNLFFWHYQNRHIANRQRTVIWLNGGPGCSSMDGALMEVGPYRLKDNLTLEYNEGSWDEFANLLFVDQPVGTGFSYVNTDSYLHELDEMSAHFIIFLDKFFELFPEYEGDDIYLAGESYAGQHIPYIAKAILDRNKNAVSPWNLRGLLIGNGWISPADQYPSYLTFAYEEGLIKEDSRTAKSLEVLQSVCQSKLETGGKDRIHIGDCETVLQELLSKTLDSDNKCYNMYDIRLRDTVPSCGMNWPQDLKDVKPYLRRADVVKALNINPEKKSGWEECSGAVSSSFLPQKSVPAVQLLPSLLESGISVLLFSGDKDLICNHVGTEQLINNMKWGGGVGFETSPGVWAPRHDWTFEGEPAGIYQHARNLTYVLLYNSSHMAPYDLPRQTRDMLDRFMKVDIASIGGSPADSRIDGEKLPQTSVGGHPNSTAAEEQEKERMKQAEWKAYAKSGEAVLVVVIIGVSVWGFFIWRSRQRHRRYQGLYHEDVSGASVLERFHNKRSGQDVEAGDFDESELDDLHSPDMAREHYTVGEDSDEDDVNRQHQRTTINPS

SEQ ID NO: 25239 - protein, 372 aa, Mycobacterium avium
MRMHDTDEIRLIEAQAVPTRFARGWHCLGLIRDFGDGKPHPIDAFGQKLVVFRGGDGAINVLDGYCRHMGGDLSRGEVKGNEIACPFHDWRWGGDGRCKQVPYSRRTPRLARTRAWTTLQQDGMLFVWNDPEGNPPPPEVTIPRIEGAGSDEWTDWHWYSTVVQSNCREIIDNVVDMAHFFYIHGSLPKQFKNIFEGHVATQYMNSAGRPDIGGEGARMLGTTSVASYWGPSFMIDDLTYHYEDADHQTVLINCHYPIDANSFVLQYGIIVKKSDALPDDLAMQTAIALGDFVKLGFEQDVEIWRHKARIDNPLLVEEDGPVYQLRRWYQQFYVDVADVQPDMVDRFEFELDTTRPYAAWMKEVEANLAARA

SEQ ID NO: 25240 - protein, 713 aa, Arabidopsis thaliana
MNEEEAPSEQKKTLSLVPSPTTNLFLPDDILLSSLSRISRLYYPTFSLVSKSFRSLIASPELYQTRSILGRTESCLYVSLRLLNDSNLRWYTLCRVPDRKLTNFSGGHLLVPILSRYAPPAHWSSVVAVDYNIYAIGGPINDAPSSSVSVLDCQCEKWREAPSMRVARNYPTATVLDGKIYVAGGCEDCTSLDCIEVFDPKTQTWDSVASPGTERCERLVYKSVGIEGKYHLFGGAGHVAYDPKEGRWDSVGMDMEMGRTWVSYCVINNILFYYNDREFKWYDYKGRFWRKLMGLERLIKFLCYSRVNLAAYGEKMAVLWDTFVPSSSKNKMIWCAEITIERHDIYEICGKTEWFDVVLRVPKSYELPMSSPERKRKRVTSTKNPSVKKKKKISPVPTPIPSLPDDLLEGNPDPNPLWFTLCMKPDRTLKNGKKKKKKKMSSGNLLIPIPVPNPPLEHWSGHASVGSDIYFFGGYMEENVRSSRVVILDCRSHTLREAPSLQMERSDPAASVIDGKIYVAGGVDGDDADSLYPIEVFDIKTQIWDHRPIPYWEKDWGALSRSAYVDGKFYLTIGMKVMAYDLEESRWDFAGYQMGQSWFWSCNCVIENVLYCYGDAFRWFDTKLRLWKVMKVKGLPKLSRNVDVKIADYGGKMAIFWDNPSPSASDTNKIIRCAVIALERPNSEEIWGTVEWHEAVLTVPVSYEFEHALAVTV

SEQ ID NO: 25241 - protein, 490 aa, Clostridium acetobutylicum
MKRSGKVYIIGAGPGEEELITLKAIRKMKECTAVLYDRLVGQGILKYLNEKCEIYYCGKEPGCHYKTQDEINEMIIKLAKEGHIVGRIKGGDPYIFGRGGEEGLSLLKENIEFEVISGVTSPVAVLNYAGIPVTHRGIARSFHVFTAKTANDDSINFSAAAKIDGTLIFLMGYRQLNDITRKLIENGMDSKMPCAVVMRGTTSLQKKVIGNLSDIKEKCDNANMTSPCIIVVGKVVGFNQQLNWYEKKPLFGRNICITRSKNQSKTMREELLDLGAEVTEVHSIEIENTASNLEEYINKISEYDYIILTSVNAVEVLFDYLASKDYDVRKVRAKFAVIGNATKEALKKRGIVPEIVSRKHNGEGLFDEIRGYLKKDDKIFIPRSENSRKYIKEQLVSLGLSVDECFIYRTVPGKLYDKAAFENADTIVFTSPSTVKNMIALFGEKNIKKKSIIAIGPITGRELGKINAEYSTCSECSVDAIIRECLNSDK

SEQ ID NO: 25242 - protein, 694 aa, Chlamydophila abortus
MTFETISVTLEEGKTLVFETGKIARQANGAVLARMQETWVFSSVCAANLEEAVDFLPLRVDYQEKFSSIGKTLGGFIKREGRPTEREILTSRLIDRSMRPSLPNRLMQDIQILSYVWSYDGVTLPDPIAICGVSAALAISDIPQTSIVAGVRVGFVNNRWVVNPTKAEMDVSRMELVLAGTENAILMIEGHCDFFTEEQVIEAIEFGHKHIVTICKALKDWQKHIGKEKNTSGIVSLPEEVQSAVNTFVEGKFVDLLKIKEKKAFEAASKQLENEVIEQLQEENEVFTAFNIKIAFKQAKSNFIRGLIREQGLRSDGRSVTTIRPISIDTSFLPRTHGSCLFTRGETQTMAVCTLGSEAMAQRYEDLNGEGLAKFYLQYFFPPFSVGEVGRIGSPGRREIGHGKLAEKALSHTLPDPMKFPYTIRIESNITESNGSSSMASVCGGCLALMDAGVPIKTPIAGIAMGLILEDDHVTILSDISGLEDHLGDMDFKVAGNTEGITAFQMDIKVEGITPDIMRAALAQAKEGRQDILETMKQALAAPKTDLSQYAPRIETMQIKPNKIATVIGPGGKQIRQIIEEAGVQIDINDSGLVSISASSPQAIEKAKSIIEGLVGEVEVGKIYEGRVTSVVPFGAFVEILPGKEGLCHISEFSKQRIDNVGDFVKQGDTLTVKLLSINEKGQYKLSHKATLSE

SEQ ID NO: 25243 - protein, 256 aa, Trichodesmium erythraeum
MTATNNIVNLYQPFLDYALTKLKEELELQPYPIPSGFEHKVAMTGKGKKQQEVQTTSYAHCSPKLRQIRAAHVQGGSALQVLNFVIFPHLNYDLPFFGADLVSLPGGHLIALDMQPLFRDNLQYQKKYTEPIWETFQKHQKYLPWGGDFPEEATPFFSPAFLWTRPQKTELVETRVFEAFKDYLQAYLIFVKQTEQITNSEKLAEIKEAQLRYLRYRAEKDPARKMLTRFYGHEWTEEYIHGFLFDLERKLALNPA

SEQ ID NO: 25244 - protein, 436 aa, Haemophilus somnus
MSIYTYICFLSTISILIGFVTQKISDRIQYTIAITATATVGSLILLIAGSTNLFHLDDIAQNVMQRIDFKDFLLNGILGFLLFAGALGIKLPVLKSQKLEITILALFSTIASTLFIGVLFYGISALLRLHIDFIYCILFGALISPTDPIAVLAIIKNLKAPKKLSMKVEGESLFNDGVGLVIFTTIFTVAFGGHEPTAMEITKLFLAEAVGGIFFGLILGVIAHFLISATDDGSLEILLTLTIPTAGFMLANLLHVSGALAMVVAGIMISNWTRHSGFSEQSQHYLDHFWEMIDHFLNSLLFLLIGSAMLLVNFTSQAIILSLIAIPVCLFCRYASVWIPFKFLSMKTVYNPYTLRILTWGGLRGGLSLAMALSIPATSAFLENIGMNVRDLFIIITYSVVLFSILIQGTTIETMIRKSKEATLQKRGYIGLKNQT

SEQ ID NO: 25245 - protein, 469 aa, Bacillus clausii
MAKQNIGVVGVGVMGRSLALNLESKGFSVSLYDVSEERINEILDHNKGKRLVGTFSLEEFVHSLEKPRKIMLMVQAGQVTDQVIDSVIPLLDKKDILIDGGNTYYTDTIRRSQTAAEHGIHFIGTGVSGGEEGALKGPSIMPGGQKEAYELVKPMFEKIAAQVNGEPCTTYIGPDGAGHYVKMVHNGIEYGDMQLICEAYSLLVNVLGLNAEDLHSVFKEWNEGELDSYLIEITADIFTKVDEETGKPMVDVILDTAGQKGTGKWTSKSSLDLGVPLPVITESVFARFLSAMKEERVKASQILSGPEKKQFTGDKQELIERIRQALYFSKVLSYAQGFSQLKSMSLEMNWNLQYGEIAKIFRGGCIIRAAFLQNITDAFERDANLDNLLLDPYFENISRKYQQALREVVALAVEYGIPVPGFSSAISYYDSYRSERLPANLLQAQRDYFGAHTYQRIDKEGVFHTNWLD

SEQ ID NO: 25246 - protein, 646 aa, Mycobacterium avium
MSTGMAVTTESAGAAGPDPYDVGELRANLRQADPGVLVAVLAQLTGDPAVVDRFAPKITHVPDPPEQAGVTDPETAAQLVDEIVTALRTPRRADAVPADDLDLFARVAPVALGGEVGPEYLGLLVEQGGFQPSQPVLPRTAKLPAGFRVVIIGAGIAGITAALACADAGIEYQIIERNDEVGGTWYTTRYPGIGVDTPSAYYSLSRDINGDWSSYYPQGAEYQAYLVSVADKNDLRKHTRFGTEVEALWWQERRRQWQIHSVGPDGTRDVSYANVVIPAAGYLNRPRWPELAGRETFSGISIHSAHWDPELDLTGKRVAIIGAGCTAVQIVDACVDQVAHLTVFQRQPHWVAPRRRASDDVSTYQRWLGTRLPYYANWIRIKSYWGTADNNYPVILHDPQWAAEHLSVSPANDVLLRMCLDYIDRVFGAGSELARKVTPDFAPYGKRIIRDPGGYYAALAREHVDVEASEPARVNQAGIVTADGRQIDLDVIIYATGYYLDFLSTVDIRGRDGKKLTDEWGDAPRAYRGGMVPGFPNMFISSAPNYSPGHGAGHNFGVEVMVHYVMECLQLMALRRATTVEVTQRAYEEYVADIDALMAGTVWCHTPSAHTYYRSGGGRIVTAFPYRLVDFWRDHRAPSEEDLELR

SEQ ID NO: 25247 - protein, 428 aa, Trichodesmium erythraeum
MSDSLFDDASRRLERALQYVSLSEDTKERLKYPKATLIVSIPVRMDDGSLRVFQGYRVRYDDTRGPTKGGIRYHPNVSIDEVKSLAFWMTFKCAVVSLPFGGAKGGITVNPKELSRMELERLSRGYIDAIADFIGPDTDIPAPDMYTNPMIMGWMMDEYSIIRRQLSPAVITGKPVSIGGSLGRNTATAMGAFFAIETIMPKFEYTPEKTTVAIQGFGNAGAFLAELLCLHGYKVVAVSDSQGGIYSAQGLDIPSIRQYKEVNKQIQAVYCKDSVCNIVEHTVLTNEELLALDVDILIPAALENQITEENVKDIQAKFIFEAANGPTTSGADKILEDRGVYVFPDILINAGGVTVSYFEWVQNRSGLYWTLDEVNQKLKAKMVAETENIWQISQELSISMRTAAYVHGLDRLGQAINAKGTRAFYAKR

SEQ ID NO: 25248 - protein, 282 aa, Chlamydia trachomatis
MEFPCTLTLKELLESGAHFGHQTSRWNPRMKPFIFEEKNGLYIIDLAKTLGQLEKAVSCIQKTIEQERSILFVGTKKQAKQIIREAAIECGEFFASERWLGGMLTNMATIRNSVKTLNRIELDLEASNSGLTKKELALLAKRHHKLLNNLEGVRHMNSLPGLLIVIDPGYERIAVAEAGKLGIPVMALVDTNCDPTPINHVIPCNDDSMKSIRLIVNVLKDAVIDAKKRLGVEILSPVRPAERPAEEAVKELPLPTGEAQDEASSKEGVLLWADIDNCEALK

SEQ ID NO: 25249 - protein, 252 aa, Unknown
  Platanus x acerifolia
MHHSVSWMAMAAVAAAFLQLCSSVENVETSHLEADRINKLPGQPQVSFQQFSGYITVDERKQRALFYYFVEAEKDPASKPLVLWLNGGPGCSSIGVGAFSEHGPFRPSGEILIRNEYSWNKEANMLYLETPAGVGFSYSTNTSFYKAVDDEITAKDNLVFLQRWFIKFPLYKDRDLFLAGESYAGHYVPQLAQLIVQFNKKEKLFNLKGIALGNPLLEFTTNLNSRAEYLWSHGRISDLTYRVLTSACNYSR

SEQ ID NO: 25250 - protein, 99 aa, Anabaena variabilis
MATFKVTLINEAEGTSNTIDVPDDEYILDAAEEQGYDLPFSCRAGACSTCAGKLVSGTVDQSDQSFLDDDQIEAGYVLTCVAYPTSDVTIQTHKEEDLY

SEQ ID NO: 25251 - protein, 283 aa, Moorella thermoacetica
MRGIWFSELQTPDLAISVRLNQTLHHEKTPYQELAVVDTEAYGRMLLLDNIIQTTVKDEFFYHEMIAHVPLNTHPNPRTALVIGGGDGGVVREIVKHPSIEKVTLVEIDARVVANAREYLPEIACGLDDARVEIRFEDGIEHVRQRENTYDVIIVDSTDPIGPAVGLFSAEFYRNVYRALKADGVFVAQTESPIFNSRLIRRIQRDLKEIFPIARLYLTTVPTYPGGLWAFSLGSKKYDPLEVDWRQAPKVATRYYTPAIHQAAFSLPPFVQEFLEAPEEEEF

SEQ ID NO: 25252 - protein, 372 aa, Pseudomonas aeruginosa
MRDKVTGARRWVVKIGSALLTADGRGLDRNAMAVWVEQMVALHCAGIELVLVSSGAVAAGMSRLGWVSRPSAMHELQAAASVGQMGLVQAWESSFALHGLQTAQVLLTHDDLSDRKRYLNARSTLRTLVELGVVPVINENDTVVTDEIRFGDNDTLAALVANLVEADLLVILTDRDGMFDADPRNNPDAQLIYEARADDPQLDAVAGGSAGALGRGGMQTKLRAARLAARSGGHTVIVGGRIERVLDRLRAGERLGTLLTPDRSRKAARKQWLAGHLQMRGTLVLDDGAVKAVSQDHKSLLPVGVKAVQGSFRRGEMVVCVDQGGREVARGLVNYSALEAQKILGQPTDAIEALLGYVDGPELVHRDNLVLV

SEQ ID NO: 25253 - protein, 361 aa, Candida glabrata
MEVTRVLGGIYMGGFTPLANHTPLKAEYNITHILSVIKLDTIPEYLVRKGYTLKSIPIDDDDTTDILQYFNESNKFLDHCLYPYEQEYDPALVDFRKKKQDPQNAVYVHCQAGISRSTSFVVAYLMYRFGLRLKDALHAVRRKRPQVEPNPNFMEQLQVYAEMGANRVDPDNQLYKTWKLAQSIKVDPTGRDILSKDDTYKDSSNEDQELDKLTKEELSQTTVIRCKNCRKRLALSTSFIKHDPPSKQSSEGHFIRRAAGSRRIIDIQESSTTCSHFFVEPLNWMKQELQGKQELEGKFSCPGCSYKVGGYNWKGSRCSCGKWVIPAIHLQSSKVDHFPLAERTLPNMVNFKPSNVPLPKN

SEQ ID NO: 25254 - protein, 117 aa, Ipomoea nil
TVRCGHCANLLSVNMGSLLQPLPLHQDIQNEQKQQQSNNEDGSGSSSSSSKCNKFAPFDSPEHEQQPRLAPIRPPEKRQRVPSAYNRFIKEEIQRIKASNPDISHREAFSTAAKNWA

SEQ ID NO: 25255 - protein, 282 aa, Chlamydia trachomatis
MELPCKLTLKELLESGAHFGHQTSRWNPKMKPFIFEEKNGLYIIDLAKTLGQLKKAVSCIQKTIEQERSILFVGTKKQAKQIIREAAIECGEFFASERWLGGMLTNMATIRNSVKTLNRIELDLEASNSGLTKKEIALLAKRHRKLLNNLEGVRHMNSLPGLLIVIDPGYERIAVAEAGKLGIPVMALVDTNCDPTPINHVIPCNDDSIKSIRLVVNVLKDAVIDAKKRSGIEILSPVRPVERPAEEAVEELPLPTGEAQDEASSKEGFLLWADIDNCGALK

SEQ ID NO: 25256 - protein, 345 aa, Vibrio parahaemolyticus
MTQANTNNAYGKDIAMTVIGAGSYGTSLAISLARNGANVVLWGHEPEHMARLEADRANHAFLPGVDFPESLIIESDLEKAVQASRDLLVVVPSHVFGIVLNSCKPFLREDSRICWATKGLEPETGRLLKDVAYDIIGENYSLAVLSGPTFAKELAMGLPTAISVASPDAEFVADLQEKIHCSKTFRVYANNDFIGMQLGGAVKNVIAIGAGMSDGIGFGANARTALITRGLAEMSRLGAALGAKPETFMGMAGLGDLVLTCTDNQSRNRRFGLALGQGQDVDTAQEEIGQVVEGYRNTKEVWMLSQRMGVEMPIVDQIYQVLYQGKDARLAAQDLLARDKKAEGK

SEQ ID NO: 25257 - protein, 445 aa, Propionibacterium acnes
MDRQLENAYESVLRRNPGEAEFHQAVREIFESLGPVLDTNPQYVEAAVLSRICEPERQIIFRVPWVDDEGKIRINRGFRVEYSSVLGPYKGGLRFHPSVYLGTIKFLGFEQIFKNALTGMPIGGAKGGSDFDPHDASEAEVMRFCQSFMTELYRHLGEHTDVPAGDIGVGSREIGFLFGQYKRITNRHESGVLTGKGLTWGGSLVRTEATGYGTVFFVQRMLATNGKSLDGLRVTVSGSGNVAIYAIEKAQDLGATVVACSDSSGYVVDEKGIDVALLKQIKEVERARICEYAARRDSATFHSDGSIWDVPVDVALPCATQNELNGQAAATLIRNGVVAVAEGANMPCTPEAVHSFQDAGVIFAPGKASNAGGVATSALEMQQNAARDSWDFDATEARLQQIMADIHDRCIETADEYGHPGDYVMGANIAGFTKVADAVIAMGVV

SEQ ID NO: 25258 - protein, 245 aa, Unknown
  Silicibacter sp. TM1040
MSGFVSFVSSGPGDPELLTLKAVKRLEAADAVLFDDLSSGPILSHARADADMVGVGKRAGRPSPKQDHVSQLLVEYAQSGAHVVRLKSGDSGVFGRLEEEMVALRAAGIKYEIIPGVTAASAAAAAAGIPLTRRLTARRLQFITGHDVTGGLPEHMNLTALADPEATTVVYMGKRTFATLLELLLEAGLPETTPALVALGVSTPAQELHRVTVAALPDLLEAIISPAPVLILYGPLADDDALVSQ

SEQ ID NO: 25259 - protein, 134 aa, Photorhabdus luminescens
MSDLKTLNNIRTLRAQARECQLEFLDEILEKLTVVVEERREEESQVQAELEERTRKLEEVRKMILDQGIDPSELLQTMSAGKSAGKAKRPARPAKYQYVDTNGETKTWTGQGRTPAVIKKAIEDEGRTLESFLL

SEQ ID NO: 25260 - protein, 377 aa, Unknown
  Shewanella sp. MR-4
MSKRDYYEVLGVGRDASEREIKKAYKRLAMKFHPDRNPGDKAAEASFKEVKEAYEILTDANKKAAYDQFGHAGVDPNRGGGGGYGGAGDFGDIFGDVFGDIFGGGRRGGQRQAARGSDLRYNLELSLEEAVKGLTKELRIPTLASCDVCDGSGAKKGTSATTCGTCHGQGQVQMRQGFFTVQQACPTCHGRGKIIKDPCTKCHGDGRVEKTKTLSVKIPAGVDTGDRIRLAGEGEAGEFGAPPGDLYVQVTVREHAIFVRDGNNLYCEVPISFSKAALGGEIEVPTLDGKVSLKIPAETQTGRMFRLRGKGVKSVRSHAVGDLLCKVVMETPVNLNERQKELLREFEATLTGESKKHSPKAEGFFDGVKKFFQDLNS

SEQ ID NO: 25261 - protein, 764 aa, Triticum aestivum
SGPAPRLRRWRPNATAGKGVGEVCAAVVEAATKVEDEGEEDEPVAEDRYALGGACRVLAGMPAPLGATALAGGVNFAVYSGGATAAALCLFTPEDLKADRVTEEVPLDPLMNRTGNVWHVFIEGELHNMLYGYRFDGTFAPHCGHYLDVSNVVVDPYAKAVISRGEYGVPARGNNCWPQMAGMIPLPYSTFDWEGDLPLRYPQKDLVIYEMHLRGFTKHDSSNVEHPGTFIGAVSKLDYLKELGVNCIELMPCHEFNELEYSTSSSKMNFWGYSTINFFSPMTRYTSGGIKNCGRDAINEFKTFVREAHKRGIEVILDVVFNHTAEGNENGPILSFKGVDNTTYYMLAPKGEFYNYSGCGNTFNCNHPVVRQFIVDCLRYWVTEMHVDGFRFDLASIMTRGSSLWDPVNVYGAPIEGDMITTGTPLVTPPLIDMISNDPILGGVKLIAEAWDAGGLYQVGQFPHWNVWSEWNGKYRDIVRQFIKGTDGFAGGFAECLCGSPHLYQAGGRKPWHSINFVCAHDGFTLADLVTYNKKYNLPNGENNRDGENHNLSWNCGEEGEFARLSVKRLRKRQMRNFFVCLMVSQGVPMFYMGDEYGHTKGGNNNTYCHDSYVNYFRWDKKEQYSELHRFCCLMTKFRKECEGLGLEDFPTAKRLQWHGHQPGKPDWSENSRFVAFSMKDERQGEIYVAFNTSHLPAVVELPERAGRRWEPVVDTGKPAPYDFLTDDLPDRALTIHQFSHFLYSNLYPMLSYSSVILVLRPDV

SEQ ID NO: 25262 - protein, 300 aa, Cenarchaeum symbiosum
MHFVGCGPGDPELITIKARKLIRKADVLVHSGSLIPRPILEMCGGKMHDASGMIREEIFALLRDGALKGKHVVRLHDGDPSVYGAIREQIDALEEEGIGCTVVPGVTSMLAASAALGVQLTLPGVTQTIMITRAGARTGVPAREGMTSLARHGTTIVLYLSVHLLRDTVKKAVAGGYKKSTPAAVVYRASWPDQKIVRGTLGDIADKVREAGITRTAIVMIGDVISPKSYEYSRLYDKSFSHGYRKAKSAKSGPSRAKVRGKGPSKPKGSTGPGARGRGKAPSSAGARSAKRPRARTLVS

SEQ ID NO: 25263 - protein, 137 aa, Chlamydia trachomatis
MEFPCTLTLKELLESGAHFGHQTSRWNPRMKPFIFEEKNGLYIIDLAKTLAQLKKAVACIQTTIGQEKSILFVGTKKQAKQIIREAAIECGEFFASERWLGGMLTNMATIRNSVKTLNRIELDLEASNSGLTKKELA

SEQ ID NO: 25264 - protein, 745 aa, Thermoanaerobacter mathranii
MGRDVLNFNVDWLYIPEDLNDAYKFDFDESNFEVVSLPHANKTFPHHYFKEEDYRFVSWYRKHFKVDERYKGKKVYIHFEGVMTVAKVYVNGEFVGEHKGGYTPFEFDITEYVKYGDFENLIAVQVDSREHKDIPPEGHLVDYMLFGGIYRNVWLKILNDTHIKDVYFVVDKLQNSVAEISITTTIEGKEVRNAKILTEVINKEGVVCSSSVTDVKDMQKEIVQRIKMENPLTWHPDHPYLYNVSVKLVAENEILDNYTFKTGIRTVEFRDDGKFYINGEPLKLRGLNRHQTFPYVGGAMPDRVQRKDADILKYELGLNYVRTSHYPQAVSFLDRCDEIGLLVFEEIPGWQHIGDENWKNIAKENLKEMILRDRNHPCIFMWGVRINESLDDHDFYKEMNEIAHKLDRSRPTGGVRYLRDSEKLEDVFTYNDFIYNLEGKIQLPNHKKYMVTEYMGHMYPTKSYDNLNRLITHARLHALIQDKQYGIPNMAGASGWCAFDYNTTSAFGSGDNICYHGVCDIFRLPKFAAHFYRSQADPHLYGPYVFIASYLIPSFREENGDKLLVFSNCEEIELYINDKFVMKQMPNRVDFPSLPYPPFEFSLNQLGVNYMDMAIKANDVSITAVGLINGKEVARHTLRTYGKPDKLILSCDDNEIMADGSDCTRVVVSVVDENGSILPYANIPVSFEIEGEGKLIGENPLALEAGRGAVYVKSTRKPGEIILKAKSHYVAEESSVSIKTNSIGY

SEQ ID NO: 25265 - protein, 283 aa, Propionibacterium acnes
MAVVTTRQLLESGVHFGHQTRRWNPKMKRFIFTERNGIYIIDLHQSLTYIDKAYAFVKETVAKGGQILFVGTKKQAQESIVEQATRVGMPYVNQRWLGGMLTNFQTISKRIARLKELEAMDFDKVSGSGLTKKELLMLSREKDKLEKDLGGIRDMPKVPQAVWVVDTKKEHLAIDEARKLKIPVVAILDTNCDPDEVDYAIPGNDDAIRSVSLLTRIIADAAAEGLMARSAGKSGEQPAEAEPMPDWERELLEGDGAKTEAKAEEPKAEAKKADEAPEAEKSN

SEQ ID NO: 25266 - protein, 1049 aa, Caldicellulosiruptor lactoaceticus
MDAIISKKHYENPEVLHINREEPRAFFIPFQSLDLALSKNYELSDYFKTLNGNWKFLFIDNTADIPKNFEKDNFDDSSWDTIYVPSNWQLMGYDRPVYTNIAYPIPVDPPHVPEENPVGIYRRKFFIGREIDDKETFIVFEGVDSCFYVWLNGHFIGFSKGSHMPAEFNVTKYLRKGENTICVAVLKWSDATYLEDQDKWRLSGIFRDVYLLFRPKLYVRDFAVKYEFENDSLEKVNLSIDIMMRNLDSSQNGTIKLFLLNKDNQVVFEKTITEKVKANEEKYVSIAETLYKPELWSAETPNIYKLAIENHIQNKKEVIVHNIGFRKIEIKDGVFYLNNVAIKIKGVNRHEMHPDLGQAITKESMLQDLMLMKQYNINAIRTSHYPNHPFFLDLCDELGFYVIDEADIETHGFWLLGDVSIISNHPQWEAAYIDRAKRMVLRDRNHPCVIIWSLGNESGYGKNHDSMANYIRTIDNSRPIHYEGAFDAGIVDIVSVMYPTVEFLEEQGKKKEKRPFFMCEYAHAMGNGPGSLKEYWDVIYKYPRLMGGCVWEWADHGIRKIENNKEFFAYGGDFDDHPNDGNFCIDGLMFPDRKPYPGIIEYKKAIEPVRIEEIDAAEGKFRITNTYDFLNLNVLSITWELLEDGIIVDEGELDLNLEPHCTAEVEIPFRKELLNSDCEYHINIISKLKSSTPWAKKGFTVAYSQFRIPSKVAKKIINVNSLSQNLNLKDEENEIIVFSEDTNVVFSKKKGTIINLKYNNIELLKEGPSINLFRAFTDNDKYMKNTFFENDVFKLIDAEEKVKAFNELIYSLANSMFYRIEDINYRLENNKAFVIEVSKIHGIYSLPPLFRTLTKYIIYANDYIFMNTTFLPLALSQKMVLPKLGVQMVLPRGFEYVKWFGRGPHENYIDRKESTLVGIYEGNVDELYVPYVKPQEYGNRCDVRWTCISSMTGIGLLAIGNPTFEMSVKKYADFELLRKKHAHELKEYDGIILNIDYMVSGLGSNSCGPQPLEKYKLYPQKIEFSFYLKPINLNLTHPEILAKMIPELL

SEQ ID NO: 25267 - protein, 487 aa, Cryptococcus neoformans
MNQPSTLAQAHPDHPTLAELVADRPDPATATPLGHDIASPQHTTTPTSMSDADSSPASPEAPRRPGGLSEGPNARSKSVTVASGEDTFGALNCHPGPGSAAISNSNLPADSFRVGVSEDRNRRCRRTMEDAHSFVYDFAGVKGQGYFAVFDGHAGKHAAEWCGQNFHEYLLDGLLIEPDTPVPDLMNKTFHLVDKRLSHLAHAAGTSSGCTAVTAFLRVEEMDDNDSFRKGFTNPGLQPRGLWEGKGEDELESQTSLQPSSRRSSMGGGTGGQMGGASAPGVNGRTGSLARRLSSKKIRDFVKGLTGGMEKNFDEAITEDEGVISAADGTRVEAIEPKSEKGVRRVLYTANVGDARAVLCRGGKAVRLTYDHKGSDAQEAKRITDAGGFVMNNRVNGVLAVTRSLGDASMKEFVVGAPYTTETTLDEQDEFLIVACDGLWDVCSDQEAVEIVHLVTDPQEASKRLLDHAMSNFSTDNLSVMVVRFNH

SEQ ID NO: 25268 - protein, 199 aa, Glycine max
MSPATSSAVGTLSGGLLPHGAHRRRPLPTARLLPPRWSRLQVNAARHRRLATPPRAQSAPSPGYLPDSEFYKIEAILRPWRVSHVSSGLLEMGIRGVTVSDVRGYGAQGGSTERYEGSEFSEDTFIAKVKMEIVVCKEQVEPVIDKIIEKARTGEIGDGKIFLIPVADVVRVRTGERGVHAEKMIGGLSDKLPPVITIS

SEQ ID NO: 25269 - protein, 221 aa, Aspergillus oryzae
MSLVLSFLAGLFSFMQAPVKIMVLIGDSGVGKSNLLSRFTRNEFNLDTKSTIGVEFATRSIQVDSKTIKAQIWDTAGQERYRAITSAYYRGAVGALLVYDISKHQTYDNVNRWLKELRDHADSNIVIMLVGNKSDLRHLRAVPTEEAKQFASENNLSFIETSALDASNVELAFQNILTEIYRIVSSKALDSGDSGQAGLGDRRPVVDINPSQDPETKQGCC

SEQ ID NO: 25270 - protein, 162 aa, Trema orientalis
MSSSEVDKVFTEEQEALVVKSWAVMKKNSAELGLKFFLKIFEIAPSANNLFSYLKDSPIPLEQNPKLKPHAMTVFVMTCESAVQFRKAGKVTVRESNLKRIGAIHFKNGVVHEHFEVTRFALLETIKEAVPEMWSPEMKNAWGEAYDQLVAAIKFEVKPSST

SEQ ID NO: 25271 - protein, 493 aa, Aspergillus oryzae
MLSPIHLLSRRTCLRSIATAIDQPRFPVFLQQQSLSTPFSSSLVYSKALKFPRPTSTRLISCSFSRLYTTSVNDLAKMSSLTPYQRKHKVTVIGSGNWGTAIAKIVAENTASNPAIFEKDVQMWVFEENVEVPKTSPHYNPSSPLCQGPQKLTEIINKTHENVKYLPGINLPTNLHANPSLEDSVKDSTILVFNLPHQFIIKTCEQIKGKILPYARGISCIKGVDVREDGISLFSETIGKILGIYCGALSGANIASEVAQEKWSESSIAYDPPHLDSKAPSPNRSPSSSTVDVVHFTHKDVSGQLSRVKLQALPSEYPPIDHAVLKTLFHRPYFHISVVSDVAGVSLGGALKNVVAIAAGWVEGMGWGDNAKAAVMRVGLLEMVKFGEMFFGATINTRTFTEESAGVADLITSCSGGRNFRCAKLSIERKQPIGKVEETELNGQKLQGTLTAIEVNKFLKNQGVEEEYPLLTAVYKILEGTMSVEDIPSYIER

SEQ ID NO: 25272 - protein, 373 aa, Pseudomonas fluorescens
MMRSKVTGAQRWVVKIGSALLTADGKGLDRTAMGVWVEQMVALHEAGVELVLVSSGAVAAGMSRLGWTARPSAMHELQAAAAIGQMGLVQAWESSFAEHGRHTAQILLTHDDLSDRKRYLNARSTLRALVELKVIPVINENDTVVTDEIRFGDNDTLAALVANLVEADLLVILTDRDGMFDADPRSNPDAQLIYEARADDPTLDAVAGGTGGALGRGGMQTKLRAARLAARSGAHTIIVGGRLERVLDRLKAGERIGTLLSPERGMLAARKQWLAGHLQTRGTLVLDDGAVSALSQGNKSLLPVGVKLVQGSFRRGEMVVCVAPDGREIARGLANYSALEAQKIIGQSSDAIVGLLGYMAEPELVHRDNLILV

SEQ ID NO: 25273 - protein, 87 aa, Unknown
  Synechococcus sp. CC9311
MKKRVTVPIESINRPHESVIDEGKVDELMRSISEIGLQEPVDLIEFDGKYYGFNGCHRYTAHKRLGRKTIEANIRQVDRATFRLHLM

SEQ ID NO: 25274 - protein, 215 aa, Pseudomonas syringae
MTLRSEILVNKNVLPTAEQALPGRETPMALPEFHFVNGNPLLGPFSSNVEFAIFGMGCFWGAERRLWQQEGVVSTVAGYAGGFTPNPTYEEVCSGLTGHTEVVLVVYEPAKISYEELLKVFWEVHNPTQGMRQGNDIGTQYRSVIYCTTPEQLDAAKASAETFQAQLNKAGKGTITTEIEQAPTVYFAEAYHQQYLAKNPQGYCGLGGTGVCMPA

SEQ ID NO: 25275 - protein, 764 aa, Bacillus licheniformis
MTKRCVPMIEITKGVETGYGSILAISDMESAMRDERIKKTKPVCTYCGVGCSFDVWTKGRDILKVEPQEEAPANGISTCVKGKFGWDFINSEERLTKPLIREGDHFREAEWEEALTLIASKFTDLKEEFGPDSLAFITSSKCTNEESYLMQKLARGIIGTNNVDNCSRYCQSPATAGLFRTVGYGGDSGSIADIAQADLVLIIGSNTSESHPVLSTRIKRAHKLRGQKVIVADIRKHEMAERSDLFVQPRAGSDIVWLNAIAKYLIENGKADERFLQERVNGRDEYVKSLTPYTLEYAEEKTGIDQETLIQMAEMIGQADSVCALWAMGVTQHIGGSDTSTAISNLLLVTGNYGKPGAGSYPLRGHNNVQGASDFGSMPDRLPGYEKVTDEQVRQKYEQAWGVPLPKEPGMTNHEMIEKIHSGKLKAMYVKGEEMGLVDSNINHVHAAYEKLDFFVVQDIFFSRTAEFADVVLPASPSLEKEGTFTNTERRIQRLYQVFEPLGESKPDWQIIMEVANKLGADWHYEHPADIMEEAAKLSPIYAGVTYERLEGYNSLQWPVSADGKDSPLLFTERFPFPDGKAILYPVHWTEPEEFGEEYDIHVNNGRLLEHFHEGNLTYKSKGISKKTPEVFLEISPELAAERGIQDGTLVRLTSPFGNVKVKCLITDRVKGKEVYLPMNDSGEAAINLLTGSHADKDTDTPAYKETSAKMEILKRDGSNPLPKINHRNGNPQPQIGVQVQKKWARKDYIFPGDAVKRGIGHNG

SEQ ID NO: 25276 - protein, 473 aa, Oryza sativa
MDNSVSDRSFLIDSDEEDDAAAAVEDGKRRGHGGDESDDGSDSSSSCGTPRVAAAGGGGGGRGSQPSSYTQQWPQSYRQSIDMYSSVQSPNLSFLGTPTLSRLSNSFLTASFRGKPPEIISGLIKPLLPTTAAAAAADDEGDGRQQQHEDGRKSSQYLLPPRRPSSLQKIPEDQKPLVVGHHEVGPYRQCTYTQGVLNGVNVLCGVGVLSTPYAVKQGGWLGLIILALLAVLAWYTGILLKRCLDSKEGLETYPDIGHAAFGTTGRIVISVILYMELFACCIEYLILESDNLSKLFPNAHLTIGTFTINAHILFAILTTLIVMPTTWLRDLSCLSFISAGGVIASIVIVACLFWVGLVDHIEAKDEGTALNLPGIPIAVGLYGYCYSGHGMFPNIYSSMKKRSQFPAVIFTCIALSTVLFAGAAIMGYIMFGESTESQFTLNLPSNLVASKIAVWTTVTNPITKCTYHDSSCP

SEQ ID NO: 25277 - protein, 540 aa, Methanosarcina mazei
MFCNQCQEALNVIGCTKNGVCGKKGEVADLQDRLLYVLKSVSYYNLKARELGLNEETADKIVLDAFFATLTNTNFDKQAIESYIKKGFEIRDSIKAKLPAGTLPAEEDLPDVAKVTPENITGMDVAVHSTQNEDVRSLRELLTYGMKGMAAYAHHAYILGYKDEEIFKFIEKGLVATTDDTIGVDDLIGLVLECGQKGVSVLALLDKANTETYGSPEPTAVNIGVRGNPGILISGHDLLDLEQLLEQTKGTGIDVYTHGEMLPANSYPAFKKYDNFAGNYGNAWWRQNEEFEKFNGPVLMTTNCIIPPRESYRNRIYTTGVVGFEGLPHIHEKEDGTKDFTSLIEQAKMSKPPEQLESGTIMGGFAHEAALSVADKIIDAVKTGKISRFMVMAGCDGRHKERAYYTEFAKALPENTVILTAGCAKYRYNKLDLGDIGGIPRVLDAGQCNDCYSLVVIAQKLAEAFGLEDINDLPISYNIAWYEQKAVLVLLALLSLGVKNIVLGPTLPAFVSPNVLKVLVDNFNIRPNTTVEEDMKVLLG

SEQ ID NO: 25278 - protein, 448 aa, Lactobacillus plantarum
MSQATDYVQHVYQVIEHRDPNQTEFLEAINDVFKTITPVLEQHPEYIEANILERLTEPERIIQFRVPWLDDAGHARVNRGFRVQFNSAIGPYKGGLRLHPSVNLSIVKFLGFEQIFKNALTGLPIGGGKGGSDFDPKGKSDNEIMRFCQSFMTELSKYIGLDTDVPAGDIGVGGREIGFLYGQYKRLRGADRGVLTGKGLNYGGSLARTEATGYGLAYYTNEMLKANQLSFPGQRVAISGAGNVAIYAIQKVEELGGKVITCSDSNGYVIDENGIDFKIVKQIKEVERGRIKDYADRVASASYYEGSVWDAQVAYDIALPCATQNEISGDQAKNLIANGAKVVAEGANMPSSPEAIATYQAASLLYGPAKAANAGGVAVSALEMSQNSMRLSWTFEEVDNRLKQIMQDIFAHSVAAADEYHVSGDYLSGANIAGFTKVADAMLAQGLV

SEQ ID NO: 25279 - protein, 419 aa, Thermotoga maritima
MAERLGILVGGGPAPGINSVISSVTIEAINNGLEVIGIYDGFKHLVEGKTNMVKKLSIEDVSRIHIEGGSILRTSRVNPAKSEETLEKTVQTLKKLGIKYLVTIGGDDTAFSASKVCERSKGEIKVVHVPKTIDNDLPLPENMPTFGFETARHVATELVYNLMQDSRTTNRWYFVAMMGREAGHLALGVGKAASATITIIPEEFKEGVTLEEVCDVLDGAILKRKLMGRDDGVAVIGEGIAEKMDPEELANIPGVIVEKDPHGHLRLAEIPLATILKRAIERRYAERGERIHIVDVTIGYELRSARPIPFDIVYTRTLGYGAVRFLLGDYSDLPGGMVCVVGGRIKILPFDAFMDPKTGRTKVRVVDVRSEDYRVARKYMIRLEKKDLEDPETLEKLAKLAKMEPEEFKKKYWHTTELP

SEQ ID NO: 25280 - protein, 305 aa, Bacillus cereus
MKLCENVTELIGDTPVVRLSKFIPEDAADVYVKLEMFNPSRSVKDRAAYNLLHVAEENGLIKPGDTIIEPTSGNTGIGLAMNAAAKGYKAILIMPDNMSKERINLLKAYGAEVVLTPAEQRMPGAIAKALELQKQIPNSFIPQQFENPANPNIHRYTTALEIYEQMDGELDAFVATAGTGGTITGTGETLKEKLPNLYVAVVEPKGSPVLSGGVPGPHKLVGTSPGFIPKNLNTEVYNEIIQIADEEALTTMRNLARQEGLLVGPSSGASVYAAIMIAKRLGAGKKVLCIAPDTGERYLSMGLFE

SEQ ID NO: 25281 - protein, 831 aa, Geobacter metallireducens
MVSLTIDGKDISVAKGSTILDAAAQLGITIPTLCWLKKVSPTGACRVCAVEVEGVDRPMTACNTPVKEGIKVTTQSEKLSRIRQKIMELMLVNHPLDCPVCDAGGECDLQNSCYGLGASRQEYSALLERREIRYNWPLIESDPNRCILCEKCVKVDHEVVGCDAIAVVNRGEATIIDTIDGKPLNCEFCGNCVGACPTGTLISKPFKFRGRPWAFTVTKSVCAFCSTGCQIEYHTRNGRVERVTSDDDNFNSGNLCINGRFGYSYINSSDRLTQPLVRGEKVDWNAAMGTAATGLKEIVANYGPDAVAGFGSPRVTNEESYLFQKLFRNALGSGNIDSEARLGFAQAQKALRERLGLRGASATIDAIDRAGAILVFGCDLNAEATGIEYRVIKAATKNDAKLVLANMRDVKLKKFANSHLKYRPGSELALINALTRVVLDEGLQDNDFASARIANLAELTAALGTVSVADAAAAVGLSEAELRAAARLLGKKKSVAVLFGADLMRSSGADEAVNALANLAIVLGALGKETGGLFPVYEKTNIRGLLDMGVAPDMLPGYAAPAVAGKDLWQIVEGIEQGSVKALYLLGCDPVASFPEGERIRAALGKLELLIVQDPFPGESAKQAHIVLPSSVAAEKSGTFTTIDGRVQSIAKAANPPGEAREDWDILTELCNRLTGESRPASPASIMAEITALVPGYGADVVLPAGFPSAGPVSLAVSKDVRPVQSQQAPLLLAGAILYHSGTTTTWSKNNLEIVPAGYVEIHPDDAARLGVSDGSSLRISAGAVSVNAPARVSGKVQAGLLFAPSHFRAMNVNALLGKGAGVVPVKVEKA

SEQ ID NO: 25282 - protein, 137 aa, Chlamydia trachomatis
MEFPCTLTLKELLESGAHFGHQTSRWNPRMKPFIFEEKNGLYIIDLAKTLAQLKKAVACIQTTIGQEKSILFVGTKKQAKQIIREAAIECGEFFASERWLGGMLTNMATIRNSVKTLNRIELDLEASNSGLRKKSSL

SEQ ID NO: 25283 - protein, 79 aa, Glycine max
EKLLVKQENENQLFLTFINGTVSVWSFCGELVTQFEDHQLWHPDCYTNNTYITKDQDLIISYCKADSDDQWMEGNGNHL

SEQ ID NO: 25284 - protein, 429 aa, Bacillus anthracis
MGFILRRWIKKEEIKMNEVLAKGKKAKEIARELVLKSTEQKNEALSAIADQLILETAYILEENKKDIEEGKAKGFSDSLLDRLMLNEQRIVDMTEGIKQLIELRDPVGECVSAWERPNGLSIQEMRVPLGVVGMIYEARPNVTVDAATICLKTGNAVILRGSSSAIHSNKAIVAVIHRALKQTSLPQESVQLIEDTTRDSAKQLFTMNDYLDVLIPRGGKQLIDTVVREASVPVLETGAGNCHVFIDETADKQMAFDIINAKTQRPSVCNAIETIVLHEKWAEQYGSELFSSLKKRGVELRGDQKALAMDSTIVLASEEDWGTEFLSLTPAVKLVSSIEEAIHHINTYGSMHSEAIISENEEKVSKFFVSVDAAALYHNASTRFTDGSEFGSGAEIGISTQKLHVRGPMGLPALTSTKYVIRGNGQIRK

SEQ ID NO: 25285 - protein, 336 aa, Saccharophagus degradans
MPMTTYRPAKTSLANLPTALQPLDRVSQILGGPRIWLKRDDLTGSTLSGNKVRKLEYVVAEALSNGADTLITCGGLQSNHCRATALVAAQLGLKAHLILRGQQKGSAADGNLLLDDLAGAQISQYSVADYSKNLTSLFSHWQNHYAQQGRKAWCIPTGASDEIGIWGYIDAFAELEAQLAERDINPDLVVCATGSGGTQAGLSLGAHILGSKAKVVGMAVCDSEAYFERKAKQDITLWQQKYGQAAGISAQQATQVQINTIDKYIGPGYAKAYPELLERIRWLAATEGVVLDPVYTGKAFYGLVQEIKSGRWANMKDIVFVHTGGIFGLFPYRDEF

SEQ ID NO: 25286 - protein, 701 aa, Unknown
  Oceanospirillum sp. MED92
MFQVTTKTFQFGGQEVTIETGRVARQATGSVLVKMGGNEVLCTVVGAKEAKAGQDFFPLSVHYQEKYYAVGRIPGGFFKREARPSEKETLTSRLIDRPIRPLFPKGYMNEVQVVCTVVSADKKNDPDIAAMIGTSAALAISGIPFQGPIGAARVGFTEDAGYLLNPSFEQLQTSELDMVVAGTADAVLMVESEAQELSEDEMLGAVLFAHQEMQVVINAVNELAAEAGKEAWVWEAPAKDEALIAKVRAEVGEGITAAYQVADKMQRQNALAELRAKAVEALAGEEEGQPSAGDVSGIVSSLEKEIVRGRIVNGEPRIDGRDTKTVRGIDVQIDVLQGTHGSALFTRGETQAIATCTLGTARDQQIIDAIEGERKDPFMLHYNFPPYSVGECGRMGGAGRREIGHGRLARRGVAAVLPTQEEFPYTIRIVSEITESNGSSSMASVCGASLSMMDAGVPLKAPVAGIAMGLVKEGDKFAVLTDILGDEDHLGDMDFKVAGTERGVTALQMDIKITGITEEIMDIALEQAYEARVHILKEMATVIGYARPELPDNAPALTQLKINPEKIRDVIGKGGATIRALTEETGASIDIEDDGTVRVYAEDKAAAKAATDKIIEITAEAEIGQIYKGKVVRIEDFGAFVNILPGKDGLVHISQIANKRVEKVTDYIQMDQEVTVKVLDVDQRGRIKLSMKDIEADDAVS

SEQ ID NO: 25287 - protein, 243 aa, Glycine max
MGAYAVWCFYCSLWSNSFPPSRSNFIVFKHMIETVLKSSNVLATLINDVLDLSRLEDGSLELEMGKFNLHGVLGEIVELIKPIASVKKLPITLILSPDLPTHAIGDEKRLTQTLLNVVGNAVKFTKEGYVSVRVSVAKPESSQDWRPPEFYPASSDGHFYIRVQVKDSGCGILPQDIPHLFTKFAQSRSGPARPSSGAGLGLAICKRFVNLMGGHIWIESEGLDKGSTACLNTIKLEREGGKE

SEQ ID NO: 25288 - protein, 473 aa, Buchnera aphidicola
MLKQQVGVIGMAVMGRNLALNIESKKYTVSIFNRTQSVTEEVINNNKEKKIFPYFSIKDFVNSLRKPRCILLMVKSGQPTDETIQFILPYLNKGDILIDGGNTFYKDSIRRSNDLMKCGINFIGMGVSGGELGALNGPSIMPGGSREAYDLVSSMLKNISAKFKNEPCVSYIGPNGAGHYVKMIHNGIEYGDMQLISESYFILKNVLNMKNEELSNTFSQWNKGELNSYLIEITKNIFLKKEKDGIHYLIDSILDHAEDKGTGKWISQDALELHEPLSLITESVFARYLSSLKDQRLIASKILKGPILKCISSQNKELFVEEVTKSLYLGKIISYAQGFSQLKKASEIYSWNLQYGKIAKIFRAGCIIRADFLERITDAFKSNNVTNLLLTPYFSEISNKYEKSLRYITSYAIKYGIPVPTFASAISYYDNYRTMSSSANLIQAQRDYFGAHTYRRTDKKGYFHTNWLTKKEL

SEQ ID NO: 25289 - protein, 369 aa, Helicobacter pylori
MELSYYEILEVEKHSNQETIKKSYRKLALKYHPDRNAGDKEAEEKFKLINEAYGVLGDEKKRALYDRYGKKGLNQAGTSQSDFSDFFEDLGSFFEDAFGFGARGSKRQKSSIAPDYLQMIELSFKEAVFGCKKTIKAQYQSVCESCDGTGAKDKALENCKQCNGQGQVFMRQGFMSFAQTCGACQGKGKIIKTPCQACKGKTYILKDEEIDAIIPEGIDDQNRMVLKNKGNEYEKGKRGDLYLEARVKEDEHFKREGCDLFIKAPVFFTTIALGHTIKVPSLRGDELELKIPRNAKDRQAFAFRNEGVKHPESSYRGSLIVELQVIYPKSLNKEQQGLLEKLHASFGYEGEPHKSVLETCVSKIKDWFK

SEQ ID NO: 25290 - protein, 803 aa, Cryptococcus neoformans
MSAIVTLRAIPTEADTGALKSIVSRDVRRAYISPETLRTHKVAAGDWMRFKSGSTFIMAQAWPKASIDDDVVALSSAQINNLCGSEVEMHHFKAGQSQGRLVSIVLKEVPLTEAPSSSKLNVVTRPPINLDSPREWVWCKAAIKEALTSLHYVRTGYSLIVGDTEKAPRKFEIISVEVSPKDIEKRLASIEDGMEELAIDEENQRLYEMHWKTSVSLEGEKLQENKEVREAIPDEKKVLSTKDFSKMSTSSVPHYINFFTPAESPVSAYTFLGGLQSQIDQIKTLLDLPMLHPDLYIKFGLNPPRGILLHGPPGTGKTALARAVASSAGCSCIVVNGPELSSAYHGETEERLRGVFTEARKRSPCIVVLDEVDALCPRRDGGEGGEVERRVVATLLTLMDGMSHESLEGERVFVVAATNRPNSIDPALRRPGRFDREIEVGVPDVKGRREILDIMLSKIPHSLSEKDLSSLAARTHGYVGADLFSLVRESASAAISRFHLSPSSTLSEPVLTNADILSTLPSIRPSAMREVFIETPTVRWSDIGGQQDVKQKLRECIEWPLMHRDTFKRLGVEAPRGVLLYGPPGCSKTMTAKALATESGINFIAVKGPELLNKYVGESERAVREIFRKARAASPSIIFFDEIDALGSARSDDHAHSGVLTSLLNEMDGVEELSGVTVVAATNRPDVLDSALMRPGRLDRILYVGAPDFETRKDIFRIRLATMAVEPGVNVEQLAEITEGCSGAEVVSICQDAALAAMNESLDAPYVKASHLVNSAHTVRRRITPEMIAFFEEWRDLSGVRSA

SEQ ID NO: 25291 - protein, 371 aa, Oryza sativa
MSMVVQQEQEVVFDAAVLSGQTEIPSQFIWPAEESPGSVAVEELEVALIDVGAGAERSSVVRQVGEACERHGFFLVVNHGIEAALLEEAHRCMDAFFTLPLGEKQRRSGARGRTAYASSFTGRFASKLPWKETLSFRYSSAGDEEGEEGVGEYLVRKLGAEHGRRLGEVYSRYCHEMSRLSLELMEVLGESLGIVGDRRHYFRRFFQRNDSIMRLNYYPACQRPLDTLGTGPHCDPTSLTILHQDHVGGLEVWAEGRWRAIRPRPGALVVNVGDTFMALSNARYRSCLHRAVVNSTAPRRSLAFFLCPEMDTVVRPPEELVDDHHPRVYPDFTWRALLDFTQRHYRADMRTFQAFSDWLNHHRHLQPTIYS

SEQ ID NO: 25292 - protein, 225 aa, Oryza sativa
MVQCLDGVRQLLAVVFKCCDLELKQPRGLEDPQVLARETVFSVSEVEALYELFKKISSAVIDDGLINKEEFQLALFKTSKKESLFADRVFDLFDTKHNGILGFDEFARALSVFHPSAPLDEKIDFSFQLYDLKQQGYIERQEVKQMVVATLAESGMNLSDEIIESIIDKTFEEADTKHDGRIDKEEWRNLVLRHPSLLKNMTLQYLKDITTTFPSFVFHSQVDDT

SEQ ID NO: 25293 - protein, 375 aa, Aggregatibacter actinomycetemcomitans
MAKQDYYELLGISRSADEKEIKRAYKKLAMQYHPDRTKGDKEKEEKFKEIQEAYEVLNDKEKRAAYDQYGHAAFEQGTGFGGGSFGGADFGDIFGDMFGDIFGGGGRGRQRVVRGDDLRYDIEITLEEAVKGTTKDIKIHTLAPCDTCHGTGAEAGSKVETCPHCHGAGRLRRQQGFFVTEQPCHFCHGTGKKIEKPCKTCHGDGRVNKAKNLSVKIPAGVDTGNQLRLSGEGAAGENGAPAGDLYVVIHVKEHHIFERDGSNLYCEVPISFTMAALGGEIEVPTLDGRVKLKIPEETQTGKLFRMRGKGVTSTRSGYAGDLTCRIIVETPVKLNEEQKELLRKLEESLEGQTKQRPKSSSFLDGVKRFFDDLTK

SEQ ID NO: 25294 - protein, 236 aa, Arabidopsis thaliana
MIVSSPSSSLPRFLRMESQSQLRQSISCSASSSSSMALGRIGEVKRVTKETNVSVKINLDGTGVADSSSGIPFLDHMLDQLASHGLFDVHVRATGDVHIDDHHTNEDIALAIGTALLKALGERKGINRFGDFTAPLDEALIHVSLDLSGRPYLGYNLEIPTQRVGTYDTQLVEHFFQSLVNTSGMTLHIRQLAGENSHHIIEATFKAFARALRQATETDPRRGGTIPSSKGVLSRS

SEQ ID NO: 25295 - protein, 532 aa, Solanum demissum
MTLGIEHAFSSFIWLCGPITGLVVQPCVGIWSDKCHSKYGRRRPFIFIGAVMISIAVIIIGFSADIGYLLGDTKEHCSTFKGTRSRAAIVFVVGFWMLDLANNTVQGPARALLADLSGPDQRNTANAVFCSWMAVGNILGFSAGASGGWHRWFPFLTNRACCEPCGNLKAAFLVAVVFLTLCTLVTLYFANEVPLSPKQYKRLSDSAPLLDSPQNTGFDLSQSKRELQSVNSVANNESEMGRVADNSPKNEEQRPDKDQGNSFADSPGAVLVNLLTSLRHLPPAMHSVLIVMALTWVSCSLSTAANYLSFCSFNQLSWFPFFLFDTDWMGREVYHGDPKGEADEVNAYNQGVREGAFGLLLNSVVLGVSSFLIEPMCKWIGSRLVWAVSNFIVFVCMACTAIISVVSISAHTEGVQHVIGATRSTQIAALVVFSLLGIPLAVTYSVPFSITAELTADAGGGQGLAIGVLNLAIVVPQMVVSLGAGPWDALFGGGNIPAFVLASLAALAAGIFAMLRLPNLSSNFKSTGFHFG

SEQ ID NO: 25296 - protein, 119 aa, Brassica napus
  misc_feature (46)..(46): Xaa can be any naturally occurring amino acid
GRAPRPSPSSLIILVNAGAPVDQSIADFSEYMVPGDCIIDRGNEWXQSTQRRISEADQEGLLYLGIGVSGGEERARNCPSLMPSWSSHAYDNIKHLLGKVSAQVDDWPCVTYIREGRSG

SEQ ID NO: 25297 - protein, 307 aa, Solanum demissum
MAFFPTNFMLQTPHHEDEHQPSTSLNPILPSCSPQDFHGIASFLGKRSMSFSGMDGNNACEENHGEDDLSDDGSQAGEKKRRLNMEQVKTLEKNFELGNKLEPERKMQLARALGLQPRQIAIWFQNRRARWKTKQLEKDYEVLKRQFDAIKAENDALQTQNQKLHAEIMSLKNREQPTESINLNKETEGSCSNRSENSSEIKLDISRTPAIDSPLSNHHPNISSRPFFPPSMIRSNNNNNSNNGVVVPHQLFHINSSSPRQDLKLMDQNTTTTNNNSSVKEESLSNMFCGIDDQTSFWPWLEQQHFN

SEQ ID NO: 25298 - protein, 354 aa, Pseudomonas fluorescens
MPASPLVWINGLHMTEQRPIAVLGGGSFGTAVANLLAENGHQVRQWMRDPEQAEAIRVNRENPRYLKGIKILPGVTAVTDLQETLDACELCFVALPSSALRTVLAAHAERLSGKMLVSLTKGIEAQTFKLMSQILEEIAPQARIGVLSGPNLAREIAEHALTATVVASEDEELCKAVQAALHGRTFRVYASADRFGVELGGALKNVYAIIAGMAVALEMGENTKSMLITRALAEMTRFAVNQGANPMTFLGLAGVGDLIVTCSSPKSRNYQVGFALGQGLSLDEAVSRLGEVAEGVNTLKVLKAKAQEVGVYMPLVAGLHAILFEGRTLEQVIGLLMRAEPKTDVDFISTSGFN

SEQ ID NO: 25299 - protein, 112 aa, Rhodopseudomonas palustris
MKKIEAIIKPFKLDEVKEALQEVGLQGITVTEAKGFGRQKGHAELYRGAEYIVDFLPKVKIEIVIADDLVEKAIDAIRRAAQTGRIGDGKIFVSNIEEAIRIRTGESGLDAI

SEQ ID NO: 25300 - protein, 413 aa, Caulobacter crescentus [sequence omitted]

SEQ ID NO: 25301 - protein, 265 aa, Unknown
  Platanus x acerifolia
MATMLLLFGLLMASLDTTGAQTGVCYGRLGNNLPTPQEVVNLYKSKNIQRMRIYGPDEAVLRALRGSNIELMVGVPNDQLQGIASNPSTANDWVQKYIRAYSPGVKFKYIAVGNEVNPNGNLVSFVLPAMRNINSALASAGLQNQIKVSTAVDTTILGNSFPPSKGTFNDNVRSFLNPIITFLVNNRAPLLANVYPYFSYIGNTRDISLPYALFTAPSVVVQDGQLGYRSLFDAIVDGLYSALEKAGGSSVEIVISETGWPSAGG

SEQ ID NO: 25302 - protein, 557 aa, Coccidioides immitis
MSRVLEPPSRNPFTRPVEMSTEPRTIPVLSASISPSDPSPGDPMDVSPPASAAMGPPSQSSPEIEQAPTNHTNGNTAESNASQNNASGQPTGAAAAAQQPKVVQTAFIHKLYSMLQDPSIQHLISWSSSNESFVMSPSSDFSKVLSQYFKHTNISSFVRQLNMYGFHKVSDVFHTGSPDSPMWEFRHGNGSFRKGDLSGLREIKRRASRHALIHRDSFSAHKNNNASQPGTPAETVPEVPDRVVNLEHSLYEVHSRLTRMEDQHSLLSSRCQALTESLIRCHQWINLMSRFITSLVPDADNPIHREAANMQREVARQLELARAPESPNDMLMPGRQPYFQNLTVDTGPPLSPRQVAQDSRRTSLARPPIPPHISISPHRYGSIGGASNSASYTRPQVSPHPSGPHPLSVSSPPGANMGRRHTSADIRQHGWPTPGPSPFSAGATSFQWPSSPQRAPNAADQQVRDVLAKYEMGKPRQQPGTPRHATPPLSLDPAQPSEGGWPTGGSKFLRPTESLPATRRSSMASNVHSLLNPAETRERAEEEDAATCEDRKRQRLQ

SEQ ID NO: 25303 - protein, 415 aa, Thermotoga maritima
MDELLEKAKKVREAWDVLRNATTREKNKAIKKIAEKLDERRKEILEANRIDVEKARERGVKESLVDRLALNDKRIDEMIKACETVIGLKDPVGEVIDSWVREDGLRIARVRVPIGPIGIIYESRPNVTVETTILALKSGNTILLRGGSDALNSNKAIVSAIREALKETEIPESSVEFIENTDRSLVLEMIRLREYLSLVIPRGGYGLISFVRDNATVPVLETGVGNCHIFVDESADLKKAVPVIINAKTQRPGTCNAAEKLLVHEKIAKEFLPVIVEELRKHGVEVRGCEKTREIVPDVVPATEDDWPTEYLDLIIAIKVVKNVDEAIEHIKKYSTGHSESILTENYSNAKKFVSEIDAAAVYVNASTRFTDGGQFGFGAEIGISTQRFHARGPVGLRELTTYKFVVLGEYHVRE

SEQ ID NO: 25304 - protein, 478 aa, Bacillus licheniformis
MAKEKDAEQKSALNIIPLAVTILVGAVIWFIPSPAGLDPKAWHLFAIFVATIIGFISKPLPMGAIAVFALAITALTGTLSIEETLSGFGNKTIWLIVIAFFISRGFIKTGLGARIAYLFVRMFGKKTLGLSYSLLVSDLILSPAIPSNTARAGGIIFPIIRSLSETFQSTPKDGTERRIGAFLLKVGFQGNLITSAMFLTAMAANPLIAKLAHDVAGVNLTWTSWAVAAIVPGLVSLIITPLVIYKLYPPEVKKTPDAAKIATEKLKEMGPFKKSELSMVAVFLLVLFLWIFGGNLNIDATTTALIGLAVLLLTQVLTWDDIKKEQGAWDTLTWFAALVMLASFLNELGMVGWFSDAMKSYVSGFSWISAFLILIAVYYYSHYFFASATAHISAMYSAFLAVIIAAGAPPLLAALSLAFFSNLFASTTHYGAGAAPVFFGAGYIPQSKWWSIGFILSIVHIVTWLVVGGLWWKLLGIW

SEQ ID NO: 25305 - protein, 72 aa, Bacteroides thetaiotaomicron
MAKQSAIEQDGVIVEALSNAMFRVELENGHEITAHISGKMRMHYIKILPGDKVRVEMSPYDLSKGRIVFRYK

SEQ ID NO: 25306 - protein, 271 aa, Sambucus canadensis
VFIANDWHTALLPCYLKSIYKTNGIYKNAKVAFCIHNIAYQGRFAFSDFSLFNLPDEFRSSFDSIDGYDKPVKGRKINWMKAGLLESDRVFTVSPYYAQELVSGVDKGVELDNIIRKTGITGIVNGMGTQEWNPSTDKYVGVKYDITTAVDAKPLLKEALQAEVGLPVDSNIPLIGFIGRLEEQKGSDILAAAIPKFIGQNVQIVVLGTGKKYMEKQLEQLEILYPDKARGVAKFNVPLAHMIIAGADFMMIPSRFEPCGLIQLHAMRYGT

SEQ ID NO: 25307 - protein, 171 aa, Unknown
  Platanus x acerifolia
RGNAVAAEDLIVKEGRVAGVVTNWALVSMNHGTQSCMDPNVMESKVVVSSCGHDGPFGATGVKRLKSIGMIDSVPGMKALDMNTAEDAIVRLTREVVPGMIVTGMEVAEIDGAPRMGPTFGAMMISGQKAAHLALKALGLPNAMDGNYSDMGSIHPELILAAAESGDIADA

SEQ ID NO: 25308 - protein, 472 aa, Staphylococcus aureus
MENTVKYRKFILPIVVGLLIWALTPFKPDAVDPTAWYMFAIFVATIIACITQPMPIGAVSIIGFTIMVLVGIVDMKTAVAGFGNNSIWLIAMAFFISRGFVKTGLGRRIALHFVKLFGKKTLGLAYSIVGVDLILAPATPSNTARAGGIMFPIIKSLSESFGSKPKDGSARKMGAFLVFTEFQGNLITAAMFLTAMAGNPLAQNLASSTSNVHITWMNWFLAALVPGLVSLIVVPFIIYKIYPPTVKETPNAKSWAENELATMGKIALAEKFMIGIFVIALTLWIVGSFIHIDATLTAFIALALLLLTGVLTWQDILNETGAWNTLVWFSVLVLMADQLNKLGFIPWLSKSIATSLGGLSWPIVLVILILFYFYSHYLFASSTAHISAMYAALLGVAIAAGAPPLFSALMLGFFGNLLASTTHYSSGPAPILFSSGYVTQKRWWTMNLILGFVYFIIWIGLGSLWMKVIGIF

SEQ ID NO: 25309 - protein, 126 aa, Chlamydomonas reinhardtii
MQTLASRPSLRASARVAPRRAPRVAVVTKAALDPQIVISGSTAAFLAIGRFVFLGYQRREANFDSTVGPKTTGATYFDDLQKNSTIFATNDPAGFNIIDVAGWGALGHAVGFAVLAINSLQGANLS

SEQ ID NO: 25310 - protein, 431 aa, Unknown
  Silicibacter sp. TM1040
MTDATRDPGFFTQSLSERDPELFGAITDELGRQRDEIELIASENIVSAAVMEAQGSVLTNKYAEGYPGRRYYGGCQYVDVAENLAIDRAKQLFNCEFANVQPNSGSQANQGVFQAILKPGDTILGMDLASGGHLTHGAAPNQSGKWFNAVHYGVRESDCLIDYDQVQALATEHQPKLIIAGGSAIPRQIDFAKFREIADSVGAYLLVDMAHFAGLVAAGEHPSPFPHADVATTTTHKTLRGPRGGMILTNNPDLAKKFNSAIFPGIQGGPLMHVIAGKAAAFGEALKPEFKSYQKQVRANAVALADELIKGGLDIVTGGTDTHVMLVDLRPKGVTGNIVDKALGRAHITTNKNGIPFDPEKPTVTSGIRLGTPAGTTRGFGEEEFREIARLIVEVVDGLAANGEDGNAAVEEAVRGKVAALCGRFPLYPNL

SEQ ID NO: 25311 - protein, 474 aa, Bacillus anthracis
  misc_feature (470)..(470): Xaa can be any naturally occurring amino acid
MLPRNNTNNELKRTMKSRHLFMIALGGVIGTELFNGSGFIISQAGPGGSVLAFMAGGLLMYFVMLCLGELAVAMPVSGSFQEYATKFINPATGFTIGWLYWLSWANTTGLEFTTAGITMQRWFPDIPVWVWCLIFGVTIFMINALSARSYAETEFWFSSIKVSAIIAFIILGGAAMFGLIDLKGDEPAPLLSNFVNHGGLFPNGLAAILLTMVTVNYSFQGTELVGIAAGESEDPAKTLPRSIRNIIWRTMFFFVLAIFVLVALIPWEEAGLTKSPFVAVFDNISIPYAADIMNFVILTAVLSVANSGLYAATRMLWSLSKNEMAPAFLKKLSSRGIPLNALILTISISAFSLLTSVVAAETVYLWLISISGVITIIVWMSICVSQFFFRKHYVADGGRLEDLKFKTPLYPLVPILGFGLYGIILVSLIFIPDQRLGIYCTVPFIIFCYTYYHFKVKKRISTNTSSENKXSETI

SEQ ID NO: 25312 - protein, 445 aa, Pseudomonas aeruginosa
MTQSVDAFLERLKRRDPDQPEFHQAVEEVLRSLWPFLEANPHYLEAGIIERIVEPERAILFRVPWVDDQGRVRVNRGYRVQMSSAIGPYKGGLRFHPSVNLGVLKFLAFEQVFKNSLTTLPMGGGKGGSDFDPKGKSDAEVMRFCQSFMSELYRHVGADLDVPAGDIGVGAREIGYLFGQYKRLSNQFTSVLTGKGLSYGGSLIRPEATGFGCVYFAQEMLKDRGRGFDGQRVAISGSGNVAQYAARKVMEMGGKVISLSDSEGTLYAEAGLSDEQWEYLMELKNVRRGRIREMAEQFSLQFLEGRRPWGLACDIALPCATQNELDAEDARRLLANGCVCVAEGANMPSTLEAVDLFLEAGILYAPGKASNAGGVAVSGLEMSQNAMRLRWSEGEVDTKLHGIMQSIHHACLLYGEEQGRVNYVKGANIAGFVKVADAMLAQGVV

SEQ ID NO: 25313 - protein, 143 aa, Hordeum vulgare
MATSTAAVLSPPAVAGLRLAPSPRAAASFRGVSPPARRSVAARAALEPSVVISLSTGLSLVMGRFVFFNFQRENVAKQVPEQNGKTHFEAGDERAKEFAGILKSNDPVGFNLVDVLAWGSIGHIVAYYILATTSNGYDPPFFG

SEQ ID NO: 25314 - protein, 39 aa, Pisum sativum
ELNPSLVISLSTGLSLFLGRFVFFNFQRENVAKQGLPEQ

SEQ ID NO: 25315 - protein, 418 aa, Streptococcus pyogenes
MIFDKGNVEDFDKELWDAIHAEEERQEHHIELIASENMVSKAVMAAQGSVLTNKYAEGYPGNRYYGGTECVDIVETLAIERAKKLFGAAFANVQAHSGSQANAAAYMALIEAGDTVLGMDLAAGGHLTHGSPVNFSGKTYHFVGYSVDADTEMLNYEAILEQAKAVQPKLIVAGASAYSRSIDFEKFRAIADHVGAYLMVDMAHIAGLVAAGVHPSPVPYAHIVTSTTHKTLRGPRGGLILTNDEALAKKINSAVFPGLQGGPLEHVIAAKAVAFKEALDPAFKDYAQAIIDNTAAMAAVFAQDDRFRLISGGTDNHVFLVDVTKVIANGKLAQILLDEVNITLNKNAIPFETLSPFKTSGIRIGCAAITSRGMGVKESQTIAHLIIKALVNHNQTVILEEVRQEVRQLTDAFPLYKK

SEQ ID NO: 25316 - protein, 326 aa, Chlamydia trachomatis
MVSQTVSVAVTGGTGQIAYSFLFSLAHGDVFGLDCGIDLRIYDIPGTERALSGVRMELDDGAFPLLQRVQVTTSLHDAFDGIDAAFLIGSVPRGPGMERRDLLKKNGEIFATQGKALNTTAKRDAKIFVVGNPVNTNCWIAMNHAPRLLRKNFHAMLRLDQNRMHSMLSHRAEVPLSAVSQVVVWGNHSAKQVPDFTQALINDRPIAETIADRDWLENIMVPSVQSRGSAVIEARGKSSAASAARALAEAARSIYQPKEGEWFSSGVCSDHNPYGLPEDLIFGFPCRMLATGEYEVIPRLPWDAFIRGKMQISLDEILQEKASVSL

SEQ ID NO: 25317 - protein, 167 aa, Spinacia oleracea
MAAATASLSSTLLAPCSSKQPQPQQQHQHQQLKCKSFSGLRPLKLNISSNNSSSSLSMSSARRSMTCRAELSPSLVISLSTGLSLFLGRFVFFNFQRENMAKQVPEQNGMSHFEAGDTRAKEYVSLLKSNDPVGFNIVDVLAWGSIGHIVAYYILATASNGYDPSFF

SEQ ID NO: 25318 - protein, 496 aa, Solanum lycopersicum
  misc_feature (398)..(398): Xaa can be any naturally occurring amino acid
MKKATVGAVVVGTAAAVAVAALVMRHRMGKSSKWARARAILKEFEEKCATPDAKLKQVADAMTVEMHAGLASEGGSKLKMLISYVDNLPTGDEAGVFYALDLGGTNFRVLRVQLGGKDGGIMHQEFAEASIPPNLMVGTSEALFDYIAAELAKFVDEEGEKFHPPPGKQRELGFTFSFPIMQTSINSGTLIRWTKGFSIDDTVGKDVVAELTKAMQKREIDMRVSALVNDTVGTLAGGRFTDKDVSIAVILGTGTNAAYVERAQAIPKWHGPLPNSGEMVINMEWGNFRSSHLPLTQYDNAMDTDSLNPGEQIFEKICSGMYLGEILRRVLLRMAKEAGIFGEEVPPKLKNSFILRTPEMSAMHHDTSSDLRVVGDKLKDILEISNTSLKTRRLVVEXCNIVATRGARLAAAGILGIIKKMGKDTPRESGPEKIVVAMDGGLYEHYTEYSKCLENTLVELLGKEMATSIVFKHANDGSGIGAALLAASNSVYVEDK

SEQ ID NO: 25319 - protein, 487 aa, Porphyra yezoensis
MPTLPPPLFLPLPQLAFRLSTPPTAIMSGLSAKLQPVFDSIKARNPNEPEFLQAAEEILHSLGPVVEAEGGDKFIPVTKALFEPERVIQFRVAWYDDAGELQVNRGFRVQMNSAIGPYKGGLRLHPTVNLSILKFLATEQVLKNAVTTLPLGGGKGGSDFNPKGRSEAEVRRFCQSFMGALARHIGPDTDVPAGDIGVSGREIGYLFGAYKRVTNRFEGILTGKGPTFGGSLIRPESTGYGVVMFVREMLKVKGDTLEGKVVVISGSGNVAQYATQKVNALGGKVIALSDSKGVLVDEEGITDKKLAEVMDIKNVRRTSLKAFTEKFSTAKWTDFSEQYTDEDEKSNPLWEIKCDVALPCATQNELNADGARALVDNGVSIVAEGANMPSTPGAIEVLRSAKVAFAPGKASNAGGVATSGLEMSQNSQRMAWSAEKVEEELDGIMTRIHADCVETAKAYDRAGDYVFGANVTGFLKVAEAMLAQGLA

SEQ ID NO: 25320 - protein, 137 aa, Chlamydia trachomatis
MEFSCTLTLKELLESGAHFGHQTSRWNPRMKPFIFEEKNGLYIIDLAKTLAQLKKAVACIQTTIGQEKSILFVGTKKQAKQIIREAAIECGEFFASERWLGGMLTNMATIRNSVKTLNRIELDLEASNSGLTKKELA

SEQ ID NO: 25321 - protein, 396 aa, Oryza sativa
MGTPETSREPCPDRILDDVGGAFGMGAVGGSLFHFLKGTYNSPNGERLVGGAQAVRMNAPRVGGSFAGLGRPLLRLRLNHGLHAQKEDPWNSIIAGAATGGFLSMRQGPGAAGRSALMGGMLLALIEGAGLMLNRVLATPPPLPVDDPNLPAVMGGGGGIPGIPQVPVAPPEVASSSGGGSGWFGSLFGKKEEEKKASPSGGKSEMLESFDTPSTPIPTFEYNKKARPSMERDPCPDRILDDIGASFGMGAVGGSFFHFVKGLRNSPSGARFAGGMEGVRMNAPRVAGGFAVWCGLFSACDCALVSVRQKEDPYNSIIAGAATGGILAARQGLRAVARASLQGAVLLALVSSFGIMMNRLPDAGSMPVNKTETCKEPQMPETFDVPSTPPPSFEYK

SEQ ID NO: 25322 - protein, 62 aa, Glycine max
  misc_feature (8)..(8): Xaa can be any naturally occurring amino acid
  misc_feature (20)..(20): Xaa can be any naturally occurring amino acid
  misc_feature (29)..(29): Xaa can be any naturally occurring amino acid
GSVWISSXLKGLNDDCEHFXCFPPVHLFXSYKEGFLHSTIPPWFYNATPYTPYYPLLLIHTF

SEQ ID NO: 25323 - protein, 525 aa, Chlamydia trachomatis
MMGKGFLDCESLVALQEMALHPIDLTASGCLSEERIQKNSLSAEGFTYSYATERVDDRCLEALQGLTEERELIKQMECMQQGAIMNRIEGFQSESRPVLHTATRAWVRDQDLHEEAAAIARHSKEEALRLAEFLYIARAKFSTLVQMGIGGSELGPKAMYFAMQGSCPSDKRIFFVSNIDPDNAAEVLREIDLEQTLVVVVSKSGTTLEPAANEELFRQAYQNKGLSIAEHFVAVTSQGSPMDDKSRYLEVFHLWDSIGGRFSATSMVGGVVLGFAFGYEAFIEFLQGAAAIDAHALTPKMRENLPLLSAMLGVWNRNLLGYPTTAVIPYSTGLKYFTAHLQQCGMESNGKSISREGKEISFRTSPIIWGDVGTNCQHSFFQSLHQGTDIVPVEFIGFLHNQRGLDCVLSGSSSSQKLFANLVAQSLALAQGRDNANSNKRFKGNRPSSILVAQQLSPRIAGSLLAFYEHKFAFQGFCWGINSFDQEGVSLGKELATQIIGIMSGNAPVEFSEARGMLRLFNVLT

SEQ ID NO: 25324 - protein, 395 aa, Phytophthora infestans
MKTLMEPERLIQFRVPWIDDEGSSRVNRGFRVQFSSALGPYMGGLRFHPETTHGTAKFLGFETIFRNALAGPYGGAHGGSDFNPMDKSESEIMRFCQSYMTELVNYIGPHTDVPTAGVGVGPQEIGYMFGQYKRMRQLHPGGTEGILSGGAYHYPQVTGYGVAHFANRILETRGETLKGKRCLISGSGTVALNVARKLLDFGAIPIGMSDNFGYVIEDQGFSSKSLEELKRIKEERNARLGAYIMSSTTANYHPSEEGRLWETPCDYAFPCAIQNDVDADAVRLLVKNGCKGIFEGANFPCTDEAISLIKQHGLAFGPNKASNGGSFALITKNLGSSTQMLDDEVDVIVKEYMDKLHDRVAASAEEFNAGGDLHVGANITAFMSVAAAMFRQGVV

SEQ ID NO: 25325 - protein, 137 aa, Chlamydia trachomatis
MEFPCTLTLKELLESGAHFGHQTSRWNPKMKPFIFEEKNGLYIIDLAKTLGQLKKAVSCIQKIIEQERSILFVGTKKQAKQIIREVAIECGEFFASERWLGGMLTNMATIRNSVKTLNRIELDLEASNSGLRKKRSL

SEQ ID NO: 25326 - protein, 320 aa, Vibrio parahaemolyticus
MIKKIGVLTSGGDAPGMNAAIRGVVRTALSEGLEVFGVYDGYLGLYEGRIEKLDRSSVSDVINKGGTFLGSARFPEFKQVEVREKAIENLKKHGIDALVVIGGDGSYMGAKKLTEMGYPCIGLPGTIDNDIAGTDYTVGYLSALNTVIDAIDRLRDTSSSHQRISIVEIMGRHCGDLTLMSAIAGGCEYIITPETGLDKDKLISNIQDGIAKGKKHAIIALTELMMDANELARDIEAATGRETRATVLGHIQRGGRPTAFDRVLASRMGNYAVHLLLEGHGGRCVGIVKEQLVHHDIIDAIENMKRPVRNDLYKVAEELF

SEQ ID NO: 25327 - protein, 191 aa, Solanum lycopersicum
AGINISGTNGEVMPGQWESQVGPSVGIEGGDHIWCARYLLERITEQAGVVLSLDPKPIEGDWNGAGCHTNYSTLSMRGEGGFEVIKKAILNLSLRHKEHISAYGEGNERRLTGKHETASIDQFSWGVANRGCSIRVGRDTEKEGKGYLEDRRPASNMDPIVVTGLLAETTILWEPTLEAEALAAQKISLKV

SEQ ID NO: 25328 - protein, 458 aa, Nostoc punctiforme
MVMTNPTVENLVIIGSGPAGYTAAIYAGRANLKPVVFEGFQAGGLPGGQLMTTTEVENFPGFPQGITGPELMDQMKAQAERWGAELYTEDVISVDLSQRPFTVRSQEREIKTNSIVIATGATAKRLGLPNEHEFWSRGISACAICDGATPIFHGAELAVIGAGDSAAEESIYLTKYGSKVNMLVRTDKMRASKAMQDRVLSNPKIQVHWNTEAVDIYGNGHMEGVKVRNTKTGEESKLHAKGLFYAVGHTPNTSLFKGQLELDEVGYVVTKPGSVETSLEGVFAAGDVQDHEFRQAITAAGTGCMAAMLAERWLSASGLIQEFHQQPEIADNELEHQPAKKTEAEEEAGFNLDETRHQGGYALRKLFHESDRLLLVKYVSPGCGPCHTLKPILNKVVDEFDSKIHFVEIDIDKDRDIAENAGVTGTPTVQLFKNKELVKEVKGVKQKTEYRQLIESNL

SEQ ID NO: 25329 - protein, 137 aa, Chlamydia trachomatis
MELPCKLTLKELLESGAHFGHQTSRWNPKMKPFIFEEKNGLYIIDLAKTLGQLKKAVSCIQKTIEQERSILFVGTKKQAKQIIREAAIECGEFFASERWLGGMLTNMATIRNSVKTLNRIELDLEASNSGLTKKEIA

SEQ ID NO: 25330 - protein, 332 aa, Synechococcus elongatus
DPPLLWAIDSDPVLAGTKLIAEAWDAAGLYQVGTFIGDRFGTWNGPFRDDIRRFWRGDQGCTYALSQRLLGSPDVYSTDQWYAGRTINFITCHDGFTLRDLVSYSQKHNFANGENNRDGTNDNYSWNYGIEGETDDPTILSLRERQQRNLLATLFLAQGTPMLTMGDEVKRSQQGNNNAYCQDNEISWFDWSLCDRHADFLVFSRRLIELSQSLVMFQQNELLQNEPHPRRPYAIWHGVKLKQPDWALWSHSLAVSLCHPRQQEWLYLAFNAYWEDLRFQLPRPPRGRVWYRLLDTSLPNLEACHLPDEAKPCLRRDYIVPARSLLLLMARA

SEQ ID NO: 25331 - protein, 61 aa, Streptococcus mutans
TPTLLAKVKVEIVAHDAAVEEMITTISQAVKTGEVGDGKIFVSPVDEIVRIRTGERDGDAI

SEQ ID NO: 25332 - protein, 752 aa, Lactococcus lactis
MMKSMLIFPPGWDPRGPYLSLPVLKAYLQQNNQEVLIRDENVEFYDFFFSEQFFKRMSRETSTLKKSIYFNSTLHIQEAKDVIRSKDSKSWQRKFAWNVLSNLNYLAGKVYKGFEIDFNSMHFKYSHDSTSEIMKALSDRAANPLIEYFEKDCSTIEEIKNQEIEYIGFSVTGNTQLIPTLTMCKAIKELCPSVKHIQLGGNFITRISSLIGNLHPFWNYIDSMLLYDGEENLSSFLQQLENNKDYSNIPNLYYLDDHRNLKRNEIVESKTINSLPPDFDGFDFSKYFTDNLWIPIYTSRACVNKSTFCTIPNASGGKFRHMPAKKVVENMEVVKEKYGISHFSFVDETFLVPKMKQIAKLLIDNEQKDISWYCETRFSKLLTADTTQILRKGGCSNIQFGLESYNQRVLDLMDKNIDIAWIEPNIINCFEAGISVHLFFMTGFPTETLEEAKNTYHFANEMILKSKKDYGLPYSTKGFGTFGLKVGAGVYEKPEVFNIEILEPADDEDLRLSRDYNIHEGLTSDEAKQLVSTMRSSKISLQTSFDAQQFDIEFPKSILPSEIDLINEREKRAAERSYKVYGFCFENESLKINRYVSLIIDEETQMTLLYNVKHGIFLSYPTSDLQIGNAKITFALDNIKSDLAYYDFLELENSQEKYSTMDEIFEGKYKLCLNDYFFEHYNSTDLLIYNKMFKEVIQTNVLGHELLKYFTISHKIQEWFTEITRSGLNLPVEKLEKLIVDALESKVLKVMI

SEQ ID NO: 25333 - protein, 518 aa, Staphylococcus epidermidis
MAKGDQYQAHTEKYHDKKSKKSYKPVWIIISFIILITILLLPTPAGLPVMAKAALAILAFAVVMWVTEAVTYPVSATLILGLMILLLGLSPVQDLSEKLGNPKSGDIILKGSDILGTNNALSHAFSGFSTSAVALVAAALFLAVAMQETNLHKRLALLVLSIVGNKTRNIVIGAILVSIVLAFFVPSATARAGAVVPILLGMIAAFNVSKDSRLASLLIITAVQAVSIWNIGIKTAAAQNIVAINFINQNLGHDVSWGEWFLYAAPWSIIMSIALYFIMIKFMPPEHDAIEGGKELIKKELNKLGPVSHREWRLIVISVLLLFFWSTEKVLHPIDSASITLVALGIILMPKIGVITWKGVEKKIPWGTIIVFGVGISLGNVLLKTGAAQWLSDQTFGLMGLKHLPIIATIALITLFNILIHLGFASATSLASALIPVFISLTSTLNLGDHAIGFVLIQQFVISFGFLLPVSAPQNMLAYGTGTFTVKDFLKTGIPLTIVGYILVIVFSLTYWKWLGLV

SEQ ID NO: 25334 - protein, 206 aa, Unknown
  Oceanospirillum sp. MED92
MAKSTSSERWLKEHFDDHYVKKSKELGYRSRASFKLIELDEKDKLFQPGMTVVDLGAAPGGWSQIAAERVGDHGRVVASDILPMDSMAGVEFVQGDFTEEEVLNRILKALGDEPADLVISDMAPNMSGMSAVDQPAAMYLVELALDMAREVLKPGGNFVAKVFQGEGFDQYLKDMRTSFNKVVTRKPDSSRARSREVYLLGKGFKG

SEQ ID NO: 25335 - protein, 137 aa, Chlamydia trachomatis
MELPCKLTLKELLESGAHFGHQTSRWNPKMKPFIFEEKNGLYIIDLAKTLGQLKKAVSCIQKIIEQERSILFVGTKKQAKQIIREAAIECGEFFASERWLGGMLTNMATIRNSVKTLNRIELDLEASNSGLTKKEIA

SEQ ID NO: 25336 - protein, 457 aa, Staphylococcus epidermidis
MAIGVILNRVFRLNNNPLFDYIYSNKESINHCYFIIPTEEFEEEAKKKAQYYYGSIQKFMYELQRYDIEPFLMSYDKLIDFCKKQAIDKVVVAGDIMSYHHEEYDILHQRKRFKQANIQVISLRANHYFNPRKTYNKQGEPYKVFTSFYRKWRPYLMIRDEYDYHLEDISKVVVKSQHKIKEDYHSYGISERDVQNRWSEFLSQDIENYKENREYLPEVLTSQLSIYLAYGMIDIIQVFNDLLQNYDKNEQNYETFIRELIFREFYYVLMTNYPETAHVAFKEKYQQLKWSYNEENFKLWKDGNTGFPIIDAAMEELKTTGFMHNRMRMVVSQFLTKDLFIDWIWGESFFKQKLIDYYAASNVHGWQWSASTGTDAVPYFRMFNPIRQSERFDNNARYIKTYIPRLNQVDAKYLHDTHKFEQQIKGQGVEIGKDYPKQMIDHKESRQRVMSEFKALD

SEQ ID NO: 25337 - protein, 221 aa, Unknown
  Sulfitobacter sp. EE-36
MGFATNMRMIALSAAIGLGLAAQATTAKAAGTETLLVAGGCFWCVEADFESVKGVKEVVSGFAGGSVKNPTYKQVVAGGTGHYEAAQIQYDPAVVSADQLLSMFFRSVDPTDAGGQFCDRGDSYRTAIFADGNGQKAAAEKAKADAQAALSKNVVTPILGKAAFYPADAYHQDYYKSDERLAFTSVGLGVKKSVAYKRYRNGCGRDQRVKQLWGSAAPFAK

SEQ ID NO: 25338 - protein, 456 aa, Vibrio angustum
MTALTLTIKQWILNRNSLIIIADILLFLTLLNTLPFEANITLGLSILSFIAVLWLTEALHVTVTAILVPLLAVFFGVFQTQQALANFSNPIIFLFLGGFALASALHKQQLDQVIADKVLIAAKGKMSVAVLMLFGVTAGLSMWISNTATTAMMLPLVLGVLNKVNSKTGHNTYVFTLLGIAYCASIGGIATIVGSPPNAIAAAEAGLNFTEWMYFGIPVSLFLLPLTVGLLYVLLKPNLNHTFEIDHTPVTWTKGKFLTLAIFLLTVSCWIFSKPINAFLGGFAKFDTLVALSAIVLLCVSRVVSWKDIQKSTDWGVLILFGGGICLSNILKATGTSVFLAQELSTFLNQAGLFLTILVVAIFVVFLTEFASNTASAALLIPVFATVAEALGVSPVVLSALIAIAASCAFMLPVATPPNAIVFSTGFIKQQEMMRVGIYLNILCIAFLTMFTWLFW

SEQ ID NO: 25339 - protein, 472 aa, Pseudomonas putida
MPVGNHSAHGQATEGGPLKRELGERHIRLMALGACIGVGLFLGSAKAIEMAGPAIMFSYIIGGLAILVIMRALGEMAVHNPVAGSFSRYAQDYLGPLAGFLTGWNYWFLWLVTCVAEITAVAIYMGIWFPDVPRWIWALAALGSMGAVNLVAVKAFGEFEFWFALIKIVTIIAMVIGGIGVIAFGFGNDGVAVGISNLWSNGGFMPNGVTGVLMSLQMVMFAYLGVEMIGLTAGEARNPQKTIPQAIGSVFWRILLFYVGALFVILSIYPWNEIGSQGSPFVMTFERLGIKTAAGIINFVVITAALSSCNGGIFSTGRMLYSLAQNGQAPAAFARTSKNGVPRNALLLSIGALLLGVLANYLVPEKVFVWVTSIATFGAIWTWVMILLAQLKFRAGLTTAERKALKYRMWLWPLSSYLALAFLVLVVGLMAYFEDTRVALYIGPAFLVLLTVLYYAFRLAPKEVQGVASTAS

SEQ ID NO: 25340 - protein, 233 aa, Eschscholzia californica
GTRVGAPPEVVAKLEEANATGEAMARTGSGTGCIGEDPALDQFMEAYCEMLTKYQQELTKPFEEAMMFLSRIECQFKALTVSDSVGGEAVNRNGSSDEDIDANDNYIDPQAEDRELKGQLLRKYSGYLGSLKQEFLKKRKKGKLPKEARQQLLDWWSRHYKWPYPSESQKIALAESTGLDQKQINNWFINQRKRHWKPSEEMQFVVMDSAHQHYYIENGMGNSRFPMDCTPML

SEQ ID NO: 25341 - protein, 168 aa, Avena strigosa
VMASSATSVAPFQGLKSTAGLPVSRRSNAGLGSVSNGGRIRCMQVWPIEGIKKFETLSYLPPLSEEALLKQIDFLIRSKWVPCLEFSKVGFIFREHGSTPGYYDGRYWTMWKLPMFGCTDASQVIKEVEDVKKKYPDAYVRIIGFVNIRQVQCVSFIAFKPPGCEESG

SEQ ID NO: 25342 - protein, 445 aa, Pseudomonas fluorescens
MIESVESFLARLKKRDPDQPEFHQAVEEVLRSLWPFLEANPHYLTSGILERICEPERAVVFRVSWVDDQGRVQVNRGFRIQMNSAIGPYKGGLRFHPSVNLGVLKFLAFEQTFKNSLTSLPMGGGKGGSDFDPKGKSDAEVMRFCQAFMSELYRHIGADVDVPAGDIGVGAREIGFLFGQYKRLSNQFTSVLTGKGMTYGGSLIRPEATGFGCVYFAEEMLKRREQTVEGKRVAISGSGNVAQYAARKVMDLGGKVISLSDSEGTLYCEAGLSEEQWLALLELKNVKRGRISELASAFGLEFRAGQLPWSLPCDIALPCATQNELDAESARTLLRNGCVCVAEGANMPTTLEAVDIFIEAGILFAPGKASNAGGVAVSGLEMSQNAMRLLWTGGEVDSKLHGIMQSIHHACVHYGEENGRINYVKGANIAGFVKVADAMLAQGVV

SEQ ID NO: 25343 - protein, 580 aa, Oryza sativa
MASHIILPKEEEAALGVAVEEDHDSPAAPGYQHQQGPPVAKALPFSATCVRISRDSYPNLRALRNASAMSLPDDDAAYAKLEEGDYGYLLDDVPHFTDYLSDLPVSGWRQYFVNADDTVPEKVVVQKDSPRGVHFRRAGPRQRVYFESEDVKACIVTCGGLCPGLNTVIRELVCGLSHMYNVNDIFGIQNGYKGFYSSNYLPMTPKSVNDIHKRGGTVLGTSRGGHDTKKIVDNIQDRGINQVYIIGGDGTQKGAYEIYKEIRRRGLKVAVAGVPKTIDNDIAVIDKSFGFDSAVEEAQRAIDAAHVEASSAENGIGLVKLMGRYSGFIAMYATLASRDVDCCLIPESPFYLEGEGGLFEYIEKRLKENNHMDYCKNKKMEMTIKYIDPTYMIRAIPSNASDNVYCTLLAHSAIHGAMAGYSFTVGMVNGRHAYIPFHRVTSTRNKVKITDRMWARLLSSTNQPSFLSQKDIDAAREADKLASKSPVPVNTKEHGENAKKPANGEGSSDAVVQEPFGNGPTSPAALAAGAVSNPALTPAAVSMSFYDVNAGEQPSREDEAPEEVVECRCGERSTDGRGEA

SEQ ID NO: 25344 - protein, 552 aa, Solanum demissum
MTLGIEHAFSSFIWLCGPITGLVVQPCVGIWSDKCHSKYGRRRPFIFIGAVMISIAVIIIGFSADIGYLLGDTKEHCSTFKGTRSRAAIVFVVGFWMLDLANNTVQGPARALLADLSGPDQRNTANAVFCSWMAVGNILGFSAGASGGWHRWFPFLTNRACCEPCGNLKAAFLVAVVNIDNPAIAEYLYRSFTTDNVFLTLCTLVTLYFANEVPLSPKQYKRLSDSAPLLDSPQNTGFDLSQSKRELQSVNSVANNESEMGRVADNSPKNEEQRPDKDQGDSFADSPGAVLVNLLTSLRHLPPAMHSVLIVMALTWVSCNLSTAANYLSFCSFNQLSWFPFFLFDTDWMGREVYHGDPKGEADEVNAYNQGVREGAFGLLLNSVVLGVSSFLIEPMCKWIGSRLVWAVSNFIVFVCMACTAIISVVSISAHTEGVQHVIGATRSTQIAALVVFSLLGIPLAVTYSVPFSITAELTADAGGGQGLAIGVLNLAIVVPQMVVSLGAGPWDALFGGGNIPAFVLASLAALAAGIFAMLRLPNLSSNFKSTGFHFG

SEQ ID NO: 25345 - protein, 315 aa, Mycobacterium avium
MVKPNLTLEIPDLRGKFAVVTGANSGLGFGLAKRLAAAGAEVVLAVRDPAKGDQAVAAIRREVPQAKLTIRQLDLSSLRSVAALGEQLTAEGRPIDILINNAGVMAPPRRQQTSDGFELQFGTNHLGHFALTGRLLALLRAADSARVVTVSSIAATQRKLDFADVNAEHGYQPMYSYGVAKLAQLMFAVELDRRSRLGGWGLMSNAAHPGLAKTNLLSGASYGRSAPTLQARLTRLTWRLLPFMWLDIDEAVKPTLYAAVSPDAQGARYYGPRGFYETARGGVTFARVPPLARSEPEMARLWRLSEQLSGVDYPG

SEQ ID NO: 25346 - protein, 173 aa, Solanum demissum
MAFFPTNFMLQTPHHEDEHQPSTSLNPILPSCSPQDFHGIASFLGKRSMSFSGMDGNNACEENHGEDDLSDDGSQAGEKKRRLNMEQVKTLEKNFELGNKLEPERKMQLARALGLQPRQIAIWFQNRRARWKTKQLEKDYEVLKRQFDAIKAENDALQTQNQKLHAELVFLEV

SEQ ID NO: 25347 - protein, 417 aa, Pseudomonas fluorescens
MFSRDLTIAKYDADLFAAMEQEAQRQEEHIELIASENYTSPAVMEAQGSVLTNKYAEGYPGKRYYGGCEYVDVVEQLAIDRAKELFGADYANVQPHAGSQANAAVYLALLSAGDTILGMSLAHGGHLTHGASVSSSGKLYNAIQYGIDANGLIDYDEVERLAVEHKPKMIVAGFSAYSQILDFPRFRAIADKVGAYLFVDMAHVAGLVAAGVYPNPVPFADVVTTTTHKTLRGPRGGLILAKANADIEKKLNSAVFPGAQGGPLEHVIAAKAICFKEALQPEFKAYQQQVVKNAQAMAGVFIERGFDVVSGGTENHLFLLSLIKQEISGKDADAALGKAFITVNKNSVPNDPRSPFVTSGLRFGTPAVTTRGFKEAECKELAGWICDILADLNNEAVIDAVREKVKAICKKLPVYGA

SEQ ID NO: 25348 - protein, 180 aa, Triticum aestivum
  misc_feature (91)..(91): Xaa can be any naturally occurring amino acid
  misc_feature (150)..(150): Xaa can be any naturally occurring amino acid
  misc_feature (163)..(163): Xaa can be any naturally occurring amino acid
MAPTVMASSATSVAPFQGLKSTAGLPVSRRSNGASLGSVSNGGRIRCMQVWPIEGIKKFETLSYLPPLSTEALLKQVDYLIRSKWVPCLRXSSKVGFIFREHNASPWGTTMAGTGTMWKLPNVSGWHRRQRKVINEVEEVKKEYPDAYVXRIIRFDNMRQVQXASSFIASNQPGCKIRQG

SEQ ID NO: 25349 - protein, 508 aa, Bacillus cereus
MILDADIKTQLSQYLQLMENDILLKVSAGDDDVSKDMLALVDELATMSSKITVEKVELERTPSFSVNRPGEDTGVVFAGIPLGHEFTSLVLALLQVSGRAPKVEQKLIDQIKNIQGEYHFESYISLSCHNCPDVVQALNVMSVLNSGITHTMIDGAAFKEEVESKDIMAVPTVFLNGESFGSGRMTLEEILAKMGNGPDASELSDKDPYDVLVVGGGPAGASAAIYAARKGIRTGIVAERFGGQVMDTMGIENFISVKRTEGPKLVASLEEHVKEYDIDVMNLQRAKRLEKKELIEVELENGAILKSKSVIVSTGARWRNVGVPGEAEFKNKGVAYCPHCDGPLFTGKDVAVIGGGNSGIEAAIDLAGIVKHVTVLEFMPELKADAVLQERLNSLPNVTVLKNVQTKEITGTDKVNGISYIDRETEEVHHVELQGVFVQIGLVPNTDWLGETVERVRGEIVTDKHGATNVPGVFAAGDCTNNPYKQIIISMGSGANAALGAFDYLIRN

SEQ ID NO: 25350 - protein, 178 aa, Bacillus cereus
MSEKTYELATFAGGCFWCMVKPFDELPGIHKVLSGYAGGHVENPTYEQVKAGTSGHLEVVQITFDPSIFPYKKLLDLYWPQIDPTDDGGQFFDRGPSYRTAIFYHNETQKELAEKSKQALAESGMFKEPIVTEIRPAAPFYEAEEYHQHFYKKNPEKYATEQKESGREDFIKENWQKK

SEQ ID NO: 25351 - protein, 280 aa, Ustilago maydis
MTEASATTYEPTASNYTASTSTLIESSTTYHVDKSGRDLDDDDDDNDEDDDEKLFAELDKELDMMEDESNFGHHGGDTVASFDMAEFRERRMEELRQEIAAQRSASDSESPLSSIQHTTTASMKGLLTEITNEKDLISFSSTERQVAIHFFHPKFQRCSLLDRHLTVLARLHPTTLFLKANVLNCPFLTQKLNVSVLPCLITFKDGISKDKIVGFEELGNSDKFSTGALEWRLGQSGIIDPRENRKPIFGFSESNGGGDTVGKGVVGARKDIEDDFWDDE

SEQ ID NO: 25352 - protein, 249 aa, Burkholderia vietnamiensis
MGKVYLIGAGPGAADLITVRGARLLEQADVVLHDALVEPAMLDYAPNARRIAVGKRCGQRSTAQHFINKQIVDAAREHACVVRLKGGDPMLFGRAEEEMRALEAAGIDYEVVPGITAALAGAATLKRSLTLRGVSRSVAFATHSRAPGSDEIREAARADSIVYYMGRDSAPGIAQQLIDAGRAPATPVAIVEACSTARERTLTLTLAQMAAGDAQSWLDPAEPSLLMIGDAFAERAARANEGDALRNAA

SEQ ID NO: 25353 - protein, 529 aa, Thermoplasma volcanium
MKVLLIKPLNPTGSGYTTKFGFLPTPLGLEDLAGEARVVGIKDVKIVDMEADELTLNEMVAYIDRWRPDVIGITLHATAAHSFSQQLATQVKSIYNPLIVAGGHQATFVPNQLLDNGFDVIVLGEGDETFREILKHYKDGIDFDNIPGIVFKRNGRKFRTKKRELIDDLDSLPIPAFDLVEPEKYTFKVFGEGSVATLETSRGCPYACDFCSVTPTWGNKWRNKSNERIMEELRIIKQLGYKWVFFTDDIFIVYPNVKQREDLFNRIIEEDLGLKFIVQMRADVTAKNPDLIKKAAQAGLTIAFLGIESGSEEVLKAMHKGIITDSSIRAVKVLEENNVVVLGGMMLGAPYERISDIRKTIKFSRILARAGIDAIQFSTYTPLPGTRIFLDSLRNKKIFTLDWSRYDILTPVAITKVNPAIIQALTAYAYYTFYIYKWLHDRLHSIRAVGFKDQIMLNAQKFILRMMPSYVKDILRLPSDVIKTALLYRNGLKHMDFDQTTVNELLNDSSQIVYKETGTKNPYFKIKNQ

SEQ ID NO: 25354 - protein, 177 aa, Staphylococcus aureus
MTKEYATLAGGCFWCMVKPFTSYPGIKSVVSGYSGGHADNPTYEQVCTNQTGHVEAVQITFDPEVTSFENILDIYFKTFDPTDDQGQFFDRGESYQPVIFYHDKHQKKAAEFKKQQLNEQGIFKKPVITPIKPYKNFYPAEDYHQDYYKKNPVHYYQYQRGSGRKAFIESHWGNQNA

SEQ ID NO: 25355 - protein, 116 aa, Glycine max
MASSMISSPAATTDNRAGAAMGASFTGLKPMAGYPTRKTSSDITYIASNGGRVHCLLVWPPGGLKKYVTLSYLPDLDDAQLAKAVEYLITMGRIPCSAFEMERCFQHREHTREPGY

SEQ ID NO: 25356 - protein, 627 aa, Oryza sativa
MAISMASPLSSWPWAFLGSYKYLLYGPVVGKVVQEWREQGRLPLGTSWCLHLILLLALRSLTYQLWFSYGNMLFFTRRRRVVDDGVDFRQIDTEWDWDNMVIMQTLIAAVLVTSRVFPATSDLSAWDLRGWAIAVVLHVAVSEPAFYWAHRALHLGPLFSRYHSLHHSFQATQALTAGFVTPLESLILTLVAWAPLAGAFMAGHGSVSLVYGHILLFDYLRSMGYSNVEVISHKTFQDFPFLRYLIYTPSYLSLHHREKDSNFCLFMPLFDALGGTLNPKSWQLQKEVDLGKNHRVPDFVFLVHVVDVVSSMHVPFAFRACSSLPFATHLVLLPLWPIAFGFMLLQWFCSKTFTVSFYKLRGFLHQTWSVPRYGFQYFIPSAKKGINEMIELAILRADKMGVKVLSLAALNKNEALNGGGTLFVRKHPDLRVRVVHGNTLTAAVILNEIPGDVAEVFLTGATSKLGRAIALYLCRKKIRVLMLTLSTERFMNIQREAPAEFQQYLVQVTKYQAAQNCKTWIVGKWLSPREQRWAPAGTHFHQFVVPPIIGFRRDCTYGKLAAMRLPEDVEGLGTCEYTMGRGVVHACHAGGVVHFLEGWDHHEVGAIDVDRIDAVWNAALRHGLTPA

SEQ ID NO: 25357 - protein, 329 aa, Legionella pneumophila
MNKKTIAMLGAGSWGTAVAIHLAKIGHKTLLWSHNPQHVALMAEQHSNPAYLPGIPFPENLIPSDNLIECVQSADYVIIAVPSHAFAEIINKIPKPTQGLAWLTKGVDPASHELLSQLVASRFGVDFPIAVISGPSFAKEVARFLPTALTLASNNTNYQKKMHQLFHHDNIRVYLSDDLIGVQLCGAVKNILAIACGISDGLGYGANAKAALITRGLAEMTRLGLSMGARQDTFLGLAGVGDLVLTCTDDQSRNRRFGLLLGREVPIPEAEHQIGQVVEGKHNAAQICAIANKNKVEMPICEQINALLHGIVHAQEAVNNLMSRPAKEE

SEQ ID NO: 25358 - protein, 417 aa, Pseudomonas aeruginosa
MFSRDLTLARYDAELFAAMEQEAQRQEEHIELIASENYTSPAVMEAQGSVLTNKYAEGYPHKRYYGGCEYVDIVEQLAIDRAKQLFGADYANVQPHAGSQANAAVYLALLSAGDTILGMSLAHGGHLTHGASVSSSGKLYNAVQYGIDANGLIDYDEVERLAVEHKPKMIVAGFSAYSQVLDFARFRAIADKVGAYLFVDMAHVAGLVAAGVYPNPVPFADVVTTTTHKTLRGPRGGLILARANEEIEKKLNSAVFPSAQGGPLEHVIAAKAVCFKEALQPEFKTYQQQVLKNAQSMAQVFLDRGFDVVSGGTQNHLFLLSLIKQDITGKDADAALGRAFITVNKNSVPNDPRSPFVTSGLRIGTPAVTTRGFKEAECRELAGWICDILENMGDESVVDGVREKVKAICAKFPVYGN

SEQ ID NO: 25359 - protein, 357 aa, Pinus sylvestris
MSSVLTDLLNLDLSDVTEKVIAEYIWIGGSGMDMRSKARSLSGPVSSVKELPKWNYDGSSTGQAQGHDSEVILYPQAIFRDPFRRGKHILVICDAYSPNGTAIPSNKRAAAAKIFNEKAVSDEETWYGLEQEYTLLQKDVKWPLGWPIGGYPGPQGPYYCGVGADKAWGRDIVDAHYKACLYAGINISGINGEVMPGQWEFQVGPSVGISAADELWCARFIMERITEKAGVVLSFDPKPIEGDWNGAGCHTNYSTKSMRKEGGFEVIKKAIEKLKLRHKEHISAYGEGNERRLTGRHETADMNTFSRGVANRGASVRVGRDTEKEGKGYFEDRRPASNMDPYIVTSMIAETTILWKP

SEQ ID NO: 25360 - protein, 460 aa, Lactococcus lactis
MCYNMDMTNFKKNDIFEAEVLDLTHEGQGVVKIDSFPFFVDNALPGERIKMHVLKVGKSFGFGRVDEFISQSKHRVTQLNLDYLRTGIADFGHLSYDEQVKFKHKQVVDILRKTAGKSDYPVLPVVEAIKTINYRNKAQIPVQMVDGLLTTGFYRKNSHTLIPVEDFYIQHPEIDAVVLFLRDEFRKINLQAYDEKTRKGWLRNIVVRRAFHTGEMMITLVVTSKKLPEKVELVIDHLVERFTNIKSVQLNINSGTGSFILGKEFILLYGKDFITDLMLDKTYQISAPAFYQVNTPQAEKLYETAYEFAGLKPGDVVIDAYSGIGTIGISMADRVAKVYGMEVVPAAVENAKRNAQLNELENTHYEVGTAEKIMPKWLSEGIKPDVIFVDPPRKGLDEGFIKAAAMMNPRRIVYISCNPATFARDVVRFEADGYLLDKVQPVDLFPQTHHIELVASFNKK

SEQ ID NO: 25361 - protein, 259 aa, Cenarchaeum symbiosum
MQELPEPGEVVLATVTRVMDHGAYVSLDEFGDIPGFLHISEIAPGWIRSISRFVKTGEKKVLLVKRVNEKRADIDLSLKQVSIDQKKRKLLEVKRYEKGRTLLGSVADKAGLSDGDVDELEEALCSKFDSAYDAFSQIARGGISLVSALKLPKKTLSAMEEVSSKIRLPSVEIRGIMEITNSRPDGVEVIRDTLSAAAEGNVKITYLGAPTYRISITAPDFKTAEKELKPLVEGIQRSAEKNRGTFKFTREESKKTREE

SEQ ID NO: 25362 - protein, 137 aa, Chlamydia trachomatis
MEFSCTLTLKELLESGAHFGHQTSRWNPRMKPFIFEEKNGLYIIDLAKTLAQLKKAVACIQTTIGQEKSILFVGTKKQAKQIIREAAIECGEFFASERWLGGMLTNMATIRNSVKTLNRIELDLEASNSGLRKKSSL

SEQ ID NO: 25363 - protein, 313 aa, Pseudomonas fluorescens
MIGAPAVRIAKNAMTLQYPTIADCVGNTPLVRLQRLPGVTSNTLLLKLEGNNPAGSVKDRPALSMITRAELRGQIHEGDTLIEATSGNTGIALAMAAAIKGYKMILIMPDNSSAERKAAMTAYGAELILVSQEEGMEGARDLAQRMEAEGRGKVLDQFANGDNPEAHYTTTGPEIWRQTQGSITHFVSSMGTTGTIMGVSRYLKEQNDNVQIVGLQPMEGSAIPGIRRWPQEYLPKIYQADRVDRIVDMAQSEAENVTRRLAREEGIFCGVSSGGAVAAMLRLSKEVENAVIVAIICDRGDRYLSTGIFDAPN

SEQ ID NO: 25364 - protein, 183 aa, Clostridium perfringens
MIRDIKDDVKKVLYSEEQLAKRVKEMAEEISKDYAGKDLLVVGILKGSVLFTSDLIKNITIPCEIDFMAVSSYGNSAQTSGVVRILKDLDSDIENKHVLIVEDIVDTGTTLSYLLEYLKARKAASIEIVALLDKEARRTSNVSAKYKGFDVPDEFIVGYGIDYAEKYRNLPFIGALKEEIYNK

SEQ ID NO: 25365 - protein, 415 aa, Bacillus subtilis [sequence omitted]

SEQ ID NO: 25366 - protein, 307 aa, Bacillus licheniformis
MVRVANSVYDLIGNTPVVKLNRLVDEDSAEVYVKLEYMNPGSSVKDRIALAMIEDAEEKGLLKEGDTLIEPTSGNTGIGLAMVAAAKGIKAILVMPDTMSSERRNLLRAYGAELVLTPGAEGMKGAIKKAEELAEEHGYFMPQQFNNPANAEVHRRTTGKEIAEQFGDGLDAFIAGIGTGGTITGAGEVLKEKNPSIKIFAVEPTDSPVLSGGKPGPHKIQGIGAGFVPKILNTEIYDEIITVKNEEAFEFARKAAREEGILGGISSGAAICAALQVAKKLGKGKKVLAVLPSNGERYLSTPLYQFE

SEQ ID NO: 25367 - protein, 625 aa, Musa acuminata
MDGCDCIEPQWPADELLIKYQYISDFFIALAYFSIPLELIYFVKKSSFFPYRWVLIQFGAFIVLCGATHLINLWTFALHSRTLAIVMTVAKVSTAVVSCATALMLVHIIPDLLSVKTRELFLKNKAEELDREMGLIRTQEETEGNVRMLTHEIRSTLDRDTVLKTTLVELGRTLDLKDCMLWMPSHSGTSLQLSHTLHHQIPTGSAVPINLPVVNQIFSSNHAMIIPHTCRLARIWPLSVRHVPPEVAAVRVPLLHLSNFQISDWSELSTKSYAVMVLILPSDSGRKWHVHELELVEVVADQVAVALSHAAILAESMRARDLLTEQNVALYLARQEAELAIRARNDFLAVMNHEMQTPLHATITLSSLLLETELSPEQRSMVETVLKSSSLLATLINDILDLSRLEDGRLELEIGDFNLHSVFREVMNFIKPIRAVKKLQVSLMLSPDLPLYAIGDEKRLMQIMLNVAANAVRFTKEGDISLTASVARTDYLREFRALDFYPVASDGHFYLRVTIKDTGCGISHQDLPNLFTKFSQSQNVSSQGYSGNGLGLAICERYVSLMQGHIWVESDGIGKGCTATFVVRLRLCENPDGSQQKILPLPWKKQTQKFSSSRGMPTDPGGLFD

SEQ ID NO: 25368 - protein, 922 aa, Pseudomonas fluorescens
MQEKGVLKKLGIKGRVLLLTLLPTSLMALVLGGYFTWTQQSDLQTQLMQRGEMIAEQLAPLVAPAMGHGDAELLERIATQSLEQPDVRAVTFLAPDRSPLAHAGPTMLNQAPSGDSAHLLRRSGNDATRYLLPVFGKHRNLAGELIPQESDRLLGWVELELSHNGMLLRGYRSLFASLLLIGAGLAGAALLALRMGRTINRPLSQIKQAVAQLKDGHLETRLPPLGSQELDELASGINRMAGTLQNAREELQHSVDQATEDVRQNLETIEIQNIELDLARKEALEASRIKSEFLANMSHEIRTPLNGILGFTHLLQKSELTPRQLDYLGTIEKSADSLLGIINEILDFSKIEAGKLVLDHIPFNLRDLLQDTLTILAPAAHAKQLELVSLVYRDTPLSLVGDPLRLKQILTNLVSNAIKFTREGTIVARAMLEEENDDSVQLRISIQDTGIGLSNQDVRALFQAFSQADNSLSRQPGGTGLGLVISKRLIEQMGGEIGVDSTPGEGSEFWISLNLPKTRDDAEDLPAAPLLGRRVAVLENHELARQALQHQLEDCGLDVTPFNTLESLTNGVTGAHQTDQAIDLAVLGITSNDMPPERLNQHIWDLEHLGCRVLVLCPTTELTLYHLSVPNPHSQLQSKPACTRKLRRALSDMVNPRQSRSEPGEPLSSRAPKVLCVDDNPANLLLVQTLLEDMGAKVLAVESGYAAVKAVQSESFDLVLMDVQMPGMDGRQSTETIRQWESERHCTPLPIVALTAHAMANEKRALLQSGMDDYLTKPISERQLAQVVLKWTGLALRNQAPDRGGESLLGNQELPILDHEEGLRLAAGKADLAADMLAMLLASLEADREAIRTARDHQDQNALLERVHRLHGATRYCGVPQLRAACQRSETLLKQDDPKASAALDELERAINRLAAQAKISA

SEQ ID NO: 25369 - protein, 304 aa, Myxococcus xanthus
MLVVNTRSRSGREAFETARETLVARGVSIVECHALSRADRLDAVVERMVARGTRRLIVGGGDGTLSRAVVRLLGRDVTLGVLPLGTGNDFARSLGIPPDIEAACDVIAQGYTARVDVGLANGRPFLNAASLGLATGIAKRLTKRLKQRAGKLAYPVAAAAEMKDLRPFHIRLKADDQELALDVLQLVVGNGLYHGAGNMVAPDARLDDRRLDIYAIAAPSAASGHEGTGLGQLQDIATLMRVALSLRSGEHVEHPAVTALRAARLYVEAAPVQEVNADGELVGKTPMRFEVAPAALRVYAPAPS

SEQ ID NO: 25370 - protein, 142 aa, Brassica napus
  misc_feature (80)..(80): Xaa can be any naturally occurring amino acid
  misc_feature (96)..(96): Xaa can be any naturally occurring amino acid
MAYSMLSSAAVVTSPAQATMVAPFTGLKSSSAFPVTRKANNDITSIVSNGGRVNCMQVWPPIGKKKFETLSYLPDPYRKXMGVREVDYLLRNKWIXLCVEIRVGATGFCVPWSMEAHLDTTMAVIGQCGSFLCSDALTLLKC

SEQ ID NO: 25371 - protein, 128 aa, Streptococcus pyogenes
VLPKKEVALLNKQRARLEKFLGGIEDMPRIPDVMYVVDPHKEQIAVKEAKKLGIPVVAMVDTNADPDDIDIIIPANDDAIRAVKLITAKLADAIIEGRQGEDADIAFEADTQADSIEEIVEVVEGDNA

SEQ ID NO: 25372 - protein, 258 aa, Ralstonia mannitolilytica
SVKNAAVNVPYGGAKGGIRVDPRKLSSGELERLTRRYTSEIGIIIGPNKDIPAPDVNTNAQIMAWMMDTYSMNEGATATGVVTGKPIALGGSLGRREATGRGVFVVGSEAARNLGIDVKGARVVVQGFGNVGSVAAKLFHDAGAKVIAVQDHKGIVFNGSGLDVDALIKHVDHNGSVAGFAAETVSADDFWALDCEFLIPAALEGQITAKNAPHIKAKIVVEGANGPTTPEADDILRERNILVCPDVIANAGGVTVSY

SEQ ID NO: 25373 - protein, 476 aa, Bacillus anthracis
MIEKNVVELHVDNNDTPKVKSSWVLPVALILIVEIVLLLPSSLTMEAKWSLFGFCSAIILWTTTTINSAYIALGSVLFLIISGTAKQDLLFDSLASDVIWLMIGSFILGRALQITGLAEKMTYFVVNRARNISGLCWILTMIIQILAFFIPSTSGRAAVVLPVFQAICKEIGSRRIAKALAILMPTVILVSTSSTIIGAGSHLIALDMLNEFNNKNITFVEWLIWGLPFGIIMSFISCRVILVLFLDKEEVKTKLQQKKVKFELSRNEKYTISILIAMVAFWLTEWLHGLEIATVTIIGVFLLTLPKLGVMQWKESLKGVSWNLILFVGAAIALGKSLMESGAAQWIMQNLFLVTELINKQSIFIVLLVIVILSVTSHLYITSHTTRAVIFIPPLLYFASSLQLNEVAVLFLGIVGMNYCLTFPVSSKALLLFQESDRETFQPQDLLKLSSYLSVIYIFVMVIFYYAYWQWVGLSL

SEQ ID NO: 25374 - protein, 516 aa, Solanum tuberosum
MENGTKREGLGKLTVSSSLQVEQPLAPSKLWKIIVVASIAAGVQFGWALQLSLLTPYVQLLGIPHKFASFIWLCGPISGMIVQPVVGYYSDNCSSRFGRRRPFIAAGAALVMIAVFLIGFAADLGHASGDTLGKGFKPRAIAVFVVGFWILDVANNMLQGPCRALLADLSGGKSGRMRTANAFFSFFMAVGNILGYAAGSYSHLFKVFPFSKTKACDMYCANLKSCFFIAIFLLLSLTTIALTLVRENELPEKDEQEIDEKLAGAGKSKVPFFGEIFGALKELPRPMWILLLVTCLNWIAWFPFFLYDTDWMAKEVFGGQVGDARLYDLGVRAGAMGLLLQSVVLGFMSLGVEFLGKKIGGAKRLWGILNFVLAICLAMTILVTKMAEKSRQHDPAGTLMGPTPGVKIGALLLFAALGIPLAATFSIPFALASIFSSNRGSGQGLSLGVLNLAIVVPQMLVSLVGGPWDDLFGGGNLPGFVVGAVAAAASAVLALTMLPSPPADAKPAVAMGLSIK

SEQ ID NO: 25375 - protein, 545 aa, Azospirillum lipoferum
MKLAEALLRALKDRGAQAMFGIPGDFALPFFKVAEETQILPLHTLSHEPAVGFAADAAARYSSTLGVAAVTYGAGAFNMVNAVAGAYAEKSPVVVISGAPGTTEGNAGLLLHHQGRTLDTQFQVFKEITVAQARLDDPAKAPAEIARVLGAARALSRPVYLEIPRNMVNAEVEPVGDDPAWPVDRDALAACADEVLAAMRSATSPVLMVCVRSAATGLEAKVAELAQRLGVPVVTTFMGRGLLADAPTPPLGTYIGVAGDAEITRLVEESDGLFLLGAILSDTNFAVSQRKIDLRKTIHAFDRAVTLGYHTYADNPLGGLVDALLEWLPRSDRTTRGKEPHAYPTGLQADGEPIAPMDIARAVNDRVRAGQEPLLIAADMGDCLFTAMDMIDAGLMAPGYYAGMGFGVPAGIGAQCVSGGKRILTVVGDGAFQMTGWELGNCRRLGIDPIVILFNNASWEMLRTFQPESAFNDLDDWRFADMAAGMGGDGVRVRTRAELKAALDSAFATRGRFQLIEAMIPRGVLSDTLARFVQGQKRLHAAPRD

SEQ ID NO: 25376 - protein, 634 aa, Bipolaris oryzae
MPPKRKSNGIPHNVKSANKYTDASGNAPNKRSRIAKPLDKASTNSAPLIDAIVRNSKNGAPGDAVKKEEGNFDHSRPEERAGIVDRQYYPAEMSNERCAMYNANEIPRPIAILEKTLKDTKQRRDKIQSGNENGHGDAVMHWFKRDLRVRDNTGLSKAAELAKSKGIGLVAVWIMSPQDWEAHLVSPPKCDFELRSVQLLKQELEELDIPLYIETVHERKNIKKRLVEMALEWNVKSVFCNLEYEPDELRREERLVRMMLEKGINMDPQHDDCVVPPGSLKTGTGKQYAVYTPWYRAWIAYLHAHPHLLNERSMPEKNPTGFREKFTKLFDSRVPDLPDCKSLTAEEKERFHHLWPAGEAAAIDRLERFLTEKVIKYKDTRNFPALNSTGRISAHHAAGTLAARTSVRMARDINSVKKLDGGKEGIKGWIGEVAWRDFYRHVLVHWPYVCMNKPFKYEYTNIEWEYNDAHFEAWTQGRTGYPIVDAAMRCLKHTGYMHNRLRMITASFLAKHLLLDWRLGEQYFITHLIDGDFASNNGGWGFSASTGVDPQPYFRIFNPWTQSEKFDEQGEFIRLWVKELEDVQGAAIHNPYQAKGEAAKIAKKNGYPEPIVEHKFARERCLARYKAGIGRETA

SEQ ID NO: 25377 - protein, 381 aa, Vibrio vulnificus
MSKRDFYEVLGVSRDASERDIKKAYKRLAMKFHPDRNQGDESAADKFKEVKEAYEILTDPQKKAAYDQYGHAAFEQGGGGFGGGFGGGGADFGDIFGDVFGDIFGGGRRGGGHARPQRGADLRYNMELSLEEAVRGVSKEIEVPTLVHCDTCEGTGAKKGTSAETCGTCHGHGQVQMRQGFFAVQQTCPTCHGKGKIIKDPCNVCHGQGRKQKTKTLNVKIPAGVDTGDRIRLSGEGEAGERGAPAGDLYVQVHVREHHIFEREGNNLYCEVPVSFAMAALGGEVEVPTLDGRVNLKVPSETQTGRMFRMRGKGVKGVRGGAIGDLIVKLVVETPVNLSSRQKELLKEFEESCCGEAATKHKPKSEGFFNGVKKFFDDLTS

SEQ ID NO: 25378 - protein, 102 aa, Cyanidioschyzon merolae
MLHIDELTFENEVLQSEKLVLVDFWAPWCGPCRMIGPILEEIAKEFNLKVVQVNTDENPNLATFYGIRSIPTLMLFKKGQRVDTVIGAVPKSILIHTINKYL

SEQ ID NO: 25379 - protein, 225 aa, Pisum sativum
MLQCLEGFKSLLASVLRCCDIDINQPRGLEDPELLARETVFSVSEIEALYELFKKISSAVIDDGLINKEEFQLALFKTNKKESLFADRVFDLFDTKHNGILGFEEFARALSVFHPNAPIDDKIEFSFQLYDLKQQGFIERQEVKQMVVATLAESGMNLSDDVIESIIDKTFEEADTKHDGKIDKEEWRNLVLRHPSLLKNMTLQYLKDITTTFPSFVFHSQVDDT

SEQ ID NO: 25380 - protein, 267 aa, Streptococcus agalactiae
MKRHFETTRRIVIKVGTSSLVQTSGKINLSKIDHLAFVISSLMNRGMEVILVSSGAMGFGLDILKMDKRPQEISQQQAVSSVGQVAMMSLYSQIFSHYQTHVSQILLTRDVVVFPESLQNVTNSFESLLSMGILPIVNENDAVSVDEMDHKTKFGDNDRLSAVVAKITKADLLIMLSDIDGLFDKNPNIYDDAVLRSHVSEITDDIIKSAGGAGSKFGTGGMLSKIKSAQMVFDNNGQMILMNGANPRDILKVLDGHNIGTYFAQGK

SEQ ID NO: 25381 - protein, 228 aa, Buchnera aphidicola
MMVSMRDMLNAGVHFGHQTRYWNPKMKPFIFGSKNKVHIINLEKTMTMFNFALFELKKISLRKGKILFVGTKQSASKIIKESAILCKQFYVNHRWLGGMLTNWKTVRQSIKRLKDLESQSQDGTFNKLTKKEVLLRMRELSKLENSLGGIKEMGSLPDALFVVDADHEHIAIREANNLGISVFSIVDTNSDPDGVDFIIPGNDDAIRAVNLYLNAVSKVIKKNVKNEK

SEQ ID NO: 25382 - protein, 458 aa, Bacillus cereus
MSTKMTPPVEKNEFIDVVFEDLTHDGAGVAKVKGYPIFVKNGLPGEEAQIKIVKVKKNFAFGRLMKLHTESPYRKEAECPVYNQCGGCQLQHLTYEGQLQAKEKQVRDVMQRIGGLGDVPVHPVLGMKNPWVYRNKAQVPIGEREGGLVAGFYRQGTHDIINMETCLIQAEENDTLIQEVKRICEKHGISAYNEERNKGTLRHVMARYGQVTGEIMLVFITRTAELPNKKAIIEEIAAKFPEVKSIVQNVNPKRTNVIFGDKTTVLYGSEYIYDFIGDIKFAISARSFYQVNPEQTKVLYDKTLEYAKLDGNETVIDAYCGIGSISLFLAQKAKKVYGVEIVPEAIEDAKRNAALNNMTNAEFGVGEAEVVIPKWYKEGVIADTMVVDPPRKGCDEALLNTIIDMKPKRVVYVSCNPATLARDLKVLEEGGYKTQEVQPVDMFPHTTHVECVAWLKLV

SEQ ID NO: 25383 - protein, 417 aa, Streptococcus agalactiae
MTYIEILGQNAKKASQSVARLSTASKNEILRDLARNIVADTETILTENARDVVKAKDNGISEIMVDRLRLNKDRIQAIANGIYQVADLADPIGQVVSGYTNLDGLKILKKRVPLGVIAMIFESRPNVSVDAFSLAFKTGNAIILRGGKDAIFSNTALVNCMRQTLQDTGHNPDIVQLVEDTSHVVAEELMQATDYVDVLIPRGGAKLIQTVKEKSKIPVIETGVGNVHIYIDEFADLDMAAKIVINAKTQRPSVCNAAEGLVVHQAIAKGFLSQLEKMLKESNQSVEFRADEEALQLLENAVAASESDYATEFLDYIMSVKVVDSFEQAISWINKYSSHHSEAIITNNISRAEIFQDMVDAAAVYVNASTRFTDGFVFGLGAEIGISTQKLHARGPMGLEALTSTKYYINGTGQVRE

SEQ ID NO: 25384 - protein, 268 aa, Vicia faba
MEFAHLTVLSLFCLAFVGITATSSGEDYWQSIWPNTPLPKTFSDLLIPSGITNSLPIKSEELKQYSTLFFEHDLHPGKNFNLGHTNSVGSIIRPFTKSRQGVTDSIWLANKEKQSLEDFCYSPTAIAEHKHCVSSLKSMIDQVISHFGSTKIKAISSNFAPYQDQYVVEDVKKVGDNAVMCHRLNFEKVVFNCHQVRDTTAYVVSLVASDGTKTKALTVCHHDTRGMNPELLYEALEVTPGTVPVCHFIGNKAAAWVPNHTADNLCVM

SEQ ID NO: 25385 - protein, 448 aa, Chlamydomonas reinhardtii
MEARTVSVLAGLAHRVASAAWRSASGLRTCTTTTPTYGRTSVYVKEALDLLDFDPQVEKAILNPDREVTVNLVVPMDNGEVNMFPAYRVQHNNALGPFKGGIIYHPGVTLENMRNLASLNTWKFSLLNVQFGGAKGGVGVDPRSLSERETEKLTRKYVQALQEVIGPHTDIPAPDINTDEHHMAWIFDQYSRLRGFAPAAVTGKPTWLHGIVGRDKAGGRGAAIATREFLTRSLRRKVAGTSFLIQGFGKLGSWTAQILQQEMGAKIVGVSCSETAVYNEEGLDIPALRAHVAAGGLLKDFPGGTGVLNDDSFLDLPADVFIPCAVDGTIHAGNVHRCVNFKAVVEAANGALTPEADAALRKAGVPVLPDLIANGGAVVVSFFEWVQNNQNMQWEEDDVKRELDRYLTDAFEALLREQSLHAGCSLRTAGYLVALRRLQQADSVRGHS

SEQ ID NO: 25386 - protein, 454 aa, Ureaplasma parvum
MQLKIKEIFNQDYVKLEGQKIQIKAWVRSNRDSKKIGFLVLNDGSSLTNLQAVYRVDKIDNYEEIAAARMWAAVVIEGVIKLTPTAKQPLELEVLNAQILKQSDEDFLLSNNDLNLETLRLNAHLRPRTNLFHAIMKVRATLAFAVHEFMNQNEYSWLAAPLFTGNDAEGAGETFSIQKFDNEEFFGKQTHLSVTGQLQAEAYAQAFGNVYTFGPTFRAEKSHTNRHLAEFWMIEPEMAFVDLKGMQDIVEDLVKHVIKAVLEKNQQELEFLAQRNDENLIKKLQKVVESKFERIEYKDAVKILADAVKNGHQFENNEIFFGMDLGSEHERYMCETYHQGPVFLQNYPKDIKAFYMKLNDDQQTVASTDLLIPGVGELVGGSQREDSYEKLLKRCQELKMPIESLQWYLDLRRFGYYMSSGFGIGFERLVMYVTGVNNIKDTIPFPRSHGQIEF

SEQ ID NO: 25387 - protein, 72 aa, Saccharophagus degradans
MAKEDNFELEGEVIDTLPNTTFRVKLENGHVVTAHISGKMRKNYIRILTGDKVKVEMTPYDLSKGRITYRAR

SEQ ID NO: 25388 - protein, 352 aa, Amycolatopsis methanolica
MTSTTFRRSDQMRVGVLTGGGDCPGLNAVIRAVVRKGIEAHGWEIVGFRSGWRGPLTGDSRPLGLDDVEEILIRGGTILGSSRTNPYKEEGGVEKIRAVLADQGVDALIAIGGEDTLGVAKKLTDDGIGVVGVPKTIDNDLAATDYTFGFDTAVHIATEAIDRLRTTAESHYRAMVVEVMGRHAGWIALHAGLAGGANVILVPERPFSVEQVVEWVERRFEKMYAPIIVVAEGAVPEGGAEVLRTGEKDAFGHVQLGGVGTWLADEIAERTGKESRAVVLGHTQRGGTPTAYDRVLATRFGLHAVDAVADGDFGTMVALRGTDIVRVKLAEATAELKTVPPERYEEAEVFFG

SEQ ID NO: 25389 - protein, 638 aa, Gibberella zeae
MVLSAHEISQLRAALQDAVVKCSERCLYQSSKWAAELLNALPETDDDEENINPADPSHVSPIFAANNDPEEAILEARELSKYLLAKSLFDCREYDRCAAVFLPDSLLSSVLASRVDHASASSAAGKGKSKASEAAVPLPKLSQKSLFLALYAKFMSGEKRRNEDSEMVMGPQDLGTVTNKQLLVIGHFLATWFEERTTEDDEVLGSQGWLEYLYGMVLAKEKNDDKALEYFIRSVHKYTMNWGCWLEMTSLISRVEDGPGLANSLEQLLSIFPTSSFLLTCNALLAYHAKDLMAAEQHFTRLLALHPHRLDSLDHYSNILYVLNLRPKLAFLAHLCSSVDKFRPESCVVIGNYYSLLSMHEKAVQYFRRALTLDRSCLSAWTLMGHEYVELKNTHAAIESYRRAVDVNRRDYRAWYGLGQTYEMLEMHTYSLWYYKKAAGLRPWDGKMWMAVGSCLQKMGRERDGIKALKRALLADAYYDVGSSFGSGDLLGSRNATGHMDPDILLQIAVMYDQLGEEEEARSYMELCVAQEDGSGGAAGAEVDPGESIAIHNDSPAGSENGAENDENSNNEGTGVTAATSKARMWLAKFSMRTGDYMTASRLAGELCQDGVEVEEAKALVREVRSRMEATGMLDPLS

SEQ ID NO: 25390 - protein, 244 aa, Nostoc punctiforme
MYKPFLEFLEKELFQRFDLQSRVIPPGLEFKVSDRGRNPATIRSWCYQSQELRKIRYTYIDAGESAQIFNSVVYPSHNYDLPLLGIDFLSFGKVKNLIVLDFQPLFQDEDYQNKYIAPLKYLHNKYPDLAQNLEMKFYDANQYFSKYLLFAKTDAETVSTRVFEAFQDYLNLYWQMLADAQALHDPEDIQRIVKAQKDYDQYSADRDPASGLFSSYFGHEWAERFLHEFLFEDAVPLAVSASKR

SEQ ID NO: 25391 - protein, 981 aa, Glycine max
MRSCVCYTLLLFVFFIWLHVATCSSFSDMDALLKLKESMKGDRAKDDALHDWKFSTSLSAHCFFSGVSCDQELRVVAINVSFVPLFGHVPPEIGELDKLENLTISQNNLTGELPKELAALTSLKHLNISHNVFSGYFPGKIILPMTELEVLDVYDNNFTGSLPEEFVKLEKLKYLKLDGNYFSGSIPESYSEFKSLEFLSLSTNSLSGNIPKSLSKLKTLRILKLGYNNAYEGGIPPEFGTMESLKYLDLSSCNLSGEIPPSLANMRNLDTLFLQMNNLTGTIPSELSDMVSLMSLDLSFNGLTGEIPTRFSQLKNLTLMNFFHNNLRGSVPSFVGELPNLETLQLWENNFSSELPQNLGQNGKFKFFDVTKNHFSGLIPRDLCKSGRLQTFLITDNFFHGPIPNEIANCKSLTKIRASNNYLNGAVPSGIFKLPSVTIIELANNRFNGELPPEISGDSLGILTLSNNLFTGKIPPALKNLRALQTLSLDTNEFLGEIPGEVFDLPMLTVVNISGNNLTGPIPTTFTRCVSLAAVDLSRNMLDGEIPKGMKNLTDLSIFNVSINQISGSVPDEIRFMLSLTTLDLSYNNFIGKVPTGGQFLVFSDKSFAGNPNLCSSHSCPNSSLKKRRGPWSLKSTRVIVMVIALATAAILVAGTEYMRRRRKLKLAMTWKLTGFQRLNLKAEEVVECLKEENIIGKGGAGIVYRGSMRNGSDVAIKRLVGAGSGRNDYGFKAEIETVGKIRHRNIMRLLGYVSNKETNLLLYEYMPNGSLGEWLHGAKGGHLKWEMRYKIAVEAAKGLCYLHHDCSPLIIHRDVKSNNILLDAHFEAHVADFGLAKFLYDLGSSQSMSSIAGSYGYIAPEYAYTLKVDEKSDVYSFGVVLLELIIGRKPVGEFGDGVDIVGWVNKTRLELSQPSDAAVVLAVVDPRLSGYPLISVIYMFNIAMMCVKEVGPTRPTMREVVHMLSNPPHFTTHTHNLINL

SEQ ID NO: 25392 - protein, 112 aa, Unknown
  Dehalococcoides sp. CBDB1
MKKIEAIIREERLEPVRKALELVGFAGLTVSEVSGRGKQKGVPLQWRVGEYRVEFLPKLKLEVICHDDDCQIAVDAIIKAARTGRIGDGKIFILPVEQVIRIRTGETGNDAV

SEQ ID NO: 25393 - protein, 314 aa, Saccharophagus degradans
MTDVQHHQVIVLGSGPAGYTAAIYAARANLKPVVITGMQQGGQLTTTTEVENWPGGVADLQGPDLMVQMQQHAERFDTDIIFDHIHECDLSKRPFTLKGNNTYTCDALIISTGASAQYLGLPSEEAFMGKGVSACATCDGFFYRDKKVIVVGGGNTAVEEALYLSNIASEVTLVHRRDSLRSEKILQERLFAKEKNGNVKIMWNQNLDEVLGDDSGVTGARLKSSIDGSTQEIDASGVFIAIGHKPNTDIFQGQLEMKDGYIVIKSGLNGEATSTSVPGVFAAGDVADHIYRQAITSAGFGCMAALDAEKFLDS

SEQ ID NO: 25394 - protein, 137 aa, Chlamydia trachomatis
MELSCKLTLKELLESGAHFGHQTSRWNPKMKPFIFEEKNGLYIIDLAKTLGQLKKAVSCIQKTIEQERSILFVGTKKQAKQIIREAAIECGEFFASERWLGGMLTNMATIRNSVKTLNRIELDLEASNSGLTKKELA

SEQ ID NO: 25395 - protein, 987 aa, Glycine max
MRSCVCYTLLLFIFFIWLRVATCSSFTDMESLLKLKDSMKGDKAKDDALHDWKFFPSLSAHCFFSGVKCDRELRVVAINVSFVPLFGHLPPEIGQLDKLENLTVSQNNLTGVLPKELAALTSLKHLNISHNVFSGHFPGQIILPMTKLEVLDVYDNNFTGPLPVELVKLEKLKYLKLDGNYFSGSIPESYSEFKSLEFLSLSTNSLSGKIPKSLSKLKTLRYLKLGYNNAYEGGIPPEFGSMKSLRYLDLSSCNLSGEIPPSLANLTNLDTLFLQINNLTGTIPSELSAMVSLMSLDLSINDLTGEIPMSFSQLRNLTLMNFFQNNLRGSVPSFVGELPNLETLQLWDNNFSFVLPPNLGQNGKLKFFDVIKNHFTGLIPRDLCKSGRLQTIMITDNFFRGPIPNEIGNCKSLTKIRASNNYLNGVVPSGIFKLPSVTIIELANNRFNGELPPEISGESLGILTLSNNLFSGKIPPALKNLRALQTLSLDANEFVGEIPGEVFDLPMLTVVNISGNNLTGPIPTTLTRCVSLTAVDLSRNMLEGKIPKGIKNLTDLSIFNVSINQISGPVPEEIRFMLSLTTLDLSNNNFIGKVPTGGQFAVFSEKSFAGNPNLCTSHSCPNSSLYPDDALKKRRGPWSLKSTRVIVIVIALGTAALLVAVTVYMMRRRKMNLAKTWKLTAFQRLNFKAEDVVECLKEENIIGKGGAGIVYRGSMPNGTDVAIKRLVGAGSGRNDYGFKAEIETLGKIRHRNIMRLLGYVSNKETNLLLYEYMPNGSLGEWLHGAKGGHLKWEMRYKIAVEAAKGLCYLHHDCSPLIIHRDVKSNNILLDGDLEAHVADFGLAKFLYDPGASQSMSSIAGSYGYIAPEYAYTLKVDEKSDVYSFGVVLLELIIGRKPVGEFGDGVDIVGWVNKTRLELAQPSDAALVLAVVDPRLSGYPLTSVIYMFNIAMMCVKEMGPARPTMREVVHMLSEPPHSATHTHNLINL

SEQ ID NO: 25396 - protein, 137 aa, Chlamydia trachomatis
MELPCKLTLKELLESGAHFGHQTSRWNPKMKPFIFEEKNGLYIIDLAKTLGQLKKAVSCIQKTIDQERSILFVGTKKQAKQIIREAAIECGEFFASERWLGGMLTNMATIRNSVKTLNRIELDLEASNSGLTKKELA

SEQ ID NO: 25397 - protein, 1092 aa, Unknown
  Marinobacter sp. ELB17
MKRMLINATHPEELRVALVDGQRLFDLDIESSSREQKKANIYKGKITRVEPSLEAAFVDFGADRHGFLPLKEISKEYFKKSPGQIEGKVNIKDVIAEGQEVIVQVDKEERGNKGAALTTYISLAGRYLVLMPNNARAGGISRRIEGEERAQLKEAMNQVQVPKSMGIIVRTAGIGRNSEELQWDLDYLVQFWEAITQAAGERKAPFLIHQESNVIIRAVRDYLRQDIGEVLIDAAAVHEDVLNFVRAVMPTFENKIKLYSDEIPLFSRYQIEGQIETAFQREVKLPSGGSIVIDPTEALVSIDINSSRATKGHDIEETALQTNLEAAEEIGRQLRLRDMGGLIVIDFIDMTPARNQREVENKMREALEIDRARVQVGKISRFGLLEMSRQRLRPSLGETRSEVCPRCEGQGTIRGIESLALSIMRLIYEESSKDKTGEVRAVVPVSVATFLLNEKRKQLATIEANQEVSIVIVPVPQMETPHFEIIRMRDDETGSEHVSSHQVAQEYSEREEEVADVTVQEKPVREQAAVKSVRPASPVPVPATKPAATPAKAAAEKTRDEGMFSRLGRKIALFFNGEEESQPAADSSSNRNAKQAGGDDRSRQRPTSSRNDRQDRRKTRVARDDQQDTRSRGERSSSSSSSGSSNLSDDNRSNRTDDSRSRSNRGRTRSEGRSEDKTNAGSQNSNAQSSSAQSSNSQSSSAQSNNVQNGNTQSSGNDTRRDGRRDNQNRSRSNRDSSRDTSRDGNKPNAEQADQKPAIEQKSAELRSSSPSPSYNDQNDAQSPAVAGKAGGDEKRRSKPRRSRGRDGSPAEKPVSNPAERKAARSEIHQQDTQPETRDAEDRAKAKAKAAEKPADAQVQPSAAATPAEQAAPQVAQNPADASPETTSEQPVAAKPVEQSPEPEVSKPALPASEVPVEAAEESAHVSAAKAIPSRIDAYNGGTRKAADKAEKADAPEVDSPDTDSAPVDAVEAEAPKAETHTAEATPADAEDESADKATKPTRKRTPARKAKATKTEPANEQEPQPANTDASDNNAAKADTAAEQPTAVAPVADAASETPAAPVAPGRAYNDPREVRKRQRAADAAKNGGSE

SEQ ID NO: 25398 - protein, 425 aa, Oryza sativa
MAAAAAATFLPHTPTPRRRLAVAVHSPTRRRLSLVFSGPPDGALSVAAAEEKADAGEEAAAAVSAPRGGGGGGGKERRRVVRKAWEKLVRWSRSWRRRNRSDVVETTRKVVVLGGGSFGTAMAVQVAAKKADLEVSMLLRDDLVCRSINHSHINCKYLRDHRLPENITATTSASDALAGADFCFHAVPVQFSSSFLEGISTHVDPKLPFISLSKGLELNTLRTMSQIIPQALGNPRQPFIVLSGPSFAIELMNKLPTGRNLIVIKLYMAAMVVASKDKKLAAAVQQLLASPNLRISTSNDVTGVEIAGALKNVLAIAAGIVEGMHLGNNCMAALVAQGCSEIRWLATKVAEGVSTAGAVIALAQKYHVKMPVLTAVARIIDNELTPKKAVMELMNLPQVQYLSENILFIQRKLAHGELENIEINE

SEQ ID NO: 25399 - protein, 542 aa, Streptococcus pyogenes
MTIDKKKVVYQIYPKSYKDTTGNGVGDLRGIIDKLPYLQELGIDMIWLNPFYPSPQRDNGYDVSDYTAVNPDFGTMADFENLVKAAKEHQIELMLDMVLNHCSTDHEWFQKALAGDPYYQDFFILRDQPTDWVSKFGGNAWAPFGDTGKYYLHLFDVTQADLNWRNPHVREELAKVVNFWRDKGVKGFRFDVINLIGKDEELVDCPVNDGKPAYTDRPITHTYLHDLNQASFGQDDSFMTVGEMSATTIDNCLLYTAPEREELSMAFNFHHLKVDYENGQKWTIMAFDFAALRDLFHAWGEGMGQGNGWNALFYNNHDQPRALNRFIDVTHFRNEGATMLAASIHLSRGTPYIYMGEEIGMLDPDFDSMDDYVDVESLNAYSSLLVSGKSAEEAFAIIKAKSRDNARTPMQWDASEHAGFTTGKPWLEVGKSYRDINVETEKEGRIFPFYQRLIALRKELPIIAEGDYRAAFKDSQAVYAFERHLGDQCLLVLNHFYADEVELELPPRYQHGQVLISNYEKVSICEKVILKPYQTLAILAEN

SEQ ID NO: 25400 - protein, 1113 aa, Coprinopsis cinerea
MRIAILTSGGDSAGMNAVVRAVVKTGILKGCEMYVVREGYEGLVRGNNEHAEQQAKNVAAETEAEVEREVKATYEAPHGQPAVNLLHNLRFGDGELLKDGTCEFVGGRTLKGRYIVRVGWDDVRGWFSQGGTLIGTARSMTFKTVEGREAAAHNLIREGIDALVVCGGDGSLTGADVFRREWPSLIAALKEKGLVSEDQAKKHAHLKIVGLVGSIDNDMSMTDLTIGAPTALQRICEAIDNINSTAYSHSRAFVIEVMGRDCGWLAALAGVAGGADFIFIPERPPTAMPWEDDMCAQIHRPTLQGVEAIDALLQSTEDTPSYMIGLHENKITRAVARAVKAKDYEKALELRGSEFKEILDGFFATSMLAEESAKLPKEKRMRIGIIHMGAPAGGMNAATRAAVRYCIRQGHTALAIHNGFRGLLDGNIDQLSWLGVDAWTPRGGSELGTNRALPSTDIGGVAAKFQEYNLQGLLIIGGFEGFTALLQLEEGRKHYPAFHIPMVHLPATISNNVPVTEYSIGSDTSLNALVDACDAIKQSASASRDRVFVVETQGGKCGYIATMGALAVGASLVYTPEEGITLDMLRRDVRFLKTRYSLDPPGKSEGRLVIRNEASSSVYTTTMITKMLQEEGGSLFDARSASLGHTLQGGIPSPIDRVRAARLSLKCMVFLEQHHNRLLGQKHRQAPPESASVITVQTSSVKMVPVQEMVKHADMVNRRGKTAWWFGVKHLEEQLAGKPQFLGLHKSPEYQASDGGHAFILRRFDTQAISLTTMFRAAFPTASEAEEKDEINYVKANFDLFGNNGSSKEPHITRLAGTWVNRDTAGQLAHDYNMVDLINTMVEAEPDPNGQYRRSNKSAQNNNPPTNAPEPTPATNVHATRSPAKQSPKPPSKTLPTPSPGSGDAQPPAPKRRREGSPATFTSGIPVASSPAVPKTPGPRRSTRTKSPAPSRVPQPLTATKPRSRASVAPPSPKKRPVDLPKSSPIKAEEDTAVEDNVAGNELYAQDISEQKKLIADLKAAASSKKPADTVKEDDDQQMEEEGQGPSKLKRIRQDEEKPLQFEFKEPEREERQIATNRRVGRFDMQPERKSLAWGIAAFAFGMTAITYLPNFL

SEQ ID NO: 25401 - protein, 301 aa, Bacillus cereus
MMKRARIIYNPTSGRELFKKSLPEVLQKLEQAGYETSCHATTGPGDATVAARQAADRKFDVVIAAGGDGTLNEVVNGLVGHEFRPKFGIIPVGTTNDFARAIGVPRSIEEAADIICEGKTVPLDLGRANDTYFINIAGGGRITELTYEVPSKLKTVLGQLAYYLKGIEMLPSLHPTYVEIEYDGKLLQEEITMFLITNTRSVGGFEKVAPYASINDGLFDLLVLKKGSIADLIKAATQAQRGEHINNPKVLYTQANRIKVHSPDKLMINLDGEYGGDAPMEFENIYHCLELFVPEHQEDAL

SEQ ID NO: 25402 - protein, 326 aa, Nocardia farcinica
MTRAPAEPGRRGFRRVPARRPPLWHGGLYESVADMKTILITGATSGIGSAAAEQLGARGEHLILVGRNPEKLAATEQRVRAAGAGAVDTLRCDVGSQAAIRELAEQVRQRYDRLDVLANNAGGHFPDRALTEDGVETTFAVNYLGPFLLTELLLDLLLDSAPARVVFTSSVLHFGARLDLDDLPFEHGYTGEKAYSRSKLALILYTRELARRLDGTGVTVNAFHPGAVATGIWDTMPWYGKPLAAIAKRIFMISPEQGAEALTYLATDPEVADTTGCYFQRNRPKQPGRRATDDELGARLVEVSARLCGLPTPLKAGDARGGTPPA

SEQ ID NO: 25403 - protein, 411 aa, Glycine max
MNALAATNRNFRRAAHILGLDTKLENSLLIPFREIKVECTIPKDDGTLVSYVGFRIQHDNARGPMKGGIRYHPEVDPDEVNALAQLMTWKTAVADIPYGGAKGGIGCNPRDLSVSELERLTRVFTQKIHDLIGIQRDVPAPDMGTNSQTMAWILDEYSKFHGHSPAVVTGKPIDLGGSLGREAATGLGVIFATEALFAEYGKSISDMTFVIQGFGNVGTWAAKSIYERGGKVIAVSDISGAIRNPNGIDIPALLKHKEGNGNLKEFSGADIMDPDELLVHECDVLIPCALGGVLNKENAADVKAKFIIEAANHPTDPDADEILSKKGVIILPDIYANAGGVTVSYFEWVQNIQGFMWDEEKVNRELKKYMTKAFRNIKAMCQIHNCDLRMGAFSLGVNRVARATLLRGWEA

SEQ ID NO: 25404 - protein, 447 aa, Salmonella typhimurium
MDQTCSLESFLNHVQKRDPHQTEFAQAVREVMTTLWPFLEQNPRYRHMSLLERLVEPERVIQFRVVWLDDKNQVQVNRAWRVQFNSAIGPYKGGMRFHPSVNLSILKFLGFEQTFKNALTTLPMGGGKGGSDFDPKGKSEGEVMRFCQALMTELYRHLGPDTDVPAGDIGVGGREVGFMAGMMRKLSNNSSCVFTGKGLSFGGSLIRPEATGYGLVYFTEAMLKRHGLGFEGMRVAVSGSGNVAQYAIEKAMAFGARVVTASDSSGTVVDESGFTPEKLARLCEIKASRDGRVADYARDFGLTYLEGQQPWSVPVDIALPCATQNELDVDAARVLIANGVKAVAEGANMPTTIEATDLFLEAGVLFAPGKAANAGGVATSGLEMAQNAARLSWKAEKVDARLHHIMLDIHHACVEYGGDNKHTNYVQGANIAGFVKVADAMLAQGVI

SEQ ID NO: 25405 - protein, 100 aa, Arachis hypogaea
AFSNGFLGLKTSLKRGDLAVAMASYKVKLVTPDGTQEFECPSDVYILDHAEEVGIDLPYSCRAGSCSSCAGKVVGGEVDQSDGSFLDDEQIEAGFVLTCV

SEQ ID NO: 25406 - protein, 431 aa, Salmonella typhimurium
MVSLEKNDRVMLARQLPLKSVALILAGGRGTRLKDLANKRAKPAVHFGGKFRVIDFALSNCLNSGIRRIGVITQYQSHTLVQHIQRGWSLFSEEMNEFVDLLPAQQRMKGENWYRGTADAVTQNLDIIRRYKAEYVVILAGDHIYKQDYSRMLIDHVEKGARCTVACMPVPIKEATAFGVMAVDESDKIIDFVEKPANPAMLGDASKSLASMGIYVFDADYLYELLAADDKDDASSHDFGKDIIPKITREGMAYAHPFPLSCVQSDPQAEPYWRDVGTLEAYWKANRDLASVTPQLDMYDQNWPIRTHMESLPRAKFVQERSGSHGMTLKSLVFGGCIISGSVVVQSVLFPRVRINSFCNIDSAVLLPEVWDGRSCRLRCCVIDRACIIPEGMVIGENAEEDARRFYRSEEGIVLVTREMLRKLQGHKQER

SEQ ID NO: 25407 - protein, 295 aa, Rickettsia sibirica
MSKIPSVNIKALLDAGVHFGHKTSRWNPKMASYIYGERDDVHIIDLRQSVALMSVALNAIYETVKKDGKILFVSTKIQASDIIAEYAEKCGQYYVNHRWLGGMLTNWKTIAGSIEKLNKLDKTLENEEALMGYTKKEILNMSRKKDKLLLSLAGIRNLNSKPDLLVVIDTNKEHIAINEAVKLNVPIVAVVDTNSNPDNVDYPIPGNDDSIRSIRLYCSLFADAALQGLEESMKASGVDMGAMQEHTDKGLTSKNVSKLKQAKKFSKTKNIDEETNTEFEQALNDADENKNSDNA

SEQ ID NO: 25408 - protein, 171 aa, Zea mays
MQSLQDKASEWSGVAAADAFAIDEVNVFEALGGTPQPFVDLSTNFYTRVYEDEEEWFREIFSGSKKEDAIQNQYEFLVQRMGGPPLFSQRRGHPALIGRHRPFPVTHRAAERWLHHMQQALETTESINPDTKPKMMNFFRHTAYFLVAGNEMTRQTQSVPPCKHATSKPAE

SEQ ID NO: 25409 - protein, 258 aa, Ralstonia solanacearum
SVKNAAVNVPYGGAKGGVRVDPRKLSSGELERLTRRYTSEIGIIIGPNKDIPAPDVNTNAQIMAWMMDTYSMNEGATATGVVTGKPIALGGSLGRREATGRGVFVVGSEAARNLGIDVKGARIVVQGFGNVGSVAAKLFQDAGAKVIAVQDHKGIVFNGAGLDVDALIQHVDHNGSVDGFKAETLSADDFWALECEFLIPAALEGQITGKNAPQIKAKIVVEGANGPTTPEADDILRDRGILVCPDVIANAGGVTVSY

SEQ ID NO: 25410 - protein, 258 aa, Ralstonia solanacearum
SVKNAAVNVPYGGAKGGIRVDPRKLSSGELERLTRRYTSEIGIIIGPNKDIPAPDVNTNAQIMAWMMDTYSMNEGATATGVVTGKPIALGGSLGRREATGRGVFVVGSEAARNLGIDVKGARIVVQGFGNVGSVAAKLFHDAGAKVIAVQDHKGIVFNGAGLDVDALIQHVDHNGSVAGFKAETVSADDFWGLECEFLIPAALEGQITGKNAPQIKAKIVVEGANGPTTPEADDILRDRGILVCPDVIANAGGVTVSY

SEQ ID NO: 25411 - protein, 397 aa, Arabidopsis thaliana
FSSFKAPFLLVPGSNRSLLLLQVLSLTQQGEMALSAIGFEGYEKRLEVTFFEPSIFQDSKGLGLRALTKSQLDEILTPAACTIVSSLSNDQLDSYVLSESSFFVYPYKVIIKTCGTTKLLLSIPPLLKLAGELSLSVKSVKYTRGSFLCPGGQPFPHRSFSEEVSVLDGHFTQLGLNSVAYLMGNDDETKKWHVYAASAQDSSNCNNNVYTLEMCMTGLDREKAAVFYKDEADKTGSMTDNSGIRKILPKSEICDFEFEPCGYSMNSIEGDAISTIHVTPEDGFSYASFEAVGYDFNTLDLSQLVTRVLSCFEPKQFSVAVHSSVGANSYKPEITVDLEDYGCRERTFESLGEESGTVMYQTFEKLGKYCGSPRSTLKCEWSSNNSCSSEDEKDEGI

SEQ ID NO: 25412 - protein, 552 aa, Escherichia coli
MIMFCVQCEQTIRTPAGNGCSYAQGMCGKTAETSDLQDLLIATLQGLSAWAVKAREYGIINHDVDSFAPRAFFSTLTNVNFDSPRIVGYAREAIALREALKAQCLAVDANARVDNPMADLQLVSDDLGELQRQAAEFTPNKDKAAIGENILGLRLLCLYGLKGAAAYMEHAHVLGQYDNDIYAQYHKIMAWLGTWPADMNALLECSMEIGQMNFKVMSILDAGETGKYGHPTPTQVNVKATAGKCILISGHDLKDLYNLLEQTEGTGVNVYTHGEMLPAHGYPELRKFKHLVGNYGSGWQNQQVEFARFPGPIVMTSNCIIDPTVGAYDDRIWTRSIVGWPGVRHLDGEDFSAVIAQAQQMAGFPYSEIPHLITVGFGRQTLLGAADTLIDLVSREKLRHIFLLGGCDGARGERHYFTDFATSVPDDCLILTLACGKYRFNKLEFGDIEGLPRLVDAGQCNDAYSAIILAVTLAEKLGCGVNDLPLSLVLSWFEQKAIVILLTLLSLGVKNIVTGPTAPGFLTPDLLAVLNEKFGLRSITTVEEDMKQLLSA

SEQ ID NO: 25413 - protein, 301 aa, Bacillus cereus
MMKRARIIYNPTSGRELFKKSLPEVLQKLEQAGYEASCHATTGPGDATVAARQAVERKFDVVIAAGGDGTLNEVVNGLVGHEHRPKFGIIPVGTTNDFARAIGVPRSIEEAADIICEGKTVPLDLGRANDTYFINIAGGGRITELTYEVPSKLKTVLGQLAYYLKGIEMLPSLHPTYVEIEYDGKLLQEEITMFLITNTRSVGGFEKVAPYASINDGLFDLLVLKKGSIADLIKAATQAQRGEHINNPKVLYTQANRIKVHSPDKLMINLDGEYGGDAPMEFENIYHCLELFVPEHQEDAL

SEQ ID NO: 25414 - protein, 304 aa, Streptococcus agalactiae
MYDTLIIGSGPGGMTAALYAARSNLKVGLIEQGAPGGQMNNTAEIENYPGYDHISGPELSMKMYEPLEKFEVEHIYGIVQRVENDGDVKRVITEDESYEAKTVILATGAKNSLLGVPGEEEYTSRGVSYCAVCDGAFFRDQDLLVVGGGDSAVEEAVFLTQFAKSVTIIHRRDQLRAQKVLQDRAFANEKIKFVWDSVVKEIKGNEIKVSGVTVENLKTGEISEMTFGGVFIYVGLKPHSSMVSELGITDETGWVLTDTNMKTSIPGLYAIGDVRQKDLRQIATAVGEGAIAGQGVYNYITEHF

SEQ ID NO: 25415 - protein, 490 aa, Kineococcus radiotolerans
MTETTTQKAQIGVTGLATMGRNLARNIARHGYVTAVHNRSDAKTKALVEEFGHEGTFVPGYTSQEFVDSLESPRTIIVMVKAGPATDAVIEELAPLLSEGDIVVDAGNAHFADTRRREAALRERGVHFAGVGVSGGEEGALLGPSIMPGGSEHAYAKLGPIFADIAVSVDGTPCSTHVGPDGAGHFVKMVHNGIEYADMQLIAEAYDLLRHGLGRTPKQLAEVFTSWNEGDLESFLIEITARVLDKDDPTQEGTPLVDVILDEAEQKGTGRWTVQTALDLGTPVSGIAEAVFARALSGHAEQRKAAQGVLPGPAAGAEGTGGFVAEADAEAFVDDVRAALYASKVVAYAQGFDMIRAGSTEYGWGVDPGAMATIWRGGCIIRAKFLDRIKDAYANQPDLPSLLLDPYFADAVAKGQEAWRRVVTHSVQAGIPAPGFSSALAYYDALRRDRSSAALIQGLRDLFGAHTYKRTDRAGDFHVDWSGDGTESQG

SEQ ID NO: 25416 - protein, 146 aa, Arabidopsis thaliana
  misc_feature (15)..(15): Xaa can be any naturally occurring amino acid
  misc_feature (27)..(27): Xaa can be any naturally occurring amino acid
  misc_feature (64)..(64): Xaa can be any naturally occurring amino acid
  misc_feature (102)..(102): Xaa can be any naturally occurring amino acid
  misc_feature (115)..(115): Xaa can be any naturally occurring amino acid
  misc_feature (129)..(129): Xaa can be any naturally occurring amino acid
MAASMLSCAVEVTSXDEAPMVAPFTGXKIFAAYPVPRMTNQDITSIARNGGRVSCMKVWPTHRXKKFETVSYIADLRDVELTKDVDYLVRNKWIPCVEHESXHCSAYCEHGNTQXYYDGLDWTMWKLAXTGCTCSAQVLKEAEECT

SEQ ID NO: 25417 - protein, 250 aa, Raphanus sativus
MTKNYPAVSEEYQKEIEKCKRKLRGLIAEKNCAPIMVRLAWHSAGTFDCASRTGGPFGTMRFDDELAHGANNGLHIALRLLEPIREQFPTISHADFHQLAGVVAVEVTGGPEIPFHPGREDKPQPPPEGRLPDATKACDHLRQVFLKQMGLTDQDIVALSGAHTLGRCHKDRSGFEGAWTSNPLIFDNSYFKELLSGEKEGLLQLPSDKALLDDPVFRPLVEKYAADEEAFFADYAEAHLKLSELGFADA

SEQ ID NO: 25418 - protein, 85 aa, Pennisetum alopecuroides
ECQKVGAPPEVSARLTAMAQELEARQRTALGGLGAALEPELDQFMEAYHEMLVKFREELTRPLQEAMEFMRRVESQLNSLSISGR

SEQ ID NO: 25419 - protein, 458 aa, Saccharophagus degradans
MDYLPLFFDLKAKPCLIVGGGTIATRKARLLHKAGAKLHVVAPKVSEELEKLVAASNGKVFKQEYDQTFLDDVILVISATDIDAVNSVVAADCHAIKLPVNVVDSPALCSVIMPAIIDRSPLIIGVTSGGEAPVLARRVRSMLESSIPAAYGQLAQLASKFRQRAKDVFENGDLRRRFWENILNGPIAEKVLGGNLAAAEQLIEAQLDSASVEKTGEVYLVGAGPGDPDLLTFKALRLMQQAEVVLYDRLVSEPILEMTRRDAERIYVGKKRAEHAVPQQKINQMLLELAQQGKRVLRLKGGDPFIFGRGGEEIDLLAEHKIPFQVVPGITAASGCASYSGIPLTHRDYSQSVRFITGHLQEGKENFRWSEFVDKQQTLVFYMGLAGLETICSKLIEYGKSPSTPAALIERGTLPEQRVHVSDLAGLAAKIEGLDVHAPTLLIIGDVVRCHEKLNWYK

SEQ ID NO: 25420 - protein, 435 aa, Unknown
  Dehalococcoides sp. CBDB1
MKADYLIVGCSAGGIGAAEAIREVDRDGSIVIVGEEPYLAYSRPMIAKYLSGQKTVEKILFRRPEFYANNNITCLTDTKVEAVNTATHEVSLSNGEKISYGKLLLAPGGKPIVPPIDGSNKAGVFNFINMKDAVLIDGYVKAENVKKAVIIGGGLIGMSAADALTKLGIEVDIIELKGHILNTILDEAAGKIAAQTVTSYGVKLNTGRTVSKVLGLHKVAGVELDNGHQIESQMLVIAIGVIPRTELFKAAGLEVNRGVVVNDNMRTSNPDVYACGDACESFDFIYNSRRVTPIWPNAYIGGRIAGYNMAGMDTTYHGGTVMNSLNYFGMDIATAGMSVLPPDASGLEVLSTLTANGYKKLVLNAEGKIVGMLTLGETDTAGIIFGLMRDRSDVRPIKDNILNENFGLAYLSADSREEHLHGNTSGRVAPADFKH

SEQ ID NO: 25421 - protein, 351 aa, Cenarchaeum symbiosum
MSAKRDYYEVLGLGRDAELAEIKSQYRKLALKFHPDRNKSADAPEHFKEISEAYGVLSDPEKRGVYDQHGHGGVGERYSTEDIFRGSGGFEDAFGGGGFGSIFDTIFGGGGPGRRRGSDILYKTDVTLEEVLRGKKAVIDLDTNVACDVCRASGCQPGTSKASCKACGGHGQIKQVRQTGFGSFMTMSACHRCRGQGTVIEKPCSTCSGRGTRRGRKHLEFEIPPGIDNGDYTVRGEGELVPGGENGDLIVRITVRPHAIFKRDGRDIFYDEEVTMVDAALGKKVTVPTLDDTREIKIDPGTQPNTIIKLRGRGVPHQGSGRGDQYVRIVVTIPKKLTKDQKKILGEFYKP

SEQ ID NO: 25422 - protein, 130 aa, Unknown
  Photobacterium sp. SKA34
MIDILLNLRSLRAQAREMSVVDLQEGLQKFTQVVEERREEEEAANAVNKEQEAKLQKYRDMLEAEGITAEELVALLGDAPKAKKKRAARPAKYTFSDENGEEKTWTGQGRTPKALQQLLDNGAQLSEFEI

SEQ ID NO: 25423 - protein, 114 aa, Unknown
  Cyanothece sp. PCC 8801
MEEDTMTTTYKVRLIKGKKNQPPEMDVTLEVPEDEYILSVAEDEGLDLPSSCKSGACSSCVGRIVEGTVNQEDQSFLDDELIEKGWVLLWLLIPLPIVPLKPTKKPIFLKIVDS

SEQ ID NO: 25424 - protein, 85 aa, Pennisetum alopecuroides
ECQKVGAPPEVSARLTAMAQELEARQRTALGGLGAASEPELDQFMEAYHEMLVKFREELTRPLQEAMEFMRRVESQLNSLSISGR

SEQ ID NO: 25425 - protein, 310 aa, Lactococcus lactis
MTKIYDNITELIGQTPIVKLQHVPAESADVYVKLEAFNPGGSVKDRIALAMIRAAEADGHLKPGGTIVEPTSGNTGIGLAFVGSALGYKVVIVMPESFSLERRKLIQAYGAQLVLTPASGGMKAAIAKAKELSETEGYFLAMQFENPANPEIHEKTTGAEIIDAFGPTGLDAFVAGAGTGGTITGVSHALKKANPTIKTYVVEADESAILSGEAAGPHKIQGISAGFIPGNLDTKSYDEIIRVKGDDAILTARHLGGKEGFLVGISSGAAIYAALEVAKKLGKGKKVLAIAPDNGERYLSTALYDFESEK

SEQ ID NO: 25426 - protein, 320 aa, Unknown
  Dehalococcoides sp. CBDB1
MENRTSKYNIHNGRGIASNITELIGNTPLVRLNKIGSGLKAEIILKLESFNPTHSAKDRPALYMIKKAEQEGKLIPGSIVIESTSGNTGIALAAVCAAKGYRLMLTMPENFSVERRRLLRLLGAELVLTPAELGMQGAIEKAAELKAKLPQAFIPNQFENPANPESHYKTTAEEIWRDTDGKVDILVAGVGTGGTISGIARGLKAAKPSIRIIAVEPAESPVISGGEPQPHLIQGIGAGFIPRILSLELIDKVIRVPGKEAVNMALRLAREEGIMAGISSGAALWAALETAKQAENSGKLIVAIMPDSGERYLSSLPLGD

SEQ ID NO: 25427 - protein, 728 aa, Cenarchaeum symbiosum
MSQNALSLKVLEAYTRDVGRGVARIDYDSMDTLSASTGDVIEIKGKRRTVAKCLPLYPSDEGKGIIRIDGLGRNNSGIAIGDTIAVRKIKAVGADKVVVAPLEAIPPIDERYLADALESVPLIKGDNVMVPYFGGRLTFQVIGITPAADAVLVTQKTVFNIAEKGETLRGVPQVTYEDIGGLTDEIKKVREMIELPLRHPEIFEKLGIEAPKGVLLYGPPGTGKTLLAKAVANESNAHFISISGPEIMSKFYGESEARLREIFKEAREKAPSIIFVDEIDSIAPKREEVTGEVERRVVSQMLSLMDGLEARGKVIVISATNRPNAIDPALRRPGRFDREIEIKVPDKKGRKDILAIHTRNMPLTDDVNIDKIAGVSHGYVGADLEYLCKEAAMKCLRRLLPELNLEDEKIPPETLDKLVVNGEDYQKALIEVTPSGMREVFIENPDVKWDEVGGLEDVKRELQEAVEWPMKYPALYDKLGHRMPRGILLHGASGTGKTLLAKAVATQSEANFVSVKGPELLSKWVGESERGIREIFRRARQASPCVIFFDEVDSIAPVRGADSAATNITERVVSQLLTELDGMENLHGVVVLAATNRADMIDPALLRPGRFDKIIQIPLPDKESRTSILKINSEGIPVVTAAEDPEHVNMEAIADMTDGLSGADVASIANTAVSLVIHEYLDTHPDAKEIENSTEEARVTMRHFEEAVKKVKTQKNLKLGEKIAPFIQ

SEQ ID NO: 25428 - protein, 357 aa, Medicago sativa
MAQAKTITSLSEENTFESGFIRDEDERPKVAYNQFSNEIPVISIAGIDEVNGRREEICKKIVEACEEWGIFQIVDHGVDTKLISEMTHLSREFFALPPEEKLRFDMSGGKKGGFVVSSHLQGEVVQDWREMVIYFSYPIKDRDYSRWPDKPEEWKKVIEEYSENLMNLGCKLLEVLSEAMDLEKDALTKACVDMDQKIVVNLYPKCPKPDLTLGNKRHTDPGTITLLLQDQVGGLQATKDDGKTWITIQPIEGAFVVNLGDHGHVLSNGRFKNADHQAVVNSNHDRLSIATFQNPSQDATVYPLKIREGEKSLLEEPITFAEMYKRKMSKDIETAKLKKLAKEKQLQDLEINAKVED

SEQ ID NO: 25429 - protein, 1216 aa, Xanthomonas campestris
MKRMLINATQAEELRVAIVDGQTLYDIDIEQPSKEQKKSNIYKGRITRLEPSLEAAFVDYGAERHGFLPLKEISRDYFQAGVDHNKSTIRELLREGQEIVVQVDKEERGNKGAALTTFISLAGRYMVLMPNSPSAGGVSRRIEGEDRAALKEALDKLDIPDDMGVIIRTAGVGRDAEELQWDLDYLLQTWKAIAEAALSKPAAFLIYQESRLIIRALRDYLRADVGEILVDTPELYADAQEFMKQVMPQSLRKLKHYTDDIPLFNRFQIESQIEGAYERNVRLPSGGSIVVDQTEALTAVDVNSSRATKGSDIEETAFQTNLEAAEEVARQLRLRDLGGLVVIDFIDMASSKHQREVENRLQNALKYDRARVQLGRISRFGLMEMSRQRLRPSLGESSQIVCPRCDGHGRMRSVESLSLSIIRVAEEHAMKENTGQVLVQAPVEIANYLLNEKRSALREIEQRHESPIIIVADEQLHTPHYEVTRLRENELGEESGKPSYQRGTPRKLPVHALTKAQLNIPAAPAVTSIKPSQPAPVREEAPAPVAPVAAPAPVVTVPIPAPITGVVGWLKRIFGGVEPVAPAPESTPRPRQNDAGRSNRGERGERGGQRRDGRDARNGGNGGNQQRGNGGNGNGANKERRDERRQPASAQGAQNGAQAQQVQAPKPPRNETQASKQQQPQQQKSKPQNQSPRPPRAPAQQDGAPAERQPRPARQDEGTAAAQTVTSTAATATTSSVVAAIADAAAPTNAQTNANEAAQAHPVDVMVSESTADRGADANATAPAQDAAGDDAANGEGGSRRRRGRRGGRRRRRGAGANGEGGTSVDGLEGDDLDSDADNDLDGDSEGDDAGAHAHVSGAPRAGQPEFDFDDEAPAPAVRAKPESAAQATAKPRPVPKERAEPRGGSDTASTTAPVSNTVPASQASAAPVAEAARERPAAPVAATDAPAKPAPAVTASTAASTEGAAAQAAEQRPAPVAQQASATPAPLAAPAPVASTPAPAVAPAAGTAPTALAVASPVTNDAATSSQHQPAPSAPASAAVPAADAEAAKADHQQRAVSADVAAPAVQAAPVQPARATPADDLPAPAAATPASQAAVVTVTSPHAEQSASQAPSAEVAMTSTSTVVQASPSADTAPVRKPYAPVQTTMLDALSPNDAAPAASSASKPPADPAAEQELQAGKPKPTVVVSEPVKPVAPSADADQVQDDDNNKPRGDH

SEQ ID NO: 25430 - protein, 487 aa, Nocardia farcinica
MFMNTPSIVIIGTGFGGLGMAMELQRAGVHDFVILERAEDVGGVWRENTYPGAGCDIPSPLYSYSYAPRTDWPKRFSQQPDILDYLRGIARDNNLLPKIRFRSEVTDAEYDDATGRWRVRTADGTEYTCAVLISAVGQLSRPALPDIPGVETFRGTAFHSAEWDHEADLTGKRVAVIGTGASAVQFVPAIAPQVAHLTLFQRSAAWIMPKPDVEYRPWHHRAFDLLPITRLSERFAFWAFCEFLSLGIVDVPVIRKLVTDIGLRHLENQVPDPRLRATLTPDYPAGCKRALFSNDYLPALTRPNVAVETTAITEITPEGVRTADGVLHEVDAIVYGTGFKGTEFLWPMRISGRGGRKLQDEWADGARAYRGMTVPGYPNLFLMYGPNTNLGVGSIVYMIESQARYIRQAVAHLARRPGHVLDVRPQVAAEFDRKLQARLDRTPWNFCSSWYRNAAGRITNNWPGTVTSYRWQTRRFDPADFECKPVS

SEQ ID NO: 25431 - protein, 206 aa, Clostridium perfringens
MISGIYERLQSLESLDLKSLDKNRTMLLIVDINKGFAKEGALYSDRIEKLISPISNLANYALNSGIRVKAFTDYHTEDSIELKAYPKHCMKDTDEWELVDELNLEGIEVIKKNSTNGFLEENFILNKEEIDNVIIVGDCTDICIYQLAISLRAEFNRVNKDGEIYVPKKLVDTFDMPMHKANFMNYVFLNSMLDNGVKVIEDIILD

SEQ ID NO: 25432 - protein, 431 aa, Sinorhizobium meliloti
MLSQTNDAFFTRSLADSDPEIFGAIEKELGRQRHEIELIASENIVSRAVLEAQGSIMTNKYAEGYPGKRYYGGCQYVDIAEALAIERAKKLFGVNFANVQPNSGSQMNQAVFLALLQPGDTFMGLDLNSGGHLTHGSPVNMSGKWFNVVSYGVREDDHLLDMDEVARKAREQKPKLIIAGGTAYSRIWDWKRFREIADEVGAWLMVDMAHIAGLVAGGQHPSPFPHCHVATTTTHKSLRGPRGGMILTNDEEIAKKINSAVFPGLQGGPLMHVIAAKAVALGEALQPSFKDYAAQVVKNARTLAETLKANGLDIVSGGTDNHLMLVDLRKKNATGKRAEAALGRAYVTCNKNGIPFDPEKPFVTSGVRLGAPAGTTRGFKEAEFKEVGELIVEVLDGLKAANSDEGNAAVEAGVREKVIKLTDRFPMYGYM

SEQ ID NO: 25433 - protein, 278 aa, Solanum lycopersicum
MSESLKRNYCVGGELGRGRFGTVFKCYSSATGELFAVKSIDKRLIADDAIDRQCLYNEAKIMHLLSPNPNVVRVFDIYEDDTHLDMVLELCNSGDLFQRLSSQPIFSESDAVDVMVPLMKAIAHCHRLGVAHRDIKPDNILFTDSNELKLADFGSAECFHEGQLMSGVVGTPYYVAPEVLAGRNYSEKIDIWSAGVILYIMLAGVPPFFGDSASEIFEAVLRANLRFPPRIFHSVSPAAKDLLRRMLSKDVSRRFSAEQVLRHPWMTSNGEIRTVAPF

SEQ ID NO: 25434 - protein, 160 aa, Citrullus lanatus
IIAKGHYTERAAASLLRTIVQIVHTCHSMGVIHRDLKPENFLLLSKDEDSPLKATDFGLSVFYKQGEVFKDIVGSAYYIAPEVLKRRYGPEVDIWSVGVMLYILLCGVPPFWAESEHGIFNAILRGHIDFTSDPWPTISPAAKDLVRKMLNSDPKQRLTA

SEQ ID NO: 25435 - protein, 458 aa, Bacillus cereus
MSTKMTPPVEKNEFIDVVFEDLTHDGAGVAKVKGYPIFVKNGLPGEEAQIKIIKVKKNFAFGRLMKLHTESPYRKDAECPVYNQCGGCQLQHLTYEGQLQAKEKQVRDVMQRIGGLADVPVHPVLGMKNPWVYRNKAQVPIGEREGGLVAGFYRQGTHDIINMESCLIQAEENDTLIQEVKRICEKHGITAYNEERNKGTLRHVMARYGQVTGEIMLVFITRTAELPNKKAIIEEIAAKFPEVKSIVQNVNTKRTNVIFGDKTTVLYGSEYIYDFIGDIKFAISARSFYQVNPEQTKVLYDKTLEYAKLNGNETVIDAYCGIGSISLFLAQKAKKVYGVEIVPEAIEDANRNAALNNMTNAEFGVGEAEVVIPKWYKEGVIADTMVVDPPRKGCDEALLNTIIDMKPNRVVYVSCNPATLARDLKVLEEGGYKTQEVQPVDMFPHTTHVECVAWLKLV

SEQ ID NO: 25436 - protein, 1011 aa, Aspergillus oryzae
MVFIRLIVKVYPREQLSHAYPTPNRKPPTASSEHETKPASFLLALPNPEETSLGELARLIRSKWAKLRPNAEPLDIKKLLDDSRDMVDLDVDMTVADVWVNQARAKRDEDDQVGTVRVVQRPAPYAPVRFPSVDQDWGVTKEEKFRGKFETIEEAGETETDSESGSEESEEEEEESEGEKGNLIDAQARAVNGRDNEESETDESEEEDSREESDSGSEEDDNEQVNGRANVEESADEGESEESAPDNDIRMEDSLPETRVLKRKMSTEELEPRKQPRLAQSSQASAGDAENVHGTPVSSPLGTRKRDADRAPSFSGLGRRLSFTERPALSHGLGLGITKSPPRKQPFLMADLLKDSTQSESGPSDTRVSPTSVPPSSAPAIRRSSGNQHPSTPAKLQTPADKVRLLQSALRKDSPAERSPERRSVSFAEGEDHAVPTSVPVTRATSRVIHKEQKNVTNSGSKQAPPEPEEPSDKEEEFSTGINLEINEYERALQTHDLDEKSEYTRKVKLAAKKWQIMKNNKDKGRKRMQERYKNAVNDLRILHRDIVELWEFNKPPSPRPKSQIPNGTPATKKLSRDPTSSQNRKSQDPWDVEILTPRADSKKLIPKNLPPSQTSRKSSDREEAQAQQQDKGHQSVEIPPPKAGGSAERRLGSKKLSQERPPSPPSESESEAESEKSGSEEESTAKQPERKKSSSQEKSPSPPAGSESEDESGSEEEEEEEEDNAAPNQADSLTNLTSTVEASIPDPVPESGSGSDSEEQSGSDEEDEDEDEEKQGEEEEKDRPTDEESQNKDADQHEEKEKEMVQEPETQKDDIVPETEEEREQETTTPAQSNPPPTETLSKPNPAEEETESDADEESDGEEEESDNESDKENRSLPKPASTAKANVLRRTSLNPPSSQPNPPSSQQQPTSSQSTPTGSRPTRNTLKSLLFQQRAEQAQARLKKEEEAAKRKSQPRKDIFSGPSDSESEDEDESSSSSSSSSESESGADAGDILSSGRVGKLRAAIPRK

SEQ ID NO: 25437 - protein, 467 aa, Listeria monocytogenes
MTSVMWFRRDLRVSDNKALYHACKEDDLLLLFQVNPAQFITGSPSHQAFFASVAHFKQEVDKTALLQIMFGEPVECLKQLKETLPSWDKVYFNRDETGYGAERDEAAKTFFDEQEIEVQAFHDSYLHSAEEVKKSPTEYYKIFTPYYKKWREEIKETPFKVTLKADNIRKENLFPKYEEQFAEMTCDLPILDSGEKTANTRLANFIKHDVADYDKARDFPELDKTSHLSRYLRTGEISVRTIWQALQENEATEGRAIFEKELCWRDFYNMIYVSFPNQKNEPIQENYRFIEWENNREFFKAWQDGKTGFPLVDAAMRQLKETGWMHNRLRMVTASFLTKDLLIDWRFGEKYFQQMLIDYDPASNIGGWQWAASTGTDAVPYFRIFNPTTQSQKFDPTGKFIRKYVKELANLPDKYIHQPEKMSEIEQKEYGLLLGKDYPFPLIDHKERRKLAIARYEFSKEHYRGNI

SEQ ID NO: 25438 - protein, 155 aa, Cyanidioschyzon merolae
MDKKSIWHRSDLDQLAKQLEEEDFLSANQTTYKLMCQWAGCGEREWIYFTEIAMIPNEAIREIDELWKKYSKGKFGYGVQRRIWLAKQKDWMKFWEQIGWVKQGQWLRYPNEFEWSLDAPEGHLPLWNQLRGVQALERLFTHDVWLSVGNVQINK

SEQ ID NO: 25439 - protein, 525 aa, Triticum aestivum
RLVGCCNELNAAYAADGYARARDGGVGACAVTFTVGGLSAINAVAGAFSENLPVICIVGGPNSNDYGSNRILHHTIGIPDFTQELRCFQNVTCYQAVVNNLEDAHEQIDTAISTALKESKPVYISISCNLPSIPHPTFSRHPVPFFLSPKLSNQMTLEAAVETAAAFLNKSVKPVLVGGPKMRVAKACEAFVELADACGYPVAAMPSAKGLVPEHHSRFIGTYWGAVSSPFCAEIVESADAYLFAGPIFNDYSSVGYSLLLKKEKAIIVQPDRVVIGNGPAFGCVLMKDFLHALGTRLKKNTAAYDNYSRIFVPQGEPLSSAPGEPLRVNVLFKHIQKMLSGDSAVIAETGDSWFNCQKLKLPEGCGYEFQMQYGSIGWAVGATLGYAQAAKGKRVISFIGDGSFQVTAQEVSTMLRWEQNNIIFLINNGGYTIEVEIHDGPYNVIKNWNYTGVVEAFHNGEGKCYTAKVRTEEELKKAIEASLGPNKDSLCFIEVIVHKDDTSKELLEWGSRVSAANSRPPNPQ

SEQ ID NO: 25440 - protein, 363 aa, Aspergillus nidulans
MATAEPHHLFHAPIADHSFSSDKSVLAVARENNVELYQKTGSKFSLTDELKGHEKTVTSVDIAPNSGRIVTCSQDRNAYVWEQTPTGWKPTLVLLRINRAATFVRWSPSEQKFAVGSGARVIAVCYFEEENDWWISKHLKKPIRSTITTLAWHPNSVLLAAGSTDSHARVFSSFIKGVDTRPEPSAWGERLPFNTICGEFLNDSAGWIHGVCFSPSGNALAFTGHDSSVTIVYPSAPEQPPRAMLNISTRLLPFNSLIWNGENEIIAAGHDCEPYRLRGDENGWQLEGTIENKAGAGAGSVREESALNMFRQMDLKGQTQADTQLKTVHQNTINTIRVYEDTAGSVHKISTSGVDGRVVIWTI

SEQ ID NO: 25441 - protein, 258 aa, Ralstonia solanacearum
SVKNAAVNVPYGGAKGGIRVDPRKLSSGELERLTRRYTSEIGIIIGPNKDIPAPDVNTNAQIMAWMMDTYSMNEGATATGVVTGKPIALGGSLGRREATGRGVFVVGSEAARNLGIDIKGARIVVQGFGNVGSVAAKLFHDAGAKVIAVQDHKGIVFNGAGLDVDALIQHVEHNGSVAGFKAETVSADDFWGLECEFLIPAALEGQITGKNAPQIKAKIVVEGANGPTTPEADDILRDRGILVCPDVIANAGGVTVSY

SEQ ID NO: 25442 - protein, 239 aa, Cyanidioschyzon merolae
MASLSFIGAGPGHPDWLTLRAYHLLQQAQLVVYDALVSQQILQLVNPYASLIQVGKRSSQRGYHPTEIAQLLMNSYHQGNHTVRLKGGDVSIFARFYEEILPIHEACIPFEIVPGITTASGVCASLACALTHRSLASSVTFISAMEAISPFRWSKLISTSDTLVVYMPLANLPSLIDGYLQAGGHPETPILLVQWCSLDTQATLLGTISTINHQIQRHQFGPPSLAIIGEVTTLCIGST

SEQ ID NO: 25443 - protein, 335 aa, Bdellovibrio bacteriovorus
MSKKDFYSLLNVSRSATADEIKKSYRKLAMQYHPDKNPGDKKAEEKFKEITEAYEVLSDTKKREMYDQFGHAGAQGFGGAGGPFGGAGGFGGFGGAGAGGAGAGAGGDPFQDIFGDVFGEIFGNARGGPGAGGARARRPSKGTDLRYTLNISFEESALGSEKVISFMRQRGGREEPAKLSVNVPAGVKEGQRLKLAGEGDASGGAAAGDLYVIINIQEHPLFKRNENDVTLDLPIVYTDAILGTNIEVPTLTGKAMIRIPPGTHSGQTFRLKGKGFPKLGGFGSGDMLVRVLVDTPSSLSNKQKELVEELAKSTDTSPLVKAFQDKVAQLMRTRK

SEQ ID NO: 25444 - protein, 273 aa, Arabidopsis thaliana
MALSMEFGFSIGSCFKAPNPPVLISASPNKINFTLRRRKKRFLLRVSAVSYKEFAESALEETRKRIVLEPSHLQVFDFAGFMEPEYDTPIFCANFFTSTNVNIVVLDLNPLHQLTDQTDYQDKYYNKIMSIYHKYAETFPWGGKLTGESIKFFSPLVMWTRFSSSKEKHKALFSAFLEYYQAWLEMTIQVREEMEPSHVRANCEAQHKYLTWRAQKELLRDFLFNGVDELGTKTFIDYFPEYQTEDGTVSDKRSIIGKSYETRPWDLTGQFIG

SEQ ID NO: 25445 - protein, 493 aa, Candida albicans
MTETSISGLRGPKSMYFMEIVDVSSQESSVLSSIVESFTSAVSASNLGVYSDEVLCDIKSSLKENSPITMLPNYNVSPTGDEHGQYLVIDLGGSTLRIAVVDISKPHPNLSRSERITIVVEKSWIIGNDFKRIDGEFFKYIGSKINEILMGQNVIDVKSVINTGITWSFPLETTDYNRGKIKHVSKGYTVGEDIYDKDLKMVLEDTLRQEYGLTLDVQSILNDSLAVYSAGCFIDSKMKLAMVLGTGINMCCSLKRSSDIHPSKMLADATLFNCELSLFGQNLCKDFATKYDIIIDKRFAGLSHHFKTFMEPDPITKTLFQPHELMTSGRYLPELTRLVVVDLIEAGEIFQNVDHQQMYQEYGGFSGELICFVHENDDYDDIHDKLCKAYGWTTVGLSDIVCLKEVVSCIIKRAAFIVANAIIAFFKLLGSDELGGDVTIGYVGSVLNYFHKYRRLIVEYVNSAEEAKGIKVDLKLIENSSIIGAAIGAAYHK

SEQ ID NO: 25446 - protein, 85 aa, Pennisetum flaccidum
ECQKVGAPPEVSARLTAMAQELEARQRTALGGLSAATEPELDQFMEAYHEMLVKFREELTRPLQEAMEFMRRVESQLNSLSISGR

SEQ ID NO: 25447 - protein, 927 aa, Vibrio cholerae
MTQRYGLRARVMTLTLAPTLIIGLLLSALFSFNRYHDLETQVINSGASIIEPLAIASEDALRMQSRESVRRIISYAHRKNSKLVRSIAVFDANHELFVTSNFHPNFEKLMYPKDKPIPFLSSSVIDENTLILRTPIISERTVLDNGDANPATPVMGYIAIELDLSSLRLQQYQEIFSAGLVLVIGILLSGVFASRLMYDVTRPITHMKNMVDRIRRGHLDVRIEGKMHGELDTLKKGINAMAVSLSEYHVEMQHSIDQATSDLRETLEQLEIQNVELDIAKKRAQEAARVKSEFLANMSHELRTPLNGVIGFTRQMLKTQLTNSQADYLQTIEKSANNLLTIINDILDFSKLEAGKLALENIPFEFQEVLEEVVNLQATSAHEKGLEITLKIDPKIPRGVVGDPLRIQQVLTNLVGNSIKFTERGNIDVSVEMRALRDDVIDLQFMVRDTGIGISERQQAQLFQAFSQADASISRRYGGTGLGLVITQKLVSHMGGEISLTSRLHQGSTFWFTLRLHTTELPLNDGYNADSLNHRHLLLIEPNMQAAAIVQQTLVQSGLEVTYRSAIPEEQHVYDYVLLNLAPSKETNPTLVELWVQRALAMTHNVIVGVPSTELALADQLMQRYPVKCISKPLSRKKLLQTLAAQQPQLANTSLPKPQADKLPLCVMAVDDNPANLKLITALLQERVEYVVSCTSGQEAIEQAQSRQFDIILMDIQMPHMDGVTACKAIKQLKGYRDTPVIAVTAHAMAGERDRLLKAGMDDYLTKPIEEHILQQVLVHWSPHTRSKQVAKVTPPDGAAVISNALPSSPPAEEAIIDWPVALRQSANKEDLAKEMLGMLVDYLREVETVVNTALEDEEYPASDLLHHIHKLHGSCSYSGVPRLRKICASLEQALRNGASIDELEPELFELQDEMAKVLEASRDYLN

SEQ ID NO: 25448 - protein, 430 aa, Staphylococcus aureus
MKTTIKQAKDHLNQDVTIGAWLTNKRSSGKIAFLQLRDGTGFMQGVVVKSEVDEEVFKLAKEITQESSLYVTGTITEDNRSDLGYEMQVKSIEVISEAHDYPITPKNHGTEFLMDHRHLWLRSKKQHAVMKIRNEVIRATYEFFNKDGFTKVDPPILTASAPEGTSELFHTKYFDQDAFLSQSGQLYLEAAAMAHGKVFSFGPTFRAEKSKTRRHLIEFWMIEGEMAFTNHAESLEIQEQYVTHVVKSVLENCKLELKMLERDTSKLEKVATPFPRISYDDAIEFLKAEGFDDIEWGEDFGAPHETAIANHYDLPVFITNYPTKIKPFYMQPNPENEETVLCADLIAPEGYGEIIGGSERVDDLELLEQRVKEHGLDEEAYSYYLDLRRYGSVPHCGFGLGLERTVAWISGVEHVRETAPFPRLLNRLYP

SEQ ID NO: 25449 - protein, 175 aa, Oryza sativa
MGPTVMASSATSVAPFQGLKSTAGLPVSRRSTNSGFGNVSNGGRIKCMQVWPIEGIKKFETLSYLPPLTVEDLLKQIEYLLRSKWVPCLEFSKVGFVYRENHRSPGYYDGRYWTMWKLPMFGCTDATQVLKELEDAKKAYPDAFVRIIGFDNVRQVQLISLIANKPPGRAEFGGN

SEQ ID NO: 25450 - protein, 85 aa, Pennisetum flaccidum
ECQKVGAPPEVSARLTAMAQELEARQRTALGGLGAATEPELDQFMEAYHEMLEKFREELTRPLQEAMEFMRRVESQLNSLSISGR

SEQ ID NO: 25451 - protein, 414 aa, Xanthomonas campestris
MTIKSLALQCRDAAQVLSQLSADAKQALLLAMANALDTDATQILQANQRDVDAAREKGTGAAMLDRLTLTPARLSAVGAALREVAVLPDPVGQVTRDDVRPNGIRVQKVRVPLGVIAMIYEARPNVTADAAALCIKAGNGVILRGGSEAIHSNTAIARALQRALREAGVPEAALTLVEDLRRETMLELLQLSDIVDLAIPRGGEGLIRFVAEHARVPVIKHYKGVCHLFVDASADVDLAVRLLVDGKASRPSACNSLETLLVHADIAERFLPAAAAALRARNVELRGDAATRAVLPEIAAASDDDYAAEFLDLILAIRVVPDLDTALAHIRQYGSDHTEVIATQTPANAETFVQSLRSAVVMVNASSRFSDGGELGLGAEIGISTTRLHSYGPMGLEALTVERFVVRGEGQVRH

SEQ ID NO: 25452 - protein, 316 aa, Geobacter metallireducens
METTHHRLIILGSGPAGYTAAVYAARANLNPTLITGLQQGGQLMTTTEVDNWPGDPNGVQGPDLMERMRQHAERFNTTMVFDHIGKANLRERPFRLEGDNGIYTCDALIIATGATARYLGLPSEDAFKGKGVSACATCDGFFYRGKPVAVIGGGSTAVEEALYLSNIASHVTVIHRRDKFRSEKILADRLIEKTKGGNVTIEWHHVLDEVLGDATGVTGIRIRHTSGSTKDIPVHGCFIAIGHAPNTQLFEGQLEMDNGYIRTLCGGEGNVTATSIPGVFAAGDVQDQYYKQAITSAGTGCMAALDAEKYLETLLS

SEQ ID NO: 25453 - protein, 324 aa, Ureaplasma parvum
MSKILIVGSGAFGSALTQVLVSNSHIVDVYGINENELNDLKENQKNKKYFQDQKLDLPINNTYLDINLALQNQYDFIIIAIPSFAIKNFVDNIKIFNLSKTIVVNAAKGLNLETKSSWCDYIKQNLKIKALVGLVGPSFAIDVFLKKPTVVNLVGNNSNALIKVKEEFENNWFKCILSKQFDAANYISCFKNALAIGCGIIYGLQNSNNSLVAFLTKGINEMQLILEKIFHKKVNPLEYFFIGDTILTCTDQKSRNFSFGLLIAQQGVQEALVNKQQTIEGLNNIKVIYEIIKTNQISAPLFQNLYKVIINALNPQDLFDKSFC

SEQ ID NO: 25454 - protein, 712 aa, Rhodopirellula baltica
MDLNSQRRVSHVRERGISPSIPNLDSNMNAWEKAEGSPFPLGASWIAEESSFNFSLYSRHATAVHLLLYRKDDLVHPAREVELSYLFNKSGPVWHCRVRSEHPDEWAYYAYRVDGPAPQGGYDHHDFDFQKILLDPFARGVFFPESFSRNAARRPGSNSGQAPLGILPNQFCEFDWNEDRVLRHGSDLVIYEMHVRGFTKNPNSGVPETHQGTFLGVVDKIPYLVELGVTAVELMPVFQFDPGDGDYWGYMPLNFFAPHHAYATNTTACNQRDEFCTMVKALHAAGIEVILDVVYNHTCEGGHRGPTYCWKGIDSSTAYMMTGNPNAPYANHSGTGNTLHTANRAVRRMIVDSLRFWDSQMHVDGFRFDLASVFTRNSDGSINLDDPPIVSEIGTDSDLSDDRLIAEPWDADGQFQLGKKFPGQRWMQWNAHYRDTMQRFVRGDCGMVSDLMTRLYGSCDLFPDDLPHALQPQLSVNYITSHDGSTLYDLTAYNEKRNWANGNNNTDGALEYSWDCGWEGDDGTPSEILQLRKQQVRNFFCLLMLSNGTPMFRMGDEFLQTQRGNNNPYNQDNETSWLDWDRRSEHADIFNFVREVISFRKSHPSISRSRFWRGDVRWYGTGHLVDMSLESRQLAYCLHGESQDDADIYVMINAGRDSVEFGIQEWAFEKWRLAIDTSRTSLSELSDDPANQCVASPTWNVNARSICVLVER

SEQ ID NO: 25455 - protein, 184 aa, Triticum aestivum
  misc_feature (57)..(57): Xaa can be any naturally occurring amino acid
  misc_feature (102)..(102): Xaa can be any naturally occurring amino acid
  misc_feature (116)..(116): Xaa can be any naturally occurring amino acid
  misc_feature (126)..(126): Xaa can be any naturally occurring amino acid
  misc_feature (132)..(132): Xaa can be any naturally occurring amino acid
  misc_feature (136)..(136): Xaa can be any naturally occurring amino acid
  misc_feature (138)..(138): Xaa can be any naturally occurring amino acid
  misc_feature (143)..(143): Xaa can be any naturally occurring amino acid
  misc_feature (146)..(147): Xaa can be any naturally occurring amino acid
LSKHDQMVSGIDWSKSSNKIVTVSHDRNSYVWTQEGSDWVPTLVILKLNRAALCVQXWSPKENKFAVGSGAKSVCICYYEQENNWWISKVIRKKHDLPVTSXAWHPNNIYLATSSXTDGKCRVFSXFIKGVXTRGXNXDFNRXKFXXNPHLSTPLGIGCKWHNGKIGYQDTQIITTPVNWTLIP

SEQ ID NO: 25456 - protein, 303 aa, Bacillus subtilis
MKRARIIYNPTSGREIFKKHLAQVLQKFEQAGYETSTHATTCAGDATHAAKEAALREFDLIIAAGGDGTINEVVNGLAPLDNRPTLGVIPVGTTNDFARALGIPREDILKAADTVINGVARPIDIGQVNGQYFINIAGGGRLTELTYDVPSKLKTMLGQLAYYLKGMEMLPSLRPTEVEIEYDGKLFQGEIMLFLVTLTNSVGGFEKLAPDSSLNDGMFDLMILKKANLAEFIRVATMALRGEHINDQHIIYTKANRVKVNVSEKMQLNLDGEYGGMLPGEFVNLYRHIHVVMPKEKAEQLDD

SEQ ID NO: 25457 - protein, 459 aa, Bacillus subtilis
MKMKPPVEKNEYYDVTFEDLTHEGAGVAKVQGFPIFVPNALPEEKAQIKVTRVKKGFAFGRLIELKEESPHRTDAPCPIYKQCGGCQLQHMTYEGQLLFKQKQVKDVLERIGKLDLSKVTVHPTLGMEDPWNYRNKAQVPVGEREGGLVAGFYQQRSHDIIDMSACLIQQSKNDEAVQAVKDICANYGVKAYNEERHKGWLRHIMVRYGVVTGEMMIVFITRTSDFPHKAKIIEDITAQFPHVKSIVQNINPNKTNVIFGNETNVIWGEEYIYDLIGDVKFAISARSFYQVNPEQTKVLYDKALEYAELQGEETVIDAYCGIGTISLFLAKQAKKVYGVEIVPEAIEDAKRNAELNGNTNAEFAVGEAETVIPKWYEEGITADTLVVDPPRKGCDEALLRTIVEMKPKRVVYVSCNPGTLARDLRVLEDGGYVTREVQPVDMFPHTNHVECCVLIKLKE

SEQ ID NO: 25458 - protein, 125 aa, Medicago truncatula
MANFVLQVPNTLRSFTVFASSNPNGALSGGSGSGGVGPVILELPLDKIRRPMMRTRSNDQNKVQELMDSISEIGLQVPIDVLEVDGNYYGFSGCHRYEAHQRLGLPTIRCKIRRGTKETLRHHMR

SEQ ID NO: 25459 - protein, 364 aa, Saccharomyces cerevisiae
MAGNANSVDEEVTRILGGIYLGGIRPIIDHRPLGAEFNITHILSVIKFQVIPEYLIRKGYTLKNIPIDDDDVTDVLQYFDETNRFIDQCLFPNEVEYSPRLVDFKKKPQRGAVFAHCQAGLSRSVTFIVAYLMYRYGLSLSMAMHAVKRKKPSVEPNENFMEQLHLFEKMGGDFVDFDNPAYKQWKLKQSIKLDPSGSELVSNSGMFKDSESSQDLDKLTEAEKSKVTAVRCKKCRTKLALSTSFIAHDPPSKESSEGHFIKRAANSHRIIDIQESQANCSHFFIEPLKWMQPELQGKQELEGKFSCPGCSSKVGGYNWKGSRCSCGKWVIPAIHLQTSKVDQFPLQSTALPNMVNFESEKVNR

SEQ ID NO: 25460 - protein, 201 aa, Oryza sativa
MAVAIEAPFHVLAVDDSLPDRKLIERLLKTSSFQVTTVDSGSKALEFLGLHDHEDSPISTQSDQQEVGVNLIITDYCMPGMTGYDLLKKIKESSYLRDIPVVIMSSDNIPSRINRCLEEGADEFFLKPVRLSDMSKLKPHILKSRCKEHYQQEQHLQSNSESNNSSNPTSENSSSSTSTNSHKRKAVDEEILPHTIRPRHS

SEQ ID NO: 25461 - protein, 811 aa, Cryptococcus neoformans
MTGGAFFAPAADNDEEYDMGPVGEAHAVQWIGTAGVKGPKWARLPLLTVGMLGIQCVWSIEMGYASPYLLELGLSKSFMSLVFMAGPLSGLIVQPLVGIFADRSRSPLGRRRPFMLAGCLICVSAMMLLGWSREVAAIFGGGQWLAITLAVWAIYCIDFSINAVMSTDRALVVDTLPPREQEEGSAWAGRMFGFGSVAGFFVGNLDLAPVLPFLGKTQLQILSFLTSAVLMVTHSFTSWAVSERVLLRDDRPQSKSSLKSNLKSIWENMFSLPPGIRTVCIVQFFASLGWFPILFFTTVWVSEIYKSSVPSDGIDPATFDSRAVRSGARALLLQALVNIITSIGMPFLVAESGVQPSESVDGYEAIEGSSSRRVGLETANGDGRSPQASVATPPNSALWKRAREDLENGTVFRRFLHSVQSMVNNVKKGELGIPIKGLTLVKVWWISQFVFAAAMAGSWFVKSVGGAYVIIATTGFCWALSQWAPYSLLGELILIDGSIQRNQSINLSRMRARRNSSDAQSRPSSALFDAEETSHPIIPPSNTNFSRVSTPLHSRHASRTSLVLDRSNRHSRDRTRPSSPSSNLDRPANFDREKFMSHKSNLSLEGEGLSPLVIQGDTPVEPAFGSTVVLRHSDEMSRSEGEDDEYEMGQVRGNSSSTHHSPRASGDYDMNGTKGTADKAGVILGIHNVFLVLPQFIVTVLSSVIFWLMEPSKSLPTHHPGSVPVTDTNTTAAIAAIANSSVLEDAVSATMEVAEQVAKRTVELVSREGVDVDVSSPDAVGLIFRIGGVSAAVGGWICWRLARDWARGQGV

SEQ ID NO: 25462 - protein, 776 aa, Brassica oleracea
MMVREVASGLLILFSILIWVSPAAAGNGGGCNCEDEGVSFWSTENILETQRVSDFLIAVAYFSIPIELLYFVSCSNVPFKWVLFEFIAFIVLCGMTHLLHGWTYGPHPFKLMVALTVFKMLTALVSCATAITLITLIPLLLKVKVREFMLKKKAHELGREVGLIMIQKETGVHVRMLTQEIRKSLDRHTILYTTLVELSKTLALQNCAVWMENEGKSEMNLTHELRGSSGRSGYGYSVSMHDVDVVRVRESNDVNILSVDSLIARASGGDVSEIGPVAAIRMPMLRVSDFKGGTPELIQTCYAILVCVLPSGQPRDWSYQEIEIVKVVADQVAVALSHAAVLEESQMMRDKLADQNRALQIAKRDAMRASQARNVLQKAMSEGMRRPMHSILGLLSMIQDEKLSNEQKMIVDTMVKTGNVMSNLVGDAMDVSDGRFVTEMKPFSLHRTVREAACLARCLCLYNGFRFTVDAEMSLPDNVVGDERRVFQVILHMVGSLVKPRKCREGSLSSSVIFKVFKERGSLDRSDQRWAAWRSPTCSADGDVYIRFEMSVENDGSGSQSFASVSSRDQEVGEVRLSGYGLGQDLSFDVCKKVVQLIQGNISVVPGSDGSPETMSLLLRFRRRPSISVHGTGEAPAPDHHLHPHSDSLLRGLQVLLVDTNDSNRAVTRKLLEKLGCIVTAVSSGFDCLTAIAPSSSSSSSTFQVVVLDLQMAEMDGYEVAMRIRSRSWPLMVAMTVSLDEEMWDKCMQIGINGVVRKPVMLRAMESELRRVLLQA

SEQ ID NO: 25463 - protein, 209 aa, Unknown
  Shewanella sp. MR-4
MSGKKRTASSTRWMQEHFDDHYVKLAQKRGLRSRAAFKLEELQEKDQLIRPGMTVVDLGAAPGGWSQIAVKLTGDKGKVIACDILPMDPIVGVDFLQGDFREEKVLEALLTRVGADKVDVVLSDMAPNMSGSDGVDQPRAMYLVELALDMCHQVLAPNGSFAVKVFQGEGFDEYMKAVKDAFKVVKTRKPDSSRARSREVYLVATGYKL

SEQ ID NO: 25464 - protein, 594 aa, Zea mays
MGKRSGGRKLPFFTRSSSSSSKRNRSGRRLPSPSKQDNATRALLASPTAASPSATPDSAAAGQTAQPPSPLSVTAGAGGALSGKITKKKPGARLWMRLDRWGASEHPHCAAPRPAPPRPRRRGNAMGKRSGGRKLPFFTRSSSSSSKRNRSARRLPSLPKQDNATRALLASPSAASPSATPGSAAAGQTAQLPPPLSVTAGGGVAVSGKVNKKKAGTRLWMRLDRWSASEIVELDKASIIRRAGLPPRDLRILGPVFSRSSSILAREKAMVINLEFIRAIVTAEEVLLLDPLMHEVLPFVDQLRQHLPLRSRVGENGECAPDGNGEKQKGSLNEATGAEHELPFEFHVLEVALEVVCSSLDLSVSDLERHATPVLDELTKNVSTRNLERVRNLKSHLTRLLARVQKVRDEIEHLLDDNEDMEHLYLTRKQVQNQQVEALMSSAASNSIVLAGTGVPRLNSSFRRSLSIATSMHLDNDVEDLEMLLEAYFMQLDGIRNRILSVREYIDDTEDYVNIQLDNQRNELIQLQLTLTIASFGIAANTFIAGAFAMNIPGSLFNTDGSLFWPFVGSTSSGCFVITVLLLGYAWWKKLLGP

SEQ ID NO: 25465 - protein, 200 aa, Lactococcus lactis
MTRISHITRNTKETQIELSINLDGTGQADISTGIGFLDHMLTLLTFHSDFDLKIIGHGDHETVGMDPHHLIEDVAIALGKCISEALGNKLGIRRYGSFTIPMDEALVTCDLDISGRPYLVFHADLSGNQKLGGYDTEMTEEFFRVLAFNAGITLHLNENYGQNTHHIIEGMFKSTARALKQAVSIDEAKVGEIPSSKGVL

SEQ ID NO: 25466 - protein, 427 aa, Triticum aestivum
MAQAVVPAMQCQVGVRGRSAVPARQPAGRVWGVRRTARATSGFKVLALGPETTGVIQRMQQLLDMDTTPFTDKIIAEYIWVGGSGIDLRSKSRTISKPVEDPSELPKWNYDGSSTGQAPGEDSEVILYPQAIFKDPFRGGNNILVICVTYTPQGEPIPTNKRHMAAQIFSDPKVTSQVPWFGIEQEYTLMQRDVNWPLGWPVGGYPGPQGPYYCAVGSDKSFGRGISDAHYKACLYAGIEISGTNGEVMPGQWEYQVGPSVGIDAGDHIWASRYILERITEQAGVVLTLDPKPIQGDWNGAGCHTNYSTLSMREDGGFDVIKKAILNLSLRHDLHIAAYGEGNERRLTGLHETASISDFSWGVANRGCSIRVGRETEAKGKGYLEDRRPASNMDPYTVTALLAETTILWEPTLEAEALAAKKLALKV

SEQ ID NO: 25467 - protein, 183 aa, Pseudomonas syringae
MKIRFVSIPLLLLSMSGAVMAADCPPLLQGELPKLRAKENIDLCKRFAGKPLVVVNTASFCGFAPQFKGLEELSQRYKGQGLEVLGLPSNDFKQEAKDGEETAKVCYVNYGVTFTMTEPQAVRGDDATHLFKVLAEQSSAPRWNFYKYVVDRQGKVVANFSSMTKPDDPELIAAIEKAIASKP

SEQ ID NO: 25468 - protein, 338 aa, Glycine max
MDIKVLSSGVQYSNLPESYIRPESERPRLSEVSECEDVPIIDLGSQNRAQIVHQIGEACRNYGFFQVINHGVALEAAKEMEEVAHGFFKLPVEEKLKLYSEDTSKTMRLSTSFNVKKETVRNWRDYLRLHCYPLEKYAPEWPSNPPSFKETVTEYCTIIRELGLRIQEYISESLGLEKDYIKNVLGEQGQHMAVNYYPPCPEPELTYGLPGHTDPNALTILLQDLQVAGLQVLKDGKWLAVSPQPNAFVINIGDQLQALSNGLYKSVWHRAVVNVEKPRLSVASFLCPNDEALISPAKPLTEHGSEAVYRGFTYAEYYKKFWSRNLDQEHCLELFKNK

SEQ ID NO: 25469 - protein, 450 aa, Vibrio angustum
MARFFKPQKRKTDTKHKEITISRLDHIGAGIGHLNNKPVFIDGALPDETVVVQLTEDKKNYARARVIKRLKDSAARIKPHCPIYDQCGGCNLQHLSHQGQVIAKQQALSELMAKFAITEKDDAAQVEPIVGQSEHYRRCARFSVRMLPNGKMVFGFRKKQSKDIVDVNACPVLATTLNDLLPPLRELLSNLKGRKHVGHIELVNADNGRVLLIRHLQPFNDNDLAAIKAFATEHALMLFLAPSSDELDHVLGEQPYYDIDDVRLTFSPKDFIQVNRDVNVKMVEQAINWLDIQPQDRVLDLFCGLGNFSLPLARRAKAVVGVEGVDEMVARATANAAANGLDNATFYQANLDEDVTKLVWAQEQFDKILLDPARAGAAGVMQHIVNLAPSKVVYVSCNPATLARDSQMLLQQGYKLARLGMMDMFPHTGHLESMTLFVKTNHHKKNSNVM

SEQ ID NO: 25470 - protein, 218 aa, Myxococcus xanthus
MFFNPTKKLRIPTPEEALPGRSDVMPVPEKHEVLGTPIKGPVPEGLEEVYFGLGCFWGAERKFYQTPGVYSTAVGYAGGPTPNPTYREVCSGLTGHNEVVRVVFDPKKVSFEQLLRVFWESHDPTQGMRQGNDVGTQYRSGIYFTSEAQQRAAVASRDAYQKALAARGFDAITTELLPAPPFYFAEDYHQQYLEKNPGGYCGLGGTGVSCPVGVGVNA

SEQ ID NO: 25471 - protein, 410 aa, Alkalilimnicola ehrlichei
MTPERQETLTRIGPGTTMGELLRRYWWPLAASVEVRPGRALARRLLGEDLVLFRTPAGGLGLIDEHCTHRGASLRCGHVDEEGIACPYHGWKFDHHGHCLAMPAEPRQKPALLRRAATRGFPVQELGGLVFAYIGPDPAPLLPRYDLLLQDDALRDIGVAELPCNWLQIMENSVDPAHVEWLHGHHLAGVRSERGEPAPTQYLKHHQRIGFDVFEYGIIKRRIVAGGSEEDEDWRTGHPLIFPCALRVGTGNQHRFQFRVPMDDTHTRHYWYACYLPPEGRSAPPQREIPLYPVPWRDEHGDYIVDFVDGGDIMVWVSQGAIADRTRERLVASDKGIVLYRRLLLEQAQRVADGLDPMGVIRDEAENRVIRFAQERNKLGDGRRLLREAIEMSHVRYSPLKEQIIALLQP

SEQ ID NO: 25472 - protein, 508 aa, Bacillus cereus
MILDADIKTQLSQYLQLMENDILLKVSAGDDNVSKDMLALVDELATMSSKITVEKVELERTPSFSVNRPGEDTGVVFAGIPLGHEFTSLVLALLQVSGRAPKVEQKLIDQIKNIQGEYHFESYISLSCHNCPDVVQALNVMSVLNPGITHTMIDGAAFKEEVESKDIMAVPTVYLNGESFGSGRMTLEEILAKMGNGPDASELSDKDPYDVLVVGGGPAGASAAIYAARKGIRTGIVAERFGGQVMDTMGIENFISVKKTEGPKLVASLEEHVKEYDIDVMNLQRAKRLEKKELIEVELENGAILKSKSVIVSTGARWRNVGVPGEAEFKNKGVAYCPHCDGPLFTGKDVAVIGGGNSGIEAAIDLAGIVKHVTVLEFMPELKADAVLQERLNSLPNVTVLKNVQTKEITGTDKVNGISYIDRETEEVHHVELQGVFVQIGLVPNTDWLGETVERVRGEIVTDKHGATNVPGVFAAGDCTNNPYKQIIISMGSGANAALGAFDYLIRN

SEQ ID NO: 25473 - protein, 258 aa, Ralstonia solanacearum
SVKNAAVNVPYGGAKGGVRVDPRKLSSGELERLTRRYTSEIGIIIGPNKDIPAPDVNTNAQIMAWMMDTYSMNEGATATGVVTGKPIALGGSLGRREATGRGVFVVGSEAARNLGIDVKGARIVVQGFGNVGSVAAKLFQDAGAKVIAVQDHKGIVFNGAGLDVDALIQHVDHNGSVDSFKAETLSADDFWALECEFLIPAALEGQITGKNAPHIRAKIVVEGANGPTTPEADDILRDRGILVCPDVIANAGGVTVSY

SEQ ID NO: 25474 - protein, 119 aa, Unknown
  Frankia sp. CcI3
MSIYDTIGGATAVQAAVDDFYVRVTADPVLAPLFANRDLPRLKEHQRAFIAAVIGGPEVYRGRDMAAVHATLGLTDAHFDAVVDHLLAALTGLGVPTETTGQIGAALAPLRSDVVTISK

SEQ ID NO: 25475 - protein, 474 aa, Oryza sativa
MAMATALRKLSSDALRRQPLSRITPLYYMWPKQLNAPLEEVDPEIADIIEHEKARQWKGLELIPSENFTSVSVMQAVGSVMTNKYSEGYPGARYYGGNEYVNVQPLSGSPANFHVYTALLKPHERIMALDLPHGGHLSHGYQTDTKKISAVSIFFETMPYRLDESTGLIDYDQMEKSAVLFRPKLIVAGASAYARLYDYDRMRKVCDKQKAILLADMAHISGLVAAGVVPSPFDYADVVTTTTHKSLRGPRGAMIFYRKGVKGVNKQGKEVMYDFEDKINAAVFPGLQGGPHNHTITGLAVALKQATTPEYRAYQEQVMSNCAKFAQSLTAKGYELVSGGTDNHLVLVNLKSKGIDGSRVEKVLENVHIAANKNTVPGDVSAMLHDHAGTPALTSRGFVEEDFAKVADFFDAAVNLALKVKAAAGGTKLKDFVATLQSDSNIQSEIAKLRHDVEEYAKQFPTIGFEKETMKYKN

SEQ ID NO: 25476 - protein, 485 aa, Ostreococcus tauri
MMMRCASYKEKNERTGKANPVGKTARPSSVLGRETPDVNDLFEFHDELGRGQFGTTFLVTEKATGRKCACKAISKRQLQNAEDIEEVRNEVRILHHLSGDNRVVELVGAYEGNKHVYIVMELLSGGELFDRIVEKGKYSEKDASETLRTIVETVEYCHELSVMHRDLKPENFVLKTKDRDSPVCAIDFGLSTFFRDNQVFVDLVGSPYYVAPEVLRRRYGREADIWSCGVILYILLSGVPPFWAQTEQGIFDAILQGSLDLDSDPWPKISSEAKELISGMLQSDPSKRMTAAQVLKHPWVADPNVAPKTKLDNTVFKRFKNFAGMTKFKKMGLMAMAKTMTSDEVAGLKELFKSFDTDGSGTISIDELRQGLKLKSAGPAMEELRAIMKTIDIDGSGELDYEEFIAATLATSKQQSNDAVRRAFDYFDKDGDGSITVQEFEEAFKKMTDVERANLGDIGSLIKSADTDGDGCIDFNEFIAMMSSK

SEQ ID NO: 25477 - protein, 258 aa, Ralstonia solanacearum
SVKNAAVNVPYGGAKGGIRVDPRKLSSGELERLTRRYTSEIGIIIGPNKDIPAPDVNTNAQIMAWMMDTYSMNEGSTATGVVTGKPIALGGSLGRREATGRGVFVVGSEAARNLGIDIKGARIVVQGFGNVGSVAAKLFHDAGAKVIAVQDHKGIVFNGAGLDVDALIQHVDHNGSVAGFKAETLSADDFWALECEFLIPAALEGQITGKNAPNIGAKIVVEGANGPTTPEADDILRERGILVCPDVIANAGGVTVSY

SEQ ID NO: 25478 - protein, 475 aa, Geobacter sulfurreducens
MKPLFLNPPTYEDFDGGAGARYQASREVTSFWYPTWLCFPAGMIEGSRVVDAPVQRFDLDACLAIAAEYDMVVMYTSTPTLSLDIETAHRIKERKPATVTVLTGPHVTVLPEESLRQGEGVIDIVCRGEFDYTTKELCEGREWEKVDGISFWKNGAIHHTPDRPPIQDLDALPFVAPVYKRDLPIAEYVIPHFKNPYVSIYSSRGCPSKCIYCLWPQTFSGRAMRTRSPQNVYEEVKWIVDNIPEMRELSFDDDTFTADRRHAREVAAKLKPLGISWTINARANCDYETLKIMREAGLRHVVVGYETGNEQILKNIKKGVTKEQAIEFTRNCKKLGLSVHGAFIMGLPGETRDTIRETIEFAKALDLNSIQASLASPYPGTEFWDLCRQEGWIASDAYIDDTGHQMCVINYPHLSNAEIFNAVEEFYDKFYFRPKFILRTVMKMITDGEERRKRLKEGKQYLEYMKKRKAAGHSC

SEQ ID NO: 25479 - protein, 442 aa, Unknown
  Frankia sp. CcI3
MGQVPSRRFSLFDRRSWPEARRIAEILRREAIGGGLLLAATVLALGWANSPWSESYQSMLSYQLGPSWAHLDLTLAQWAADGLLAIFFFVAGLELKREFIAGDLRDPRRAAVPVLAACGGVAVPAVLYALVNVGGDASAGWAIPTATDIAFALAVLAVIGRHLPSGLRTFLLTLAVVDDLLAIVIIAVVYTRHLSILPLLGALVPLALFTLLVQRRVRSWWLLLPLAAATWTLVHASGVHATVAGVLLGFAVPVLRGTRAGGPEAGPGLAEHFEHRWRPLSAGVAVPIFAFFSAGVTVDGLSGLSAALSDRAALGVVLGLVVGKPLGIMAATFLVARFTRATLDDGLTWTDVLGLAVLAGIGFTVSLLIGELAFGSGSARDDHVKIAVLTGSLLAALLAAVVLRLRNRVYRRLQEAETADRDHDGIPDVYQDLHRSSPRPWG

SEQ ID NO: 25480 - protein, 261 aa, Aspergillus nidulans
MTSLFSQDPHINPIGYSFAQPTNAGNKEHSFYPYTDNGGSVLGITGKDFAVLAGDTRSTSGYNINSRYVPKVFKIGGEDETGKGAHILLSVVGFAADGLALKERLDAVVKMYKYQHGKPMSVRACAQRLSTILYQKRFFPYYVQAILAGLDEEGKGALYGYDPVGSYEREQCRSAGAASSLIMPFLDNQVNLKNQYIPGSGEGHALEARKPEPMSRETVEQLVRDAFTSAVERHIEVGDGLQMLVITADGIEEVYHPLKKD

SEQ ID NO: 25481 - protein, 470 aa, Triticum aestivum
  misc_feature (416)..(416): Xaa can be any naturally occurring amino acid
MITGTDFYHVMTAMVPLYVAMMLAYGSVKWWRIFTPDQCSGINRFVALFAVPLLSFHFISTNNPYTMNLRFIAADTLQKLIVLALLTLWSHLSRNGSLEWTITLFSLSTLPNTLVMGIPLLKGMYGDFSGSLMVQIVVLQCIIWYTLMLFMFEYRGARMLITEQFPDTAGAIASIVVDPDVVSLDGRSNAIETEAEVKEDGKIHVTVRRSSASRSDIYSRRSMGFSSTTPRPSNLTNAEIYSLQSSRNPTPRGSSFNHTDFYSMVGRSSNFGAADAYGIRTGATPRPSNYEEDAPKPKHPAPGAGHYPAPNPAVAAAPKGPKKPATNGQAKGEDLHMFVWSSSASPVSDVFGGGAPDYNDAAAAKSPRKMDGAKEREDYNVERDDLSFGNRGALDRDAEPAARALAARPNHAMGAXATAMPPTSDDPLILIWCGQLIRTQNIPTHGLFGRRWSREIRCGNAGTNPPVDGG

SEQ ID NO: 25482 - protein, 148 aa, Geobacillus kaustophilus
MGYIEELRKIIGTRPIILAGAGVAVTDECGRILLQKRRDGLWGLPGGLLELGESAEEAARREVWEETGLEIGKLELVDVFSGKKYFVRLPNGDQYYPVTVVYLTRDIRGGELKEDGEESLEVKFFPFHELPNELSPLVKDFIEQYFRG

SEQ ID NO: 25483 - protein, 510 aa, Eustoma grandiflorum
MAVGNGVLLHIARSLMLFFHVQKLVQYLWMNSRRHRLPPGPIGWPVLGALPLLGTMPHVALANMAKKYGPVMYLKVGSCGLAVASTPEAAKAFLKTLDMNFSNRPPNAGATHLAYNAQDMVFADYGPRWKLLRKLSNIHILGGKALQGWEEVRKKELGYMLYAMAESGRHGQPVVVSEMLTYAMANMLGQVMLSKRVFGSQGSESNEFKDMVVELMTVAGYFNIGDFIPSIAWMDLQGIQGGMKRLHKKFDALLTRLLEEHTASAHERKGSPDFLDFVVANRDNSEGERLHTVNIKALLLNMFTAGTDTSSSVIEWALAELLKNPIILKRAQEEMDGVIGRDRRFLEADISKLPYLQAICKEAFRKHPSTPLNLPRIASQACEVNGHYIPKGTRLSVNIWAIGRDPSLWENPNEFNPDRFLERKNAKIDPRGNDFELIPFGAGRRICAGTRLGILLVEYILGTLVHSFDWELPSSVIELNMDEPFGLALQKAVPLAAMVTPRLPLHIYCP

SEQ ID NO: 25484 - protein, 258 aa, Ralstonia solanacearum
SVKNAAVNVPYGGAKGGIRVDPRKLSSGELERLTRRYTSEIGIIIGPNKDIPAPDVNTNAQIMAWMMDTYSMNEGATATGVVTGKPIALGGSLGRREATGRGVFVVGSEAARNLGIDIKGARIVVQGFGNVGSVAAKLFHDAGAKVIAVQDHKGIVFNGAGLDVDALIQHVDHNGSVAGFKAETVSADDFWGLECEFLIPAALEGQITGKNAPQIKAKIVVEGANGPTTPEADDILRDRGILVCPDVIANAGGVTVSY

SEQ ID NO: 25485 - protein, 523 aa, Campanula medium
MSIDISTLFYELVAAISLYLATYSFIRFLFKPSHHHHLPPGPTGWPIIGALPLLGTMPHVSLADMAVKYGPIMYLKLGSKGTVVASNPKAARAFLKTHDANFSNRPIDGGPTYLAYNAQDMVFAEYGPKWKLLRKLCSLHMLGPKALEDWAHVKVSEVGHMLKEMYEQSSKSVPVPVVVPEMLTYAMANMIGRIILSRRPFVITSKLDSSASASASVSEFQYMVMELMRMAGLFNIGDFIPYIAWMDLQGIQRDMKVIQKKFDVLLNKMIKEHTESAHDRKDNPDFLDILMAATQENTEGIQLNLVNVKALLLDLFTAGTDTSSSVIEWALAEMLNHRQILNRAHEEMDQVIGRNRRLEQSDIPNLPYFQAICKETFRKHPSTPLNLPRISTEACEVDGFHIPKNTRLIVNIWAIGRDPKVWENPLDFTPERFLSEKHAKIDPRGNHFELIPFGAGRRICAGARMGAASVEYILGTLVHSFDWKLPDGVVEVNMEESFGIALQKKVPLSAIVTPRLPPSSYTV

SEQ ID NO: 25486 - protein, 181 aa, Impatiens balsamina
MYMRKRSSSSSSTEPLAVGRVIGDVIDPFVLAVKMLVTYNNKQVYNGYELFPSQITSKPRVEVHGGDLRTFYTLVMTDPDVPGPSDPYLKEHLHWMVTDIPGTTDATFGKEMVKYEMPMPNIGIHRFVFVLFKQRCRQSVQPPSSREHFNTRRFAADNDLGQPVAAVFFNAQRETAARCRR

SEQ ID NO: 25487 - protein, 461 aa, Geobacter sulfurreducens
MNERIRIREILAGTPAGTEVIVKGWVRTSRVGKGVAFLAVNDGSCLASLQVVAEPGLANYHELRGIGTGAAVAVRGIVAESPAAGQAVELHATKVVVVGGADEQYPLQKKRHTFEYLRTIAHLRPRSNTFGAVFRVRSSLAQAVHRFFAERGFLYVHTPIITTSDCEGAGELFRVTTLDPSAPPMADGAVDFSQDFFAAQAGLTVSGQLEGELFAQAFSDIYTFGPTFRAENSNTPRHAAEFWMIEPEMAFADLRDDAALAEDFFRYLCRHVLDNCAEDMAFFNEHVDRGLLARVEQVAGSSFAMMEYGVAIEHLKRAAVPFEYPVEWGLDLQTEHERYLTEQVVGGPVFVVNYPQEIKAFYMRRNDDGRTVAAMDLLVPKVGEIIGGSQREERYDLLESRMREGGIAPESLWWYLDSRRWGSTPHAGFGLGFERLIMYLTGMENIRDVIPFPRTPRHAEF

SEQ ID NO: 25488 - protein, 461 aa, Geobacter metallireducens
MSARIRIRNALAGEGLGNEIMVKGWVRTIRTGKEVAFLALNDGSCFANLQVVAEPGLATFADVCAIGTGAAVAVRGRLVDSPASGQCYELHADEVAVIGLADESYPLQKKRHSFEYLRSIAHLRPRSNTFGAVFRVRSSVAQAVHRFFAERGFLYVHTPIITTSDCEGAGEMFRVTTLDPAAPPLLEGEVDFSRDFFAAQAGLTVSGQLEGELFAQAFSDIYTFGPTFRAENSNTPRHAAEFWMIEPEMAFADLMADAALAEEFFRYLCRHVLDACGEDMAFFNDHIDKGLIARVEQVANSSFAIMEYGEAIERLKKATVTFEYPVEWGLDLQTEHERYLTEQVVGGPVFVINYPKHIKAFYMRVNDDNKTVAAMDLLVPKVGEIIGGSQREERLPVLEGRMAEVGVNPEGLWWYLDSRRWGSTPHAGFGLGFERLIMYLTGMENIRDVIPFPRTPRHAEF

SEQ ID NO: 25489 - protein, 475 aa, Geobacter metallireducens
MKPLFLNPPTYEDFDGGAGARYQASREVTSFWYPTWLCFPAGMIDGSRVVDAPVQRFTIDDCLAIARDFDMVVMYTSTPTLALDIATARRVKEQKPATVTVLTGPHVSVLPEETLRQGEGVIDIVCRGEFDYTTKELCEGREWAKVDGISFWKDGKIHHTPDRPPIQDLDALPFVAPVYKRDLPIAEYVIPHFKNPYVSIYSSRGCPSKCIYCLWPQTFSGRAMRTRSPQNVYEEVKWIVDNIPEMRELSFDDDTFTADRKHAREVAAKLKPLGISWTINARANCDYETLKIMREAGLRHVVVGYETGNEQILKNIKKGVTKEQAIEFTRNCKKLGLSVHGAFIMGLPGETRDTIRETIEYAKALDLNSIQASLASPYPGTEFWDLCRQEGWIASEAYIDDTGHQMCVINYPHLSNKEIFDAVELFYNKFYFRPKYIGRSIMKMIVDGEERKKLLKEGKQYLEYMRKRKAAGSSC

SEQ ID NO: 25490 - protein, 577 aa, Desulfovibrio vulgaris
MATTPETMENHAFDADMSFESALENYLSSDFGDLEEGSIVKGEIVRLGDDYVLVDVNFKSEGQIAANEFRDANGDLIIGVGDRVDVFVVRKNEMEGTITLSYEKAKRMQLFDQLEEVQEKNGVIKGRIVRRIKGGYTVDLGGVEAFLPGSHVDLRPVPDMDALVNQEYEFRVLKINRRRSNVIVSRRVLLEEERDSKRQDLLRTLEEGQVVKGKAKNITEYGVFVDLGGLDGLLHITDMSWKRIRHPKELVSLGQELELKVLSFDRDSQKVSLGMKQLVADPWQDITAKFPEGLRGQGKVTNLVDYGAFVELEPGVEGLVHISEMSWTRKLRHPSQMVRVGDEVEVVILGVDPDKKRISLGMKQVKPNPWEVVAEKYPEGTILEGVIKNITEFGMFIGIEDGIDGLIHVSDISWTKKIRHPNEMYKVGDVVQAKVLTVDQENEKFTLGVKQLAEDPWSRVPATYPVGTLVTGSVTNITDFGLFVEVEEGIEGLVHVSEISQKKIKSPSEIYKEGQEIQAKVIHVSAEERRLGLSIKQLKDEEERRKPKEFRSGSPEVGGQTLGDILKLKLEEDAADN

SEQ ID NO: 25491 - protein, 123 aa, Desulfovibrio desulfuricans
MSKHILIVDDSKTVRNLVAFIMKKEGFRVTMAEDGLDGLEKLYSAEETVDLIISDVNMPRMDGFTFIKTVREQDTYRDLPIVVLSTEGQEKDIQMGMSLGANLYMVKPAQPDKMVKNIKMLLG

SEQ ID NO: 25492 - protein, 335 aa, Fusobacterium nucleatum
MVKISVIGSGGWGIALAILLHKNGHNLTIWSFDKKEAEELKINRQNKTKLPNILLPEDIKVTDNLKEAVDNKDILVLAVPSKAIRSVSKSLKDIIKDNQIIVNVAKGLEEDTLKTMTDIIEEELKEKNPQVAVLSGPSHAEEVGKGIPTTCVVSAHNKELTLYLQNIFMNPSFRVYTSPDMIGVEIGGALKNVIALAAGIADGLNYGDNTKAALITRGIKEISSLGVAMGGEQSTFYGLTGLGDLIVTCASMHSRNRRAGILLGQGKTLDEAIKEVNMVVEGIYSAKSALMAAKKYNVEIPIIEQVNAVLFENKNAAEAVNELMIRDKKLEIQSW

SEQ ID NO: 25493 - protein, 135 aa, Cenarchaeum symbiosum
MDDSEYERIRDKQLHDLMGEHREGQLAAKAGVLELDTSNFDGVIGAGGLVLVDFWAEWCGPCKSMHPIFERMAKKYPGIKFARVNVDNAQPIAHRYGVQAIPTFVMFRDGSPADRMTGAVGEPGIHMIAKKHLGL

SEQ ID NO: 25494 - protein, 85 aa, Pennisetum villosum
ECQKVGAPPEVSARLSAMAQELEARQRTALGGLSAATEPELDQFMEAYHEMLVKFREELTRPLQEAMEFMRRVESQLNSLSISGR

SEQ ID NO: 25495 - protein, 427 aa, Triticum aestivum
MAQAVVPAMQCQVGVRGRSAVPARQPAGRVWGVRRTARATSGFKVLALGPETTGVIQRMQQLLDMDTTPFTDKIIAEYIWVGGSGIDLRSKSRTISKPVEDPSELPKWNYDGSSTGQAPGEDSEVILYPQAIFKDPFRGGNNILVICDTYTPQGEPIPTNKRHMAAQIFSDPKVTAQVPWFGIEQEYTLMQRDVNWPLGWPVGGYPGPQGPYYCAVGSDKSFGRDISDAHYKACLYAGIEISGTNGEVMPGQWEYQVGPSVGIDAGDHIWASRYILERITEQAGVVLTLDPKPIQGDWNGAGCHTNYSTLSMREDGGFDVIKKAILNLSLRHDLHIAAYGEGNERRLTGLHETASISDFSWGVANRGCSIRVGRETEAKGKGYLEDRRPASNMDPYTVTALLAETTILWEPTLEAEALAAKKLALKV

SEQ ID NO: 25496 - protein, 1482 aa, Aspergillus nidulans
MNGHDRPRGPLGDPVPQRDPRRRAESRAGGHGGPGDGASRAEKFEDEKRRIVQSCFSKKDSDGALVESYITHVRIMEDGAYPSSPPPPNSSPENKKARVIIVAVRRSGRVRMHKARENNDGSFSIGKTWMLDDLSAIKSYNAIVPSSPQEELQKQWASNVGFLVTVGKPYYWHAKSPKEKDFFIGSLVKIYKKYTGGKMPDLIGFDERELQLLLGPHYSGGKGPSSGSSNTEGSFVPPRPPSSQGNRPQSPHWARARSRDSPKRRPNEEDLPIRAQRSREQMSRPSTAQSGKSGPPPFAPPQHPPPVLPVDQGDRPPPRAMERLAGDPKTPKIAPVSPLEPKIREIPSSLRTAHSRENISKEAEEVNLSSVQTEPRPPSSRSGKMVPEPRPIVRSENSSSSIPEARRLNDDIVPGLAPSELRVKEPKRGSETPSSTSKGQPTSLAGDQLSSSNNLQLADVPPGLLAGLPASNNATSAKPVETPQQVSEREEPEEPVAESKAPSSPISPPEALQENDEDDPDAHRPGLGPMIKKKSNKDVAGAFRKAANAYGAFKPRSGGAGARLLAAAKKQAASEGPDGITSVVPAPSLVRRVEEPAKTTTEERPEETATVPPVSETPEIPSTDAPPVPAPPVPAPTVPEPNIQEPPRVEITEAVADATVAPSLDAPKNMPEAVAVRADERSRSVSPSPRDRRRRRHEDNTVKYCQALGLDPKVLGDRGVEFDDILTDLGWNGRLSDEKKIEDLEADVRREIGRVEATSWLGNLEQQEGKVDQLAKLIDKTIEECEELDNLLTLYSHELNTLRDDVSYIETQSQGLQVQTANQKLLHSELQTLLKTLSISVNDLQPLKEASLSNIDGLRETELALSTLYKAMLTIDPDIWHNKKRLDAAGGHGTVGVYADTEIGQMRAIKDKKEEYRFYSSSFLQRLRQFMGIAYQVAAQKRADAAANSQKDPMKLDGSARAYARRELWVYSALTLFAREVSGPEWQGLITLYEQQAKQSYQAEFRDNNMAWKRTARKMTGEEQELLFTHQDKEKEAEGITTAARKLTVRRGKTIRAAAGLRLPSADKQHGRLEPFEVFAGTLQETVKMISEEQNFLVRFFHLTSLSNTDFADIVASGAPDERAVPDFTIKQSPDPDRGMAKKVEQAMDELYSFWPMDMQNLVDWSIKADPLQGIGILFAIEKTIADFDDTNQDFIIHSLQKLHSRLIGLFNRFVDEQIRGIEETKVKINKRKGVISFMRIFPNFSVAVENMLSDPSSEFYDIRLNVNEAYDRINRAMWESLKFIAKEAPGQSATVAAAAGSGDPEDKEILNYHILLIENMNHYIEEVDIRNLPVLERWRNRAQEDMREHMRLYLDSVIYRPLGKLLEFVDSVEGLAATTSNPTDIASRPSHSRSVAKRVLAAYDAKEIRRGIEMLKKRVEKHFGDADDPGLSRSLVIKVLRECESRYEQAYDRTQHVIRAVYEGQLELEWRKEDVAATFRK

SEQ ID NO: 25497 - protein, 163 aa, Saccharomyces cerevisiae
MSEFYKLAPVDKKGQPFPFDQLKGKVVLIVNVASKCGFTPQYKELEALYKRYKDEGFTIIGFPCNQFGHQEPGSDEEIAQFCQLNYGVTFPIMKKIDVNGGNEDPVYKFLKSQKSGMLGLRGIKWNFEKFLVDKKGKVYERYSSLTKPSSLSETIEELLKEVE

SEQ ID NO: 25498 - protein, 646 aa, Pisum sativum
MTDYRSLPTMNNSIWTDDNSSVMEAFMSTTADLSSIWLPPPNSAASTTTPGPDTTKPPPQQQPLFNQETLQHRLQALIEDAKENWTYAIFWQTSYDYSTSRQLLGWGDGYYKGEDDKEKAKKVILPEQQAHRNKVLRELNALISGSSSSDDVVDEDVTDTEWFFLTSMTHSFVNGSGLLSQAYFNSSPVWINDRLSMSTCERTRAAHVHGLQTLVYIPAPSSNGVVELASTEIIPHSAGIMEKVRFLFDFNNPEARSWPLNSADNDPSSMWLDIPGSGGIEIRDSINTVSAVSVTASANATIPKKSPFEIHGASTTLPESSTTVNISTAQRQIQNQNQNQSFFPRELNFSGSFKPESGEILNFGESKKSSYSSANGNFFSGPSPFAANEENRKRRSPVSRSSIEDGILSFSSGKLLHGSTIKSGGGDSDHSDLEVSVVKKTVSSRVIEPEKRPRKRGRKPANGREEPLNHVEAERQRREKLNQRFYALRAVVPNVSKMDKASLLGDAISYINELKLKLQGLESSKDELEKELDTTRKELEIATKKPVRLNEEEKEKPENNSKLIDLDIDVKIMGWDAMIRIQCSKKNHPAAKLMAALKELDLDVNHASVSVVNDLMIQQASINMGSRFYTQEQLLSVLSSKIGDTQ

SEQ ID NO: 25499 - protein, 468 aa, Escherichia coli
MSKQQIGVVGMAVMGRNLALNIESRGYTVSIFNRSREKTEEVIAENPGKKLVPYYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLTNEELAQTFTEWNNGELSSYLIDITKDIFTKKDEDGNYLVDVILDEAANKGTGKWTSQSALDLGEPLSLITESVFARYISSLKDQRVAASKVLSGRQAQPAGDKAEFIEKVRRALYLGKIVSYAQGFSQLRAASEEYNWDLNYGEIAKIFRAGCIIRAQFLQKITDAYAENPQIANLLLAPYFKQIADDYQQALRDVVAYAVQNGIPVPTFSAAVAYYDSYRAAVLPANLIQAQRDYFGAHTYKRIDKEGVFHTEWLD

SEQ ID NO: 25500 - protein, 897 aa, Lotus japonicus
MMDSPEPSKINRSSSASALNASVNTPSSESPQVQESPFFRFASNLSPMRPAKACHVAPSFLGLNSPPLVFKSPRVNCDRESRYLERPQGTHLSSVEMSQSYNGGNSLRVAPGDSNESNSQLPLPERFATDTQQDIGLRNDTNTQSCSFPTSVDEYLADPGDTDEMYSVNPDVEQSTYAVESEPSNLTRTKKVILKCNGNDDPGDKAEEPSPLSEESNEIHQERPVENPETEGDKRVVERVSQEHTKLESNLAADVSHNSLTQHAGNGPDHSDCAAQSMSDPLQDVKESKDCHEMVSTLHVRQENISQDGSEASLKYHGIRRRCLKFGEAASSALGSNMSNMKLNATSSQMHFVNPFKPVSSLYLQRGIPETGSKPAGIGLHLNSIINGMPPSCASTTGMRSSDVLQGMQSTSSISLNKVENMKKYVISSNMDRQPLVDNRNEIHETDASLAADYFSPSLKEPIALYPASGHDKRKLSPTDAGNSEGLDQHTPGKKKKKTSSTADGNGCKRCNCKKSKCLKLYCDCFAAGVFCLDPCSCQDCFNKPEYGEKVLETRQQIESRNPLAFAPKIVKSATNAPSNMEDVNLTTPSSARHTRGCNCKRSMCLKKYCECYQSNVGCSSGCRCEGCKNVYGKKEDYVAPDHALSKERVSSNVEKGSDSTMLNKPEMVASREDLFQKEFYDQHHLSPITPSLQCSDQGKDMFPSHRSLMLTDSCDSKSYENVQSPAPPCNSASCILQLTPLSNPDSTSGAPSIPAKPVGTSAPSSRVSHGCVRQLSGGSLRWRSSPVTPRNTNLGEAQHLQGLESDSRLFDIVEDETPAILKESSTPTKTVKANSPIQKRVSPPRVIGSSSSGGLRTGRKFILKSVPSFPPLTPCMDSKGNGNEDGNVDSGNGATK

SEQ ID NO: 25501 - protein, 340 aa, Bacillus anthracis
MTKITVVGAGSWGTALAMVLADNGHDVRIWGNRSELMDEINTKHENSRYLPGITLPSTIVAYSSLEEALVDVNVVLIVVPTKAYREVLQDMKKYVAGPTTWIHASKGIEPGTSKRISEVIEEEIPEDLIKDVVVLSGPSHAEEVGLRQATTVTSAAKRMEAAEEVQDLFMNSYFRVYTNPDIVGVELGGALKNIIALAAGITDGLGLGDNAKAALMTRGLTEIARLGRKMGGNPLTFAGLTGMGDLIVTCTSVHSRNWRAGNMLGKGHSLEEVLESMGMVVEGVRTTKAAHELAEKMEVEMPITAALYDVLFNGNNVKDAVGSLMGRVRKHEVEAIPDLL

SEQ ID NO: 25502 - protein, 699 aa, Unknown
  Shewanella sp. MR-4
MNPIVKSFEYGQHTVTLETGVIARQADAAVLASMGDTTVLVTVVGKKEAEAGRDFFPLTVNYQEKTYAAGKIPGGFFKREGRPSEDETLIARLIDRPIRPLFPNGFTNEVQVIITVVSVDPQIEPDIISMIGTSAALAISGIPFSGPLGAARVGYINGEYVLNPTVTQLANSQLNLVVAGTEGAVLMVESEAQALPEEVMLGSVVYGHDQQQVVIKAIAEFKAEAGKPAWNWTAPVANEALVAQVKELAEVGLAQAYQIQVKQERYAQVAVVKAAAKEALLAANPEVDLREVDGLLGSLEKKVVRGRIIRGEPRIDGREPDMVRALSVLAGVLPRTHGSALFTRGETQALVTCTLGTERDAQKIDSIMGERTNRFMLHYNFPPYSVGETGMVGSPKRREIGHGKLAWRGINAVMPSAEEFPYSVRVVSEITESNGSSSMASVCGTSLALMDAGVPIKTSVAGIAMGLVKEGDNFVVLSDILGDEDHLGDMDFKVAGTRDGVTALQMDIKIEGITKEIMEIALQQAYGARVHILNVMDQAIGSHRDDISDHAPRITTIKINPEKIRDVIGKGGAVIRALTEETGTTIELEDDGTVKIASSNGEATKEAIRRIEEITSEVEVGRIYNGKVIRIVDFGAFVNILPGKDGLVHISQISDERVANVSDHLELNQEVTVKVMEVDRQGRVRLSIKEAQTKEAAAE

SEQ ID NO: 25503 - protein, 465 aa, Brassica napus
MPSMICLLLGFVVSSFLFIFVSKKLLSRHNMSEVSRLPSVPVVPGLPLIGNLLQLKEKKPHKTFTRWSELYGPIYSIKMGSSSLVVLNSTETAKEAMVTRFPSISTRKLSNALTVLTCNKSMVATSDYDDFHKLVKRCILNGLLGANAQKRKRHYRDALIENVTSKLHAHTRDHPEEPVNFRAIFEHELFGVALKQAFGKDIESIHVDELGETLSREEIFKVLVHDMMEGAIDVDWRDFFPYLKWVPNNSFESRIQQKHKRRLAVMNALIQDCLKQNDSDDCYLNYLMSEGKTLTKEQIAILVWETIIETADTTLVTTEWAIYELAKHQSVQARLCEEIKSVCGGEKIKEEQLPLLPYVNAIFHETLRKYSPAPLVPIRYAHEDTEIGGYYVPAGSEIAINIYGCNMDKKRWEKPEEWWPERFLDDRYELSDLHKTMAFGAGKRVCAGALQASLMAGIAIGRLVQ

SEQ ID NO: 25504 - protein, 118 aa, Citrullus lanatus
  misc_feature (58)..(58): Xaa can be any naturally occurring amino acid
  misc_feature (84)..(84): Xaa can be any naturally occurring amino acid
  misc_feature (89)..(89): Xaa can be any naturally occurring amino acid
  misc_feature (99)..(99): Xaa can be any naturally occurring amino acid
DLTPRQVEVWFQNRRARTKLKQTEVDCEYLKRCCENLTEENRRLQKEVQELRALKLSXQLYMHMNPPTTLTMCPQCERVAVSSXSSASXATTTRHPAAXSVQRPSMAINPWAVLPIQR

SEQ ID NO: 25505 - protein, 235 aa, Geobacillus kaustophilus
MSVISMKQLLEAGVHFGHQTRRWNPKMKKYIFTERNGIYIIDLQKTVKKVEEAYNFVRELAANGGKILFVGTKKQAQESVKEEAERCDMFYVNQRWLGGTLTNFATIQKRIKRLREIEKMEEDGIFDVLPKKEVIRLKKEKERLEKFLGGIKDMKELPDALFVIDPRKERIAVAEARKLNIPIIGIVDTNCDPDEIDYVIPANDDAIRAVKLLTSKIADAVLEAKQGEEAAVAAE

SEQ ID NO: 25506 - protein, 510 aa, Eustoma grandiflorum
MAVGNGVLLHIAASLMLFFHVQKLVQYLWMNSRRHRLPPGPIGWPVLGALRLLGTMPHVALANMAKKYGPVMYLKVGSCGLAVASTPEAAKAFLKTLDMNFSNRPPNAGATHLAYNAQDMVFADYGPRWKLLRKLSNIHILGGKALQGWEEVRKKELGYMLYAMAESGRHGQPVVVSEMLTYAMANMLGQVMLSKRVFGSQGSESNEFKDMVVELMTVAGYFNIGDFIPSIAWMDLQGIQGGMKRLHKKFDALLTRLLEEHTASAHERKGSPDFLDFVVANGDNSEGERLQTVNIKALLLNMFTAGTDTSSSVIEWALAELLKNPIILRRAQEEMDGVIGRDRRFLEADISKLPYLQAICKEAFRKHPSTPLNLPRIASQACEVNGHYIPKGTRLSVNIWAIGRDPSVWENPNEFNPDRFLERKNAKIDPRGNDFELIPFGAGRRICAGTRLGILLVEYILGTLVHSFVWELPSSVIELNMDESFGLALQKAVPLAAMVTPRLPLHIYSP

SEQ ID NO: 25507 - protein, 633 aa, Bacillus anthracis
MCGFVGCLCENPREFSETEKHQFENMNTMIFHRGPDDEGYFRDEHVQFGFRRLSIIDLEAGHQPLTYENDRYVIIFNGEIYNYVELREMLLEKGATFATQSDTEVIIALYAHMKEKCVDYLRGMFAFMIWDREEKKLFGARDHFGIKPLYIAQQGDTTFFASEKKSIMHVMEDKGVNPTSLQHYFTYQYGPEPETLTIDVNKIEPGHYFVKEIGKEMEIHRYWKPYFNASSATKEEHIQAIRDVLYDSVKVHMRSDVPVGSFLSGGIDSSIIASIAREMNPNLLTFSVGFEQRGFSEVDVAKETAEKLGVKNHNVFISAKEFMDEFPKIIWHMDDPLADPAAVPLYFVAKEARKHVTVVLSGEGADELFGGYNIYREPNSLKMFSYIPSPGKSVLKALSGALKEGFKGKSFLERGCTPIEERYYGNAKIFREEEKAELMKYYNESVNYMDITKPLYNEIKDYDDVSKMQYIDMFTWLRGDILLKADKMTMANSLELRVPFLDKEVFDVASKIPTEFKIANGTTKAILREAARGIVPDHVLDRKKLGFPVPIRHWLKDEMHDWAINIINESKTEHLIDKQYVLNLLEAHCADKGDYSRKIWTVLAFMVWHQIYVEHKYDTNKFHEETKRAYSLV

SEQ ID NO: 25508 - protein, 246 aa, Arabidopsis thaliana
MSNNQAFMELGWRNDVGSLAVKDQGMMSERARSDEDRLINGLKWGYGYFDHDQTDNYLQIVPEIHKEVENAKEDLLVVVPDEHSETDDHHHIKDFSERSDHRFYLRNKHENPKKRRIQVLSSDDESEEFTREVPSVTRKGSKRRRRDEKMSNKMRKLQQLVPNCHKVDGQGFGSRQDHRVYEKPSTSTSDDVNSGGESLFSSGDIRIWNAQPHADGNGFGSRPKSGESHDAIAANSGVKLAITTVY

SEQ ID NO: 25509 - protein, 257 aa, Escherichia blattae
MTHAIDRHCVWFVGAGPGDCELITVKGLRLLQQADVVIYAGSLINPQLLDYCPAQARCHDSAGLHLQQIIDLMREGIAAGKLVVRLQTGDLSLYGSIREQGEALSQLQIPWQVVPGVSAFQGAAAQLGLEYTVPEVSQSLIITRMEGRTPMPARESLAGFAAHRTSMAIYLSVQRINKVAEQLIAGGYRPETPVAVVYKATWPESQTLRGTLADISEQVRAADIRKTALILVGDFLGDEYHNSKLYDAAFSHEYRKA

SEQ ID NO: 25510 - protein, 158 aa, Geobacillus kaustophilus
MSVYEFSVKTIRGEEQPLSAYRGKVLLIVNTASRCGFTPQYKELQELYDEYRDRGFVVLGFPCNQFGGQEPGTEAEIEQFCQLNYGVTFPLFAKVDVNGDHAHPLFQYLKEEAPGALGTKAIKWNFTKFLVDRHGRVVARFAPQTKPSELKEDIEKLL

SEQ ID NO: 25511 - protein, 353 aa, Arabidopsis thaliana
MSSPVKKMKKKTTTSPILSPTPHSTQILSLPVDLLISILARVSRLDYPILSLVSKSFRSLIASPELYETRSLLGRTESCLYLCLGIPSDFNPRWFTLCRKPKPSGHVMAAISIPNSRPVHCSGLVAVGSDIYNIGGSIINEHSSSVSILDCRYHTWRDAPNMLVERNSHAANVIDGKIYVAGGSRDSNSSNWMEVFDIKTQTWEPVLNPIADGCDRRIRKSAVIEEAICLFGMGMASCCVIDNVLYCYSNIDGIKLYDSKIGCWMKLKGLEGLPEFASYSYVRLADYGGKMAVLWDKLPTTGNNNMVIWCAVITLEKRHNENIWGRVEWFDAVLTVPEPYEFQCVDWLGCSHS

SEQ ID NO: 25512 - protein, 181 aa, Impatiens balsamina
MYMRKRSSSSSSTEPLAVGRVIGDVIDPFVLSVKMLVTYNNKQVYNGYELFPSQITSKPRVEVHGGDLRTFYTLVMTDPDVPGPSDPYLKEHLHWMVTDIPGTTDATFGKEMVKYEMPMPNIGIHRFVFVLFKQRCRQSVQPPSSREHFNTRRFAADNDLGQPVAAVFFNAQRETAARCRR

SEQ ID NO: 25513 - protein, 377 aa, Arabidopsis thaliana
MAVSFVTTSPEEEDKPKLGLGNIQTPLIFNPSMLNLQANIPNQFIWPDDEKPSINVLELDVPLIDLQNLLSDPSSTLDASRLISEACKKHGFFLVVNHGISEELISDAHEYTSRFFDMPLSEKQRVLRKSGESVGYASSFTGRFSTKLPWKETLSFRFCDDMSRSKSVQDYFCDALGHGFQPFGKVYQEYCEAMSSLSLKIMELLGLSLGVKRDYFREFFEENDSIMRLNYYPPCMKPDLTLGTGPHCDPTSLTILHQDHVNGLQVFVENQWRSIRPNPKAFVVNIGDTFMALSNDRYKSCLHRAVVNSKSERKSLAFFLCPKKDRVVTPPRELLDSITSRRYPDFTWSMFLEFTQKHYRADMNTLQAFSDWLTKPI

SEQ ID NO: 25514 - protein, 482 aa, Brevibacterium flavum
MNANVRVFILNSLAMNDPQRPPTLLWFRDDLRLSDNAALKWAADHGPVIGLFIDETINRSIGAAARWWREQSLNALAQDLSFYGVPLLRRTGNPLEILPKIVSEMEVKAVTWNRRYHQPLCEVDATLKKNLRDQGIEVHSHPGFLLTEPWEVSTATGTPYKVFTPFSKAAWEVARGHAYETVKNNVTVPSHLTGPEGVELPIPEMEQPFWATTLVKECAPGEKNASEKLFDFLEHLQDYPQARDSLARSATSKLSAHLRFGEISIHRVWAETAAIDSEGTELFLKELLWRDFAWHRLYALPHMDTQNVRMQFNRFGWSWDPSEKDKLNTPSTPLIPTKADQFHEDLAAWRAGKTGIPLVDAGMRELWATGSMHNRVRMVVASFLTKNLQIHWRHGEEWFWETLVDADPASNAFNWQWAAGSGDDASPYFRIFNPVTQAKKFDPDETYIRRWVPEYGTPSYPDPIVDLKESRQIALDAYSAIK

SEQ ID NO: 25515 - protein, 377 aa, Arabidopsis thaliana
MAVSFVRTSPEEEDKPKLGLGNIQTPLIFNPSMLDLQANMANQFHWPDDEKPSTLQLELDVPLIDLQNLLSDPSSTLDASRLISEACKKHGFFLVVNHGISEELISDAHEYTSRFFDMPLSEKQRVLRKSGESVGYASSFTGRFSTKLPWKETLSFRFCDDMSRSKSVQDYFCDALGHGFQPFGKVYQEYCEAMSSLSLKIMELLGLSLGVKRDYFREFFEENDSIMRLNYYPPCIKPDLTLGTGPHCDPTSLTILHQDHVNGLQVFVENQWRSIRPNPKAFVVNIGDTFMALSNDRYKSCLHRAVVNSERMRKSLAFFLCPKKDRVVTPPRELLDSITSRRYPDFTWSMFLEFTQKHYRADMNTLQAFSDWLTKPI

SEQ ID NO: 25516 - protein, 271 aa, Arabidopsis thaliana
MAVSFVTTSPEEEDKPKLGLGNIQTPLIFNPSMLNLQANIPNQFIWPDDEKPSINVLELDVPLIDLQNLLSDPSSTLDASRLISEACKKHGFFLVVNHGISEELISDAHEYTSRFFDMPLSEKQRVLRKSGESVGYASSFTGRFSTKLPWKETLSFRFCDDMSRSKSVQDYFCDALGHGFQPFGKVYQEYCEAMSSLSLKIMELLGLSLGVKRDYFREFFEENDSIMRLNYYPPCMKPDLTLGTGPHCDPTSLTILHQDHVNGLQVFVENQ

SEQ ID NO: 25517 - protein, 256 aa, Geobacillus kaustophilus
MTVGKVYLVGAGPGDEKLITVYGRECLERADVIIYDRLINRKLLRYAKPDAELLYCGKEPGKHDTVQEQIHELLVWHAQQGKTVVRLKGGDPCIFGRVGEEAEVLVKAGIPFEIVPGVTSGIAVPAYAGIPVTHRDYAASVAMVSGHRSERIDWEALTRGCDTIIVYMGAANLSDICGRLMAAGKPSDTPAAIIEWGTTERQRTVAATLSTLSDEAEQAGISHPAIIIIGDVVRLRETLQWFPERQGGVVDADASS

SEQ ID NO: 25518 - protein, 332 aa, Staphylococcus aureus
MTKITVFGMGSFGTALANVLAENGHDVLMWGKNQEAVDELNTCHTNKKYLKYAKLDVNIIATSDMTKAIQYADIYLMALPTKAMREVATQINDKLTSKKTFIHVAKGIENGTFKRVSEMIEDSISPEYNAGIGVLSGPSHAEEVVVKQPTTVAASSKDKNVSKLTQDLFMNDYLRVYTNDDLVGVELGGALKNIIAVASGIVAGIGYGDNAKAALMTRGLAEISRLGEKLGADPMTFLGLGGIGDLIVTCTSTHSRNFTLGYKLGQGESMDQALSEMNMVVEGIYTTKSVYHLAKEKNVDMPITNALYRVLFENISVKECVKDLMERDKKSE

SEQ ID NO: 25519 - protein, 150 aa, Bradyrhizobium japonicum
MRYLHTMLRVRNLDVALKFYQDALGLKEVRRIENDKGRFTLVFLCSADDLEALKKQPQTRGAPLVELTYNWDEEKYGEDRFFGHLAYEVDDIYATCEKLMKAGVTINRPPRDGNMAFVRSPDLHSIELLQKGEPKAPQEPWSSMPNTGHW

SEQ ID NO: 25520 - protein, 790 aa, Triticum aestivum
MTMMAMPEAPCLCARPSLAARARRPGSGPAPRLRRWRPNATAGKGVGEVCAAVVEAATKVEDEGEEDEPVAEDRYALGGACRVLAGMPAPLGATALAGGVNFAVYSGGATAAALCLFTPEDLKADRVTEEVPLDPLMNRTGNVWHVFIEGELHNMLYGYRFDGTFAPHCGHYLDVSNVVVDPYAKAVISRGEYGVPARGNNCWPQMAGMIPLPYSTFDWEGDLPLRYPQKDLVIYEMHLRGFTKHDSSNVEHPGTFIGAVSKLDYLKELGVNCIELMPCHEFNELEYSTSSSKMNFWGYSTINFFSPMTRYTSGGIKNCGRDAINEFKTFVREAHKRGIEVILDVVFNHTAEGNENGPILSFRGVDNTTYYMLAPKGEFYNYSGCGNTFNCNHPVVRQFIVDCLRYWVTEMHVDGFRFDLASIMTRGSSLWDPVNVYGAPIEGDMITTGTPLVTPPLIDMISNDPILGGVKLIAEAWDAGGLYQVGQFPHWNVWSEWNGKYRDIVRQFIKGTDGFAGGFAECLCGSPHLYQAGGRKPWHSINFVCAHDGFTLADLVTYNKKYNLPNGENNRDGENHNLSWNCGEEGEFARLSVKRLRKRQMRNFFVCLMVSQGVPMFYMGDEYGHTKGGNNNIYCHDSYVNYFRWDKKEQYSELHRFCCLMTKFRKECEGLGLEDFPTAKRLQWHGHQPGKPDWSENSRFVAFSMKDERQGEIYVAFNTSHLPAVVELPERAGRRWEPVVDTGKPAPYDFLTDDLPDRALTIHQFSHFLYSNLYPMLSYSSVILVLRPDV

SEQ ID NO: 25521 - protein, 391 aa, Staphylococcus aureus
MTEEFNESMINDIKEGDKVTGEVQQVEDKQVVVHINGGKFNGIIPISQLSTHHIDSPSEVVKEGDEVEAYVTKVEFDEENETGAYILSRRQLETEKSYSYLQEKLDNNEIIEAKVTEVVKGGLVVDVGQRGFVPASLISTDFIEDFSVFDGQTIRIKVEELDPENNRVILSRKAVEQEENDAKKDQLLQSLNEGDVIDGKVARLTQFGAFIDIGGVDGLVHVSELSHEHVQTPEEVVSIGQDVKVKIKSIDRDTERISLSIKDTLPTPFENIKGQFHENDDIEGVVVRLANFGAFVEIAPGVQGLVHISEIAHKHIGTPGEVLEPGQQVNVKILGIDEENERVSLSIKATLPNEDVVESDPSTTKAYLESEEEDNPTIGDMIGDKLKNLKL

SEQ ID NO: 25522 - protein, 567 aa, Triticum aestivum
MADDAASAPPTAQLAAASISSPPSSDLEPPTSRTRIRAILDAGDAMAGERVVVGGWVKTGRQQGKGEFAFLEVNDGSCQGNLQVMVEKDVAPARKPHPHGAPPVLVEGVLKKPPAEAKQRIELKVERVIELGEVDAAAYPLPKTKITLETLRDFVHLRARTNTIGAVARIRHQLAYATHSFFDENGFLYIHTPIITTSDCEGAGEMFQVTALFSQAEKVEKELKENPAPSEADVEAAKLVVKEKGDAVAQLKAAKASKQEITAAVSVLTKAKENVLRVEERSKLKPGLPLKGDGKIAFENDFFKRQAFLTVSGQLQVETYACALSNVYTFGPTFRAENSHTSRHLAEFWMVEPEIAFANLQDDMNCAERYVQYLCKWLLKHCREDMEFMVKHVDKTAIERLELVSSTPFERISYTKAVEILEGVDKKFENKVEWGIDLASEHERYLTEVIFKRPVIVYNYPKGIKAFYMRLNDDQKTVAAMDVLVPKVGELIGGSQREERLDILKQRILDADLPLEPYEWYLDLRRFGSVKHSGFGLGFERMILFATGLENIRDVIPFPRYPGRADL

SEQ ID NO: 25523 - protein, 497 aa, Xylella fastidiosa
MSEEILVNVTFGETRVAVVENGLLQELHIERDGCRGVVGNIYKGRVQRVMPGMQAAFVDVGMERTAFLHVNDVVRSAPADSSVIDTDETTVPPLSEIPIVELLRDGQELMVQVLKEPIGTKGARLTTQISIPSRYLVLLPQSKMVGVSLRIEDEAERARLKAVVTDLAAQYGDYGYIVRTNAEGQSADVLVEDIAYLSRLWGVVERRGRELPVCSLLYEDLSLSLRSVRDLIRKDVEKIKVDSKEAFAQLQGFVTKYMPVLADKLELYVGDHPIFDLYGVEDEIGRALDRQIPLKSGGYLVIEQTEAMTTVDVNTGSFVGKRTLEETVFRTNLEAAQALARQLRLRNLGGIIVIDFIDMQDAEHRCQVLRVLEKALIRDHAKTKVYDFSPLGLVEMTRKRTVESLQRQLSETCQECGGRGTIKTAETVTYEIFRDITRAVRQFDAVRLLVIASPNVVSRMTDEESAAVAELEAVLGKAIRFQADPHYLQEQYEVVLL

SEQ ID NO: 25524 - protein, 330 aa, Desulfovibrio vulgaris
MKIAVLGGGSWGTALAHLLAGKGEDVRLWVRDPAVVEGVNRDHENPRYLKGLHLHEALRATCDAGEALEGADILLSVVPCQQTRTVLRSLRPRLKTGMVVVSASKGIETDGLRTVGEMVEDELAGLAPRYAVISGPSFAAEVVAGMPTAVVLGCADRDLGGTLREVFSTPTFRTYSCTDVRGVELGGAVKNVIAIAAGLSDGLGFGSNARAGLITRGLAEMGRLGVALGARGSTFMGLSGLGDLVLTCTGDLSRNRQVGLRLAEGQGLDAIVAGMGMVAEGVKTTEAVYELAQREGVDLPITQAMYAVLHDGRDPRDMVQELMTRELREE

SEQ ID NO: 25525 - protein, 176 aa, Camellia sinensis
MAASIISSAVVAPAQASMAAPFTGLKSTSAFPVTRKLDTDITSLASNGGRVQCMKVWPPLGLKKFETLSYLPPLTQAQLGKEVDYLIRLGWIPCLEFSVQGGFVYREHNKSPGYYDGRYWTMWKLPMFGCTDSSQVLKEVEECKKEYPQSFIRIIGFDNKRQVQCISFICYKPPGF

SEQ ID NO: 25526 - protein, 595 aa, Neurospora crassa
MDPQPAQQPAEATPDGHGAPAPVALTKTRTESFSAKSENSQTAADFIRDQMQLEADAREALPYSILTSHQSIETCTKPLGPLRQAVFSCLTCNPPPADPKAPYNAAGICYSCSVQCHGEHTLVEIFAKRNFTCDCGTTRFPPTSPCNLRINEETGTKGGVHSEEPDVNNKYNHNFRNRFCGCECDYDPFEQKGTMFQCLGLGTAETGGCGEDWYHPGCIVGLGPDWFEKMDKKDKPKSAALKTEVKTENGALPTIAEDETTEQNGAHAEEAEEDEDEDDDPPPPPGFPADDDFEGFICYKCVEAYPWIKRYAGTEGFLPPVYLKKEEQTISTTSELKVNGNSSSKKRKASDEDNEHIEESQEKKPKTDETVHSTTTAITTTESLTTNGSSTITSTTNTTTLTTTDSSTTTPHPNPNPKPCLLSSLPPPPSQTSQNSPFSLFFTTPSFRSLLCHCPHCFPLLIPHPHLLEEEDTYEPPVSETSSSSPSHSLHGGGGGGSSSKGSGSVLERGESALRNIDRVRAIEGVMAYNHLKDKLKPFFREFAESGRAVSAEDIKAYFAKLRGDDEVRTGGSGEMEEEEEKGVNGDGRKEQDGY

SEQ ID NO: 25527 - protein, 325 aa, Saccharophagus degradans
MPNPSLLNLLTGDLPQLAATVQHQRLNWRVADEAGVAVYLRRDDAIHAKLSGNKLYKLHGHLQAYFESAHSKQPIASFGGAYSNHLYALAAAGQILGIPTIAVIRGERPKGAAPTLDDLEAMGMRLHFISRERYKLRNDQALLMALNLELGEPCFWVPEGGAGLLGNTGCQVLGASCSEFLQRVTPNESDAYVVMACGTGTTFSGVVNGVGPSVQVLGVPVLKVGGEYKAEIAAAIGANTRWKLLEDGHCGGYAKFPEYLLKFMVETELEVGVQLDPVYTAKMLYSLATAIKQGKFARGSHIVAIHSGGLQGRRSVEKQLMELYV

SEQ ID NO: 25528 - protein, 359 aa, Capsicum annuum
MGTAIILLGLLAANIDIAGGQSIGVCYGMLGNNLPPASQVVQLYKSRNIRRMRLYDPNQAALQALRGSNIEVMLGVPNSIFKTLLPPFNAILGSKECQNSGHCLNYRVHCCEMKSALLTGTSSLTRFLLPAMRNIRNAISSAGLGNNIKVSTSIDMTLIGNSFPPSQGSFRNDVRSFIDPIIVFLRGINSPLLVNIYPYFSYAGNPRDISLSYALFTAPNVVVQDGSLGYRNLSDERLDSVTAALSQARGGSVEIVVSESGWPSAGAFATTTNDAAAYYKNLIQHVKRGSPRRPNKVIETYLFAMFDENNKNPELEKHFGGFSPNKQPKFPLNFGFSDRFLDIFAENNNATSTFFKSDI

SEQ ID NO: 25529 - protein, 195 aa, Haloarcula marismortui
MTDRTAAVTRTTAETDIEVTLDVDGDGDSTIDTGIGFFDHMLDSFSTHGLFDLTVQCDGDLDIDDHHTVEDVAITLGEAFTEALDDKRGIRRFADRKVPLDEAVASVVVDISGRPYFEFDGEFSQASVGGMTSHMAKHFCRSLSMNAGLTLHCGVDGENAHHEIEALFKSLARSLDDATRIDERRSDVASTKGEL

SEQ ID NO: 25530 - protein, 375 aa, Ureaplasma parvum
MAKRDYYEILGVSKSATPEEIKAAFRKLAKEHHPDRNKSADDTLFKEINEAYEVLSDSKKRAQYDQFGHDGPQGFSSASGFSGFSGGFGGVDFDINDIFGSFFNNASSSHNSSNQYETYDIHLRLHLDFMEAVNGISKNINYDRKITCHKCQGTGAKDPKDVKICTKCHGRGTSIENVHSLFGTIQQEVECHECEGTGKVASSKCEQCYGKKVINERVNLTVEIPAGTREGEKLLVSKKGNIVNNQEFDLYLHISVKPSKYFALDGLDIYSETYIDPIKAIVGGIIEVVTINGIKTIEIPSNTPEGKKFRISGSGIVNKKSNIFGKKNGDFYTTIRYAKPVELSKDEIAYLKNISTRTNQNVEYYKNKVLKEISK

SEQ ID NO: 25531 - protein, 92 aa, Glycine max
  misc_feature (8)..(8): Xaa can be any naturally occurring amino acid
  misc_feature (19)..(19): Xaa can be any naturally occurring amino acid
  misc_feature (33)..(33): Xaa can be any naturally occurring amino acid
  misc_feature (45)..(45): Xaa can be any naturally occurring amino acid
  misc_feature (54)..(54): Xaa can be any naturally occurring amino acid
  misc_feature (70)..(70): Xaa can be any naturally occurring amino acid
  misc_feature (74)..(74): Xaa can be any naturally occurring amino acid
HISFFQSXLFADPVGYGLXRALAQTHQDEILTXAARTIDSSFRNXHADSYVSVXDSKLFAYAYRNIIMTXGTTXLQPALGPILKIAEMLSLT

SEQ ID NO: 25532 - protein, 289 aa, Legionella pneumophila
MSNYLDKTASLTPATKRIVCNKATEYPHTGSYNQVATHGTYLCRRCGLALFRGVSQFSSGCGWPSFDDEIANAVARKPDADGQRTEILCARCDAHLGHVFTGEYMTYKNLRHCVNSASLDFVADNEVLDTEEAILAGGCFWGVEYYLKRIPGVLKVESGYTGGHVSEPSYEQVCSGTSGHYEAVRVVYNSAKTNYHDIVKRFFEIHDPTQANGQGPDLGHQYLSAVFYFNQEQLQEAELLIQLLKKRGYQVVTQLLQAQPFWPAEDYHQDYYFKHHKIPYCHKPVDRFG

SEQ ID NO: 25533 - protein, 130 aa, Unknown
  Oceanospirillum sp. MED92
MRLLHTMLRVTDLKASIEFYTELMGMQLLRSKDYPEGKFTLAFLGYGDEAEHTALELTHNWDTDAYDLGNGFGHLAIEVDDVYAACDAIKAKGGEVVREAGPMKHGSTVLAFVKDPDGYMIELLGSKRSD

SEQ ID NO: 25534 - protein, 468 aa, Escherichia coli
MSKQQIGVVGMAVMGRNLALNIESRGYTVSIFNRSREKTEEVVAENPGKKLVPYYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLSNEELATTFTEWNEGELSSYLIDITKDIFTKKDEDGNYLVDVILDEAANKGTGKWTSQSSLDLGEPLSLITESVFARYISSLKDQRVAASKVLSGPQAKLAGDKAEFVEKVRRALYLGKIVSYAQGFSQLRAASDEYNWDLNYGEIAKIFRAGCIIRAQFLQKITDAYAENKGIANLLLAPYFKNIADDYQQALRDVVAYAVQNGIPVPTFSAAVAYYDSYRAAVLPANLIQAQRDYFGAHTYKRTDKEGAFHTEWLD

SEQ ID NO: 25535 - protein, 379 aa, Arabidopsis thaliana
MEYGEEPSIKRFLMLPDDLVFNCLARVSRLHYPTLSLVSKKFRFLLASKELYQTRILLGGTESCLYVCVRLHTDSEQLHWFIIYQGPNSSKKVLVPISSPNFTSAALPGFVVVGHEIYAIGGGSENKNASINATGSKTYNALSSVMVMDSRSHTWREAPSMRVARVFPSACTLDGRIYVTGGCENLNSMNWMEIFDTKTQTWEFLQIPSEEVCKGSEYLSISYQRTVYVGSREKDVTYKMHKGKWRGADICLNHGWSLDPSSCCVIENVFYRCSLGDVRWYDLKKREWAALKGLEGLPTFTNYYRNFKSADHCGKLAISWEEYVLVDDETKIWCAEIAIQKRQNGEIWGTLEWFDNVFISSGPNRHVDLLVNALTATVW

SEQ ID NO: 25536 - protein, 467 aa, Oryza sativa
MEDVAVAAALAPAPATAPVFSPAAAGLTLIAAAAADPIAAVVAGAMDGVVTVPPVRTASAVEDDAVAPGRGEEGGEASAVGSPCSVTSDCSSVASADFEGVGLGFFGAAADGGAAMVFEDSAASAATVEAEARVAAGARSVFAVECVPLWGHKSICGRRPEMEDAVVAVSRFFDIPLWMLTGNSVVDGLDPMSFRLPAHFFGVYDGHGGAQVANYCRERLHAALVEELSRIEGSVSGANLGSVEFKKKWEQAFVDCFSRVDEEVGGNASRGEAVAPETVGSTAVVAVICSSHIIVANCGDSRAVLCRGKQPVPLSVDHKPNREDEYARIEAEGGKVIQWNGYRVFGVLAMSRSIGDRYLKPWIIPVPEITIVPRAKDDECLVLASDGLWDVMSNEEVCDVARKRILLWHKKNGTNPASAPRSGDSSDPAAEAAAECLSKLALQKGSKDNISVIVVDLKAHRKFKSKS

SEQ ID NO: 25537 - protein, 541 aa, Coprinopsis cinerea
MEEDDEGRFFGGGLTSEQKEILNIFDKAGDSAEPEDPLSLPAIRRSLLRLERAINKNQDQRSKYPDDPTKFIDSEADLDSAIKALLPLSQAPALAYKELVRSGTIAQLVGLFTHENVDIVIDVVELLYELTDDDVTDESDEESETALKELIESLVDLSVLDLLVENLPRLNEAEESDRQGVFHILGVFENILGFNPDLATTLVEKTKLLPWLLNRIQGKTHDENRGYSAEILSILLQNSTPNRLAFGREDGVETVLKLLSHYRRREPADADETEYMENLFVTLCSALAEPSIKQLFLEAEGHDLMVLMMKEKLQSRSRAIKALDHAMSGPRGVHVCNAFVDALGLKTLFAAFMGKASKKGKSTAALPDSEDVNHMLGIISSLLSNLESESINRIRLLAKFVENNYEKVDKLLDIREAARSRLSQTDKDIAQEKEELDEDDDILADEDVIYLRRLDGGLFTLKMVDYILAWIVMEDDGIQAHVVRMLSRKNQSLGDIVATLRIFHDNVDEVPPDVDDSGYMPSQKEILENLIKALSPASNQQ

SEQ ID NO: 25538 - protein, 305 aa, Arabidopsis thaliana
MADRIKGPWSPEEDEQLRRLVVKYGPRNWTVISKSIPGRSGKSCRLRWCNQLSPQVEHRPFSAEEDETIARAHAQFGNKWATIARLLNGRTDNAVKNHWNSTLKRKCGGYDHRGYDGSEDHRPVKRSVSAGSPPVVTGLYMSPGSPTGSDVSDSSTIPILPSVELFKPVPRPGAVVLPLPIETSSSSDDPPTSLSLSLPGADVSEESNRSHESTNINNTTSSRHNHNNTVSFMPFSGGFRGAIEEMGKSFPGNGGEFMAVVQEMIKAEVRSYMTEMQRNNGGGFVGGFIDNGMIPMSQIGVGRIE

SEQ ID NO: 25539 - protein, 940 aa, Medicago truncatula
MKGEKAKDDALKDWKFSTSASAHCSFSGVKCDEDQRVIALNVTQVPLFGHLSKEIGELNMLESLTITMDNLTGELPTELSKLTSLRILNISHNLFSGNFPGNITFGMKKLEALDAYDNNFEGPLPEEIVSLMKLKYLSFAGNFFSGTIPESYSEFQKLEILRLNYNSLTGKIPKSLSKLKMLKELQLGYENAYSGGIPPELGSIKSLRYLEISNANLTGEIPPSLGNLENLDSLFLQMNNLTGTIPPELSSMRSLMSLDLSINGLSGEIPETFSKLKNLTLINFFQNKLRGSIPAFIGDLPNLETLQVWENNFSFVLPQNLGSNGKFIYFDVTKNHLTGLIPPELCKSKKLKTFIVTDNFFRGPIPNGIGPCKSLEKIRVANNYLDGPVPPGIFQLPSVQIIELGNNRFNGQLPTEISGNSLGNLALSNNLFTGRIPASMKNLRSLQTLLLDANQFLGEIPAEVFALPVLTRINISGNNLTGGIPKTVTQCSSLTAVDFSRNMLTGEVPKGMKNLKVLSIFNVSHNSISGKIPDEIRFMTSLTTLDLSYNNFTGIVPTGGQFLVFNDRSFAGNPSLCFPHQTTCSSLLYRSRKSHAKEKAVVIAIVFATAVLMVIVTLHMMRKRKRHMAKAWKLTAFQKLEFRAEEVVECLKEENIIGKGGAGIVYRGSMANGTDVAIKRLVGQGSGRNDYGFKAEIETLGRIRHRNIMRLLGYVSNKDTNLLLYEYMPNGSLGEWLHGAKGCHLSWEMRYKIAVEAAKGLCYLHHDCSPLIIHRDVKSNNILLDADFEAHVADFGLAKFLYDPGASQSMSSIAGSYGYIAPEYAYTLKVDEKSDVYSFGVVLLELIIGRKPVGEFGDGVDIVGWINKTELELYQPSDKALVSAVVDPRLNGYPLTSVIYMFNIAMMCVKEMGPARPTMREVVHMLTNPPHSTSHNLINL

SEQ ID NO: 25540 - protein, 457 aa, Escherichia blattae
MDHLPIFCQLQNRACLLVGGGDVAERKARLLLEAGARLTVNALAFTPQFHVWASAQALTLAEGEFAPHLLDNCWLAIAATDDDAVNQEVSHQAEQRRIFCNVVDAPARASFIMPSIIDRSPLMVAVSSGGTSPVLARLLREKLESLLPQHLGQVASYAGALRNRVKQSFKTVAERRRFWEKFFVNDRLAQSLANQDLRAVEQATDALLSEPLDHRGEVVLVGAGPGDPGLLTLKGLQQIQQADVVVYDRLVSDEIMNLVRRDADRVFVGKRAGYHCVPQDEINQILLREARSGKRVVRLKGGDPFIFGRGGEELETLCTENIPFSVVPGITAASGCSAYAGIPLTHRDYAQSVRLVTGHLKTGGELDWANLAAEKQTLVFYMGLSQAGTIQRQLLAHGMEADMPVALVENGTAVRQRVVSGTLEQLEQLAGQVASPALIIVGRVVALRDKLNWFSNH

SEQ ID NO: 25541 - protein, 140 aa, Bacillus anthracis
MGYIEELRKVVGSRPLNLAGVAVAVFNEQGQILLQQRQNGIWGVPGGFVELGESTEEAGRREVFEETGVEIGTLQLISVFSGKEFFVKLPNGDEFYPITIAYLCKDIKGGLLKADGIESLSVQFFDFDKLPENISPFIKN

SEQ ID NO: 25542 - protein, 280 aa, Oenococcus oeni
MTKNNCEEILNDIYNLILNPATSAWERSLLSSAKNAIGEDMNFERQLSKLEFELRPLAVRNNLTADVTDFYMKITGNSPDHLQFDFSKHYAKDLSYQDRAIFAGGCFWCMVEPFENERGIVSVLSGYTGGHVDHPTYEQVVSGYTGHVEAVEIIFDTRIIQYTELLDLYWQITDPTDEFGQINDHGDNYRPVIFVRNEEQRKIAESSKLKLAESGMYNRPIVTAIEPATKFWPAENFHQQFYKKNPKKYKIIEKSRQRYLAFQHLQGRIRLGLKGLTKKH

SEQ ID NO: 25543 - protein, 257 aa, Geobacillus kaustophilus
MKLYIVGAGPGAPDLITVRGAELLAAADAIFYTDSLVSAELIERYRKPDADVFHTAGMHLEEMVAAMAEQVKQGRLVVRVHTGDPSIYGATLEQIALLKEEGIEVEIVPGVSSAFAAAAAVQAELTVPELTQTVIFTRAEGRTPMPPREKLQELAQHHCTLVLFLSATLAKKVSAALLEAGWSGDTPVAIVYKATWPDEVVIRSTVATMADDMRRHGVTKHAIMLAGWALDPHIHERGYRSKLYDRTFTHGYRKGEK

SEQ ID NO: 25544 - protein, 450 aa, Chlamydophila abortus
MELQKAGQMIENDFQGYPSSYQVSHFYRDKVGVIVLCGGEGRRLSPLTCWRCKPTVSFGGRYKLIDVPISHAIASGFSKIFVIGQYLTYTLQQHLMKTYFYHGVLQDQIHLLAPEGRDGSQVWYQGTADAIRQNLLYLEDTEIEYFLVLSGDQLYNMDFRRIVDYALYAKSDMVIVAQPIQEKDASRMGVLQIDKDGNLLDFYEKPQEQEILNRFRLSPADCRRHKLDPQYGNFLGNMGIYLFRRESLFQLLLEEPGDDFGKHLIQAQIQRGTVKTFLYDGYWTDIGTIESYYEANIALTQRPRPHVRGLNCYDDRGMIYSKNHHLPGTIVSDSMISNSLLCEGAVIDSSKVSHSVVGIRGVIGKNSVIDHSVVMGNDRYGNTLQTPLGIGDNCEIYKTIIDENCRIGNGVKLTNIKGYKDYDSPDGKLVVRDGIIIIPRGTRIPNNYTF

SEQ ID NO: 25545 - protein, 413 aa, Ostreococcus tauri
MGRTRRDGAAATTVSATRRTRGEDGRGRRTRTHAGAYEAFKAGVSEEDRASIVGEWDKIMRWAAFVESAHARNDESVLKSAKKVAIMGGGSFGTAMATLLARNKGDLDVVILMRSDKDAASLNAEHRNLKYLPKYDLPVNIRATTDAREALSGSDFIIHAVPVQQSRAFLSGVKDFIDPKTPLLCLSKGLETGTCEMMSEIIPAGLGRDQPLAVLSGPTFAVELMQGLPTTIVAASEDEGLAIRVQQLFGSSCLRVNTSTDVTGVELSGAMKNVLAIAAGIVEGLELGNNAMASLVAQGVTEIRWLAGKLGARPETLAGVSGTGDIMLTCFVNLSRNRTVGVRLGSGESLEEILGSMSQVAEGVATAGAVVRLARRHRVNLPVLTAVACILDGDMDAKTAVDKIINLPQVPEV

SEQ ID NO: 25546 - protein, 300 aa, Unknown
  Rhodococcus sp. RHA1
MAVVTMKQLLDSGTHFGHQTRRWNPKMKRFIFTDRNGIYIIDLQQTLTYIDKAYEFVKETVAHGGTVLFVGTKKQAQESIAAEATRVGMPYVNQRWLGGMLTNFTTVHKRLLRLKELEAMEQTGGFEGRTKKEILMLTREMTKLDRTLGGIRDMAKVPSAVWVVDTNKEHLAVAEARKLNIPVIAILDTNCDPDLVDYPIPGNDDAIRSAALLTKVVASAVAEGVQARAGLSADKDAKPEAGAGEPLAEWEQELLSQAAPAAEAAPAAEAAPAAEAAPAAEAQAAPAAEAPAAEAPSTEA

SEQ ID NO: 25547 - protein, 844 aa, Geobacter sulfurreducens
MVSLTIDGKDITVAKETTILDAAALLGITIPTLCWLKKVSPTGACRVCAVEIEGVDRPMTACNTPVKDGIKVTTQSEKLSRIRQKIMELMLVNHPLDCPVCDAGGECDLQNACYGLGAAKQEYGAVLERRKIRYDWPLIESDPNRCILCEKCVKVDHEIVGCNAIRVVNRGEATIIDTVDGNPLNCEFCGNCVAACPTGTLISKPFKFRGRPWAFTTTPSVCPFCATGCQIEYHSRNGRVERVTSDDSTYNSGNLCINGRFGYSYINSPDRLAEPMVKGQKADWNTAMGTAATALKQIVASHGADAVAGFGSPRVTNEDNYLFQKLMRSAIGTGNIDSEARLGFAATQKVLREMLGIAGASTTIDAIDRATAVLVVGCDLNAEATGMEYRVIKAATKNNAKLVLAAMRDIKLKKFANSHLKYRPGNETLLINALTKAVLEEGLENKEFCSANISNLSDLTAALAGVSIADAAAATGVTEADLRAAARLVGGKKGVAVIFGAELMRGGNTDAVKALINLALILGATAGDTGGLFPVYEKTNIRGLLDMGVAPDHFPGHQTDGTTFEKAWGKKLPAAAGKDLWQIIEGIEQGSVKALYLLGCDPVASFPEGERIRKALEKLELLIVQDPFPGEAAKMAHVVFPSSVAAEKNGTFTTIDGRVQPLAKAVAPSGDAREDWDILTELYNRLTGESRIHSPAAVLDEVAALVPAYASVGRTGGTITAQPRSGGLALAPVSARAVAGSPTTLLVGTILYHSGTTTTWSKNNLEIIPKGYIEIHPNDAAKLGIAEGGKVRLSAGSVKVEGTAKITPRVQPGLLFAPSHFRGMNVNALLSRDGGVVPVTVEKA

SEQ ID NO: 25548 - protein, 417 aa, Buchnera aphidicola
MFIKNKTISNYDADVYRMMKQEYQRQENHIELIASENYVSSCVMEAQGSQLTNKYAEGYPGKRYYGGCDYVDAIEKIAIKRAKKLFNANYANVQPHSGSQANYAVYSALLKPNDIVLGMSLSHGGHLTHGSSVNFSGKLYKFISYGLDISGDIDYPQIRKLAHRYKPKMIVGGFSAYSGICNWKLLREIADEINSYLFVDMAHISGLVAAGLYPNPLKYAHVVTSTTHKTLSGPRGGLILAKGDNVSLFKKLNSSVFPGCQGGPLMHVIAAKAIAFKEAMEPEFKDYQYQVIKNAQEMAKTFISRGYKVVSGKTFNHLLLLDLSNKNITGKRADILLHSANIIVNKNSIPNDLLSPFITSGIRIGTPAITRRGFTELESRQVSNWICDILDNFNNIEISAKVKQKVLNLCSLFPVYK

SEQ ID NO: 25549 - protein, 406 aa, Glycine max
  misc_feature (265)..(265): Xaa can be any naturally occurring amino acid
  misc_feature (279)..(279): Xaa can be any naturally occurring amino acid
MATTSVVPANRRRAANPAEEMDFETTEGVKAIASFEEMGIKDDLLRGIYQYGFEKPSAIQQRAVTPIIQGRDVIAQAQSGTGKTSMIALTVCQVVDTSVREVQALILSPTRELASQTEKVILAIGDFINIQAHACVGGKSVGEDIRKLEYGVHVVSGTPGRVCDMIKRRTLRTRAIKMLVLDESDEMLSRGFKDQIYDVYRYLPPDLQVCLISATLPHEILEMTNKFMTDPVRILVKRDELTLEGIKQFFVAVEREEWKFDTLCXFMIPSLSLKLLYSXNTKRKVDWLTEKMRNNNFTVSSMHGDMPQKERDAIMGEFRAGTTRVLITTDVWARGLDVQQVSLVINYDLPNNRELYIHRIGRSGRFGRKGVAINFVKSDDIKILRDIEQYYSTQIDEMPMNVADLI

SEQ ID NO: 25550 - protein, 450 aa, Desulfovibrio desulfuricans
MTATRFESGSIVLDTTIPNLGPAKIPSPLSYCRFANEEQGLSLFLDHDQVEELGDEVVPLTFEPAGPRRHVYFDTSKTKCAIVTCGGLCPGINDVIRAIVMEAYHNYRVPAVLGIKYGLEGFIPRYGHDVVELTPALVGDIHQFGGTILGSSRGPQSPEEIVDALERMNVNILFMIGGDGTMKAVRSITGEINQRRLKISVIGIPKTIDNDINFISQSFGFETAVDKATEAIQCAHTEAVGAMNGIGLVKLMGRESGFIAAQATLSLKEVNFVLVPETPFTLHGEDGLLNALAQRLRERSHAVIVVAEGAGQHLLSGSHDTDASGNPILGDIATLLRTEIKSHFDKLGIPHTLKYIDPSYIIRSVPANANDRVYCGFLGQNAVHAGMAGKTGMVVAKLMDRYIHLPLDLVTSKRRKLNIISDFWRAVLESTGQSHLAGMVPPEARSCPRA

SEQ ID NO: 25551 - protein, 459 aa, Ipomoea nil
MFDLNLSAVEAIGDRGVAASEKVLELSGTSNSSVVNAETSSTAGDDEYSCSDGYAFEILRREEDGKEYGESENRGGFETMELFPLSGGEAALFNQQQQQWLDLSANYGIVADPRIMILPPQRPQVKKSRRGPRSRSSQYRGVTFYRRTGRWESHIWDCGKQVYLGFDTAHAAARAYDRAAIKFRGLDADINFNVTDYEEDLQQMKNLTKEEFVHILRRQSTGFSRGSSKYRGVTLHKCGRWEARMGQFLGKKYIYLGLFDSEIEAARAYDKAAIKLSGREAVTNFELSAYEQELTSEVDTGGGSQDLDLHLGIAPTSFVDGMGTLQLQSGLASPKHWGVGTSASNTVESELLPHGFELLSEHPPICNGVNTQFFPIYKGTAIGKGMEIDSSPNWAQAYGGTPPATLFSTAASSGFANATFTSSPAAPRLPHFSSGMLPYHHSSPPIPTMNSTAHFCCRS

SEQ ID NO: 25552 - protein, 604 aa, Corynebacterium glutamicum
MTDTSPLNSQPSADHHPDHAARPVLDAHGLIVEHESEEFPVPAPAPGEQPWEKKNREWYKDAVFYEVLVRAFYDPEGNGVGSLKGLTEKLDYIQWLGVDCIWIPPFYDSPLRDGGYDIRNFREILPEFGTVDDFVELVDHAHRRGLRVITDLVMNHTSDQHAWFQESRRDPTGPYGDFYVWSDDPTLYNEARIIFVDTEESNWTYDPVRGQYFWHRFFSHQPDLNYDNPAVQEAMLDVLRFWLDLGLDGFRLDAVPYLFEREGTNGENLKETHDFLKLCRSVIEKEYPGRILLAEANQWPQDVVEYFGEKDKGDECHMAFHFPLMPRIFMGVRQGSRTPISEILANTPEIPKTAQWGIFLRNHDELTLEMVSDEERSYMYSQFASEPRMRANVGIRRRLSPLLEGDRNQLELLHGLLLSLPGSPVLYYGDEIGMGDNIWLHDRDGVRTPMQWSNDRNGGFSKADPERLYLPAIQNDQYGYAQVNVESQLNRENSLLRWLRNQILIRKQYRAFGAGTYREVSSTNESVLTFLREHKGQTILCVNNMSKYPQAVSLDLREFAGHTPREMSGGQLFPTIAEREWIVTLAPHGFFWFDLTADEKDDME

SEQ ID NO: 25553 - protein, 419 aa, Bordetella bronchiseptica [sequence omitted]

SEQ ID NO: 25554 - protein, 412 aa, Triticum aestivum
MGTEQGKEGTGAGEGRVEVRTGPRPALPAPQQRAVDGFWRERQEEMEATADFNDRILPMARLKRLIRAEEDGMMIAADTPAYLAKLCELFVQELAVRAWACAQSHHRRIILESDIAEAIAFTQSYDFLATVLLEHQREARLAGRAAIPTTVPVTAARARLITRKRHMPDPNPPRPVHGVRRIRPRALPIPPPSDFRYVPVPFPFTSAPIGAAAMAEGLMILPPINHATTERVFFLDRNSGTDFAGENSAAETIASPPPPAGPAGAVALPTVHPAAYYLCAYPVTNDVEAFAVGNTDPDVIPPEIVVGDVAIPPEIIEGNVADGNGDGGQQQQQSENLGGNGESVVVSQSNGVQEDGADGMFLKEILMDEDLMFPDAELFPLVGAAPGPEDFIVDQDVLDDVFANPSSSASSD

SEQ ID NO: 25555 - protein, 581 aa, Saccharomyces cerevisiae
MTIIHNPKWWKEATVYQIYPASFKDSNNDGWGDLAGITSKLDYVKELGVDAIWVCPFYDSPQEDMGYDIANYEKVWPRYGTNEDCFQMIEEAHKRGIKVIVDLVINHCSEEHEWFKESRSSKANPKRDWFFWRPPKGYDEKGNPIPPNNWRSFFGGSAWRYDEKTGEFFLHVFALGQPDFNWENEECRKAIYDSSVGYWLRHNVDGFRIDVGSMYSKVEGLPDAPITDPTVPYQKGTEFFINGPRIHEYHKEMHNYMLSQVPEGKEIMTVGEVGIGNEDDFRVYTSAKEGELNMMFNFKHTSVGENPKCKYELIPFTLKDFKLALAESFLFIENTDCWSTIYLENHDQPRSVSRFGSDSPKWREISSKMLATLIISLTGTVFIYQGQELGMPNFKNRKIEQIKCVEGTGTYAAIKRDYGEDSEKMKKFFEALALISRDHGRTPFPWSADEPSAGFSKDAKPWIDMNESFRDGINAEAELKDKNSVFFFWKKALQVRKEHKDILVYGHNFQFIDLDNDKLFMFTKDTDNKKMFAVFNFSSDNTDFSVPDNEASYTMFFGNYANSNGDSRTLQPWEGRLYLLK

SEQ ID NO: 25556 - protein, 490 aa, Oryza sativa
MGSHRHRSAGQCSLVQPPRLITCLLLLLLLLLSPPALPCSASSSSSSSSVITHLPGFHGRLPFYLETGYIGIEEKTGTELFYYFVESETNPDTDPLVLWLVGGPRCSAFSGLAYEVGPLNFVLEAYNGSLPRLVYNQYSWTQMASIIFLDSPVGSGFSYARDSNGYDVGDISSSLQVVTFMKEWLNDHPRYRSHNFYVGGASYAGKGVPVIVQYISEAIEEQRQRPLIDLKLQGYIVGNPITGSKFDKNFHVPYSHGVGIISDQLYEAAVTHCKGDFVNPTNQLCANVVYTINKLMSEVSDGNILEDKCVKAAPKPTIDVSASRALLEEYSRLSKPPIRPSMDCASYGYYLSYCWMNDNTTRDALKIKKGTIGEWLRCNRGVFPYAKDIPNALDYHFNLTTRGYRALVMSGDHDLKVPFLSTQAWIRSFNFFIVDDWRAWHVDGQAAGFTITYANNLTFATVKGGSHVATVNRPKESFAMGKRWLANKPL

SEQ ID NO: 25557 - protein, 191 aa, Methanosarcina barkeri
MRTGRMSRKTKETDIQLELNLDGTGIADVNTGIGFFDHMLTSFARHAEFDLKVRAEGDLYVDEHHLVEDTGIVLGKVLAEALGDMAGTARFGEARIPMDEALADVALDIGGRSYLVLKAEFASPQVGQFSTQLVKHFFETLASNAKITIHASVYGDNDHHKIEALFKAFAYAMKRAVKIEGKEVKSTKGTL

SEQ ID NO: 25558 - protein, 85 aa, Setaria viridis
ECQKVGAPPEVSARLTAMAQELEARQRTALGGLGAATEPELDQFMEAHHEMLVKFREELTRPLQEAMEFMRRVESQLNSLSISGR

SEQ ID NO: 25559 - protein, 261 aa, Methanosarcina mazei
MDDGRVLETRRKNVFGAITGKPTSLGGSAGRFDATAKGGLYAVREAAKKLGIELEDAKVAVQGFGNVGYHAAYLAKKLFGCRVVAVSDSKGAIYSGKGLDPEDVSGYKHSTGSVLGYPEAENLSNKELLELDVDILIPAALEDVVSIENAEKVRPKILAEMANGPTTREAEEVLISNGVHIIPDILYNGGGVIVSYFEMVQNESSIQWDEKEVEMRLEKKMKEAYHSVFDFAEKNNAGMRQAAYTLAVGRVVEAMQLRGWI

SEQ ID NO: 25560 - protein, 585 aa, Magnetospirillum magnetotacticum
MCGIAGLMTPGGPPDETVLDKLADALAHRGPDGRGRHVQGNVGLVQNRLSIIDLEGGRQPILDGQGNAIVANGEVYNYLELKSDMAGQAFATGSDCEPPLHLYRHQGPAFARSLRGMYALAIHDGKAEKLILCRDPFGIKPLYLAEGSPGLAFASEPQALLAAGLVKPELDPVALAELLQLQFTTGTRTIFKGIRRLAPGETVVAEEGCVAESRRLPALPAGGPNEGGLDQLLDQLDDTLTESVELHQRSDVPYGMFLSGGIDSSVVLALMARLNPRGILAFTAGFPGTKVHDEREHARDLARAVGARHVEVEFTQSDFWALLPQVAAAMDDPAADYACLPTFKLAQEARKEVKVILSGEGGDELFGGYGRYRHAMRPWPLTKSMRRKGTFDGLDVLRDGILSHWRHGMKLAERVEAMPGRTRLQVAQAVDCADWLPNDLLAKADRCLMANGIEGRVPFLDPVVAAFAFRLPDHLKVRKGLGKWILRRWLETALPASRPFEKKRGFTVPVAEWIAARPEIGHLVAHQPGIEEICHPGKVKRLFKDCTKDTGFACWTLLFYALWHQRHVLGKIPDGDAFSALAERI

SEQ ID NO: 25561 - protein, 572 aa, Aspergillus nidulans
MPTKKHPNDSTHLPTKIKNFFRINSSSSTSSHQSSNHVNSSDRDTGSSTPVKHEPKSTFRQSRFLPMIGRNRSATVASEGNPLDEAISPTATANPYFVHQGQPALQHRNDGSIPSSPPDTPELQVDGVSAAEQATTANKEELARKLRRVASAPNAQGLFTATDSDGRPQTAELGKEPLVHSGAAGSPVGLVEVSSNTDQDGNLTVPQPGSGKLPAVTQVRTSSGGFRRTYSSNSIKVRNVEVGPASFDKIKLIGKGDVGKVYLVREKKSTRLYAMKVLSKKEMIKRNKIKRALAEQEILATSNHPFIVTLYHSFQSEDYLYLCMEYCSGGEFFRALQTRPGKCISEDAARFYAAEVTAALEYLHLMGFIYRDLKPENILLHQSGHIMLSDFDLSKQSGPGGAPTMIPARSGNSNTSLPTIDTKSCIADFRTNSFVGTEEYIAPEVIKGCGHTSAVDWWTLGILIYEMLYGTTPFKGKNRNATFGNILRDEVPFPEQGGAQQISKYVITEFCRGNETVNFRNVKESASVDIGEKNPSKMKGVPLNSGLATPNGEIADPFEEFNSVTLHHDGDF

SEQ ID NO: 25562 - protein, 517 aa, Unknown
  uncultured bacterium
MKKSILTTSIFALVAFSSCEKKPAPEVKNYWPQAGVTYEIFVQSFYDSNGDSIGDFNGVTQKLDYVKELGANAIWFMPIMPSPTYHKYDVTDYKAVHPDYGTLDDFKKLLDEAHKRDIKIVIDLIINHTSNEHPWFLEAKSGRDNPYRDYYVWAQKDTIADFLNKKTITFDLDNIRQWHDPGQGEDFYYGFFWGGMPDLNFDNPKVREEIYEIGRFWLEEVGVDGFRLDAAKHIFPDDRPLDNHAFWKEFRAKMEVIKPDVYLVGEVYDKKEVVAPYLPGLPALFNFDFHYTLLETMNTGDGMLLAKKQKEILDFYQGITSSFIDATISSNHDQPRLLNELGSDPAKYKQAIAVMLSMPGAPYLYYGEEIGMLGLKPDEHIREPFLWDEKSKDTGRTKWIKPKYSKDSTVTSLEVQKKDSNSYFNHYKNLIALRNSYPALAIGSLELPAEELPKSVMAYFRKSGDQEIFVVHNVDKEEVDIQLPEGFEEVIFYLGEGKNSSGKLQLKGNSSMVFLKD

SEQ ID NO: 25563 - protein, 235 aa, Unknown
  uncultured bacterium
GISHGIDALVVIGGDGSLTGAHLFYQEYGIPAIGLPGTIDNDLSGTDSTIGFDTACNTAIEAIDKIRDTATSHDRLFFVEVMGRDAGFIAINAGIGSAAAAILIPENKTPIETLVEKLKTRTKAKKTSNIFIVAEGGKSGSAQEIADKVKKHLPYYDIKVTILGHLQRGGAPTSFDRLLSFQMGVAAIEGLMAGKYDVMAGMINNKIVYTPIVKAIVDDKTVDEEDLRVANILST

SEQ ID NO: 25564 - protein, 656 aa, Oryza sativa
  misc_feature (188)..(188): Xaa can be any naturally occurring amino acid
  misc_feature (228)..(228): Xaa can be any naturally occurring amino acid
MALVVVPPGQMLLYLLYGPVVGKVVQEWREQGRLPLGTSWCLHLILLLALRSLTYQLWFSYGNMLFFTRRRRVVDDGVDFRQIDTEWDWDNMVIMQTLIAAVLVTSRVFPATSDLSAWDLRGWAIAVVLHVAVSEPAFYWAHRALHLGPLFSRYHSLHHSFQATQALTAGFVTPLESLILTLVAWAPXCRGLHGGTRLREPGLWTHPPLRLPPVHGVQQRRGHLTQDXFQDFPFLRYLIYTPSYLSLHHREKDSNFCLFMPLFDALGGTLNPKSWQLQKEVDLGKNHRVPDFVFLVHVVDVVSSMHVPFAFRACSSLPFATHLVLLPLWPIAFGFMLLQWFCSKTFTVSFYKLRGFLHQTWSVPRYGFQVTRFIQASRLISIELYFIPSAKKGINEMIELAILRADKMGVKVLSLAALNKMSLNLTAGKFSERSNILTETVNEALNGGGTLFVRKHPDLRVRVVHGNTLTAAVILNEIPGDVAEVFLTGATSKLGRAIALYLCRKKIRVLMLTLSTERFMNIQREAPAEFQQYLVQVTKYQAAQNCKTWIVGKWLSPREQRWAPAGTHFHQFVVPPIIGFRRDCTYGKLAAMRLPEDVEGLGTCEYTMGRGVVHACHAGGVVHFLEGWDHHEVGAIDVDRIDAVWNAALRHGLTPA

SEQ ID NO: 25565 - protein, 128 aa, Glycine max
  misc_feature (17)..(17): Xaa can be any naturally occurring amino acid
ASSMISSPPVTTINRAXAGMAATFTGLTSMAGSPTRNTNNDITYIASNSGRVHCMHVWPPDDKKNFETISYLPDLDDAQLAKEVKYLLRKGWIPCLEFELEHGFVFREHNKSPEYYDGHYCTMWKPPI

SEQ ID NO: 25566 - protein, 650 aa, Listeria innocua
MEIFELILLMLSAVFLSNVLSRFLPSIAVPLIQVLLGIILAIPLGDHTMDINPELFLLLFMAPILFNDGARTDKKSLWKNRKAILSLSIGLVFVTVGVLGAFIHYLIPAIPFAAAFALAAALAPTDAVAVGALAEKVRVPHKIMHILEGESLINDASGLVSFQFAVLALVTGTFSFMSAGTSFLLLSLGGIALGVVLSLLKIMLMRGLRQLGIENMTSFMLMEILLPFLIFMVAENIGVNGILAVVSGGMVHSFSYKRINPEMAQLNLLSKNTWSVIIFSLNGLVFVLLGTQLPQIMTAIWEDTGIHKSMLFLYIFGITFLLLALRFLWILFFRNYEENPHADLVSRLKNTFLYTVAGVRGTITLVSALSLPFVLGQGNAFPERDLLIFIAAGVIITTLLLANFTLPLFAAKKDVVVADHTTAIALLRDVVGQLQRYKTDENEVEMNNVLKMYNGRIFSLMEHKEVSATEKELRRLTQEWQLENTRRLVFERKIDTGVGLSLMMRLGKRLYVQTRAQKYRARMRYRQLLSHSIRDFRIVPLSFEERRKERAKLQTENNQFVVQKLNELDKNEFNPEVISLYLMNFERALGSGKHKKETDNEELQTTIDLASQIERETIQHYFEKGTITRKEMKVYRDNLLAIEASFQLEF

SEQ ID NO: 25567 - protein, 322 aa, Xanthomonas oryzae
MSASSASPAKHSRLLILGSGPAGWTAAVYAARANLKPVVITGLQQGGQLMTTTEVDNWPGDPHGLMGPDLMTRMQAHAERFETEVIFDHIHTADLSQRPFRLTGDGAEYTCDALIIATGATAKYLGIPTEEAFKGRGVSACATCDGFFYKDQDVVVVGGGNTAVEEALYLSNIARKVYLVHRRDTLRAEKIMQDKLFAKVAAGKIETVWHHAIDEVLGNDAGVTGVRVKSTIDGSTRDIDAHGFFVAIGHHPNTQLFDGQLAMNNGYLEIRSGLNGAATETSVAGVFAAGDVADQHYRQAITSAGFGCMAALDAERFLDKSA

SEQ ID NO: 25568 - protein, 801 aa, Staphylococcus carnosus
MSKQRLVMIGNGMAGVRTIEEIIDRDPDKFDITIIGKEPYPNYNRIMLSNILQKKMTVEETIMNPYSWYEENGIALITGEKATRVNREKHIVETEKGREIPYDICIFATGSKAFVLPIPGHELPSVIGWRTIEDTERMIEIAQDKKEATVIGGGLLGLECARGLLDQGMNVTVVHLAEWLMEMQLDRQAGDMLREDLEKQGMKFELGANTKEIIGNQDVEAIRLADGRDLPADLVVMAVGIKPFTQEAIDSGIDVERGIVVDDFMRTSDPEIYAVGECAQHNCKVYGLVAPLYEQGKVLADHLTGRPTEGYQGSTTFTSLKVSGCDLYSAGQIQEDDEVEGVEIYNSHDHVYKKIFLKEERVVGAVLYGDTDDGTRFFNMMKKREPIEDYTLVSLLQKVGEEAVSTVADMDDSETICGCNGVSKGKIVSAIVEDGLTSVAEVTKATKAGNSCGKCKPQIGELLEHTLGGAFVASKPAGICDCTELTRDQIVTQIRAKGLKTSKEVRHVLDWKNKGGCPKCRPAINYYLNMVYPHEHEDEKASRFANERYHANIQNDGTFSVIPQMRGGVTNPDQLIRLGEVAKKYDVPLVKVTGSQRIGLYGISKEDLPKVWKDLGMRSASAYAKKTRSVKSCVGKEFCRFGTQYTTRLGIRLEETFEYIDTPHKFKMGVSGCPRSCVESGVKDFGVIGVENGFQIYIGGNGGTEVTKGQFLTTVETEEDVIQLCGAYMQYYRETGIYAERTAPWLERMGFENVKEYVLDPERQKALYDRIMDAKRAVAEEPWSEIVNDQADQKIFKVEKV

SEQ ID NO: 25569 - protein, 563 aa, Pseudomonas syringae
MSESFAELFEESLKTLNLQAGSIITAIIVDIDYQAGWVTVHAGLKSEGLIPLEQFHNDAGELTIKIGDEVHVALDAVEDGFGETKLSREKAKRAECWIVLEAAFAAEEVVKGVINGKVKGGFTVDVNGIRAFLPGSLVDVRPVRDTTHLEGKELEFKVIKLDQKRNNVVVSRRSVLEAENSAEREALLESLQEGQQVKGIVKNLTDYGAFVDLGGVDGLLHITDMAWKRIKHPSEIVNVGDEIDVKVLKYDRERNRVSLGLKQLGEDPWVAIKARYPESTRVTARVTNLTDYGCFAELEEGVEGLVHVSEMDWTNKNIHPSKVVQVGDEVEVMVLDIDEERRRISLGIKQCKSNPWEDFSGQFNKGDKISGTIKSITDFGIFIGLDGGIDGLVHLSDISWNEVGEEAVRRFKKGDELDTVILSVDPERERISLGIKQLESDPFSEYVTVNDKGAIVRGIVKEVDAKGAIITLADDIEATLKASEISRDRVEDARNVLKEGEEIEAKIISVDRKSRVISLSIKSKDVEDEKEAIQSLRSKPEVAESTGPTTIGDLLRAQMEKQN

SEQ ID NO: 25570 - protein, 78 aa, Xanthomonas oryzae
MIAQDYMSKDDSIEFEGSVSETLPNTTFRVKLENGHEIIAHISGRMRKNYIRILTGDRVKVEMTPYDLTKGRITYRMK

SEQ ID NO: 25571 - protein, 131 aa, Bacillus anthracis
MKIALIAHDKKKEDMVSFAYAYKPIFEQHELFATGTTGLRIMEATGLVVTRYQSGPLGGDQEIGAMIAKNDLDMVIFFRDPLTAQPHEPDVNALLRLCDVYAIPLATNMASAEMLMHALERGDLDYRKLRK

SEQ ID NO: 25572 - protein, 499 aa, Glycyrrhiza echinata
MEILSLLSYSVFYLALFFIFNIVIRARKFKNLPPGPPSLPIIGNLHHLKRPLHRTFKGLSEKYGHVFSLWFGSRLVVVVSSASEFQQCFTKNDVVLANRPRFLSGKYIFYNYTTLGSTSYGEHWRNLRRITALDVLSNHRINSFSGIRRDETQRLITRLADDSSTNFAEMELSSRLYDMTFNNIMRMISGKRYYGEDCDTSDLQEASQFRDMVSELLQLSGANNKTDFMPLLRFLDFENLEKRLKDISGKTDAFLRGLIEEHRTKKERANTMIDHLLNLQDSQPEYYTDQIIKGLALAMLLAGTDSSAVTLEWSMSNLLNHPEVLKKVKDELDTHVGQDRLVDESDLPKLTYLKNVINETLRLYTPAPLLLPHSTSDECNIGGYKVPQDTIVLINAWAIHRDPELWTEATTFKPERFEKKGELEKLIAFGMGRRACPGEGLAIRAISMTLALLIQCFDWKLINGDKIDLAERDGFTLTKLVPLKAMCKSRPVINKVFKQ

SEQ ID NO: 25573 - protein, 219 aa, Malva pusilla
MTGEVVLLDFWPSPFGMRSRIALAEKGINYEYKEEDLRNKSPLLLQMNPVHKKIPVLIHNGKPICESLIQVQYIDEVWHDKSPLLPSDPHQRAVARFWADFVDKKMYEQGSRVWKTKGEEQATAKKEFIESLKLLEGELGASLTFGGENLGYVDGVLVPFYSWVYAYEKCGNFNIEPECPKLIAWAKRCMEKESVAKSLPDQEKVYDFVLQLKKIYGIE

SEQ ID NO: 25574 - protein, 349 aa, Umbelopsis ramanniana
MEQVQVTALLDHIPKVHWAPLRGIPLKRRLQTSAIVTWLALLPICLIIYLYLFTIPLLWPILIMYTIWLFFDKAPENGGRRISLVRKLPLWKHFANYFPVTLIKEGDLDPKGNYIMSYHPHGIISMAAFANFATEATGFSEQYPGIVPSLLTLASNFRLPLYRDFMMSLGMCSVSRHSCEAILRSGPGRSIVIVTGGASESLSARPGTNDLTLKKRLGFIRLAIRNGASLVPIFSFGENDIYEQYDNKKGSLIWRYQKWFQKITGFTVPLAHARGIFNYNAGFIPFRHPIVTVVGKPIAVPLLAEGETEPSEEQMHQVQAQYIESLQAIYDKYKDIYAKDRIKDMTMIA

SEQ ID NO: 25575 - protein, 345 aa, Bacteroides thetaiotaomicron
MTNSQLSTFNFQLNMKLPGKIAIMGGGSWATAIAKMCLAQEDSINWYMRRDDRIADFKRLGHNPAYLTGVKFDTKRITFSSNINDVVKESDTLIFVTPSPYLKAHLKKLKTKIKDKFIITAIKGIVPDDNVIVSEYFTKEYGVPPENIAVLAGPCHAEEVALERLSYLTIACPDKDKARIFARRLGSSFIKTSVSDDVAGIEYSSVLKNVYAIAAGICSGLKYGDNFQAVLISNAIQEMNRFLNTVHPLNRNVDDSVYLGDLLVTGYSNFSRNRTFGSMIGKGYSVKSAQIEMEMIAEGYYGTKCIKEINKHHHVNMPILDAVYNILYERISPMIEIKLLTDSFR

SEQ ID NO: 25576 - protein, 530 aa, Triticum aestivum
MPLSGMAIAFKASTSACTAQQLWGHPTRDQCQHGFTHLNERKSRKGSAALHARAIPGNLDLDFGDPSWKQKYQEDWDRRFSLPHITDVFDLEPCRSAFPRSTHASPRGASDASSPDKWNGYVNKDDRALLKVSDYASNTSAGAECIDPDCSWVEHWVHRAGPRKEIYYEPEEVKAAIVTCGGLCPGLNDVIRQIVFTLEIYGVKNIVGIQFGYRGFFEKGLKEMPLSREVVENINLAGGSFLGVSRGGAKTSEIVDSIQARRIDMLFVIGGNGSHAGANAIHEECRKRKLKVSVVAVPKTIDNDILFMDKTFGFDTAVEEAQRAINSAYIEARSAYHGVGLVKLMGRSTGFIAMHASLSSGQIDVCLIPEVSFTLDGEHGVLAHLEHLLETKGFCVVCVAEGAGQDLLQKSNATDASGNVILSDFGVHMQQKIKKHFKDIGVLADVKYIDPTYMVRACRANASDAILCTVLGQNAVHGAFAGFSGITSGICNTHYAFLPITEVITTPKHVNPNSRMWHRCLTSTGQPDFH

SEQ ID NO: 25577 - protein, 1124 aa, Nostoc punctiforme
MARDKAYQKAEQRIEKARQEGAIELDLSKIELTEIPEAIASLTQLQQLDLSRNQVTQLPEAIASLTQLQTLDLSNNKLTQLPEAIASLARLQRLDLSNNQLTELPEAIASLAQLQELNLRNNQLTELPEAIASLTRLQRLDLSNNQLTELPEAIASLTQLQSFDLSHNELTELPNSLSRLLYLEIFDCGSNLLRQVPSVIKELKGLKELYIYANDLEVIPSWICDLHVLEILSIGGNQISELPKSLDKLQSLEFIILGADDGGNPLSKLPPCIQRIKQIRRIWANNCELHFLPDWLNEFPQLEELYLGSNCLTDLPASLGQLPHLDDIQLDHNPLNPDLAAAYEQGTEAVLQYLRARSEAQVTLNEAKLILIGEGEVGKSCLLGALRGDEWEDGRPTTHGIEIKSVIVTDPDSGTEISLNGWDFGGQRVYRPTHQLFFSAPAVYLVIWKPREGPQQGFVKEWITLIKNREPDAKVLVVATHGGPGQRQPDIDRQEILDQFGKDTVIDFFHVDSKPNQDTTDCAGLAELKDTIARVAASLPEMGRSVPAKWQQVRETLQTSDKAYLPYDDVITICAEQGIDEEQAELFLRISHILGHFIHYHYDPTLRDIVILKPDWLAKAISFVLDDETTRKRNGLVEFKHLSQLWSHPPFAGEEGYPPKLHPIFLRLMERFDLSYKVVFDPSETSNTSLIAQLVPDTRPEPLPNWGEQPEAGDRQQVQICRIVDSRGQFAVAEGLFYQLIVRLHKYSLGRANYENSIHWQRGLMLDNDYNGRALLEYVGTDVKITVRAAYPERFLSYLTEEIKWLVENFWEGLRCNVMVPCIETCGMNAPGNGLFEVQKLIESKKKNRHEFPCPISGCGEWQNIDQLLNNAPTAQPPSQEIGIEQFRYIVKDELNVIRKDLVMYDRLDQARFQVLSQEQRTILSQVDQQFAELMQMLTDEAKDGPRLFSFKPIEPGFFDRPKWISAKFQLTLWCEHARQPLPALNPNDKKKGVYELDLPREWFTKAVPYLRILTGTLSLVLPVAGSATKFILDDTTYKAIEEQLDLGQKSIESTLKGSDMALAGKSKSDASFLEGDAIRAQGSILRELHTLLKEKDPSFGGLVRVQNKRREFLWVHPQFIDEY

SEQ ID NO: 25578 - protein, 355 aa, Umbelopsis ramanniana
MASKDQHLQQKVKHTLEAIPSPRYAPLRVPLRRRLQTLAVLLWCSMMSICMFIFFFLCSIPVLLWFPIILYLTWILVWDKAPENGGRPIRWLRNAAWWKLFAGYFPAHVIKEADLDPSKNYIFGYHPHGIISMGSFCTFSTNATGFDDLFPGIRPSLLTLTSNFNIPLYRDYLMACGLCSVSKTSCQNILTKGGPGRSIAIVVGGASESLNARPGVMDLVLKRRFGFIKIAVQTGASLVPTISFGENELYEQIESNENSKLHRWQKKIQHALGFTMPLFHGRGVFNYDFGLLPHRHPIYTIVGKPIPVPSIKYGQTKDEIIRELHDSYMHAVQDLYDRYKDIYAKDRVKELEFVE

SEQ ID NO: 25579 - protein, 445 aa, Bacteroides thetaiotaomicron
MISLNIEKTFGFISKEKVSAYEAEVKAAQEMLEKGTGEGNDFLGWLHLPSSISKEHLADLNATAKVLRDNCEVVIVAGIGGSYLGARAVIEALSNSFTWLQDKKTAPVMIYAGHNISEDYLYELTEYLKDKKFGVINISKSGTTTETALAFRLLKKQCEDQRGKETAKKVIVAVTDAKKGAARVTADKEGYKTFIIPDNVGGRFSVLTPVGLLPIAVAGFDIDKLVAGAADMEKACGSDVPFAENPAAIYAATRNELYRQGKKIEILVNFCPKLHYVSEWWKQLYGESEGKDNKGIFPASVDFSTDLHSMGQWIQEGERSIFETVISLDKVDHKLEVPFDEANLDGLNFLAGKRVDEVNKMAELGTQLAHVDGGVPNMRIVLPELSEYNIGGLLYFFEKACGISGYLLGVNPFNQPGVEAYKKNMFALLNKPGYEEESKAIQAKL

SEQ ID NO: 25580 - protein, 154 aa, Medicago sativa
AVKMLLIPWKWGMKYFWDTLLDADLESDILGWQYISGSLPDGHELERLDDPEIQGTKYDSEGEYVRQWLPELARIPTEWIHHPWNAPPTVLRASGVELGQNYPKPIIDIDLAREQLTQAIFKMWEDEAASKSSTSENKHEVVDDSENLSIPKFS

SEQ ID NO: 25581 - protein, 456 aa, Aspergillus nidulans
MSLTESTAIDIAKAASSASRHLAILSEADRNEALTALHAALSRNKDAILEANARDIQAATQAVNGGSLNHSVLKRLDLSRPGKYDDMLQGILSVRSLRDPIGNVTLRTLLDDGLTLEKVACPIGVLLIIFEARPEVIANIAALSIKSGNAAILKGGKESTESFVTIANVISEAISHTRVPQSSIQLVKTRAAVSDLLAQDSLIDLVIPRGSNDLVRFVKENTKIPVLGHADGLCSAYIHSDADPEIALKVIVDSKTDYPAACNSLETLLVHQDALKEVLPPLAKALIAKGVTLRCDESSKAALIENLTLKEAGMLRDACESDFRTEFLDLTLAVKTIPSNSPLTDVEAAIAHINSHSSKHTDIIITESENIANIFMKGVDSAGVFWNASTRFADGMRYGFGTEVGISTNKIHSRGPVGLDGLTIYKYLIRGSGHRAGDYFDGEGGRKYKHQNLELS

SEQ ID NO: 25582 - protein, 527 aa, Burkholderia vietnamiensis
MSPVAAFKLILLSFVAIVALECIAKRLRLPPAAALLMGGIGIAFIPGLPPVNLDPELVLLVFLPPLLMDGAYFTVWEEFKRNVGGILLLAIGAVAFTTFAVGYAVHWVAPSLPWAACFALGAIVSPPDAVAAKAVLERVALPRRLMVLLEGESLLNDAAGLVLFRFAVAAALTGAFSLEHAVVRFAELGIGGVVVGFVVGRIVVWFLKLLDDDYLVITVAVIAGWLAYIAGEMVEVSGVIATVTAGMIVGWHQHEVFSAAVRTRGTAFWQVIVFLLEAMVFVLIGLSLRGAIHRLGGFEQVLGTMMPAVLAVLAAVIVSRFVWVYAVEALKWPVRGIVRRGAAPDWKAATVMSWAGMRGVVTLAIALSLPEAMPGRDVILVASFAVILVTVLLQGTTIGPLIRLLCLPQRDERAAHHLSEPQTWAYIEAAQLAAIQPLVHDASGNVIHPRLLEQYTYRAALTERTKDAPQYPPEVRAAHYDVVLAAIRAGRAELLRLHRSGHIHDEMLHMVERDLDLQEVSAQHARG

SEQ ID NO: 25583 - protein, 331 aa, Ficus adenosperma
DRVFVDHPSFLEKVWGKTGSKIYGPIAGEDYQDNQLRFSLLCQAALEAPRILKFTSSKYYSGPYGEDVVFIANDWHSALLPCYLKSMYKANGLYKSARVSFCIHNIAYQGRFAFTDFALLNLPDDFLRSFDFIDGYEKPVKGRKINWMKAGILESDRVLTVSPYYAQELVSGAEKGVELDHVLRKTGIIGIVNGMDVQEWNPLTDKYIAIKYDASNVMSAKALLKEALQAEVGLPVDRNIPVIGFIGRLEEQKGSDILIAAIPHFVKENVQIIVLGTGKKPMEKQLQQLEILYPEEARGVAKFNVPLAHMITAGADFILVPSRFEPCGLIQ

SEQ ID NO: 25584 - protein, 381 aa, Parvularcula bermudensis
MLERVLRSPKSSAFLTVGAMVLAFAWVNSPYADAYEALHHAPASVRIGAFELGKPMISWINEGLMVFFFFLIGLEIKREVVEGQLSSLSQVALPALAAAGGMAVPAAIYLAFNMGDPEAARGWAVPVATDIVLVLACIAALGRRVPTSLKVFLTALAIFDDFGTLVVIAVFYSEGLSAPALIAAGAAFAVLVGFNRFRVGSPTAYAVVTIVLWLALLESGVHATLAGVLAAWTLPMRVGGRKFLHQIEHDMTPWVALLIVPIFAFFNAGIALGGVTAETLLGPVSLGVVLGLFVGKPVGVVAGTWLAVTTRLAELPAGVTWRQIYGVAMLAGVGFTMSLFVASLAFEAPGAVLNTNLSVLIGSGLSAVAGLIVLARATRGS

SEQ ID NO: 25585 - protein, 478 aa, Buchnera aphidicola
MNVNLMWFRNDLRLSDNSALHFSCRNNASTVLALFIATPKQWERHCLAPKKKMLIYKNIVALKKKITELGIIFYYYESTDYLESTNYIIEFCKIHKVTSIFFNLEYEFYERQRDKIIKKKLKKNNIIINCFHDSVLITPGSIKNSYGKMYKKFSYFKYKCIKQLQLNIPSCFPKPQNKNLHDHYSLDFTIPIFHTYLEKFDANIFPIGEDIVYEKLKFFIKYAFNKYNFDQEIFELNSTSMLSAHLSIGVISPRQCVTLLFKEYPDIIHKLEECKWINELLWREFYQHLLYFYPNIGQNQSLYHWENRIKWDNNLYYLNLWKQGNTGYPIIDAGMRQLKQLGWISNRLRMITASFLVKNLLIDWRKGEEYFMSQLIDGDFASNNGNWQWIASVGTDSMPYFRIFNPMLQSKKFDINAKFIRKYIPELSNVSTYNIHNPCDNNKTNKIHSKYPQPIINYYHSKKKTLLVFKHAKCSNKL

SEQ ID NO: 25586 - protein, 367 aa, Cucumis melo
MPNLTPFSKLDKTFDRASELKAFDQTKAGVKGLVDSGVAEIPGIFYCPPKEASNSIPEETHLGVPVVDLGDIDKDPFKRRQVVEEIREASETGGFFQVINHGVPVSVQEEIINRVRRFFEQDSEVKKQYYTRDYTKSFIYNCNFDLFSSPVANWRDTIVTVMAPNPPNPHDLPQVCRDILFEYSKHIMKLGELIFGLLSEALGLKSTHLVDLDCNEGLRIIGHYYPSSPQPELSIGTTEHSDDTFITVLLQDNMGGLQVRQQNKWVDVPPVPGAFVINVGNLLQLITNDRFVSSEHKVLANREGPRISVASFFSTGRLPTSKLYGPIKELLSEQNPPKYKEITVREYNIYFAEKGLDGTSALPHFKI

SEQ ID NO: 25587 - protein, 261 aa, Triticum aestivum
  misc_feature (200)..(200): Xaa can be any naturally occurring amino acid
MAAERGSREGRWTLAAARALITGGSKGIGYAIVEELAGFGARVHACSRNAAELEECRRRWEEKGLHVTVSACDVSVRADRERLMDTVRQTFNGKLDILVNNAGQLLVKPTAECTAEEYSKVMATNLESSFHLCQLARPLLVHAGGGSIINMSSMGGSIGFVGSAIYAITKSAMNQLTRSLAAEWAPNNIRVNGVAPGFIXTTDMIKDMDTESLEREHSKTPLLRSGKPVEIASAVAFLCMPAASFITGQVICVDGGRTISA

SEQ ID NO: 25588 - protein, 320 aa, Buchnera aphidicola
MIKRIGVLTSGGDAPGMNAAIRGVVRTALSRNLEVFGIYDGYLGLYENRMILLDRYSVSDIINKGGTFLGSARFSNFFKKDIRSIAIKNMQQRNIDFLVVIGGDGSYVGAQKLTEMGFPCISIPGTIDNDVAGTDYTIGYFTALETVVEAIDRLRDTSSSHQRISIVEVMGRNCGDLTLSAAIAGGCEFIVLPEIEFTKEELVKEIKNGIKKGKKHAIVAITEYICNVEKLAKYIQRETCRETRATILGHIQRGGAPVVYDRILASRMGEYSVDILLQGFQGRCIGTINEKMVHHDISDALKNMKRPFKFDWLKTAKQLY

SEQ ID NO: 25589 - protein, 85 aa, Setaria viridis
ECQKVGAPPEVSARLTAMAQELEARQRTALGGLGATTEPELDQFMEAYHEMLVKFREELTRPLQEAMEFMRRVESQLNSLSISGR

SEQ ID NO: 25590 - protein, 517 aa, Geobacter metallireducens
MNINRRDFLKLAGAGGLALALPGCAGNLPLPKEVFPDFGDSGRPWLGLATSLREEHDYEARIEGTIPSALRGTLYRNGPALFDRGGLRKRTLLDGDGMVQSFTVGDGGVRYRNRYVRTEKFVAEEAAGRFLYPTWSTQKPGGFWGNFWQAGSVPNQAGITVFWWRGKLYAFDEGNIPYELDPESLATAGPSNLGLTPGTAFYSAHPKLDPHTGEWLHFGVKYGPRPLLHLSAFAADGSLKRHRTFPLPRYVYMHDWIVSGRYLILSLHPVEIEFWGFLLGFRSLFASLRWRPEWGNLLMIVEREGEGKPRLVETEACYMWHSFNAYEEGGETVADFIGYRNPDHFVGDDPVISAVMEGRRGHYDFPGEIMRYRIDPVRCTVRRETLNPGSCEWPRIDERLRCRRHRIGYAVKCLPGEFFWSIVMRVDFLSGTTAEYSFGRGKYCTEAVFVPKPGTSADASQSAGEGWLLTEVYDSHTRKSFLAILDAGRVADGPLAIAHLTHHVPFSYHGWWHPSPV

SEQ ID NO: 25591 - protein, 216 aa, Chlamydia trachomatis
MIFTIAKSLVRLLFPLFYRRKILRSKASATVKGAAIIAANHVSFLDPIIIPLAFPGKLYQLAKSGLFSNSFTNRLFRELGCYPISRNAGNAAAFKAALNIFSHGGRLIIYPEGTRHADGEIHQGKVGVGMLAIKGNVPVIPVYVAGTFEAFGKNQKFPKLWRTLTTVIGSPISFQDLIDNPAIDKKEAYQLATDRIMTKITELRTWFQQGCIGEIP

SEQ ID NO: 25592 - protein, 402 aa, Desulfovibrio vulgaris
MHPIEIKKDIFWVGVVDHNSRDFHGYSLSPQGTTYNAYVVKDEKTVLFDTVKHDFTDTMLCRLSRVVEPCKIDYIVCNHLEPDHAGALPELIARCKPEKIFCSPMGLKAMEAHFDTTGWPVEVVKTGDSISIGKRTIHFVETRMLHWPDSMVSYIPEDKLLICNDAFGQNIASTERYADEIDRSALFHAMKEYYHNIVLPFSPIVLKTLAQIEQLGLDIDMLAPDHGLIFRGYDDVKYALDTYRIFAEQKPQKRAVIVYDTMWHSTEKMASAIAEGLESVGVPTRVMWLKANHHSAVMTELADCGAVLVGSPTHNNGILPAVAAMLTYMKGLRPQNRIGAAFGSFGWSGESVKSITEWLQSMGMETPVDPVKVKHVPTHDTYRQCFEMGQAVGRALIEKCGG

SEQ ID NO: 25593 - protein, 317 aa, Staphylococcus carnosus
MSVSPTGHVYLIGAGPGNPNLLTRKAEHLIRTADIILYDRLVNPFILQLAPPEIEIIDVGKKPYSRHIQQSEINEVLLDAAYKHRNVVRLKGGDPAIFGRVHEEVDILKEHNIPCEIVPGITTASAAAATLGVGLTCRNVSTSVTLTTGSFKGSEEQEIDIASLIDGGTLAIYMGIKRLHTIITQIYKQVGKDYPICAVFDVSYATQKVITGHLSDIEKKVQANAPEDAPGILLIGDALEYADENTHIQLEETSKYFGKECIVTGPREAAIEKAFEIYDAGGWCMIDPNSDDHYHQSQLDLIYRYMQVNDNTIIVKA

SEQ ID NO: 25594 - protein, 361 aa, Unknown
  Dehalococcoides sp. CBDB1
MKAIILVGGQGTRLRPLSINTPKSMVPVLNVPFLSHVLRHLSSYGIKDIILTQGHLAAPIEQYFGNGQSLGVNLVYSVEHEALGTAGAIKNAERFLDDTFFTLNGDIFTHLDLDAMLQSHRDRKALVSIALTPVDDPTKYGLVETTPDGRVSRFLEKPSPSQITTNMINAGTYLIEPEVLKYIPEDENHSFERQLFPRLLNECQAVYAYPSSAYWIDIGSPEKYSQLNRDLLCGEGGDFGFSRGNEIIIGRGCQLHPTAQISGPVLVGENCVIGANARITGPVVIGAECRIEDEATLTESVIWRNVTIGTECKVVSSIIANHCHLKAGGKYENVVLGDNVTAECGCAPEPGSKVCPGILMI

SEQ ID NO: 25595 - protein, 132 aa, Olea europaea
MSKVFTLAEVSEHNNAKDCWLIIDGKVYDVTKFLEDHPGGDEVLLSATGKDATDDFEDVGHSSTAKAMMDEFYVGDFDTSTVPTKTQYTPPKQPHYNQDKTSDFIIKLLQFLVPLFILGVAVGIHFYTKSSA

SEQ ID NO: 25596 - protein, 448 aa, Clostridium perfringens
MEVKKYVDNLMEDLKKNNPGESEFLAAAEEVLYSLVPVLEKNPKYMEEGILERIVEPERVIMFRVPWVDDAGNVRVNRGYRVQFNSAIGPYKGGLRFHPSVNLSIIKFLGFEQIFKNSLTTLPIGGGKGGSNFDPKGKSDREIMRFCQSFMSELYRHIGPNTDVPAGDIGVGGREIGYMFGQYKKLKNSVDAGVLTGKGLTYGGSLARKEATGYGLVYFVDEMLRDNGQTIEGKTVVISGSGNVAIYATEKVQELGGKVVALSDSSGYVYDENGIDLEVVKEIKEVKRGRISEYVNYVKTAKFTEGCRGIWNVKCDIALPCATQNEIDKSSAKTLIDNGVIAVGEGANMPSTLEAQKLFVDNKILFAPAKAANAGGVATSALEMSQNSLRMSWTFEEVDAKLKDIMKNIYYNSRNAASEYGHDGNLIVGANIAGFKKVADAMLDHGII

SEQ ID NO: 25597 - protein, 423 aa, Zea mays
MALAVRTPRFQPRPASISAPTTPASTSLAAGNARPRPCAGAAVRASPFTEATSSSRYRRDAWSYAADGSSNSASPSSAAAAAAGRRDDEIALQLPELRRLLDVLRASRGRGAEEGGGPGEVALVGTGPGDPELLTLKAVRAIEAADLVLYDRLVSNDVLDLVGEGARLLYVGKTAGYHSRTQEEIHELLLSFAEAGANVVRLKGGDPLVFGRGGEEMDFLQQQGIKVEVIPGITSASGIAAELGIPLTHRGVATSVRFLTGHSRNGGTDPLYVAGNAADPDTTLVVYMGLSTLPSLAPKLMKHGLPPDTPAVAVERGTTPQQRTVFASLKDLVDEVKSADLVSPTLIIIGKVVSLSPFWVESSEHDALKVQSSYANEADDNRFSWFLVTGQYLRNARSQIWEHRFDLVYTETSQEAWILNGGW

SEQ ID NO: 25598 - protein, 221 aa, Triticum aestivum
  misc_feature (184)..(184): Xaa can be any naturally occurring amino acid
MARRSGMLLLLAAAALLAAGAGAAVPPSCERIECPAYDVVDSANGFEIRRYKDAMWVSTAPIEDISLVDATRSGFLQLFKYIQGKNAYNETIEMTAPVLTRVAPSDGPFCVSSFVVSFYVPAKNQADPPPAEGLRVQKWAGARYAAVRRFGGFVADADVGKQAALLDASLQGTRWAAAVSDGRXADPASEYTVAQYNSPFEFSGRVNEIWMLFDTMAASDM

SEQ ID NO: 25599 - protein, 328 aa, Salmonella enterica
MPLHHLTRFPRLELIGAPTPLEYLPRLSDYPGREIYIKRDDVTPIAMGGNKLRKLEFLVADALREGADTLITAGAIQSNHVRQTAAVAAKLGLHCVALLENPIGTTAENYLTNGNRLLLDLFNTQIEMCDVLTDPDAQLQTLATRIEAQGFRPYVIPVGGSSALGAMGYVESALEIAQQCEEVVGLSSVVVASGSAGTHAGLAVGLEHLMPDVELIGVTVSRSVAEQKPKVIALQQAIAGQLALTATADIHLWDDYFAPGYGVPNDAGMEAVKLLASLEGVLLDPVYTGKAMAGLIDGISQKRFNDDGPILFIHTGGAPALFAYHPHV

SEQ ID NO: 25600 - protein, 96 aa, Glycine max
MMMVHPRDQVGGETHKNLVEPNVAASKKARNCACMVSYSVLILALLTLSILLLPLVLPPLPPPPLLLLFVPVFILVVLFFLAFSPSTLPNMAVLTS

SEQ ID NO: 25601 - protein, 549 aa, Thermoanaerobacter tengcongensis
MKMFCYQCQEALKNTGCTTIGVCGKTADVANLQDLLIFTLKGISFLNLKAREVGVNKEKTDRFLIEGLFSTITNVNFDRNFFLRKIKEAVALRDEIKEDLRNKGVRVDEYKNIDAISWTYGTDADIEAISQEVGVLSTEDEDIRSLRELITYGVKGMAAYAYHAYQLGYKDDNIFKFMEKALAKVLDDSLTVDDYVALAMETGKYGVDTMALLDKANTSTYGHPEITKVNIGVRNNPGILVSGHDLKDLEQLLEQTAGTGVDVYTHGEMLPAHYYPAFKKYPHFVGNYGNAWWQQDKEFELFNGPILMTTNCLIPPKDSYKDRVYTTGVVGFEGVKYIPEGPDGKKDFSEIIEHAKRCKPPVEIERGEIIGGFAHNQVLQLADKIVEAVKTGAIKRFFVMAGCDGRMKSRTYYTEFAKALPKDTVILTAGCAKYRYNKLNLGDIDGIPRVLDAGQCNDSYSLAVIAMKLKEIFGLNDINELPISYNIAWYEQKAVIVLLALLYLGVKNIHLGPTLPAFLSPNVTKVLVEKFGIGGITNVEDDLKMFLGA

SEQ ID NO: 25602 - protein, 331 aa, Ficus botryocarpa
DRVFVDHPSFLEKVWGKTGSKIYGPIAGEDYQDNQLRFSLLCQAALEAPRIPKFTSSKYCSGSYGEDVVFIANDWHSALLPCYLKSMYKANGLYKSAKVSFCIHNIAYQGRFAFTDFELLNLPDDFISSFDFIDGYEKPVKGRKINWMKAGILESDRVLTVSPYYAQELVSGAEKGVELDHVLQKIGIIGIVNGMDVQEWNPLTDKYIAIKYDASNVMSAKALLKEALQAEVGLPVDRNIPVIGFIGRLEEQKGSDILIAAIPHFIKENVQIIVLGTGKKPMEKQLQQLEILYPDKARGVTKFNVPLAHMITAGADFILVPGRFEPCGLIQ

SEQ ID NO: 25603 - protein, 544 aa, Oryza sativa
MASSKEAYRVELRAAARQLGERGLYSAAKWAAELLVGIDPDATPAPSSAMDTPSSSGSGGHLLHLHRSGGSSFRRRLRPGAAGEAGTPLGGVSYVSTPIPDDDDAFDVGADRLETLYSNIEMNGQYKVLTYSSNTIALMQQGGLRIQAGEKRKEEETVELEGSLGKSNAVNQELVALERELATHRRTGAIDSFCLYLYGIVLRDKGSEALARTVLVESVNSYPWNWSAWLELQSLCTSSDILNNLNLKNHWMKDFFLASAHLELKMHEEALKRYERLMGVFRCSDYIQAQIATVQYSMRDLDEADMIFEELLRTDPFRVDSMDVYSNLLRAVDINPRDYRAWYGLGQIYEMMGMPFYAVYYFRKSSYLQPNDARLWNAMAQCYESDQLQMIEEAIKCYERSANNNDTEGIALHQLAKLHGMLGQSEEAAFYYKKDLERMEVEERQGQNFVEALLFLAKHCKSIGRFEEAEHYCTRLLDYTGPERETAKSILQGLKRSQSVLPLMDIDHFAMRFKQVILIVCILARRLHSAGDVDFVCVMIASSC

SEQ ID NO: 25604 - protein, 389 aa, Oryza rufipogon
MVAEHPTPPQPHQPPPMDSTAGSGIAAPAAAAVCDLRMEPKIPEPFVWPNGDARPASAAELDMPVVDVGVLRDGDAEGLRRAAAQVAAACATHGFFQVSGHGVDAALARAALDGASDFFRLPLAEKRRARRVPGTVSGYTSAHADRFASKLPWKETLSFGFHDRAAAPVVADYFSSTLGPDFAPMGRVYQKYCEEMKELSLTIMELLELSLGVERGYYREFFADSSSIMRCNYYPPCPEPERTLGTGPHCDPTALTILLQDDVGGLEVLVDGEWRPVSPVPGAMVINIGDTFMALSNGRYKSCLHRAVVNQRRERRSLAFFLCPREDRVVRPPPSAATPRHYPDFTWADLMRFTQRHYRADTRTLDAFTRWLAPPAADAAATAQVEAAS

SEQ ID NO: 25605 - protein, 576 aa, Buchnera aphidicola
MLKLYFTIINMTESFAQLFEESLKNIKTRPGSIIQGTVVAITKDTILVDAKLKSESKIPIDQFKNSQGELEVKVGDQIDVALDAIEDGFGETLLSREKAKRHEAWLTLEQAYKDSKTVVGLINGKVKGGFTVELEDIRAFLPGSLVDIRPVRETMHLEGKELEFKVIKLDQKRNNVVVSRRAVIESEYNAERNLLLETLQEGLIVSGIVKNLTDYGAFVDLGGVDGLLHITDMAWKRVKHPSEIVNIGDEVKIKILKFDREKIRVSLGLKQLSDDPWTKISERYPEKTKITGRVTNLTDYGCFVEIEEGVEGLVHVSEMDWTNKNIHPSKMVQVNSVVKVMILDIDEERRRISLGLKQCKNNPWMEFSKKYNKGSHVVGKIKSITDFGIFIGLEGSIDGLVHLSDISWNISGEESVKKYKKGEEVLAVVLQVDPDRERISLGIKQLQEDPFAKYVSSHKKGSLVSGTIKKIDNNVIVVSLSEHIDGLIKFLNISDEIMNVHDNKPWNKAKIGEIVEVKLNSIDKKERIIYLSILEKQELKISNDIKKNNSHKQEIDKDKNFSNAMTEAFKAAKNVD

SEQ ID NO: 25606 - protein, 332 aa, Ficus dammaropsis
DRVFVDHPSFLEKVWGKTGSKIYGPIAGEDYQDNQLRFSLLCQAALEAPRILKFTSSKYYSGPYGEDVVFIANDWHSALLPCYLKSMYKANGLYKSARVSFCIHNIAYQGRFAFTDFALLNLPDDFLSSFDFIDGYEKPVKGRKINWMKAGILESDRVLTVSPYYAQELVSGAEKGVELDHVLRKIGIIGIVNGMDVQEWNPLTDKYIAIKYDASNVMSAKALLKEALQAEVGLPVDRNIPVIGFIGRLEEQKGSDILIAAIPHFIKENVQIIVLGTGKKPMEKQLQQLEILYPDKARGVAKFNVPLAHMITAGADFILVPSRFEPCGLIQL

SEQ ID NO: 25607 - protein, 603 aa, Escherichia coli
MLRPVETPTREIKKLDGLWAFSLDRENCGIDQRWWESALQESRAIAVPGSFNDQFADADIRNYAGNVWYQREVFIPKGWAGQRIVLRFDAVTHYGKVWVNNQEVMEHQGGYTPFEADVTPYVIAGKSVRITVCVNNELNWQTIPPGMVITDENGKKKQSYFHDFFNYAGIHRSVMLYTTPNTWVDDITVVTHVAQDCNHASVDWQVVTNGDVSVELRDADQQVVATGQGTSGTLQVVNPHLWQPGEGYLYELCVTAKSQTECDIYPLRVGIRSVAVKGEQFLINHKPFYFTGFGRHEDADLRGKGFDNVLMVHDHALMDWIGANSYRTSHYPYAEEMLDWADEHGIVVIDETAAVGFNLSLGIGFEAGNKPKELYSEEAVNGETQQAHLQAIKELIARDKNHPSVVMWSIANEPDTRPQGAREYFAPLAEATRKLDPTRPITCVNVMFCDAHTDTISDLFDVLCLNRYYGWYVQSGDLETAEKVLEKELLAWQEKLHQPIIITEYGVDTLAGLHSMYTDMWSEEYQCAWLDMYHRVFDRVSAVVGEQVWNFADFATSQGILRVGGNKKGIFTRDRKPKSAAFLLQKRWTGMNFGEKPQQGGKQ

SEQ ID NO: 25608 - protein, 166 aa, Unknown
  uncultured bacterium
MSQRPNCRSHYFLCVPRSPLMSDSIHIVCPHCQSINRVPANKLAEKPNCGRCQHPLFTGEPIDLTTATFARHLERSDLPLLVDFWAPWCGPCKMMAPQFEQAASLLEPKVRLAKVNTEAEPHLAAQFGIRSIPTLILFRGGHEVARQAGAMGAQDIMRWVASQLPR

SEQ ID NO: 25609 - protein, 669 aa, Thermoplasma volcanium
MTLTVCPYCGTGCQINVEYRNGHFTVHGYNKSIVNQGKLCIKGYQGLSYSSSSQRLNYPMIRKNGILTKVTWNEALDYVSEKLKTIRNKYGADAVAFQSSAKCTNEENYLMQKIARMFGTNNIDHCARSCHSSTVAGLIKTIGTAAATGSIKSLKSTKTYFIIGSNTTEQHPIIGTTVLKGKKSGSYLIVADPRKTKLASNADIFLQFRPGTDVALLNSIMFVILKENLYDEEFIKNRTEDFDKLAAEIEKYPPELTEAITGVDAELVRRAAEIYAKYKPSAILYGMGITQHIHGTENVMSVSNLALMTGNIGKYGAGIFPLRGQNNVQGSSDMGALAEFYPGYIPVDSEGVKRFEDLWKTELPKKVGLTLSEMFDAAAAGKVKAIYLMGENPVITEANVAEVEKGIENLELFIVQDIFLTETASLADVVLPAATALEKDGTFTNTERRVQRIVSVKSPPGEAKQDWWILSEIAHRLVGTERYRSVEDVFNEITQAIPNYSGIRYQDIYPTGKQWPVNEQNPDGTEILHTVKFTRGLGRFYPVSYEPPSEIADAEYPFILTTGRNYYHWHSGTMTRRSDILERESPSPYVEISMMDAKQLNIRDGQAIDVESRHGRITLPAKVTDKIPTGIIFVPFHFKEARVNLLVGDNLDPYSKIPEFKVVAARVIV

SEQ ID NO: 25610 - protein, 326 aa, Buchnera aphidicola
MIENTLKIEHHKLIILGSGPAGYTAAIYSARANLEPLLFTGNNKGGQLINTNEIENWPGDSKSLTGLELMERMHNHAKSLNTKIIPNEIIRVNFFKIPFLLVSDTNQYYTSDSVIIATGASPKYLGLTSESKFIGKGVSVCAVCDGFFYKNEDVAVVGGGNTALEEALYLSNIARKVYLIHRRKTFSAEKILISRMLNKTKKNIILRTGCIVNKIIGGVNGVRGVQITCNDSKENKCLINLSGVFIAIGHAPNTKLFKNQLFMKNDYILVKSGIHGNVTQTNIPGIFAAGDVIDHVYKQAITSSASGCMAALDAEKYIDQKYGFKI

SEQ ID NO: 25611 - protein, 72 aa, Buchnera aphidicola
MTKEDCIEMQGVVIDTLPNTMFRVQLDNKHIVTAHISGKMRKNYIRILTGDKVTLELTPYDLSKGRIIFRSR

SEQ ID NO: 25612 - protein, 259 aa, Picea abies
DLECDALGWQYISGCLPDGREMDRIDNPQFEGYKFDPAGEYVRRWLPELARLPTEWIHHPWDAPRAVLQAAGVELGSNYPLPIVEISTAKERLQEGLSEMWQREADARASLENGTEEGLGESLENANASLPDQMDVDREPVRNNTHLAARSQDDQLVPSISNAVQRAYVGYTLSQAASSSPSEQAEVPSNTDSGIASAASSQQFLGQSTWSMTRGLIEDLPNVTNDYAQMQVLDEQNESHSTADSSSILRGRDDMSSGG

SEQ ID NO: 25613 - protein, 695 aa, Arabidopsis thaliana
MDKSQKNPTSQIGTSTPKSKFEDSPVFNYISNLSPIESVKSISTAQTFSSLSFTSPPPVFTSPHVISHRESRFFRCHNSVDRSKHLESLDGSAVKGEVVVPLVEDLNKEASLEDEEETSVETSSELPQILKFDSQTSEHSDSPCTEDVVIEASSDPPRGDNGSSSEDVTMGLQNMLVVREGNDTPGCGRLISDATELLVFRSPNDSEAFRCLVDKISSSERRFCAGVKSTKRPDINKDIPANGSSNENQPLAVLPTNESVFNLHRGGMRRRCLDFEMPGKRKKDIVDDQQSVCDNNVAGESSSSCVVPGIGLHLNAVAMSAKDSNISVIHGYSISGEIQKSFSGSTTPIQSQDTVQETSDQAENEPVEEVPKALVFPELNLGSLKKKMRKSEQAGEGESCKRCNCKKSKCLKLYCECFAAGVYCIEPCSCIDCFNKPIHEETVLATRKQIESRNPLAFAPKVIRNADSIMEASDDASKTPASARHKRGCNCKKSNCMKKYCECYQGGVGCSMNCRCEGCTNVFGRKDGSLLVIMESKLEENQETYEKRIAKIQHNVEVSKEVEQNPSSDQPSTPLPPYRHLVVHQPFLSKNRLPPTQFFLGTGSSSFRKPNSDLAQSQNEKKPLETVTEDKTEIMPEILLNSPIANIKAISPNSKRVSPPQPGSSESGSILRRRGNGRKLILRSIPAFPSLNPNQ

SEQ ID NO: 25614 - protein, 456 aa, Yersinia pestis
MADAPLSTAAPPSISRRNLAILITDILLFILLLNVLPFDTNANRGLAFIGILWLTEALHVTITALLVPLIAVGTGLMDVNTGLRSFANPIIFLFFGGFALATALHIQGLDKLIANRLLLAAKGQLMVAVLMLFGATALVSMWISNTATTAMMLPLALGVIGNLNLERERNTYVFILLGIAYSASIGGLGTLVGSPPNAIAAAQLGLDFVGWMKYGTPAMIILMPLMVATLYVILRPNLKHHFDIELEQLPWTAARRITIGIFGMTVIGWIFSSQLSQMLGGVKQFDTLVALSAVVLIGISGVASWRQIQQNTGWGVLLLFGGGLTLSVILRDSGASAVMAQGIVSIFGAYHWFIIILAVATFIIFLTELTSNTASAALLVPVFATVSEALGMPPLLLTMIIGIGASCAFMLPVATPPNAIVYGTGFIRQPEMVKVGFWLNIICIIVVSLLAWYLWY

SEQ ID NO: 25615 - protein, 265 aa, Unknown
  Rosa hybrid cultivar
LVQFGAFIVLCGATHLINLWTFSVYSRTVAIVMATAKVFTAAVSCATALMLVHIIPDLLSVKTRELFLKNKAAELDREMGLIRTQEETGRHVRMLTHEIRSTLDRHIILKTTLVELGRILTLEECALWMPTRTGLELQLSYTLHQQNPVGYTVPIHLPVINQVFNNNGTVKISPNSPVARLRPIAGKHIPGEVVAVRVPLLHLSNFQINDWPELSTKRYALMVLVLPSDSARQWHVHELELVEVVADQVAVALSHAAILEESMRA

SEQ ID NO: 25616 - protein, 259 aa, Picea abies
DLECDALGWQYISGCLPDGREMDRIDNPQFEGYKFDPAGEYVRRWLPELARLPTEWIHHPWDAPRAVLQAAGVELGSNYPLPIVEISTAKERLQEGLSEMWQREADARASLENGTEEGLGESLENANASLPDQMDVDREPVRNNTHLAARSQDDQLVPSISNAVQRAYVGYTLSQAASSSPSEQAEVPSNTDSGIASAASSQQFLGQSTWSMTRGLIEDLPNVTNDYPQMQVLDEQNESHSTADSSSILRGRDDMSSGG

SEQ ID NO: 25617 - protein, 177 aa, Unknown
  Marinobacter sp. ELB17
MSFTGENYPGVKAPTKESAGFRLNHTMLRIKNPEKSLAFYTHVLGMTVLRRVDFEEMQFSLYFLTKMQPDQIVPEDKSDRTVWTFSQTGILELTHNWGTENQDGFAYHDGNAQPQGFGHICFSVPDLDLAISWFDANNVTYVKRPEQGKMRDVAFIKDIDSYWIEIVEAARLSRMGD

SEQ ID NO: 25618 - protein, 339 aa, Yersinia pestis
MNTNPASMAVIGAGSYGTALAITLARNGHQVVLWGHDPKHIQQLQQDRCNRAFLPDAAFPDTLRLETDLACALAASRDVLVVVPSHVFGAVLHQLKPHLRKDARIVWATKGLEAETGRLLQDVAREVLGEAIPLAVISGPTFAKELAAGLPTAIALASTDVQFSEDLQQLLHCGKSFRVYSNPDFIGVQLGGAVKNVIAIGAGMSDGIGFGANARTALITRGLAEMTRLGTALGADPSTFMGMAGLGDLVLTCTDNQSRNRRFGIMLGQGLGVKEAQDNIGQVVEGYRNTKEVLALAQRHGVEMPITEQIYQVLYCHKNAREAALTLLGRTKKDEKIGI

SEQ ID NO: 25619 - protein, 169 aa, Streptococcus pyogenes
MERAIFAGGCFWCMVQPFEEQAGILSVRSGYTGGHLPNPSYEQVCAKTTGHTEAVEIIFDPEEISYKELVELYWVQTDPTDAFGQFEDRGDNYRPVIYYTTERQKEIAEQSKANLQASGRFDQPIVTTIEPAEPFYLAEDYHQGFYKKNPKRYAQSSAIRHQFLEENWS

SEQ ID NO: 25620 - protein, 486 aa, Unknown
  Marinobacter sp. ELB17
MDFLPLFFNLNDRQVLLVGGGDIALRKARLLKRAGVGLTVISHAVDEELRALLTDDRDEIILGDYHSDLLAGKTLVVAATDNAELHRQVHAEAIARNIPINVVDTPKLCSFIFPAIVDRSPIVIGITSGGQSPVLARLLRARLETLIPKGYSSLGGLVGRFRDRVKARFNSLNDRRQFWENVLEGQIAEKVFSGRHDEAESMLVSAINRGDAGHKTGEVYLVGAGPGDPELLTFKALRLMQQADVVFYDNLVSPEVLDLCRRDADLIYVGKRRDHHTVPQDDINALLVKHAKLGRRVVRLKGGDPFIFGRGGEELEELKAHGIPFQVVPGITAASACSTYAGIPLTHRGYAQSVRFVTGQLKNRQQALDYKELIQPNQTVVFYMGLHTLPQLSAGLMAHGRATDTPVAIVSRGTAVDQKVLIGTLADIAAKQELAQLPAPALIIVGDVVRLYEKLAWFGEAAPSDNITHALGMVRRKAKFTEANVA

SEQ ID NO: 25621 - protein, 415 aa, Lactococcus lactis
MIFDKEDFESFDPELWAAIHAEEIRQQQNIELIASENIVSKAVMAAQGSVLTNKYAEGYPGKRYYGGTEAVDVVENLAIERAKELFGAKFANVQPHSGSQANAAAYMALIQPGDTVLGMDLNAGGHLTHGASVNFSGKTYHFVPYGVNSETELLDYDEILKIAKQVQPKLIVAGASAYSRLIDFAKFREIADSVGAKLMVDMAHIAGLVATGAHPNPLPYADVVTTTTHKTLRGPRGGMILTNDEALAKKINSAIFPGTQGGPLEHVIAAKAVAFKEALDPEFTTYIEQVIKNTQAMAEEFAKVEGLRLIAGGSDNHLLNLKVLDLGINGKEAQDLLDSVHITLNKEAIPDETLSPFKTSGVRIGAAAITSRGFKEVEAKKVAQLVSEALVNHDNQEKLAEVRKAALELTRQFPL

SEQ ID NO: 25622 - protein, 450 aa, Listeria innocua
MTHIKFDYSKALRFFEERELDYLEPAVKAAHDSLHNGTGAGNDALGWINLPTDYDKEEFARIKKATEKIHSDSDVLIVIGIGGSYLGARAAIETLNHSFYNVLEKGARKTPQVFFAGNSISSSYLHDLIEVVGDRDFSVNVISKSGTTTEPAIAFRVFKELLIKKYGEEGAKKRIYATTDKAKGALKTLADNEGYETFVVPDDVGGRFSVLTAVGLLPIAVSGVDIDALMNGAAAASKDFDKPELKNNIAYQYAAARNVLYRKGKVTELLISYEPGLQYFNEWWKQLFGESEGKDKKGIYPSSANFSTDLHSIGQYIQDGRRNLFETVIKVDKPRHNLTINKEEVDLDGLNYLAGETVDFVNTKAFEGTLLAHTDGEVPNFVVEVPELDAYTFGYLVYFFEKAVAISGYLNGVNPFDQPGVEAYKANMFALLGKPGFEDKKAELEKRLND

SEQ ID NO: 25623 - protein, 184 aa, Unknown
  Rosa hybrid cultivar
MLKMMEVCQARGFVYGIIPEKGKPVSGASDNIRAWWKEKVKFDKNGPAAIDKYEAEILAMTDADNNRNGNSHTILQDLQDATLGSLLSALMQHCDPPQRKYPLEKAVPPPWWPTGNEDWWMKSGLPCGQSPPYKKPHDLKKMWKVGVLTAVIKHMSPDIAKIRRHVRQSKCLQDKMTAKITSEF

SEQ ID NO: 25624 - protein, 495 aa, Mycobacterium abscessus
MTGTTTTLIVGAGFAGIGTAIRLLQEGTDDFVILERSNRVGGTWRDNTYPGAACDIPSLLYSYSFEPNPGWTHTYSGSAEILEYIDTIVTKYDLARFIQFDTDVTALEFDEGAGIWVADTADGKRYQARSVVMASGPLADASFPDIRGIDSYEGKKIHSARWDQGYDLGDKRVAVIGTGASAVQILPELVKSAASVKVFQRTPGWVLPRVNLKHPAWARSTFKQLPVSEQALRDAWFWAHEVMAVGMVWNTAATSAIQLAAKAHLRRQVKDPWLRRQLTPHFRPGCKRMLMTSDYYPALQSDNCKLISWPIATLSPNGVRTADGVEHEVDCIVFATGFDVCKRGTPFPISGLGGRKLGDEWSQGRYAFKSVSVAGYPNLFFTFGPNSGPGHNSALVYMEAVIDYVVKAIKLLQQNDIGTLDVREDRQGRYHSEIQRRLRRTTWNSGCSSWYLTEDGYNGTMYPGFATQFMRELSRLDPRDYVITRRDDAHLRLTQ

SEQ ID NO: 25625 - protein, 494 aa, Novosphingobium aromaticivorans
MAQFPNTPSFTGFNTPSRIEADIADLAHEGTIPQGLNGAFYRVQPDPQFPPRLDDDIAFNGDGMITRFHIHDGQVDFRQRWAKTDKWKLENAAGKALFGAYRNPLTDDEAVKGEIRSTANTNAFVFGGKLWAMKEDSPALVMDPATMETFGFEKFGGKMTGQTFTAHPKVDPKTGNMVAIGYAASGLCTDDVTYMEVSPEGELVREVWFKVPYYCMMHDFGITEDYLVLHIVPSIGSWERLEQGKPHFGFDTTMPVHLGIIPRRDGVRQEDIRWFTRDNCFASHVLNAWQEGTKIHFVTCEAKNNMFPFFPDVHGAPFNGMEAMSHPTDWVVDMASNGEDFAGIVKLSDTAAEFPRIDDRFTGQKTRHGWFLEMDMKRPVELRGGSAGGLLMNCLFHKDFETGREQHWWCGPVSSLQEPCFVPRAKDAPEGDGWIVQVCNRLEEQRSDLLIFDALDIEKGPVATVNIPIRLRFGLHGNWANADEIGLAEKVLAA

SEQ ID NO: 25626 - protein, 354 aa, Coprinopsis cinerea
MAYQYRNDLLAPFLALPQGDKVQAEYVWVDGDGGLRSKTTTVSKKVTDIGQLRIWDFDGSSTNQAPGNDSDVYLRPAAIFKDPFRGGDNILVLAETYNNDGTPNRTNFRHHAAKVMEQAKDEEPWFGLEQEYTLFDVDGTPFGWPKGGFPGPQGPYYCGAGTGKVFARDLIEAHYRACLYAGINISGINAEVMPSQWEFQVGPCEGISMGDHLWMARYLLVRIAEQWGVKVSFHPKPLQGDWNGAGCHTNFSTKSMREEGGIKAIEAAIERLGKRHDEHIAVYGDDNDMRLTGRHETGHIGVFSSGVANRGASIRIPRHVAAQGHGYLEDRRPASNIDPYRVTSIIVETVCLNN

SEQ ID NO: 25627 - protein, 398 aa, Oryza sativa
MGVLSAADPPPVSAIGFEGYEKRLEITFSEAPVFADPDGRGLRALSRAQIDSVLDLARCTIVSELSNKDFDSYVLSESSLFIYSDKIVIKTCGTTKLLLTIPRILELAEGLSMPLAAVKYSRGMFIFPSAQPAPHRSFSEEVAVLNRYFGHLKSGGNAYVIGDPAKPGQKWHIYYATQHPEQPMVTLEMCMTGLDKEKASVFFKTSADGHTSCAKEMTKLSGISDIIPEMEICDFDFEPCGYSMNAIHGLAFSTIHVTPEDGFSYASYEVVGFDASTLAYGDLVKRVLRCFGPSEFSVAVTIFGGHGHAGTWAKELNADAYKCNNMVEQELPCGGLLIYQSFDATEDVPVAVGSPKSVLHCFEAENMVNPAPVKEGKLGNLLPWGEDALEENDGVFDE

SEQ ID NO: 25628 - protein, 591 aa, Mycobacterium abscessus
MTRAVSPSDFNQLDPTSRSRYTGDRSMYSRLCSGFFPKPETRFIERDASLKPRKSGESVRTGNAPTPTPPRPPQREVSRLCLMSSNFATACRAYDPSIVIIGAGFAGVAMAHRLKKDGFTNFTILEKAADIGGVWRDNTYPGAACDVPSALYSLSYKPNPRWSRRYAEQPEILKYLQQLVESGGLAAHLRTQTEVVAMTFDDQLGRWTLVTNSNETITCDVVVSAVGQLSLPHVPVIADADTFQGPRFHSARWDRSVSLRGKQVAVIGTGASAIQFVPHIVQEAEHVTLYQRTAPWILPKWDSRYGVLHDRVSELLPMALRLERFAVWLIFELLAVTLVDAKPLSRVLGAIARRHLHRQVASPSLREQLMPSDAPGCKRVLFSNDYYPAIASDRVSLVPKAIAELCDNGVKTVDGEFRPADVVIYGTGFRATDFLAPMSVRGSRGVSLAEVWKTQAYAYLGITVPMFPNLFLLYGPNTNVGSGSILYMIESQVRHIATLIKAVAAHPGHAIDVRTESAQRYNTRLRRRLRRSVWALCASWYRTSSGEIPTNWPGPTLVYRLLTRKPHSGDYVLRNVGRLKVGDPAEPSLAD

SEQ ID NO: 25629 - protein, 332 aa, Ficus hispidioides
DRVFVDHPSFLERVWGKTGSKIYGPIAGEDYQDNQLRFSLLCQAALEAPRILNFTSSKYYSGPYGEDVVFIANDWHSALLPCYLKSMYKAKGLYKSSRVSFCIHNIAYQGRFAFTDFAFLNLPNDFLSSFDFIDGYEKPVKGRKINWMKAGILESDRVLTVSPYYAQELISGAEKGVELDYVLQKTGIIGIVNGMDVQEWNPLTDKYIAIKYDASNVMSAKALLKEALQAEVGLPVDRNIPVIGFIGRLEEQKGSDILIAAIPHFIKENVQIIVLGTGKKPMEKQLQQLEILYPGKARGVTKFNVPLAHMITAGADFILVPSRFEPCGLIQL

SEQ ID NO: 25630 - protein, 396 aa, Streptococcus pyogenes
MSDFLFFIESFYGLVSYIMNNTEYYDRLGVSKDASQDDIKKAYRKMSKKYHPDINKEAGAEQKYKDVQEAYETLSDSQKRAAYDQYGAAGAQGGFGGGAGGFGGFDGGGFGGFEDIFSSFFGGGGSRNPNAPRQGDDLQYRVNLSFEEAVFGVEKEVSYNREATCGTCLGSGAKPGTAPVTCRKCHGSGVMTIDTQTPLGMMRRQVTCDICHGSGKEIKEPCQTCHGTGHEKQAHKVSVKIPAGVETGQQIRLQGQGEAGFNGGPYGDLFVILNVLPSKQFERNGSTIYYNLDISFTQAALGDTVEIPTVHGDVEMAIPAGTQTGKTFRLKGKGAPKLRGGGQGDQHVTVNIVTPTKLNDAQREALQAFAEASGEKMLHPKKKGFFDKVKDALEDI

SEQ ID NO: 25631 - protein, 498 aa, Mycobacterium abscessus
MDAVEAAQRPGGTMTNHLLAPAHHVKERLSSVIMVPAPHAVDDRWRRWSRDWPVRELAPAPAGSGLKAVRGDAGLPFVGHTLDYIRFGSDFSRERYDRLGSVSWMGAFGTKMVVIAGPDATREAFTSEAKAFSQDGWSFLIDAFFHRGLMLMSFDEHLMHRRIMQEAFTRPRLTGYVEQVTPCVRSAVPAWPVGPSVRIYPLLKELTLDIATDVFMGGRGKDESDAVNKAFVATVRAASSLVRAPLPGTRFRAGVQGRRVLEDYFFRHLPAARAGETEDLFAALCQATTEDGERFSDEDVVNHMIFLMMAAHDTSTITTTAVTYFLAKYPQWQEAAAAEAAAIGDGLPDIEALEKMTVIDRVIKEALRLLAPVPLVMRKTVRDVAIDGYHIPSNTLCAITPAVNHFDRTIWNDPERFDPSRFDEPRREDQHHRFAWVPFGGGAHKCIGMQFGTLEVKAILHRMLRSFTWKVPENYHVRWDNTSLPIPVDGLPLEMKRR

SEQ ID NO: 25632 - protein, 125 aa, Glycine max
  misc_feature (112)..(112): Xaa can be any naturally occurring amino acid
HIKDLASYNKVGKYYIEMGPYNTHVTPVILTNIIENPAWHTEITPYQAEIFQGRLETLIDHHTMTTDLTGLPMDNAALVDEGTVGADALSMCNNIQIGERNSFIIASDCHPXQTIDICETRADGA

SEQ ID NO: 25633 - protein, 332 aa, Ficus mollior
DRVFVDHPSFLEKVWGKTGTKIYGPIAGEDYQDNQLRFSLLCQAALEAPRILKFTSSKYYSGPYGEDVVFIANDWHSALLPCYLKSMYKANGLYKSARVSFCIHNIAYQGRFAFTDFALLNLPDDFLSSFDFIDGYEKPVKGRKINWMKAGILESDRVLTVSPYYAQELVSGAEKGVELDHVLRKTGIIGIVNGMDVQEWNPLTDKYIAIKYDASNVMSAKALLKEALQAEVGLPVDRNIPVIGFIGRLEEQKGSDILIAAIPQFIKENVQIIVLGTGKKPMEKQLQQLEILYPDKARGVVKFNVPLAHMITAGADFILVPSRFEPCGLIQL

SEQ ID NO: 25634 - protein, 307 aa, Geobacter sulfurreducens
MPLLTNDKVIEQIGNTPLLRLAKLERKGSAAVFGKAEFFNPGGSIKDRICLAMIEAAERDGTLKPGATVVEPTSGNTGIGLSMICAVKGYKLILTMPDTMTVERRRLLAAYGAELILTPGAQGMRGAVMKAEELAAQPGHVMMHQFKNPANPDIHRRTTGPEIVETLSGTTIDAFVAGVGTGGTITGVGEVLRTHNSSVRVVAVEPADSPVLSGGQPGPHKIQGIGAGFVPDVLNTKVYDEIITVSNDDAYATVRDLAREEGILVGISSGANVFAALQVAAKLGPGKNVVTILCDTGERYLSTGVFD

SEQ ID NO: 25635 - protein, 332 aa, Ficus nodosa
DRVFVDHPSFLEKVWGKTGSKIYGPIAGEDYQDNQLRFSLLCQAALEAPRILNFTSSKYYSGPYGEDVVFIANDWHSALLPCYLKSMYKAKGLYKSARVSFCIHNIAYQGRFAFTDFALLNLPDDFISSFDFIDGYEKPVKGRKINWMKAGILESDRVLTVSPYYAQELVSSAEKGVELDHVLRKTGIIGIVNGMDVQEWNPLTDKYIAIKYDASDVMSAKALLKEALQAEVGLPVDRNIPVIGFIGRLEEQKGSDILIAAIPHFIKENVQIIVLGTGKKPMESQLQQLEILYPDKARGVAKFNVPLAHMITAGADFILVPSRFEPCGLIQL

SEQ ID NO: 25636 - protein, 457 aa, Ustilago maydis
MPPAALQATVSESVKDAIISKLRQPPSAVPSREWSAETRTSLTPADAGIAEARASAEDIELVDLQHHNFSEPRKRIVSPASLSRFEHSQAFAEILAFICVCNTRVVGKTLTEEIQISSACRTILEMLDQVAALRESTPPDASIGSSRFGNPAFRTFYAKIRENTDRLHRMIPGLETDSEWSRAARAELSVYFQECWGNEKRIDYGSGMELNMACWLLCLCKLRILRLPEDGACIVLRIFWTYVQVMRDIQSSYWLEPAGSHGVWGLDDYHFLPFLWGAGQLSSHRHLRPKAIHDAEIVDEFAPKYMYLACIQFINSVKTASLRWHSPMLDDISGAKSWSKVNQGMIKMYRAEVLKKLPIAQHIFFGSLLRFPEPATGELEEEDVEEDAHGHIHPAGKPHAHGTGEGQAAGWGDCCGIPIPSAFAAAEQEKKRQQGNFSSTMLGEKPFGTGVRRIPFD

SEQ ID NO: 25637 - protein, 291 aa, Thermoanaerobacter tengcongensis
MIAFIVNPVAGGGRAYRKIPEIRRIMKKKLIDYKIFITKYAGHGKILARKAALSGFKVVVAVGGDGTVLEVVNGIKGTPAALGVIPVGTGNDFARFFHIPKKIEKAIDVLIMGNVKVIDAALINGILTFGNIASTGIASETAALAVRFKKFFSGIWAYLVALLNVLFRYKPYSVKIKMDGKEIKKDITIFAAGVLSYYAGGIKLLPGADPHDGCLDVMIVGRVNKLKILVLLPLVIFGKHVHLKSLVETYRTKRVEIEADKEIPITVDGEILYSSKIEIKVEENAIKLCTL

SEQ ID NO: 25638 - protein, 178 aa, Bdellovibrio bacteriovorus
MTMTNLSLKPYITEEQIQQKVKELGATLSKKYKNEKVVAICVLKGSFMFYSDLVRNIEADITCEFFGVASYHGGTSSSGEVKVTLDLAGPVENCHVILVEDIVDTGLTMNYLKNAIQSRKPKSLTTVALLEKPDALKVKCDIDHVGFKIANDFVVGYGLDYQGYYRNLPYIAQVQNFQ

SEQ ID NO: 25639 - protein, 528 aa, Bacillus cereus
MTTFRELGLSDSLLQSVESMGFEEATPIQAETIPHALQGKDIIGQAQTGTGKTAAFGLPLLDKVDTHKESVQGIVIAPTRELAIQVGEELYKIGKHKRVRILPIYGGQDINRQIRALKKHPHIIVGTPGRILDHINRKTLRLQNVETVVLDEADEMLNMGFIEDIEAILTDVPETHQTLLFSATMPDPIRRIAERFMTEPQHIKVKAKEVTMPNIQQFYLEVQEKKKFDVLTRLLDIQSPELAIVFGRTKRRVDELSEALNLRGYAAEGIHGDLTQAKRMSVLRKFKEGSIEVLVATDVAARGLDISGVTHVYNFDIPQDPESYVHRIGRTGRAGKKGIAMLFVTPRESGQLKNIERTTKRKMDRMDAPTLDEALEGQQRLIAEKLQSTIENENLAYYKRIAEEMLEENDSVTVVAAALKMMTKEPDTTPIALTSEPPVVARGGGSKKRGGNGGGYRDGNRNRSRDGRGGDGRNRDRNRDGRNRDGNRDRNREGSRDGNRGRRGEGQGRPGSSNGRGERKHHSRKPQA

SEQ ID NO: 25640 - protein, 250 aa, Arabidopsis thaliana
  misc_feature (136)..(136): Xaa can be any naturally occurring amino acid
MASSMLSSATMVASPAQATMVAPFNGLKSSAAFPATRKANNDITSITSNGGRVNCMQVWPPIGKKKFETLSYLPDLTDSELAKEVDYLIRNKWIPCVEFELEHGFVYREHGNSPGYYDGRYWTMWKLPFGSGCTDXSAQVLKGKWKSARREYPHAFIRIIGFDTPRQSVDQFHCQKPPSLPVNSLCFWVTSNFIPHLDFNPCFPAFPSFWVLFPDLRLFSGGKLIHRIPRAEEKNRKVKKKKKKSGGGPN

SEQ ID NO: 25641 - protein, 529 aa, Geobacter metallireducens
MDNTLLWNRYQSHLFHDPESGLMLDISRMNFADGFLASMESATQKAFAEMGELEGGAIANPDEGRMVGHYWLRSPDLSPTDEIAAEIGETVQRIREFAAAVHGGSIAAPDGRPFRKLLVVGIGGSALGPQFVADALGDVDNPLTPHFFDNTDPDGMDRVLAQIGPDLAGTLTVVISKSGGTKETRNGMLEAEIAYRRAGLHFPRYAVAVTGEGSELDRTATSAGWLARFPMWDWVGGRTSVTSAVGLLPAALQGLDIAGMLEGARLCDQLTRRPDTARNPAALLALMWHHATGGKGARDMVVLPYKDRLLLFSRYLQQLIMESIGKELDREGNVVCQGISVYGNKGSTDQHAYVQQLREGVNNFFVTFIEVLRDRRGASLPVEPGVTSGDYLSGFLQGTRTALGEKGRESLTITIPEVSPRTVGMLIALFERAVGLYASLVNINAYHQPGVEAGKKAAGTVLAHQADIIAHLRGTGSSLTADEIAAALGRPDAAETVFRTLLHAAANPDHGIRMEPAESLTASRFSVRD

SEQ ID NO: 25642 - protein, 141 aa, Euryale ferox
FSEEQEALVVKSWGVMKKDAGQLGVKFFAKIFEIAPSAKRMFSFLRDSDLPLEQNPKLKPHALSVFAMTCESAVQLRKAGKVTVRESSLKDLGATHFKYGVVDEHFDVRFAFSRSVFSSIRDLFQPEMKIAWGEAYDKLAA

SEQ ID NO: 25643 - protein, 108 aa, Unknown
  Candidatus Kuenenia stuttgartiensis
MAEGLVEITDANFDAEVTNAKIPVLVDFWASWCGPCRQLAPVIEELAKEYSGKAKIGKLNTEENNSTPAKFGITSIPTIILFKNGKAVNRIVGVKSKNDLKTALDAQL

SEQ ID NO: 25644 - protein, 147 aa, Euryale ferox
MGSIGFSEEQEALVKEAWELMKPNVQELGLKMFFLSWADVAGGAGMFYFLKDQNEIPRNNPQLRSHVVKVFTMTCESAAQLHKNGKVEAVGSTLKKMGAIHLKKGVQESHFEVIKVAFLKVVKEAVEEKWSEEMGAAWAEAYDKLAA

SEQ ID NO: 25645 - protein, 112 aa, Unknown
  Silicibacter sp. TM1040
MKKIEAIIKPFKLDEVKEALQDVGVQGLSVIEVKGFGRQKGHTELYRGAEYVVDFLPKVKIEVVLDDDQVDAAIEAIVAAAKTDKIGDGKIFVSPVEQAIRIRTGEAGSDAL

SEQ ID NO: 25646 - protein, 814 aa, Burkholderia mallei
MRKMKLVMVGNGMAGVRTLEELFKLAPDLYDVTVFGAEPHPNYNRILLSPVLAGEQTLEQIVLNDYAWYASHGVTLHVGKKIVKIDRVKRVVIADDGTEAAYDRLLLATGSNPFMLPVPGAQLDGVLGYRDIADTQAMIDAAARHTHAVVIGGGLLGLEAANGLKLRGMDVTVVHLAPTLLERQLDAKAGDLLRASLEARGLTFLMPKQTQALVGDEHGRVRAVHFKDGGECKADLVVMAVGIRPNTALAESAGLYCNRGLVVNDTMQTYDPRIYAVGECVSHRGIAYGLVAPLFEQAKVAANHLAQFGIGRYTGSVTSTKLKVTGIDLFSAGDFLGGDDTEDITLSDPIAGVYKKLVIKDDRIVGACLYGDTADGAWYFKLLREGRNIADIRETLMFGETSLGDTGHSGATRAMTMADDAEVCGCNGVCKGTIVSAIKEKGLFTLDDVRKHTKASASCGSCTGLVEQILMSTLGGDYSASPKAKPVCGCTDHTHAEVRAAIREHKLLSVPEAMRFLEWRTPNGCSSCRPALNYYCISTWPHDAKDDPQSRFINERAHANIQKDGTYSVVPRMWGGVTSADELRRIADVVDKYAIPTVKVTGGQRIDLLGVKKEDLPGVWRDLGMPSGHAYAKALRTVKTCVGSEWCRFGTQDSTLMGQQLERALWRMYAPHKVKLAVSGCPRNCAESGIKDVGVIGVDSGWEIYVGGNGGIKTEVAQFFCKVKTHEEVLEYAGAFLQLYREEGWYLERTVHYLERVGLDHVKARVLDDAENRRALWDRLQFALKDEPDPWHDTQDAKVDLRQFIPIAVAPADA

SEQ ID NO: 25647 - protein, 241 aa, Burkholderia mallei
MTVYFIGAGPGDPELITVKGQRLVRRCPVILYAGSLVPAAVLDGHRAELVVNTAELDLDEIVALLARAHGKGQDVARVHSGDPPLYGAIGEQIRRLAALGIPYEIVPGVTATAACAAALGVELTLPGVAQTVILTHYAGKTTMPAGESLASLAAHRATLAIHLGVRHLARIVADVLPHYGADCPIAVIYRASWPDEARVTGTLADIVDKVSGRSIERTALILIGRVLSAEGFDESTLYAKA

SEQ ID NO: 25648 - protein, 402 aa, Bordetella bronchiseptica
MRKAAVIGGSLGGLFAANLLLRAGWDVHVHERVHDELDGRGAGIVTHPELLDVLRRIGVAPTESIGIEVARRVTLDLDGSVLASRALPQLLTAWGRLFSILRTRFPAERYHRGQALESLEQDERRALLRFADGARAEVDLVVAADGLRSTLRQALLPQARPAYAGYVAWRGLVDEASLSERTRRELCPYFAFGLPAHEQMIAYPVAGTGSGAQDAARRFNFVWYRPADEHTTFRDMVTDAQGQAWMDGIPPPLIRPEIVAQARQAAAQVLAPQFGEVVAKTANLFFQPIFDLESPRLALGRVALLGDAAFVARPHCGMGVTKAAGDARALAYALAGTPDIGAALQAYEDERLPFGKFIVGHARDLGRYMQAQLRDDAEREMAERYRTPEAIMRETAVAPAWR

SEQ ID NO: 25649 - protein, 175 aa, Fusobacterium nucleatum
MNYRIENLIDKEAVEKRIKELAREIEKDYAGEEVYCVGLLKGSVIFLSDLVKEINIPVIIDFMSVSSYGSETVSSGDVKILKDTDLDLRGKHVLIVEDIIDTGLTLEYVIKYFKEGKGVKSLRTCTLLNKPERRKVDVKVDYIGFDVPDKFVIGYGLDYDQKYRNLPYIAVVIPE

SEQ ID NO: 25650 - protein, 85 aa, Setaria sphacelata
ECQKVGAPPEVSARLTAMAQELEARQRTALGGLGAATEPEPDQFMEAYHEMLVKFREELTRPLQEAMEFMRRVESQLNSLSISGR

SEQ ID NO: 25651 - protein, 951 aa, Burkholderia mallei
MTVDTLAQPIAPSTPGAVRETRSTCCYCGVGCGVVIETRRDANGRDTIVGVRGDPDHPANFGRLCSKGSTLHLTATPERYAQTRATHPELRASRDATRTRVSWDDALEHVAQRLARTVERHGPDSVGFYISGQLLTEDYYVFNKLAKGLVGTNNIDSNSRLCMSSAVVGYKKTLGADAPPCSYEDLDHALTVLIAGANPAYAHPILYRRLEAARARNPQMKVIVADPRRTDSASDATLHLALQPGTDTMLFNAMLHVLIWDGALDSAFIAAHTHGFDALRDAVRDATPAAAAQVCGLRADDIVQAARWFGAGPSLSLYCQGLNQSSSGTAKNVALINLHLATGQIGKPGAGPFSLTGQPNAMGGREVGGMATLASAHRDLANPAERAEIARLWGVPDLPAKPGLTAVEMFERLAEGALKAIWIVCTNPAHSIPSQALARAGLERAEFVVLQDAYAHTGTAPYADVLLPAATWGEKEGTVTNSERRISRVRAATQPYGDARADWRIAADVGHRLEARLAPGRPTLFPYEDAEAIWNEHRATTLGRDCDIGGLSWPLLARDGPQQWPFPAGATQGLARLYTDGRFPSADGRARFVPTPYQPVAEAVDARYRFALTTGRLRDQWHGGSRTGSVAKLFAHAPQPCVELNPGDCARLGLGAHDFVHLTSRRGSALMPARADDAVAPGQAFAPMHWGDEYVSGVAGNRAAMGINALTTPARDPHSQQPELKHAAIKLLKADLPWRWLIAARVPPGELLARQRAARAFFARFPYASCVPFGTDAYAGLAWRAAAYEPAPAELQREIEALFELPAQAADVMSYGDARRGTGRRVRIVDGALVAFSVAGAAGATEDSAAVLRDYVDTGASVGALGRLLLFAGRVPLQTAPARGRTICNCVGVSEREIGAVLAADAPSAAPIERLANLQERLKCGTQCGSCIPELRRLIAETATAAAPPPR

SEQ ID NO: 25652 - protein, 539 aa, Desulfovibrio vulgaris
MSMFCNQCEQTAKGTGCTTIGVCGKQPEVSALQDLTIYALRGLSLVALAAREKGIIDAKIDEYTAKALFTTLTNVNFDPARFDVYVREIVAHRKALAARAGVDFSEGPAAFEPASTLDGLVAQAEIGSVTAGAEDADIRSLKQILLYGMKGVAAYVDHAAILGQTDAAVFGFLHKGLAAGYDGVARDLGAWIELAMECGRANLRAMELLDAGNTTTYGHPVPTQVPLGHRKGKCILVSGHDLKDLFELLKQTEGKGIDIYTHGEMLPTHAYPELKKFPHFYGHFGTAWQNQHKEFPAFPGAILFTTNCIQKPQASYAANVFTTGLVGWPGLVHCENHDFTPVINKALELPGFTDDVPGKTVTVGFGRNTVMSVAPAVIDAVKSGAIRHFFLVGGCDGAKPGRNYYTEFVEKTPADTVVLTLACGKFRFFDKDLGTIGGIPRLLDVGQCNDAYSAIKIASALAEAFNCGVNDLPLSLVLSWYEQKAVAILLTLLAIGIKDIRLGPSLPAFVTPNVLKFLVDNFNIKPISTADEDLKAILG

SEQ ID NO: 25653 - protein, 292 aa, Helicobacter pylori
MIRASVLQHAYCGSRKKTIEHTANLLEQALKKHPKTNLVVLQELNPYSYFCQSENPKFFDLGEYFEEDKAFFSALAQKFQVVLIASLFEKRAKGLYHNSAVVFEKDGSIAGVYRKMHIPDDPGFYEKFYFTPGDLGFEPIATSVGKLGLMVCWDQWYPEAARIMALKGAEILIYPSAIGFLEEDSNEEKKRQQNAWETIQRGHAIANGLPLIATNRVGVELDPSGAIKGGITFFGSSFVVGALGEFLAKASDKEEILYAEIELERTEEVRRMWPFLRDRRIDFYNDLLKRYI

SEQ ID NO: 25654 - protein, 976 aa, Phaseolus vulgaris
MEAFPRDQRGSLEVFNPSSSSYSNEKPVISPLRTQSTWKTWVDSRVEEQPEKQQRGGGPDEVTATSWMALKDSTPPPPSQTLAAVLGEPPAEVGNAAKRAAEWGLVLKTDTETGKPQGVAVQTSGGEEPGVKVTGGSRRDSGNSVRSSGESSDDGREYRGGIPRVSEDLRDALSAFQQTFVVSDATKPDYPIMYASAGFFKMTGYTSKEVIGRNCRFMQGADTDPDDVAKIREALQTGQTYCGRLLNYKKDGTPFWNLLTIAPIKDHDGRVLKFIGMQVEVSKHTEGNKENMLRPNGLPESLIRYDARQKEKANSSVSELLLAVRRPRALSESGGRPLIRKSASGDDDQDKPEKSSRRKSESVASFRRKSHAGDRTSMEKITEIPENKHKTSRRRSFMGFIRKNQSKFGSFNDEAVIEGSSESSDEDGERSGSFDGKVQRKEKRKGLDLATTLERIEKNFVITDPRLPDNPIIFASDSFLELTEYSREEILGRNCRFLQGPETDPATVRKIREAIDTQTDVTVQLINYTKTGKKFWNLFHLQPMRDQKGEVQYFIGVQLDGSQHVEPLHNRIAENTAKEGEKLVKDTAENVDDALRELPDANLKPEDLWMNHSKVVHPKPHRRDEAAWKAIQKILESGEQIGLNHFKPVKPLGSGDTGSVYLVELGETGQYFAMKAMEKGIMLNRNKVHRACTEREILDMLDHPFLPALYASFQTKTHVCLITDYCSGGELFLLLDRQPAKVLREDAVRFYAAEVVVALEYLHCQGIIYRDLKPENVLLQSSGHVSLTDFDLSCLTSCKPQLLVPSINEKKKAQKGHQPPIFMAEPMRASNSFVGTEEYIAPEIITGSGHSSAVDWWALGILLYEMFFGYTPFRGKTRQRTFTNILHKDLKFPKSKQVSFSAKQLMYRLLNRDPKSRLGSREGANEIKNHPFFRGVNWALVRCTKPPELDAPLFDTTRGEKEANFEDQVQEEMNVF

SEQ ID NO: 25655 - protein, 117 aa, Listeria innocua
MSTFKVGEVVSGKIAGIQSYGAFVALDNSTQGLVHISEITHGFVKDIHDFLEVGQEVKVKILDIDEEKNKISLSIRATEEAPKEQPAKKKNVSSGEYDEGFNTLRDKLEEWIKKADK

SEQ ID NO: 25656 - protein, 327 aa, Yersinia pestis
MVKKIGVLTSGGDAPGMNAAIRGVVRAALSAGLDVFGIEDGYLGLYENRMKKLDRYSVSDMINRGGTFLGSARFPEFRDPEVRKVALKNMHERGIDGLVVIGGDGSYAGADLLTKEGGIHCVGLPGTIDNDVAGTDYTIGFFTALETVVEAIDRLRDTSSSHQRISIVEVMGRYCGDLTLAAAIAGGCEFIAIPEVEFKRDDLVAEIKAGIAKGKKHAIVAITEKLDDIDSLAKYIEKETGRETRGTVLGHIQRGGAPVAYDRILASRMGAYAVDLLLQDHDYKKGGFCVGVQNEKMVHELISVCIAPENKKSKFKEDWYDTAKKLF

SEQ ID NO: 25657 - protein, 987 aa, Phaseolus vulgaris
MEPSEKSPKKVSSVRSSFPRDPRGSLEVFNPNTSTAANSRVRSQPLWKSYTESEESRDEIAATSWMAINPAPQAEVECGAAAQRAAEWGLVLRTDTETGRPQGVAARNSGGEEPNVAKLAAAASSSRKNSQNSARTSGDSSSDGGGDVVGGIPRISEDVMGALSAFQQTFVVSDATKPDCPILYASAGFFKMTGYTSKEVIGRNCRFLQGAETDCGDVAKIREALEAGKIYCGRLLNYKKDGTPFWNLLTITPIKDEDGKVLKFIGMLVEVSKHTEGLKEKTLRPNGLPESLIRYDARQKEKATNSVSELLQIMKRPRALSESAGRPSITKSGFAEEEKQSLHEEEEEEEEEEEKEKAKRTLRRKSESEASLGRKSEGGKKISMQRISEVPENKLKNSQRRSFMGFRRKSESNDESMENDVIEDVSSDSEDGERPDSFDVDDKEKQREKRKGLDLATTLERIEKNFVITDPRLPDNPIIFASDSFLELTEYSREEILGRNCRFLQGPETDPATVRKIREAIDNQTEVTVQLINYTKSGKKFWNLFHLQPMRDQKGEVQYFIGVQLDGSQHVEPLQNGIAEDTAKEGEQMVKQTAENVDVAVRDLPDANMKPDDLWTNHSKAVHPKPHRKDNPAWKAIQKVLESGEQISLKHFRPIKPLGSGDTGSVHLVELRGTGQYFAMKAMDKGVMLNRNKVHRVCAEREILDQLDHPFLPALYASFQTKSHVCLITDYCPGGELFMLLDQQPTKVLKEDAARFYAAEVVIALEYLHCQGIIYRDLKPENVLIQSNGHVSLTDFDLSCLTSSKPQLIIPASNSKKKKKKKQRNQEVPVFMAEPMRASNSFVGTEEYIAPEIITGSGHTSAVDWWALGILVYEMFYGYTPFRGKTRQKTFANILHKDLKFPKSKPVSLQGKQLIYWLLQRDPKERLGSREGANEIKRHPFFKGVNWALVRCMKPPQLDAPLLPKTEEEKEAKDIDPGLEDLQTNVF

SEQ ID NO: 25658 - protein, 444 aa, Mannheimia succiniciproducens
MSVYAYICFLFSISIFLAFFTRKISARIQSTIAITASAMIGSLVLILFGYFGWFKVEDIAIHIMERVDFKNFLLNGMLGFLLFAGSLGIKLPLMKEQRREIAVFALFSTLASTFFIGILIYYAAMLVGLRIDFVYCLVFGSLISPTDPIAVLAIIKNLKAPKRLSMQVEGESLFNDGVGLVIFTTLFAVAFNGQEPTFSGVFGLFLKEAVGGILFGFVMGFAIHLLITFTKEVSLEILLTLTIPTAGFMLANLLHISGALAMVTSGIIIGNWTRRQGFSERNRYFLDHFWEMIDHSLNSLLFFLIGLALLLVEFTFESSMLMLLAIPVCLIGRYVSLWIPYQIMSRFRRYNPYTLRILTWGGLRGGLALAMALSIPSNVVNISGNGMNLDLRDVIILMTYAVVMFSILVQGTTIEKMIETSKVIDPKRDAYVKLGGSRDYPPHI

SEQ ID NO: 25659 - protein, 329 aa, Deinococcus radiodurans
MAYPNPAGIKRVAVLTSGGDAPGMNAAIRAVVRTGAQQGIEVVGVRRGFSGLHRGEVQLLGPRDVANTIQRGGTILLTARSHTWRSPEGRAKGAAVLREWGVDGLVVIGGDGSFHGGYFLQEEHGIPVIGVPGTIDNDLYGTDHTIGYFTAVETALEAVDKLRDTGASHERIFVIEVMGRHAGHIALDVAVAGGAEEVFIPEDKKPIGDVVNIVKDSIAKGKRGSIIIVAEGYDGGAEAVAQAIHAGTGLETRVSILGHIQRGGTPVSSDRILASRLGEAAVYALMDGKKGVMVGRIGGGIAYTPLHETWEKRKDVSRDLYRCAKMLSI

SEQ ID NO: 25660 - protein, 250 aa, Triticum turgidum
MSRSSSSFAGKAVKNLPSSALIGDARVNMRKTAAKAKQVSSSSPWYGSDRVLYLGSLSGEPPSYLTGEFPGDYGWDTAGLSADPETFAKNRELEVIHCRWAMLGALGCVFPELLARNGVKFGEAVWFMAGSQIFSEGGLDYLGNPSLVHAQSILAIWACQVVLMGAVEGYRIAGGPLGEIVDPLYPGGSFDPLGLADDPEAFAELKVKEIKNGRLAMFSMFGFFVQAIVTGKGPLENLADHIADPVNNNA

SEQ ID NO: 25661 - protein, 542 aa, Oryza sativa
MEAATVVAAPIPAADAAAKALQKKLLDLELPPFPAPAKKAAAKVVAAAPKKKLAGGAGGYVLEDVPHLTDYLPNLPSFPNPLQNHPAYSVVKQYFVNADDTVAKKIVVHKGSARGTHFRRAGPRQRVFFQPDEVSAAIVTCGGLCPGLNTVIRELVCGLHDMYGVTSVVGIEGGYRGFYARNTVELTPRSVNGIHKRGGTVLGTSRGGQDTGKIVDSIQDRGINQVYIIGGDGTQKGAATIHAEVQRRGLKCAVVGVPKTIDNDIAVIDRSFGFDTAVEEAQRAINAAHVEAESAENGVGVVKLMGRNSGFIAMYATLASRDVDLCLIPESPFYLEGKGGLLEFAEKRLRENGHMVIVVAEGAGQDVIARSMRLADAHDASGNKVLLDVGLWLCAKIKDHFKKKANFPITLKYIDPTYMIRAVPSNASDNVYCSLLAHSAIHGAMAGYTGFTVAPVNGRHAYIPFYRITEKQNKVVITDRMWARVLCSTNQPCFLSTEDVEKAGQDDEEPIVPLVEGENSLVKAPPLLANAGDGAALCNGAA

SEQ ID NO: 25662 - protein, 1092 aa, Adiantum capillus-veneris
MSTSSSMNDQRRDAYSLRAPPNEGKLHPLARDSRGSLEVFNPGNPSSLTAASIGAGMQYTPSWQQQQPPEDENYDLPLNQREKEENIYNQTHGGPERERGPDKGTSPSDHKRGMSTGTSPPTRSKYSEIFTSHDTIDKEGKFQAYQTNEESTHDWLSSTPAGQGPMLGGGFGGGEGARGSYLLGTREHPKARCDSLAERAAGWGLVLKTDGDSGRVDGVRTRTSEEEREFRRLSEERRSLNSSTVRTSDDSGFTSDTSNASRIPRVSKDVLQALEGFQQTFVIADGTKPDLPIMYASAGFFKMTGYTSSEVIGRNCRFLQGKETDPEEIDRIRECISKGSGYCGRLLNYKKDGSAFWNLLTISPIKDVDGSVLKYIGMQVEVSQFTEGTKENAMRPNGLSESLIKYDARQKERASFQVTELVEAIKDPKQVGDDKKTSISLGVVRPVAPSGPRKGPDLRELLTAQQYTPRSATSVQPKGSNLTEPGSHRESISKRNRSSGFFSFLGLDKLAGKGPGNQHDAAEFIEPEILMTKDEDSSEASFELDKARLKEIRRGIDLATTLERIEKNFVITDPRLPDNPIIFASDNFLELTEYSREEILGRNCRFLQGPDTNRETVKLIRDAIDNEKEVTVQLLNYTKTGRTFWNLFHLQPMRDHKGELQYFTGVQLDGTEYLEPLTKRLSQQIASEGAKIIRETAANVNEALRELPDANLKVEDLWRIHSRLVLPKPHKLNHDSWGVIRKIHASGEKVKLKHFRPLRPLGYGDTGSVHLVELRGTGKLFAMKAMEKNVMVKRNKVHRVCAEREILGMMDHPFLPTLYASFETQTHVCLITDFCAGGELFLLLERQPTKIFREETARFYTSEVVVALEYLHCQGVIYRDLKPENILLQQDGHVMLSDFDLSYLSSSNPRLVVPPRLHKKRSKRKNFPPPIFRAEPIGACNSFVGTEEYIAPEVITGSGHNSSVDWWALGILMYEMLYGRTPFRGKTRQKTFGNILHKDLVFPRRIPTSLAARQLINGLLQKDPENRLGSQGGANEIKGHPFFQGVNWTLIRCMRPPTFDAPVCFAGSELDVEGDEALDWDDVEASNPIEYF

SEQ ID NO: 25663 - protein, 1114 aa, Streptococcus pyogenes
LARDEAQQGDGNAKSGDGFQSSSKEAKPVLDSSSANPASIAEHHLRMHFKTLPAGESLGSLGLWVWGDVDQPSKDWPNGAITMTKAKKDDYGYYLDVPLAAKHRQQVSYLINNKAGENLSKDQHIPLLTPKMNEVWIDENYHAHAYRPLKKGYLRINYHNQSGHYDNLAVWTFKDVKTPTTDWPNGLDLSHKGPYGAYVDVPLKEGANEIGFLILDKSKTGDAIKVQPKDYLFKELDNHTQVFVKDTDPKVYNNPYYIDQVSLKGAEQTTPNEIKAIFTTLDGLDEDAVKQNIKITDKAGKTVAIDELTLDKDKSVMTLKGDFKAQGAVYTVTFGEVSQVARQSWQLKDKLYAYDGELGATLAKDGSVDLALWSPSADSVKVVVYDKQDQTKVVGQADLTKSDKGVWRAHLTSDSVKGISDYTGYYYLYEITRGQEKVMVLDPYAKSLAAWNDATATDDIKTAKAAFIDPSKLGPTGLDFAKINNFKKREDAIIYEAHVRDFTSDKALEGKLTHPFGTFSAFVEQLDYLKDLGVTHVQLLPVLSYFYANELDKTRSTAYTSSDNNYNWGYDPQHYFALSGMYSANPNDPALRIAELKNLVNEIHKRGMGVIFDVVYNHTARTYLFEDLEPNYYHFMNADGTARESFGGGRLGTTHAMSRRILVDSITYLTREFKVDGFRFDMMGDHDAAAIEQAFKAAKAINPNTIMIGEGWRTYQGDEGKKEIAADQDWMKATNTVGVFSDDIRNTLKSGFPNEGTAAFITGGAKNLEGLFKTIKAQPSNFEADAPGDVVQYIAAHDNLTLHDVIAKSINKDPKVAEEEIHKRIRLGNTMILTAQGTAFIHSGQEYGRTKQLLNPDYKTKVSDDKVPNKATLIDAVAQYPYFIHDSYDSSDAVNHFDWAKATDSIAHPISNQTKAYTQGLIALRRSTDAFTKATKAEVDRDVTLITQAGQDGIQQEDLIMGYQTVASNGDRYAVFVNADNKTRKVVLPQAYRYLLGAQVLADAEQAGVTAIAKPKGVQFTKEGLTIDGLTALVLKVSSKTANPSQQKSQTDNHQTKTPDGSKDLDKSLMTRPKRAKTNQKLPKTGEAPSKGLLAAGVALLLLAISLLMKRQKD

SEQ ID NO: 25664 - protein, 161 aa, Pseudomonas syringae
MSENLLNIPVTTIKGEQKTLADFAGKAVLVVNTASKCGFTPQYKGLEKLWQDYKDQGLVVLGFPCNQFGKQEPGDEGAISGFCELNYGVSFPLFKKVDVNGDQAHPLFVQLKEQAPGLLGTERIKWNFTKFLIGQDGKLVKRFAPLTKPEELTDEIEALLR

SEQ ID NO: 25665 - protein, 271 aa, Sporobolus stapfianus
NEVEEEGEEFAAYCRRGKGRRRVEMEDRHVAKVALGGDPKAALFGVFDGHGGKNAAEFAAENMPKFVAEEMTKADGGESEIEGAVKRGYLKTDEEFLRRGESGGACCVTAVLQKGGLVVSNVGDCRAVLSRSGKAEALTSDHRASREDEKERIENLGGFVVNYRGTWRVQGSLAVSRGIGDAHLKQWIVADPDTRTLLVDQHCEFLILASDGLWDKIDNQEAVDLARPLCTSNDKASRMAACRMLVETSISRGSTDDISVVIIQLQNFSSS

SEQ ID NO: 25666 - protein, 332 aa, Ficus pungens
DRVFVDHPLFLEKVWGKTGSKIYGPIAGEDYQDNQLRFSLLCQAALEAPRILKFTSSKYYSGPYGEDVVFIANDWHSALLPCYLKSMYKANGLYKSAKVSFCIHNIAYQGRFAFTDFALLNLPDDFISSFDFIDGYKKPVKGRKINWMKAGILESDRVLTVSPYYAQELVSSAEKGVELDHVLQKTGIIGIVNGMDVQEWNPSTDKYIAIKYDASNVMSAKALLKEALQAEVGLPVDRNIPVIGFIGRLEEQKGSDILIAAIPHFIKENVQIIVLGTGKKPMEKQLQQLEILYPGKAQGVAKFNVPLAHMITAGADFILVPSRFEPCGLIQL

SEQ ID NO: 25667 - protein, 363 aa, Brassica napus
  misc_feature (217)..(217): Xaa can be any naturally occurring amino acid
MALSAIGFEGYEKRLEVSFFEPSIFQDSKGLGLRALTRSQLDEILTPAACEIVSSLSNDHLDSYVLSESSFFVYPYKVIIKTCGTTKLLLSIPPLLKLAGELSLSVESVKYTRGSFLCPGGQPFPHRCFSEEVSVLDGHFTKLGLNSVAYLMGNDDETKKWHVYAASSAQSSSSNNVYTLEMCMTGLDREKASVFYKNGETGSMTDNSGIRKILPQXQICDFEFEPCGYSMNSIEGDAISTIHVTPEDGFSYASFEAVGYDFNTLDLSQLVTRVLSCFEPKQFSVAVHSTVGVNAYKPEISVDLEDYGCRERTFESLGEESGPVMYQTFEKLGKYCGSPRSTLKCGWSSNNSCSSEDEKHEGI

SEQ ID NO: 25668 - protein, 332 aa, Ficus robusta
DRVFVDHPSFLEKVWGKTGSKIYGPIAGEDYQDNQLRFSLLCQAALEAPRILNFTSSKYYSGPYGEDVVFIANDWHSALLPCYLKSMYKAKGLYKSARVSFCIHNIAYQGRFAFTDFALLNLPDDFISSFDFIDGYEKPVKGRKINWMKAGILESDRVLTVSPYYAQELVSSAEKGVELDHVLRKTGIIGIVNGMDVQEWNPLTDKYIAIKYDASDVMSVKALLKEALQAEVGLPVDRNIPVIGFIGRLEEQKGSDILIAAIPHFIKENVQIIVLGTGKKPMESQLQQLEILYPDKARGVAKFNVPLAHMITAGADFILVPSRFEPCGLIQL

SEQ ID NO: 25669 - protein, 235 aa, Zea mays
MAAGGELQLLSSWYSPYVIRAKVALGLKGLIYEFIEEDLFSKSDLLLKLNPVHKKVPVLVHGGRPVCESLVIVQYVDETWAAGTGTPLLPADAHDRATARFWAAYVDDKFCKEWIKLYRSTTAEKAAEALGGVVPVVETLEQAFRECSRGKPFFGGDAVGLVDIALGSFVVWIRVVDEAAGVKLLDEAKFPALTAWAERFLAVDAVREVMPDAGRLLEHYKGFLAKRAPPSPAGY

SEQ ID NO: 25670 - protein, 174 aa, Bacteroides thetaiotaomicron
MEPKVRRGIGLVAHDAMKKDLIEWVLWNSELLMGNKFYCTGTTGTLILEALKEKHPEVEWDFTILKSGPLGGDQQMGSRIVDGQIDYLFFFTDPMTLQPHDTDVKALTRLAGVENIVFCCNRSTADHIISSPLFMDPDYERTHPDYSSYTKRFENKSVVTEAVESVNKRKRKKR

SEQ ID NO: 25671 - protein, 332 aa, Ficus semivestita
DRVFVDHPSFLEKVWGKTGSKIYGPIAGEDYQDNQLRFSLLCQAALEAPRILNFTSSKYYSGPYGEDVVFIANDWHSALLPCYLKSMYKAKGLYKSARVSFCIHNIAYQGRFAFTDFALLNLPDDFISSFDFIDGYEKPVKGRKINWMKAGILESDRVLTVSPYYAQELVSSTEKGVELDHVLRKTGIIGIVNGMDVQEWNPLTDKYTAIKYDASDVMSAKALLKEALQAEVGLPVDGNIPVIGFIGRLEEQKGSDILIAAIPHFIKENVQIIVLGTGKKPMESQLQQLEILYPDKARGVTKFNVPLAHMITAGADFILVPSRFEPCGLIQL

SEQ ID NO: 25672 - protein, 408 aa, Unknown
  Rhodococcus sp. RHA1
MTAATGDETNYLVGLNLADRRVVVVGGGTVAQRRLGLLIASGARVHLISRAVTPAVEGMATAGQITLELREYRDGDLADAWYAIACTDEPDTNAAIVAEAERNRVFCVRADNARYGTAVTPASASYDGMSIGVLAGGDHRRSAAVRTALVEGLQSGAVADTADHPAAGVALVGGGPGDPDLITVRGRRLLARADVVVADRLAPPELLAELGSDVEVIDAAKIPYGRAMAQEAINAALIDGAKAGKFVVRLKGGDPYVFGRGYEELEACAAAGVPVTVVPGITSAISVPSAAGIPVTHRGVTHEFVVVSGHVAPDHPDSLVDWSALARLKGTIVLLMAVERIEAFATVLMEGGRPVDTPVTVIQEGTLRTQRTVRADLQTVAARVKEEQIRPPAIVVIGPVAGFSVDAG

SEQ ID NO: 25673 - protein, 404 aa, Triticum aestivum
ECSEQESDAQSSCTRSEPEAESKHANSFLDFKQITERQSSTDPKNTLENRDPENPSDNKRKKASTDIEVVHIVDDEPKPSTPMEVDIVRTNSQGNGDKWFSIPAHQLELSLRRSDYGRSEDQEKNDTRTLNHSTSSAFSLYNCRPISSFGNAGDAQPCSTSATHADLANKNGDSAAPFQDKADPICHPIRVVALPVPVGGLTFDGQPFWSGAPVAPLLYPQSGPPIWNGRTPVSQEADTQATSSQQKCQQNDPTEMDSQQTESTQQQEVLPPPTANEKHLHVEIPSDSNPQQVSPMAGDSGSGSSTVLNNSGNALSGSACGSSSNRIATPTEQCNASDGATENPSMEGSHQLSQREIALNKFRLKRKERCFEKKVRYQSRKLLAEQRPRVKGQFVRQEQNIQAR

SEQ ID NO: 25674 - protein, 579 aa, Rhodopseudomonas palustris
MSQLLKVATVQFEPIMAEKERNIARLLELCEEAAVGGAKLIVTPEMGTTGYCWYDRAEVAPFVEPIPGATTARFAELARKHDCYIVVGLPEVDEDGIYYNSAVLIGPEGLIGRHRKTHPYISEPKWSAAGDLHNQVFDTPIGRIALLICMDIHFVETARLMALGGADIICHISNWLAERTPAPYWISRAFENSCYVIESNRWGLERTVQFSGGSCVIAPDGSIAAVIDGGDGVAFAEIDLDTARARQIGGEAVFRQRRPELYPELLTGTFSWNPYDFFGLYGHEAWPKGKRSRLTAAQFAPTDDIGGNLAQIDALARQAKANGAEMVVFPELSLTGLDDPARTAVAVPGPATDRLAALASELSLYLVCGLAERDGDILYNSAVLIAPDGTITTYRKTHLTENERGWAQPGDSFVVCDTPLGRVGLLIGHDAIFPEAGRVLALRGCDIIACPAAIETRFSTPHAGTSVKQPAPIPTGADPHHWHHFRVRAGENNVFFAFANVADIARGYPGLSGVFGPDTFEFPRREALMGSEEGIATATIDTSNLDSVYPTNVVRRKDLVAMRMPHSYRPLVQAMAGNY

SEQ ID NO: 25675 - protein, 330 aa, Ficus septica
DRVFVDHPSFLEKVWGKTGSKIYGPIAGEDYQDNQLRFSLLCQAALEAPRILKFTSSKYCSGPYGEDVVFIANDWHSALLPCYLKSMYKANGLYKSAKVSFCVHNIAYQGRFAFTDFELLNLPDDFISSFDFIDGYEKPVKGRKINWMKAGILESDRVLTVSPYYAQELVSGAEKGVELDHVLQKIGIIGIVNGMDVQEWNPLTDKYIAIKYDASNVMSAKALLKEALQAEVGLPVDRNIPVIGFIGRLEEQKGSDILIAAIPHFIKENVQIIVLGTGKKPMEKQLQQLEILYPDKARGVAKFNVPLAHMITAGADFILVPSRFEPCGLI

SEQ ID NO: 25676 - protein, 259 aa, Hyphomonas neptunium
MTVRITLVGAGPGAADLLTLRAVRAIEAAEVVLIDALVSDEVRSLIPPGARIIEVGKRGHKPSAGQDFINRTLVRYAQQGFNVVRLKGGDPSIFGRAAEERAALEAMGIEVAVVPGITSASAAAAQFRISLTERGTARRVLFATGHRAEGPETDWESAADPATTVCLYMAAHDFAAIAAALIAAGRRADTPAIAVCDVERPAARMLAATLATLAARLAADAFEGPVVILVGDVCRRAVSSPCAPHFREGERRVSLPGLL

SEQ ID NO: 25677 - protein, 156 aa, Pisum sativum
GPFGGLKFMTGFPVKKVNTDITSITSNGGRVKCMQVWPPIGKKKFETLSYLPPLTRDQLLKEVEYLLRKGWVPCLEFELEKGFVYREHNKSPRYYDGRYWTMWKLPMFGTTDASQVLKELDEVVAAYPQAFVRIIGFDNVRQVQCISFIAHTPESY

SEQ ID NO: 25678 - protein, 281 aa, Chlamydia trachomatis
MEFPCTLTLKELLESGAHFGHQTSRWNPRMKPFIFEEKNGLYIIDLAKTLAQLKKAVACIQTTIGQEKSILFVGTKKQAKQIIREAAIECGEFFASERWLGGMLTNMATIRNSVKTLNRIELDLEASNSGLTKKELALLAKRHRKLLNNLEGVRHMNSLPGLLIVIDPGYERIAVAEAGKLGIPVMALVDTNCDPTPINHVIPCNDDSMKSIRLIVNVLKDAVIDAKKRLGIGILSPVRPAERPAEELPLPTGEAQDEASSKKGGGRVLLWADIDNCEALK

SEQ ID NO: 25679 - protein, 284 aa, Chlamydia trachomatis
MEFPCTLTLKELLESGAHFGHQTSRWNPRMKPFIFEEKNGLYIIDLAKTLAQLKKAVACIQTTIGQEKSILFVGTKKQAKQIIREAAIECGEFFASERWLGGMLTNMATIRNSVKTLNRIELDLEASNSGLTKKELALLAKRHRKLLNNLEGVRHMNSLPGLLIVIDPGYERIAVAEAGKLGIPVMALVDTNCDPTPINHVIPCNDDSMKSIRLIVNVLKDAVIDAKKRLGVEILSPVRPAERPAEEAVEELPLPTGEAQDEASSKGGGRVLLWADIDNCEALK

SEQ ID NO: 25680 - protein, 475 aa, Yersinia pestis
MKNKIWKLCILVMIPLVIWFIPPPEGLTELSWRLSGFYLAAICGLILKPFSEAVVLLGVVGFAGFFLNNTSQILVGYATSTVWLVFAAFGISISFVKTGLGRRIAFHMIRFCGSTTLRLGYVTAFLEFVISPVTPSNTARSGGIVFPIILSVVKALGSEPGDTAKKAGSYLMSNIYFVMKVSSFMFITAMAPNLLAADFAAKILGIHLDWGVWALAMVVPGLLLLLIVPAVGYYLDKPELKKVDNKKIADEGLAELGPITRNEKLLVGIFISALLGWALPSLLGQLFGITLKIDATAVAIMAMALCILLGVIKWDDVLQNKGAWNTLLWFGGIIGLASALSKEKVFDWLANLIQNNVDFGHNPFIALTIIGFLSIIIRYFFASASSYAIAMLPVFLTVGKVAGADPMALALVLAATNSYGGALTHYGGGSAPIIFGAGYNNVKQWWASGAVIATVCFIVTMTVGYVWWQFLGFVK

SEQ ID NO: 25681 - protein, 429 aa, Magnetospirillum magnetotacticum
MFDPTERGTAIDIEVNERLRRTLALILAGGRGARLMDLTDWHAKPAIPFAGKFRIVDFTLSNCINSGIRRIGVLTQYKAHSLLQHIQRGWGFLRGEFNEFIELLPAQQRTQGEDWYKGTADAVFQNLDIIRAHRPEHVLILAGDHVYKMHYGKMLAHHLAAGADVTVGCIEVPLETAKGFGVMAADEDDRVIRFDEKPANPQPMPGHPDQALASMGIYIFNYQLLHDLLIKDSTSAETSHDFGKDIIPALVKSHRVIAHHFQDSCVMHEGAREHYWRDVGTIDAYWEANIDLTTVTPALNLYDESWPIWTDQPQSPPAKFVFDSEHRRGMAVDSLVAGGCIVSGAVVRRSMLFSNVRVNSFCVVEDAVILPNVDIGRHARLKRCIVDQGAVVPPGLVVGEDAALDASRFHRTEKGITLVTAERLKLLGA

SEQ ID NO: 25682 - protein, 533 aa, Triticum aestivum
  misc_feature (298)..(298): Xaa can be any naturally occurring amino acid
  misc_feature (315)..(315): Xaa can be any naturally occurring amino acid
  misc_feature (341)..(341): Xaa can be any naturally occurring amino acid
  misc_feature (371)..(371): Xaa can be any naturally occurring amino acid
  misc_feature (393)..(393): Xaa can be any naturally occurring amino acid
MTPEVVVHPPRGGYGRGERGSGRGGRGGYGQNRDYGSEDTNGYRGGYGARTGGEEGAQDRERAPRQPYQGGGRRGGYREGEFGDDSERPPRRNYERHSGTGRGYEIKREGAGRGNWGTTSDEFVAQETEALKQDEKAPAPEKQGAPEDAPQADENKPTKDGATVVEEEEEEEEDEEAQIDSVLDLARCTIVSELSNKDFDSYVLSESSLFIYSQKIVIKTCGTTMLLLTIPRILELAEELCMPLAAVKYSRGMFIFPGAQPAPHRSFSEEVDVLNRYFGHLKSGGNAYVIGDPAKPGXQKWHIYYATEQPEQPMXVTLEMCMTGLDKKKASVFFKTQADGXHVSCAKEMTKLSGISDIIPEMEVCDFDFEXPCGYSMNAINGSAVSTIHVTPXRDGFSYASYEVMGMDASALAYGDIVKRVLRCFGPSEFSVAVTIFGGRGHAATWGKKLEAEAYDCNNVVEQELPCGGVLIYQSFAANEEVAVSAGSPRSVFHCFEAESVQSHPLVKEGKLANLLAWRAEEDSLEEGAVLCE

SEQ ID NO: 25683 - protein, 429 aa, Zea mays
  misc_feature (192)..(192): Xaa can be any naturally occurring amino acid
MLLSAPMQITHYLYSGAPSLSSSPIDPRDWDLQRAIGLMEVGDARNGSAAAALTKGGADDAARKPLPPCCVKAKARVPETEANCHDTVVSGWFTEPRSRFGKTSKVQYFNNPMWPGEAHSLKVEKILFQGKSPYQEILVFESSTYGNVLVLDGIVQLTDKDECAYQEMVTHLPLCSIPAPKNVLVVGGGDGXGFYLREIARHDSVETIDICEIDQLVIDVSKEFFPNLSIGFKDPRVRLHVGDAVDFLRNSPEGKYDAIIVDSSDPIGPAQALVEKPFIQTIARALKPGGVLCNLAESMWLHTHLIQDMLAICRQTFKGAVHYAWTSVPTYPSGVIGFLLCAKEGRAVNFLTPANPIEKIEGAAKAGRELRFYNSEIHRAAFVLPTFVRRELEAYTTPISSAENEKPKESVSEPQKIKILSNNAILTAS

SEQ ID NO: 25684 - protein, 72 aa, Calopogonium caeruleum
WEYQVGPSVGIEGGDHIWASRYILERITEQAGVVLSLDPKPIEGDWNGAGCHTNYSTKSMREDGGYELIKKA

SEQ ID NO: 25685 - protein, 212 aa, Oryza sativa
MRVMVALRLKGVEYELLQETMGKKSELLLASNPVHKKIPVLLHRGKPISESLVIVQYVDEVWPPPASILPRDDPYAAAIHRFWGQYIDDMVSTLASMQFPPRIRILRGTVPGDKDEASDEMTTALLYLEEAFVECSKGKQYFGDDSIGYLDIALGSHLGWIRAVERIAGVELLGGAKVPNLAAWADRFCGHPAVVDVMPDVDILVEFTAKLI

SEQ ID NO: 25686 - protein, 419 aa, Desulfovibrio desulfuricans
MDIQETINQMGKKAAAAARAMRAASPSAKTSALLSLAQLIRQENKAITEANARDLAAAADRGLDAPRMDRLRLTDAVIEEMARACEFVAGLPDPIGATEKQWQRPNGLLVGKMRIPLGVISMIYESRPNVTVDSGILCLKAGNAVILRGGSEAFHSNMMLASLIHRALILAGLPQDAVQVVPSTDRGAIKALCELEEYIDVIIPRGGETLIRTVVADARMPVLKHYKGVCHAYVDEGADLEQACEIIFNAKVQRPGVCNALEGLLVHRSEAHTLLPAVAQKLGDAGVSFRACPRALPLLAPHGVPMAETDPGTEFHDLVMVVKVVDSQDEAQDYIAQHGSNHTEIICTRNHQNAMRFVREVDASMVAVNASSRFNDGGQLGLGAEIGISTSKLHSYGPMGVEELTTTKFVVLGNGQIRQ

SEQ ID NO: 25687 - protein, 319 aa, Ehrlichia ruminantium
MTQIYKTQVLILGSGAAGCTAAIYAARANLQPILITGMCPGGQLTITTDVENFPGFAHAVQGPNLMEQMQQQAYNSGAKIISDEIKEIRTDMYPFECIGIFDDHYIANSIIIATGAQAKWLNIESEEAFKGKGVSACATCDGVFFSGSDVAVVGGGNTAVEEALYLTRHATKVFLIHRRDKLRAEPILQKRLFSNDKIQVIWNSSVKEILGNKENGTVEKVILESTNTGNTTTLPVKGVFIAIGHAPNTKILKKPDNTNIVSLDDEGYIITNPNSTVTSCPGIFAAGDVQDKIYRQAVVAAGSGCMAAIEAAKFLSQLK

SEQ ID NO: 25688 - protein, 72 aa, Calopogonium mucunoides
WEYQVGPSVGIEGGDHIWASRYILERITEQAGVVLALDPKPIEGDWNGAGCHTNYSTKSMREDGGFEVIKKA

SEQ ID NO: 25689 - protein, 523 aa, Saccharophagus degradans
MRDAVVCYNFYLIVVRMSVTVYIWRLIHKKGNTVILKFLGLAVTFMCAGSALALENFITRDGHRLLDGEQEFRFAGIHFPEMHRIENDAAGVCKYDPRGWGQHFQWPTEDEQENWVKAAVRTGHKAMRVYVLSVQQASDQACDRQTHILAPAEPGGMPRLSEAAMVPYDRMIALSDKYGLRLILPFIDQWPWWGGREQLAAFYNEKPEDFYDTSSKTYAAYQSIIKQVLTRKNTFTGREYRDEKAIMAWETGNELKDTTADFLSKTAGLIKSLDKNHLVVDGTYKAINDFALADPNVDIISNHYYENAGNLSPQTVRADLEAIGGKKAYLIGEFGLLDIERLQQIMDAAVNENVNGAKTVGTFIWGGRGHRHSGGFYWHLEPANNKTYSYHLPGFKEGAHNQEMQVVDMVRLAAAQMNGEKKMAPLPVPEAPILRVIYRADNVRWMGAPTGRSYRVERAEKIDGKWKVIGKNISDGKNKFDPNTDALFSDTDKLQKGKTYYYRVIAINESGESPPSNIRALTY

SEQ ID NO: 25690 - protein, 85 aa, Setaria pumila
ECQKVGAPPEVSARLTAMAQELEARQRTALGGLGAATEPELDQFMEAYHEMLVKFREELTRPLQEAMEFMRRVETQLNSLSISGR

SEQ ID NO: 25691 - protein, 259 aa, Picea abies
DLECDALGWQYISGCLPDGREMDRIDNPQFEGYKFDPAGEYVRRWLPELARLPTEWIHHPWDAPRAVLQAAGVELGSNYPLPIVEISTAKERLQEGLSEMWQREADARASLENGTEEGLGESLENANASLPDQMDVDREPVRNNTDLAARSQDDQLVPSISNAVQRAYVGYTLSQAASSSPSEQAEVPSNTDSGIASAASSQQFLVQSTWSMTRGLIEDLPNVTNDYPQMQVLDEQNESHSTADSSSILRGRDDMSSGG

SEQ ID NO: 25692 - protein, 500 aa, Burkholderia thailandensis
MLNTPCVTGDTTFRGQGGASHREARGVAFAVRLGSRCARRVACFAGGCPASRSSEFLRRVEPVALPAARRYLATSVNLYTLNGNRMFDRAQSTIANVDPEIWQAIQQENVRQEEHIELIASENYTSPAVMAAQGSQLTNKYAEGYPGKRYYGGCEYVDIVEQLAIDRVKALFGSEAANVQPNSGSQANQGVFFAMLKPGDTIMGMSLAHGGHLTHGSPVNMSGKWFNVVSYGLNENEDIDYEAADKLAHEHKPKLIVAGASAFALKIDFERLAKIAKAVGAYLMVDMAHYAGLIAAGVYPNPVPHADFVTTTTHKSLRGPRGGVILMKAEYEKQINSAIFPGIQGGPLMHVIAAKAVAFKEALSPEFKEYQQKVIENARVLAETLVKRGLRIVSGRTESHVMLVDLRAKNITGKAAEAALGNAHITVNKNAIPNDPEKPFVTSGVRLGSPAMTTRGFGPQEAELVGNLIADVLEHPEDAATIERVRAQVADLTKRFPVYR

SEQ ID NO: 25693 - protein, 72 aa, Bituminaria bituminosa
WEYQVGPSVGIEAGDHIWASRYILERITEQAGVVLTLDPKPIEGDWNGAGCHTNYSTKSMREDGGFEVIKKA

SEQ ID NO: 25694 - protein, 654 aa, Arabidopsis thaliana
MKDEVDRRNFIDRVSLDRILIGDVAVEKGFVTKKPSFSVCLPQSPIRFSVYTILLLVVNLISRRALLVRRRVSETTSNGRNRFYKVSLSLVFLIWGLVFLSTLWISHVDGDKGRSLVDSVEKGEPDDERADETAESVDATSLESTSVHSNPGLSSDVDIAAAGESKGSETILKQLEVDNTIVIVGNVTESKDNVPMKQSEINNNTVPGNDTETTGSKLDQLSRAVPLGLDEFKSRASNSRDKSLSGQVTGVIHRMEPGGKEYNYAAASKGAKVLSSNKEAKGASSIICRDKDKYLRNPCSTEGKFVVIELSEETLVNTIKIANFEHYSSNLKDFEILGTLVYPTDTWVHLGNFTALNMKHEQNFTFADPKWVRYLKLNLLSHYGSEFYCTLSLLEVYGVDAVERMLEDLISIQDKNILKLQEGDTEQKEKKTMQAKESFESDEDKSKQKEKEQEASPENAVVKDEVSLEKRKLPDPVEEIKHQPGSRMPGDTVLKILMQKIRSLDVSLSVLESYLEERSLKYGMIFKEMDLEASKREKEVETMRLEVEGMKEREENTKKEAMEMRKWRMRVETELEKAENEKEKVKERLEQVLERLEWMEKKGVVVFTICVGFGTIAVVAVVFGMGIVRAEKQGGLAWLLLLISSTFVMFILSL

SEQ ID NO: 25695 - protein, 474 aa, Xanthomonas oryzae
MERPRSDAPMPEPSSTTAPQFRRSMQVRHLVMLSLGGVIGTGLFFNTGYIIASTGALGTVLAYLIGALVVYLVMQCLGELAVAMPQTGAFHVYAARYLGPATGYVVAWLYWLTWTVALGSSLTAAAFCMQYWFPHSPAWPWCLLFCALIFGLNTVSARWFAEGEFWFSLIKVITILVFIVLGGAAVIGLLPLADGSPAPGLRHLRADGWFAHGTLPILMTMVAVNFAFSGTELIGVAAGETEQPARAIPLAIRTTLMRLVVFFVGTVLVLAALLPAEQAAVETSPFVRAFELLGIPYAADLLNVVILTAILSAANSGLYAAARMLWSLANEGTLPSGLTRLTGRGIPLRAVSLSMLGGLLALLTGVYAADTVFVAISAVSGFAVVVVWLSICASHYVFRRQLLRDGVAPETLAYRARWYPWTPILGFSLCLLACIGLAFDPQQRIALWCGVPFVALCYGAYALTQRLAARRLHA

SEQ ID NO: 25696 - protein, 655 aa, Unknown
  Mycobacterium sp. MCS
MCGLLAFLKDPSAQSSPALVGAVSGAAELMRHRGPDEPGTWADDTDDPGIVLGFNRLSIIDIAHSHQPLRWGPPEAPLRYVLVFNGEIYNYLELREALRTEHGAEFATDGDGEAIVAAYHHWGPAALSRLRGMFAFALWDTVTGELFCARDPFGIKPLYIATGPGGTAVGSEKKCLMAVADQLGIDTGLDERAVQHYTVLQYVPEPETLHRGVRRLESGSYLRMRPGQAPVVTRYFTPRFDAVPFRAASAPGSAGGVDQARYDEITAVLEDSVAKHMRADVTVGAFLSGGIDSTAIAALAMRHNPRLITFTTGFEREGFSEVDVAVASAEAIGARHVTKVVSQAEFVEALPAIVWYLDEPVADPALVPLYFIAREARKHVKVVLSGEGADELFGGYTIYREPLSLRAFDYLPRPVRRSLRRASAPLPEGMRGKSLLHRGSQTLEERYYGNARSFSDEHLRAVLRRFSPDWTHTDVTAALYRESDGWDPVARMQHIDLFTWLRGDILVKADKMTMANSLELRVPFLDPEVFAVASRLPLEQKITRATTKFALRRALEPVVPAHVLNRPKLGFPVPIRHWLRAGELLEWAYETVAASQTGDLIDAEAVRTMLDEHRTGVSDHSRRLWTVLIFMLWHAIFVEGSVTPRIEEPHYPVQL

SEQ ID NO: 25697 - protein, 439 aa, Thermococcus kodakarensis
MKIVVVGSGTAGSNFALFMRKLDRKAEITVIGKEPTMQYSPCALPHVVSGTIEKPEDIIVFPNEFYEKQKINLMLNTEAKAIDRERKVVVTDKGEVPYDKLVLAVGSKAFIPPIKGVENEGVFTLKSLDDVRRIKAYIAERKPKKAVVIGAGLIGLEGAEAFAKLGMEVLIVELMDRLMPTMLDKDTAKLVQAEMEKYGVSFRFGVGVSEIIGSPVRAVKIGDEEVPADLVLVATGVRANTDLAKQAGLEVNRGIVVNEHLQTSDPEVYAIGDCAEVIDAVTGKRTLSQLGTSAVRMAKVAAEHIAGKDVSFRPVFNTAITELFGLEIGTFGITEERAKKEDIEVAVGKFKGSTKPEYYPGGKPITVKLIFRKSDRKLIGGQIVGGERVWGRIMTLSALAQKGATVEDVAYLETAYAPPISPTIDPITVAAEMAQRKLR

SEQ ID NO: 25698 - protein, 99 aa, Thalassiosira weissflogii
MATYKVTLISEEHDINTTIDCNDDVFVLDAAEEAGIDLPYSCRAGACSTCAGKVTEGTIDQSEQTFLDDDQMGAGFVLTCIAYPKSDCTILVHQEDELY

SEQ ID NO: 25699 - protein, 432 aa, Sinorhizobium meliloti
MLSQTNDAFFTRSLADSDPEIFGAIEKELGRQRHEIELIASENIVSRAVLEAQGSIMTNKYAEGYPGKRYYGGCQYVDIAEALAIERAKKLFGVNFANVQPNSGSQMNQAVFLALLQPGDTFMGLDLNSGGHLTHGSPVNMSGKWFNVVSYGVREDDHLLDMDEVARKAREQKPKLIIAGGTAYSRIWDWKRFREIADEVGAWLMVDMAHIAGLVAGGQHPSPFPHCHVATTTTHKSLRGPRGGMILTNDEEIAKKINSAVFPGLQGGPLMHVIAAKAVALGEALQPSFKDYAAQVVKNARTLAETLKANGLDGHRLGGTDTHLMPGRPAQEECDRQACRSCSRPCYVTCNKNGIPFDPEKPFVTSGVRLGAPAGTTRGFKEAEFKEVGELIVEVLDGLKAANSDEGNAAVEAGVREKVIKLTDRFPMYGYM

SEQ ID NO: 25700 - protein, 287 aa, Raphanus sativus
EFMNEVRLIARLQHINLVRILGCCIDADERMLIYEYLENSSLDYFLFGKKRSSNLNWKDRFAITNGVARGLLYLHQDSRFRIIHRDMKAGNILLDKNMIPKISDFGLARIIARDQTEASTDTPIGTYGYMSPEYAMYGILSEKTDVFSFGVIVLEIVTGKRNRGFYQSNPEDNLVCYAWTHWAQGRALEIVDPVIVDSLSSTFQPKEVLKCIQIGLLCIQERAEHRPTMSSVVWVLGSEATAIPQPKPPVYCLIPSFYANNPSSSRPSDDDESWTMNEYTCSVIDAR

SEQ ID NO: 25701 - protein, 454 aa, Unknown
  Rhodococcus sp. RHA1
MTDSTSTLGRGLKVRHLTMMGLGSAIGAGLFLGTGVGIATAGPAVLVSYLLAGIIVVFVMRMLGEMGAAIPASGSFSHYARIGIGEWAGFVMGWLYWFMLIMVLGAEITGASGIVSGWLPGVPQWVVALVFVIFFAAVNLAKVSNFGEFEFWFAAIKVTVIIAFLVIGVLLVFGLLPDTEPVGTTNLFGHGGFMPEGFAGVAAGLLVVAFAFGGIEIVTIAAAESEDPERSIAVAMRSVVWRISVFYLGSISIMVLVLPWDSSDLKSGPFVAVLNQAHIPYVAGFMELVVVVALLSAFNANIYGTSRMAYSLSRRGDGPAFMARISNSGVPLNAVLLSVFFGFVSVLLNWWLPDDLLGLLLNAVGSALLVIWIFIVVSHLRLRPRLEREGKLTVRMWLFPWLSYLTLAMLGGFVVLMLFDSDARTQLISTCVLFLVIAALGVLNTRLRQRSQTV

SEQ ID NO: 25702 - protein, 290 aa, Raphanus sativus
EFMNEVTLIARLQHINLVQILGCCIDADEKMLIYEYLENLSLDSYLFGKTRSSKLNWKERFDITNGIARGLLYLHQDSRFRIIHRDLKVSNILLDKNMIPKISDFGMARIFARDETEANTKRVVGTYGYMSPEYAMKGIFSEKSDVFSFGVIVLEIVTGKRNIAFNNLNYENNLLGYAWSNWKEGKALEIVDPDIVDSLSPLSSTFQPEEVLKCIQIGLVCVQELAEHRPTMSSVVWMLGSEAAEIPQPKPPGYWVRRSSYEIDPSSSRQCDDDDSWTVNQYTCSVIDAR

SEQ ID NO: 25703 - protein, 544 aa, Glycine max
MNNSVSENSFIIESDEEDEEKDLNKGGVDGNDSDSSNYSNENPPQRKPSSYNISWPQSYRQSIDLYSSVPSPNIGYLGTPSLSRLSSSFLSTSLTRRHTPEALPSVAKPLIQDTEDEQHQRRSSHTLLPPLPSRRSSLIKKDSKVIHHEVPSGHCSFGQAVLNGINVLCGVGILSTPYAAKVGGWLGLSILVIFAIISFYTGLLLRSCLDSEPELETYPDIGQAAFGTTGRIAISIVLYVELYACCIEYIILEGDNLSSLFPSAHLNLGGIELNSHTLFAVITTLAVLPTVWLRDLSILSYISAGGVVASILVVLCLLWVGIEDVGFHSKGTTLNLATLPVAVGLYGYCYSGHAVFPNIYTSMANPNQFPGVLLACFGICTLLYAGAAVLGYTMFGEAILSQFTLNMPKELVATKIAVWTTVVNPFTKYALTISPVAMSLEELIPSNHAKSYLYSIFIRTGLVLSTLVIGLSVPFFGLVMSLIGSLLTMLVTLILPCACFLRILRGKVTRTQAALCITIITVGVVCSAFGSYSALAEIVKSLRG

SEQ ID NO: 25704 - protein, 331 aa, Ficus variegata
DRVFVDHPSFLEKVWGKTGSKIYGPIAGEDYQDNQLRFSLLCQAALEAPRILNFTSSKYYSGPYGEDVVFIANDWHSALLPCYLKSMYKAKGLYKSARVSFCIHNIAYQGRFAFMDFALLNLPDDFISSFDFIDGYEKPVKGRKINWMKAGILESDRVLTVSPYYAHELVSGAEKGVELDLVLQKTGIIGIVNGVDVQEWNPLTDKYIAIKYDASNVMSAKALLKEALQAEVGLPVDRNIPVIGFIGRLEEQKGSDILIAAIPHFIKDNVQIIVLGTGKKPMESQLQQLEILYPDKARGVAKFNVPLAHMITAGADFILVPSRFEPCGLIQ

SEQ ID NO: 25705 - protein, 247 aa, Ralstonia solanacearum
MSVTMREMLEAGVHFGHQTRFWNPKMAPFIFGHRNKIHIINLEKTLPMYLDALKYVRQLAANRGTILFVGTKRQSREILAEEAARAGMPYVDSRWLGGMLTNFKTVKISIKRLKDMEAAKEAGALESMSKKEALMFEREMEKLEKSIGGIKDMGGIPDAIFVVDVGYHKIAVTEAAKLGIPVIGVVDTNHSPEGIDYVIPGNDDSSKAVALYVRGVADAILEGRANAVQEVVEAARGGDDFVEVQEG

SEQ ID NO: 25706 - protein, 104 aa, Brassica napus
  misc_feature (81)..(81): Xaa can be any naturally occurring amino acid
MDRRFPFKVLEHIFSFVDSNEDRNSVSLVCKSWFETERRTRKRVFVGNCYAVSPLKVARRFPKMRSLTLKGKPHFADYNLXPDGWGGYAWPWIEAMAARRPFLE

SEQ ID NO: 25707 - protein, 160 aa, Casuarina glauca
MSTLEGRGFTEEQEALVVKSWSAMKPNAGELGLKFFLKIFEIAPSAQKLFSFLKDSNVPLERNPKLKSHAMSVFLMTCESAVQLRKAGKVTVRESSLKKLGASHFKHGVADEHFEVTKFALLETIKEAVPETWSPEMKNAWGEAYDKLVAAIKLEMKPSS

SEQ ID NO: 25708 - protein, 325 aa, Ficus virens
DRVFVDHPSFLEKVWGKTGSKIYGPIAGDDYQDNQLRFSLLCQAALEAPRILNFTSSKYYSGPYGEDVVFIANDWHSALLPCYLKSMYKAKGLYKSARVAFCIHNIAYQGRFAFTDFALLNLPDDFISSFDFIDGYEKPVKGRKINWMKAGILESDRVLTVSPYYAQELVSGAEKGVELDHVLRKTGIIGIVNGMDVQEWNPLTDMYIAVKYDASNVMSAKALLKEALQAEVGLPVDGNIPVIGFIGRLEEQKGSDILIAAIPHFIKENVQIIVLGTGKKPMEKQLQQLEILYPDKARGVAKFNVPLAHMITAGADFILVPSRFE

SEQ ID NO: 25709 - protein, 196 aa, Bdellovibrio bacteriovorus
MDGANMNALVGMCRPGVFGPDVSHMNLHKTFSIPHGGGGPGVGPIGVGAHLAEFLPKHSLVPEAGPANGISATTSAPWGSASILPISWAYITMMGAQGLRKATLVSILSANYIAKKLEAHYPVLYKGKNGLVAHECIVDVREIKKTSGIDVTDVAKRLMDFGFHAPTMSFPVAGTLMIEPTESESKKNWIVSLNPW

SEQ ID NO: 25710 - protein, 75 aa, Zea mays
  misc_feature (45)..(45): Xaa can be any naturally occurring amino acid
VAYISLGDFNLTLLDHLIVDPGLRMVGCNNKLNAGYAANRYTHVXGVGAYVVGHLHHGSDIINSNNEINQQKLDA

SEQ ID NO: 25711 - protein, 204 aa, Brassica napus
  misc_feature (100)..(100): Xaa can be any naturally occurring amino acid
MGTEEESVPVELPAPSSWKKLFFPNKVGSVKKTEIVFVAPTGEEISNRKQLDQYLKSHPGNPSITEFDWTTSGTPRRSARISDKKTKSTPSPDKEPPKKXGRTKSSGSKKDADEEGEKPEGGGVGNSHAQEEGTEMSPLKGTEENVTVKDGSGETKDDMVAEETPDPAPVQEAGGESMKEQTHDLVGDTSKESVESPTNKKEAT

SEQ ID NO: 25712 - protein, 285 aa, Bradyrhizobium japonicum
MWPRAAVGGPAMQMNDKTVLITGSTDGVGRYVARRLAAECAKVLIHGRDAARAKTLIDEIVKAGHAAPIFYQADLSSMSGTRALAEAVKRDHQRLDVFVSNAGIGSQSDGPQRQVSADGHELRFAVNYLSGFLLAHLLLPLLKAAAPSRIVNVASLGQHPIDFDDVMITKGYSGSRAYAQSKLAQIMFTIDFAEEVKGAGVTVNSLHPATYMNTTMVRAGGITPISTVEQGGAAILRLVEGDDVAGKSGLFFNGINEARANPQAYDADARKRLRALSLELVGISS

SEQ ID NO: 25713 - protein, 531 aa, Herminiimonas arsenicoxydans
MLDANLKTQLAAYLEKIVQPIEIVASLDGSDKSRELQELLQEIVVLTDKITLVERTDDDERKPSFIIKRPDAHAGIQFAAIPLGHEFTSLVLALLQTGGHPLKLEDSVIEQIRNLDGDYTFETYMSLSCHNCPEVVQAFNVMALINPRIRAVTIDGGLFQDEVKERDIMAVPTTFLNGQPFESGRVSIEQILAKLDTGGNKRKQEELSAKAPYDVLIVGGGPAGAAAAIYAARKGIRTGVVAERFGGQVLDTLSIENFVSVQETDGPKFAVALEQHVRSYDVDIMNVQQASELVPGKLIEIKLKDGGSLKGKTVILATGARWRTIDVPGENEYRNKGVAYCPHCDGPLFKGKRVAVIGGGNSGVEAAIDLAGIVGHVTLIEFGAELRADAVLQRKLRSMPNVTVITSAQTTEITGDGKRVNGLVYKDRKTEEVKTVELEGVFIQIGLVPNTEWLKGTVALSRHGEIEVDARGQTSVPGVFAAGDVTTVPYKQIVIAVGEGSKAALSAFDHLIRTPDTDEEVVAIQGEAIPA

SEQ ID NO: 25714 - protein, 189 aa, Zea mays
  misc_feature (72)..(72): Xaa can be any naturally occurring amino acid
  misc_feature (85)..(85): Xaa can be any naturally occurring amino acid
  misc_feature (112)..(112): Xaa can be any naturally occurring amino acid
  misc_feature (128)..(128): Xaa can be any naturally occurring amino acid
SRLAGSRIPSLLRRRRLLSAAAAVGRGPARCYRQIKNKPYPKTRDCRGAPDPKIRIYDGAMNRKGVDVFPYXEHLGGGEKDYVIXEALEAARMACNKYMTKPAGKDAFHLRXRDHPFHVLQINKMLPXAGADRVHTGTRGAFGKPQGTWAMVDIGQELLSGLRKDNNAAHAREALRRSKSKFLWARKRL

SEQ ID NO: 25715 - protein, 222 aa, Methylococcus capsulatus
MWFKSAGSALPDPHDALPGRATPLQVTETHFVHGRRIRPPFPSGTARAFFGMGCFWGAERRFWTLPGVYSTAVGYAGGSTPNPTYDEVCTGRTGHAEVVLVVYEPDKVGFDALLQVFWTSHDPTQGMRQGNDVGTQYRSVIFATTPEQLQWALVSRDAYERALERAGRGGITTEIRMAPDFYYAESYHQQYLAQHPNGYCGLRGTGVECPPFRIEQSRADPI

SEQ ID NO: 25716 - protein, 161 aa, Trema tomentosa
MSSSEVDKVFTEEQEALVVKSWAVMKKNSAELGLKFFLKIFEIAPSAKNLFSYLKDSPIPLEQNPKLKPHAMTVFVMTCESAVQLRKAGKVTVRESNLKRLGAIHFKNGVVNEHFETRFALLETIKEAVPEMWSPEMKNAWGEAYDQLVAAIKSEMKPSST

SEQ ID NO: 25717 - protein, 372 aa, Unknown
  Candidatus Kuenenia stuttgartiensis
MGRDYYQILGVSRNAGSDEIKKAYRQLAMKYHPDRNPGNKESEQMFKEAAEAYGVLSDAEKKKLYDQYGEEGLKATGTRGYSSYEDIFDAFGDIFGGGSIFDEFFGKGRGGGEAGKRGASLKCDIEMGFKEVATGVEKKIELMRREICDACRGTGAKEGTSPVTCPYCGGKGQVQQSQGFFTLRTTCPKCRGTGKIIESPCRKCGGTKRYPRRATISVKIPAGVEDGTRLRLVGQGEPGENGAPSGDLYCDVHVTPHPIFQRHGNDVLCEVPISFAQAALGCKIDVPTLSGNIIQVKVPKGIQNNEIIPIKGEGFPNIHRHGKGNLLVQVVVETPTKISSRQEELLKEFAELEKNNISSRQKKFIEKMKQVS

SEQ ID NO: 25718 - protein, 255 aa, Brassica napus
  misc_feature (243)..(243): Xaa can be any naturally occurring amino acid
KEKNGKHFNVSVEASKIVKSKGKYLNVGTQFIGTVPGVEVGDEFQYRIELNFLGIHRAIQAGIDYMRDANKELLAASIVPSGGYDDDLCNSDVLIYTGQGGNLSTKFQQGNITNEPKDQQLLRGNLALANSIDKQNPVRVIRGNKKTPSSDNNTKNYVYDGLYLVEEFWKEVGSYGKLVFKFRLRRIAGQPELTWKVVKKAKSSKARDGLCCEDISGGKERLPICAVNEIDDEKPPVFDYTVXMIYPDWCQPIPP

SEQ ID NO: 25719 - protein, 121 aa, Haloarcula marismortui
MTDETDDSEIKMVVAMVRPDKLGDVKKALAEVGAPSLTVTNVSGRGSQPAKKGQWRGEEYVVDLHQKVKVETVVADIPAEDVVDAIADGAHTGEKGDGKIFVLPVDNAYQVRTGKEGPEAV

SEQ ID NO: 25720 - protein, 72 aa, Amphicarpaea edgeworthii
WEYQVGPSVGIEAGDHIWASRYILERITEQAGVVLTLDPKPIEGDWNGAGCHTNYSTKTMREDGGFEVIKKA

SEQ ID NO: 25721 - protein, 789 aa, Ehrlichia ruminantium
MFNLIRKSTEWGGKTLVLESGKIARQANGAVVVTYGGTTVLSTVVAGKAKEPVDFLPLTVQFVAKSYAVGKIPGGFLKREGKPSDRETLISRLIDRSIRPLFPSGFYDEVSIVCNLLSYDTVTPPEVTALIGATAALAISGVPFNGMVVGARVGYLLSEDKYLLNASADEMLSSSLDLFLSGNKDSVLMVESEASELSESQMLAAISFGHQNCQEVIKLIEEFREESGILPFGFIPHDITSLVDDIASSYTESFSIAYSNIVKKERVLELEKLRDQVLSDMLAKYEQPNGNLQCQYSSQDIISALKSFERSLVRSKIIETSSRIDGRAFNGIRDIEIEIDVLPKTHGSALFTRGNTQALVVTALGTPQDEQIVDDLDGDRRENFLLHYNFPPYAVGESAALRAPGRREIGHGKLAWKAIRYVLPEKSDFPYTIRVVSEITESDGSSSMATVCGASLALMDTGVPIKAPVAGIAMGLIKEGEKFIILSDILGDEDHLGDMDFKVAGTSSGITALQMDMKISGISIEVIEKSLLQAKDGRMHILDKMNLVIQESRECIKNHAPRIESIFINKDKIRNVIGSGGKNIREICEKTGARVEIMQDGTVMIYAINNDAVEYAKNMIMDIVSEPEIGKVFDGTVIEIVKFGAFVSFLGGKRGLIHISEIKNEHINAVGSVISVNDKVKVLVIGIDREYVQLSMRRVDQETGEPIDGELYNIRKTNSDSDDSFLSSGSVNNRHGSEKKRRGSGRSRRSSGGSSYHRDDLHNNGFGNGNRSFNDNRNGNEVPRKPRFF

SEQ ID NO: 25722 - protein, 462 aa, Prosthecochloris aestuarii
MNHTSDQHGNEPLDRAKGYVYIVGAGPGDPELITVKAQRVLSEADVILYDDLVSLELVDQFNALKIYTGKRKDSHHFEQEEINREIVRHASEGKTVVRLKGGDPFIFGRGGEEIDTLRNVGIHYEIIPGITAAHGASAYTEIPLTMRRISSSVAFCTGHPVNRIQVPDTDTIVYYMVASTVHDVLDAVAAKGRSGATMVAVVQSATQYNQKTYTGTLDEFRRREKAVYSPALLIIGDSIGQFIEHNWHSRKKKVLMTGGDSSRYSSTDYIMVHFPCRKISGADLDAVNRVLDHIADYSLLFFPNKFSVKYFFRFLFESGRDVRSLAHMTICTAGSAAAAELQESGLVADHYLEPDGTVGYAERLRELCVSGQQILLPGSSITDDSLVAGLTQMGNSVTPLGVYAHEVRQDEVIDLDFIDEIYFSSPVCVRNFQTLFKTIPGRITVTTADRSTQNEYDSLFGD

SEQ ID NO: 25723 - protein, 733 aa, Saccharomyces cerevisiae
MSKNQSVSASEDEKEILNNNAEGHKPQRLFDQEPDLTEEALTKFENLDDCIYANKRIGTFKNNDFMECDCYEEFSDGVNHACDEDSDCINRLTLIECVNDLCSSCGNDCQNQRFQKKQYAPIAIFKTKHKGYGVRAEQDIEANQFIYEYKGEVIEEMEFRDRLIDYDQRHFKHFYFMMLQNGEFIDATIKGSLARFCNHSCSPNAYVNKWVVKDKLRMGIFAQRKILKGEEITFDYNVDRYGAQAQKCYCEEPNCIGFLGGKTQTDAASLLPQNIADALGVTVSMEKKWLKLKKLSGEPIIKNENENINIEFLQSLEVQPIDSPVDVTKIMSVLLQQDNKIIASKLLKRLFTIDDDSLRHQAIKLHGYTCFSKMLKLFITEQPQVDGKGNETEEDDIKFIKGILDFLLELPKTTRNGIESSQIDNVVKTLPAKFPFLKPNCDELLEKWSKFETYKRITKKDINVAASKMIDLRRVRLPPGWEIIHENGRPLYYNAEQKTKLHYPPSGSSKVFSSRSNTQVNSPSSSGIPKTPGALDSKKHKLSDEEYERKKQKRLEYERIALERAKQEELESLKQKLKLENERKSVLEDIIAEFNKQKELQKEESKKLVEAKEAKRLKRKTVSQSQRLEHNWNKFFASFVPNLIKKNPQSKQFDHENIKQCAKDIVKILTTKELKKDSSRAPPDDLTKGKRHKVKEFINSYMDKIILKKKQKKALGLSSASTRMSSPPPSTSS

SEQ ID NO: 25724 - protein, 112 aa, Unknown
  Azoarcus sp. BH72
MKLITAIIRPFKLDEVREALAHVGVTGLTVTEIKGFGRQKGHAELYRGAEYVVDFVPKVKLETVVADERLEATLEAIQAAAHTGKIGDGKMFVTTVDQTIRIRTGESGADAL

SEQ ID NO: 25725 - protein, 219 aa, Arabidopsis thaliana
METGLNILKLSLCVSLVVVGSYAQAPAPWNPSNGFRPGTCDHYECPTYKLVEAGYGFEIRMYDAALWISTSPIPSLSMTQATKTGFRRLNRYIEGDNKSNVKMNMTAPVIAQATPGRSVYTVSLYLPKKNQQNPPQADDLHVRSTKPTYVAVRQIGGYVSNNVAKDEAAALMESLRDSNWILPIEKSKGKLPAYFLAVYNPPSHTTARVINEIMVPFNM

SEQ ID NO: 25726 - protein, 440 aa, Haloarcula marismortui
MGLIKMTKYRTLLLATIGFNFSFLIWFSFAPFTGPMAEEFGLSTAEIGILASSAIWMAPFGRMLTGWLSDKFGAPAIFAIVLAYVGVFSIGSAFAQDYSVFFVLRLIVATAGITFVIGIQHVAEWFEEENLGLAEGIYAGVGNAGAAGGALILPRVFGSGWNGPLFSTNWRAAFFYTGIVSILLAIAYYTLGEAAKTEAKRQATKENTNFKGWLHTATRYGTVVLAAAYIMSFGLELSMNGWLATYYREAFNQDNLVIASTFAATFSIAAGLLRPFGGYGSDLLARKEKNLLPFFKGQYREQWTFLGLCFIVVMMFAMTLAGLSGVLLNAVVIGFLVGTGCAWAEGAIFAQVPAMFPNDSGSVAGVVGGVGTVGGIVYPLFYSAPWLANLHLGYSVAAVTMIPIVLLSAWVFQPEIAKVANTAGFVGSTQEGTTVASGDD

SEQ ID NO: 25727 - protein, 701 aa, Haloarcula marismortui
MPNWTNGRRDGAWAAVSDWVPTTCMRCAVGCGHMHQGADEGYGIDAVRGDAAHPVSQGLACARGLRESKDPDGEWLTRPMVRSDGELRQTQWDVALARAVEGLQAVHQQDPDAVAVLGSGQQTNEAAYALGKVARGGFGTTNYDANTTLCMASAVTAYYQSFGSDAPPCTYADISDADRHVVWGANPAVAHPVLFRWVQQSADEDGVEIIVVDPVRSETAENAEHHVAPDPGKDLALARAVLARIVETGRVDREFVDEATDGFEDLLATLPDADDAADEAGIEMAEVDLLADAMDQQALIYWGMGINQHVQGTETARALIDLTLATGNLRPGGGPFSLTGQANSMGTRICSSKGTWPGQRAFEDPDHRRLVADHWDVPVDRLPDDTGPGPVGMLEGEPEAVWAVATNPVAGMPESESVRETLEDAFVVVQDAFHTETTEIADVVLPAATWGESDGTTTNMERTISRVRSATDVPSGVRSDLDIIATIGSRLFPGLFESTSPNPSAVFDEFTALTEGTVADCSGITYERLDDSHAVRWPAPDDDSAGGYRYYDDESWSFPTSSGRAQFSTGRQGTLPEPTDDDYPLTLTTAREADGYNTGVRSRGGEAGALVARIHPETVAEHSELVTDETLTVETRRGSATVDIDRDAGVPRGMVWLPIHHPATNRLTLSDRDPQSDEPNFKQCAARLVAAEAELSPATAD

SEQ ID NO: 25728 - protein, 409 aa, Corynebacterium glutamicum
MAPVTGLPVTPYSQEASIGASFPAVDPDTKDSAAYGHESGMRERISNAKRVVVKIGSSSLTNDEDGHTVDPNRINTIVNALQARMEAGSDLIVVSSGAVAAGMAPLGLSTRPTELAVKQAAAAVGQVHLMHQWGRSFARYGRPIGQVLLTAADAGKRDRARNAQRTIDKLRILGAVPIVNENDTVATTGVNFGDNDRLAAIVAHLVSADALVLLSDVDGLFDKNPTDPTAKFISEVRDGNDLKGVIAGDGGKVGTGGMASKVSAARLASRSGVPVLLTSAANIGPALEDAQVGTVFHPKDNRLSAWKFWALYAADTAGKIRLDDGAVEAVTSGGKSLLAVGITEIIGDFQQGEIVEILGPAGQIIGRGEVSYDSDTLQSMVGMQTQDLPDGMQRPVVHADYLSNYASRA

SEQ ID NO: 25729 - protein, 477 aa, Clostridium perfringens
MVNLMILSGIVLLTCIISSKIFYKWGVPVLLVFIIIGMLFGSDGIGGIYFDNYNITYSLSSIALVFIMFYGGFCTEWKKARSVAIPSIMLSTLGVIITAGLTGLFCHFVLKTSIFEGLLLGCIVASTDAASVISILRSRNLKLKNNIDTLVEFESGSNDPTAYMLTSVMLIFITSNESVGIGLLGMIFKQIVFGVTVGLFLSKLAVFILRKVEFEIEGLYPIFTITVAILAYSISEFLGGNGYLSVFIAGIVMGNSKIPHKKSLNHFFDGLSWIMQIILFFMLGLLAFPSQLPSIAFEGIAISIFLILVGRPIAVFTILSWFKVPIKEQMFISWVGLRGAGSLVFAIYAITKTSAIENDIFHIIFFIALFSVAIQGTLIPWFAKKLDLICYEDDNHEDNMKNNIKDYIFEVKVGENNKVVNKAIMDSEIPDEILIVMIKRDNKVVIPKGFTIIKPNDTLVLTSENNEIMNSFLDEIR

SEQ ID NO: 25730 - protein, 406 aa, Thermococcus kodakarensis
MSFRELGLSSASVEAVERKGFSIPTDIQREVIPLLLSAESDIVGQSKTGSGKTAAFGLPILDSIDESIREVQALILTPTRELAIQVTDELRSLRGKRRIYVYSVYGGQPIGPQIRALEGGVHIVVGTPGRVLDHINRGTLNLDGVRFFVLDEADRMLDMGFQEDIEAIFRATPKEKRVLMFSATMPMDVLLLAKKYMRNPEVVIVSRDELVPGEVEQEYIEAVPHRRFDLLTKILSDESNEFYGIVFCQTKAETRELSMRLRAAGFRAEALNGDMSQPAREKTFNRFKARKTKILVATDVAARGLDVPEITHVINYSIPMNPEQYIHRIGRTGRMGKKGKAITFIAPGELRRFRYITKQAGVEVKKSELSEGIPKEYRERLRQEELEGEYRGRWGSMKPRQRRRRY

SEQ ID NO: 25731 - protein, 569 aa, Clarkia lewisii
MASPALISETEAWKDLKAHLEGIKMTHLRELMGDTERCQSMMVEFDNIFLDYSRQQASPDTISKLYKLADAAHLKQKIDRMYNGDHINTTENRSVLHVALRAPRNSAICSDGKNVVPDVWNVLDKIKDFSDSVRNGSWIGATGKELKDVIAVGIGGSFLGPLFVHTALQTDPEASKNARGRELRFLANVDPIDVARNISGLNPETTLVVVVSKTFTTAETMLNARTLREWISSALGPSAVAKHMVAVSTNLPLVEKFGIDPNNAFAFWDWVGGRYSVCSAVGVLPLSLQYGFAVVEKFLQGAHSIDQHFSSAPFEKNIPVLLGLLSVWNVSFLGYPARAILPYSQALEKLAPHIQQVSMESNGKGVSIDGLPLPFESGEIDFGEPGTNGQHSFYQLIHQGRVIPCDFIGVVKSQQPVYLKGEVVNNHDELMSNFFAQPDALAYGKTPEELKKENVSEHLIPHKTFTGNRPSISILLPTLDAYRIGQLLAIYEHRVAVQGFVWGINSFDQWGVELGKSLATQVRKQLHGSRVKGEPVEEGFNFSTKTLLTRYLQATSDVPADPSTLLPNI

SEQ ID NO: 25732 - protein, 287 aa, Raphanus sativus
EFMNEVRLIARLQHINLVRILGCCIDPDEKILIYEYLENSSLDYFLFGKKRSSNLNWKDRFAITNGVARGLVYLHQDSRFRIIHRDMKAGNILLDKNMIPKISDFGLARIIARDQTEASTDTPIGTYGYMSPEYAMYGILSEKTDVFSFGVIVLEIVTGKRNRGFYQSNPEDNLVCYAWTHWAQGRALEIVDPVIVDSLSSTFQPKEVLKCIQIGLLCIQERAEHRPTMSSVVWMLGSEATAIPQPKPPVYCLIPSFYANNPSSSRPSDDDKSWTMNEYTCSVIDAR

SEQ ID NO: 25733 - protein, 370 aa, Exiguobacterium sibiricum
MHVEKRDYYEVLGVARDASAAEIKRAYRKLARTYHPDVNKEADADQKFKELSEAYEVLSDDNQRARYDQFGHQDPSQGGGGFGGAEGFGDIFDMFFGGGRRQDPNAPRKGQDLQYVEEIDFMEAFSGVEKVITIPVEEDCGTCHGSGAKPGTHPETCKRCGGSGHINVEQNTMFGRVVNQTTCSTCHGRGQIVKEPCETCRGAGRVRKNKDVRVKIPAGIDNGQQIRLAGKGEAGVNGGPFGDLYVVVRVREHELFERVDDHIVMDMPLTFAQATLGDEIEVPTVHGKVSLKIPAGTQTGSRFRLRGKGMPNVRSGHHGDQYVNVVIITPKNLTDRQKELLREFNEISDEKGVEEQHEGVFSRIKTFFTG

SEQ ID NO: 25734 - protein, 1275 aa, Schizosaccharomyces pombe
MRGRGIDVNSSHYPHISRPRTSSDSQKMYTRAPVDYYYIQENPYFNNIDQDSISDKSLPSTNQSLHHSEEDTESDNDFSESIHPEFDIDVFYKVSNILYDESDLQDPEKRERLEWHSMLSSVLKGDVMQTEKRRLRLTEPDGHSGTYISEVWLGLQAWLHGRLNADQAEVIRKSREGVEPVLREVIDFQIQDEETTKPPLEQVTEILEKVEQCKQFYISSREMEENVPLSASKEFNYKLNALISWSNVMESIQVETLVLQKWVGNDEFDLTMRTPQFNYDGVENTSSFVERIFRQSGLQRTFEQRTLTTLNRIIHQAKQTISENAQAFEEMKLPTYEDKLLPLVRFPIKLLEEALRLRLAYAKKIKGPNFLIVDSMLDDFKIALSVAVRIKREYIKIASPSPGWSLPTNVDEDYDNVLLDSLKFYFKLLTLKLSSGNKNLYFKEIDFLENEWAFLNEHIYWINGGDIHMAGQFSYLSNSLLLNVHRYVESHLNGPTERTAASLTNWYSTLLKNTQIRFRKILRFSETLNSRFENASDFVISEGHLPDLVNRLSTTGHFLAYTANLERDGVFVIADHTLSENPEALKALLFSKDISNLETIQQNCSYVLILCPVHPIVWKGRIEKVDVPDFSVDLKTNRVRIIASNKREHLQAAKSVFQSISGDLVTLAVECRSSITRVYKEFIRLSKLCMRISSTVVDCVSAVREACSGVNCHDLIYHVFSFAAEFGQRILRFLSFDSYWQTKLKRKITSLAVEWISFICDECDLMDRKTFRWGVGALEFLMLMIRGNNILLIDDAMFLKIREKVGKSMAFLLTHFDVLGAKSKVAAKLQRESTEVSSSPRLTSFGDVEEEALSIQLLQKETMLRIDELEIERNNTLLERLAIGHVLDDSVFRNRDFIKLASSFSNITIRWQQGHFVRSGMFGDVYTGVNMETGDLLAVKEIKLQDSRTFRSTVDQIHNEMTVLERLNHPNVVTYYGVEVHREKVYIFMEFCQGGSLADLLAHGRIEDENVLKVYVVQLLEGLAYIHSQHILHRDIKPANILLDHRGMIKYSDFGSALYVSPPTDPEVRYEDIQPELQHLAGTPMYMAPEIILGTKKGDFGAMDIWSLGCVILEMMTGSTPWSEMDNEWAIMYHVAAMHTPSIPQNEKISSLARDFIEQCFERDPEQRPRAVDLLTHPWITDFRKKTIITMPPATITKKTSLSHTITEEKTAQLLAGRHVDSKAETDSLAASYKEESALPVASNVGLRQPNELRIDSINLPPAIVTPDTINYSVD

SEQ ID NO: 25735 - protein, 216 aa, Zea mays
AHPSARLASFPTLSDPVALPSSLQPLYYCDYRFLAALSFFGRQQSPGQANPRFASPLSASAPKRGAKRCLCRRRVRPAEKDEQQQSRGIALMQGICAVVYRKADNTPCPIKQGLYLGSVGAAFNKDALKSLNITHILIVAKSLDPVFPAEFNYKKIEVLDIPDTDLLKHSDECFGFIDEAISSGGNVLVHCFAGRSRSGAGMENATCAALIIILVL

SEQ ID NO: 25736 - protein, 127 aa, Oceanobacillus iheyensis
MSIEVGSKLQGKVTGITNFGAFVELEKGTTGLVHISEVADNYVKDINEHLTVGDEVKVKVINVEKDGKIGLSIKKAKDRPVRQKNTKERTENFESKMSRFLKDSEDRLASLKKHTESKRGGRGAKRG

SEQ ID NO: 25737 - protein, 290 aa, Raphanus sativus
EFMNEVTLIARLQHINLVQVLGCCIDGDEKMLIYEYLENLSLDSFLFGKTRSSKLSWKERFDITNGVARGLLYLHQDSRFRIIHRDLKVSNILLDKNMIPKISDFGMARIFERDETEASTMKVVGTYGYMSPEYAMNGIFSEKSDVFSFGVIVLEIVTGQRNRGFYNLNYKNNFLSYAWSNWKEGRALEIVDPVIIDSLSPLSSTSQPKEVLKSIKIGLLCVQEHAEDRPTMSTVVWMLGSEETEIPQPNPPGYCVRRSPHELDPSASRQLDDDESWTVNQYTCSVIDAR

SEQ ID NO: 25738 - protein, 287 aa, Raphanus sativus
EFMNEVRLIARLQHINLVRILGCCIDADEKMLIYEYLENSSLDYLLFGKKRSSNLNWKDRFAITNGVARGLLYLHQDSRFRIIHRDMKAGNILLDKNMIPKISDFGLARIIARDQTEASTDNPIGTYGYMSPEYAMYGVLSEKTDVFSFGVIVLEIVTGKRNRGFYQSNPENNLICYAWTHWAQGRALEIVDPVIVDSLSSTFQPKEVLKCIQIGLLCIQERAVHRPTMSSVVWMLGSEATAIPQPKPPVYCLIPSFYANHPSSSRQSNDDESWTMNEYTCSVIDAR

SEQ ID NO: 25739 - protein, 290 aa, Raphanus sativus
EFMNEVRLIARLQHINLVRILGCCIDADEKILIYEYLENSSLDSHLFGEKRSSKLNWKDRFDITNGVARGLLYLHQDSRLRIIHRDVKVSNILLDKSMIPKISDFGMAIIFAREETEANTRNVVGTYGYMSPEYALDGVFSEKSDVFSFGVIVLEIVSGKRSRGFYSLNHENNLLSYAWSHWTEGKALEIVDPVITDSLSSLPSTFQPKEVLKCIQIGLLCVQERAEHRPTMSSVVWMLGSEATEIPQPNPPGYYVGRCPYENNPSSRRLCDDYESWTVNQYTCSVIDAR

SEQ ID NO: 25740 - protein, 1178 aa, Coprinopsis cinerea
MSATSVDAAEQSNNCVETTVNANGMNGHGPFTNGVNGHEHLADGANGHESSMNGVNGHGPVANGLNGHDHGLTDSLKTIVDDAPPGKETIFVVGLGMVGIAFIEKLLNLDDKNKYFIVENLYLNPPSWYAEQQPDRFSYHLEEQVLSISPEDHLVHTSKNRSFKYDKCVIATGSRADLPPYISADTAEKTKGVFVYRNIADLDGIISYAEKPEVKRAVVVGGGLLGLEAAKAVYDMPSISHVSIINRSAYPLSRQLDSEAGEMVLHKIEAMGVQVLTRCSPSRQLTRPADDGSGDDVFCGFEFPDGSVYEADLVIYAIGIRSRDDVARASGIQCHPRFGIIVGDDLRTSAEDVYAIGECASWRENTYGLIGPGIEMADILSFNFTQTDAHAPRLMNAPDLSTKLKLMGIDVASFGDFFADKRLPKGRTQDVTQLAKSVTNGHANGKVAKVEIEFEEEPKQNGNSAGPLPTPKPSPSKRRKRGQDEPINCLVYKDPFTATYKKYIFTEDGKYLLGGMMVGDVSDFVKLVAIVKKKKQLEVLPSQFIISDKKGEDDGGDLDDDAQVCSCHNVLKGDIVKAVQEGTCLTIPDLKCKTKVGTGCGGCMPLVTSIFNSEMKKAGRVLNNNLCPHFAMSRTDLFSVIKVKQLRSFSEVMDAVGVNKASVGCELCKPAVGSILSSLYNEHIMKPSHHQNQDTNDRFLANMQRNGTFSVVPRMTAGEVTPDGLIAIGQIAKKYNLYTKITGGQRIDLFGAKKEDLPDIWEALGAAGFESGHAYGKSLRTVKSCVGTTWCRYGVGDSVGLAVQLENRYRGVRSPHKFKGGVSGCVRECAEAQGKDFGLIATDKGWNIFVGGNGGANPRHAELFAKDVPPSKVVRIIDRFLAYYIMTADKLQRTARWIENMEGGIQKLQRVILDDELGICKDLDALMDNLVNTYEDEWAAVVKDPAKRKAFKQFVNTHETRPQSEMITERGQPRPADWAKSYPPVKLSTGQLATPKEEWKWVTLAQKADLLVNDEGTSSAAVKYGESQLAIYHVPRRGYYATQQMCPHKRAFVLEHGIIGDTAEGSLYVSCPLHKRNFALTDGECLNDGEYQIMAFEAREDPDGTGAIQVLLPPADDLDSLIATEKWLVRQAESEALGLNAATQIEILGPRGEILSGLGVNGGGGCDSSACGDSKLEW

SEQ ID NO: 25741 - protein, 290 aa, Raphanus sativus
EFMNEVTLIARLQHINLVQVLGCCIEADEKMLIYEYLENLSLDSYLFGETRSSKLNWKERFDIINGVARGLLYLHQDSRFRIIHRDLKASNILLDKNMIPKISDFGMARIFERDETEAKTRKVVGTYGYMSPEYVMDGIFSEKSDVFSFGVIVLEIVSGKKNRGFYNMSNENNLLSYVWSHWKEGRALEIVDPVILDSLLSLPSTYQPQEVLHCIQIGLLCVQEHAENRPMMSSVVWMLGSEATEIPQPKPPGYCVIRSPYELDPSSSKKCDDNESWTVNQYTCSVIDAR

SEQ ID NO: 25742 - protein, 515 aa, Coprinopsis cinerea
MSFSNSPPPFEWSHLWRPAIVNPVNLKSYTIPFFNLRDPYAQSFHLSWLGFFVAFLSWFAFPPLIPEAIKNDLKLSHAEVANSNIVALLATLGVRFAVGPLVDRYGPRKVMAWLLILGAIPSGLAGTAHNATTLYVIRFFIGILGGTFVPCQAWTSAFFDKNCVGTANALVGGWGNMGGGATFAIMTSLYTALRQAGLTEHVAWRVSFASVPAPVLLTVAAMTLVFGQDHPAGKWSERHNIPAINMADGEGTQFSDEKHPTKEKDLEKKGSQIEVNVHEVQDDEPSPKARAPVIQSTVDVAVNQNLTFASAMKILTNPLTWLPALAYLTTFGFELALDAKMADVLWEIFNERIDGFDQETAGFYTSVFGFLNLVTRPLGGYIGDVVYRKFGTKGKKWWTLICGVIMGVSTIAGGFYLADYKEPEIPDLAVIMGVFSVAAIFSELGNGANFALVPHCNAYNNGVMSGIVGSFGNLGGIIFALVFRFQPEQGKAWWIMGIICLVLNLVLIPVPVPEF

SEQ ID NO: 25743 - protein, 418 aa, Schizosaccharomyces pombe
MAQACKTTYSSRLKTGNTCLIQKNVAVSTRSHSSYTGRNSLRNVPAVNYAAFEQGEDFETPVETPEKEEEKFETDDRGLAVGRPTGNNIYPRFATKTRHIYVTDEQLKCAAEERDVYIPIRLDIELPNNYRLKDTFLWNMNEQVMTPDVFAQILCADLDLSTNVYGTQISSSIRAQIEEYAPVAEVPMPKGQEMLVVFNIQVQLAQLSYNDQVEWNLTSPLTPEEFSVLTCNDLGLSGESRPEIAYAIHECLLKLKKNACEGDLPDYDSDAVPGTKAGPRQDMDTLGALWQPVLETVSLEDAKKNENNRENLVKQWRREASKFGGFAADVSAERWRAAALGNLSQSETANLPSASVSDAQTLLEQERPRWRCRWCNVLGTGTFCVRRGPEGNKSLCNACGVAYAKTGQLPYWRKSLYT

SEQ ID NO: 25744 - protein, 108 aa, Oryza sativa
MAAMATTVSSLLKTFFAGARLPVAARNPTVSVAPSTVGAMCNSISWASSTPPYDLNAIRFSPIKESIVSREMTRRYMTDMITYADTDVVVVGAGFAGLFCAYQLSKDP

SEQ ID NO: 25745 - protein, 173 aa, Oceanobacillus iheyensis
MTLQKATFAGGCFWCMVKPFDQWDGVHQVISGYTGGKVINPTYEQVKKGNTGHYEAVEITYDDAIIDYNTILDLYWKQIDPTDDGGQFQDRGEQYRAAIFYHTKEQWGLAEASKEELATSGRFSKPIVTEIKPATPFYPAEEYHQDFYKKNKEEYEEDRAKSGRDEFIEDNWE

SEQ ID NO: 25746 - protein, 344 aa, Arabidopsis thaliana
MASQTPNLECRMYEAKYPEVDMAVMIQVKNIADMGAYVSLLEYNNIEGMILFSELSRRRIRSVSSLIKVGRIEPVMVLRVDKEKGYIDLSKRKVSEEDIQTCEERYNKSKLVHSIMRHVAETLSIDLEDLYVNIGWPLYRRHGHAFEAFKILVTDPDSVLGPLTREIKEVGPDGQEVTKVVPAVTEEVKDALVKNIRRRMTPQPMKIRADIELKCFQFDGVVHIKEAMKNAEAAGNEDCPVKIKLVAPPLYVLTTQTLDKEQGIEILNKAIAACTETIETHKGKLVVKEGARAVSERDEKMLTEHMAKLRLDNEEMSGDEDSGDEEEDTGMGEVDLDAGAGIIE

SEQ ID NO: 25747 - protein, 208 aa, Hyphomonas neptunium
MRLRQFIWLSMTQTRTADVSRSTKETEISVSVNLDGTGKADIETGIGFFDHMLDSLARHSLIDLKVRCKGDTHIDFHHSVEDTGIVIGQAIAKALGDFGGITRFGHAYIPMDETLTRASVDLCKRPYLIWKVEFRRDKIGEMDTELFKEFFHALAGNGGMCLHVENIYGENNHHIAESCFKATARALRTAITVDPRLGGKPASTKGSL

SEQ ID NO: 25748 - protein, 908 aa, Coprinopsis cinerea
MRLNTHTGKSSSSSDDLSNGSNRSGESSPFTSSGITSPATELSNSFDLGKATDAHLPEPFFPATIVDTKDAKSLKARPLPDTLPYPSLPQEEVCRVIDQQDKGTPDEWVPRDSRMVRLTGKHPFNAEARLKDLYSYGFFTPSNLFFVRNHGAVPMVDEPTAREWKVEISGLCQNPVTFSLNDLRSMFEVVTIPITLVCAGNRRKEQNVVQKSLGFSWGAAGLSTALFTGVRLSDVLEFVQPQKGAKHVIFEGGDNLPNGPYGTSRSRGPALMDIKPSLEPDHGFPIRLVVPGQIGGRSVKWLRKIELSRQESQHHLHFHDNKVLPMPLGPDRARAEKDWWYDPSAIACPDHDEVLQVASTDQYTLRGYAYAGGGRRVTRVEISFDEGTTWELAQIHYLEDLFRDVPYDDSIYGTLDLTESDQSFCWCFWSFEVGVEVLKSASSITVRAMDESLALQPRDMYWNATGMMNNWWFRVCIHHLEDGSLKFEHPTIVAGTQPGGWMQRLKDAGQDPSKPEINPKRSASSVAENPAEPVEEVKMTKPGVTRKITLEELAAHANDETPWFVVRGEVYDATEYLNEHPGGPQSITLVAGDDATEDFIAIHSADAKRKLEEYHIGTLVGSLVEESKLEASDPTIFLHPKQWKAVRLVSTTTVSRDSKIFRFALDSPDQTLGLPTGQHVYVRLKRKVERDGKKVADGELVQRAYTPLSRDVDKGFIDMLVKIYYPCNEYPLGGRMTLGFAELEEGDVVDLKGPIGHFTWLGSARASIHGKEHSVGQVGMVCAGSGITPILQVLRGIFEDSRDTTTKVWVLDVNRHFEDILCKAELDDLLEKYPDRLQLRYSLTGRPLPDGWSQSTGRITREMLVKYLPEPSEGGIVCICGPPSMEQSVKVCVSFYDLQFDLTKTNLK

SEQ ID NO: 25749 - protein, 190 aa, Legionella pneumophila
MRYLFILIALLSQPLFAKPSEAIFAGGCFWCVEADFDKVPGVLETISGYDGGTEPRPGYALVSSGKTAYVEVVRVVFDSDKVTYQELLDFYWRHIDPTVQNQQFCDVGKQYRSVIFYLNDDQKKAALASIDEIKKRFPKVYTEVIPSTTFYPAEEYHQDYYQKNPIRYKYYRYNCGRDARIKELWDEKSS

SEQ ID NO: 25750 - protein, 404 aa, Unknown
  Rhodococcus sp. RHA1
MRSQPHVLGIVLAGGEGKRLYPLTADRAKPAVPFGGAYRLIDFVLSNLVNAGYLRLCVLTQYKSHSLDRHISQTWRLSGFAGEYITPVPAQQRLGPRWYTGSADAILQSLNLVYDEDPEYIVVFGADHVYRMDPEQMVQHHIESGAGVTVAGIRVPRSEAFAFGCIDSDESGRIVQFLEKPAHPPGTPDDPNMTFASMGNYVFTTKVLVDAIRADSENSDSDHDMGGDIIPALVEAGEASVYDFKDNIVPGATDRDRGYWRDVGTLDAFYDAHMDLVSVHPIFNLYNRRWPIRGETENLAPAKFVQGGLAQESVVGAGCILSAATVRNSVLSSNVMVDSGATVEGSVLMPGVRIGKGAVVRRAILDKNVVVGDGEIIGVDLERDKQRFAVSNGGVVAIGKGVWI

SEQ ID NO: 25751 - protein, 338 aa, Mycobacterium tuberculosis
MQEAPHRVMPLVRPCPRPSDPGEYVRPMTANDNKTRKWSAADVPDQSGRVVVVTGANTGIGYHTAAVFADRGAHVVLAVRNLEKGNAARARIMAARPGAHVTLQQLDLCSLDSVRAAADALRTAYPRIDVLINNAGVMWTPKQVTKDGFELQFGTNHLGHFALTGLVLDHMLPVPGSRVVTVSSQGHRIHAAIHFDDLQWERRYNRVAAYGQAKLANLLFTYELQRRLGEAGKSTIAVAAHPGGSNTELTRNLPRLIRPVATVLGPLLFQSPEMGALPTLRAATDPTTQGGQYYGPDGFGEQRGHPKVVQSSAQSHDKDLQRRLWTVSEELTGVSFGV

SEQ ID NO: 25752 - protein, 425 aa, Methanosarcina mazei
MKIELINPAPKLLNKFGQYSPPYGLAYIGTLLMERGIEVKIIDEQIGAVPEYKCDYAMITGTTSTITRAYSISKTYLDKGIQTIIGGVHATSIINTRFKEELNGASTSVIFGPLENIIDQLIQDMNSSNLQKYYVGSFVDELKSPEPIWDVNNDKYFTYPVQSSVGCPFNCSFCAVNKTYGEFKIKNIDLTLSEIQKASKTIIFLDDNLYGNPSYSKKIFTKIKDDIGYKNWGGVASLGVYKDEKLLKLFSETGCICINVGFETLDSNKLSSVQKKNHIEEYTNCIKTLNDYGILAYPGFISFPNDDEATLKELSIFLNKAEVDIFHYDFLTPFPGTPLFENLDLNKKIIDYDWANYDFNHAVIKHKKWTTEEWEQNVEEFYKENLYSRANSLEKKLSLNPSFTNSNLSFEMWHKLTDYLMGTFD

SEQ ID NO: 25753 - protein, 353 aa, Pseudoalteromonas tunicata
MSFPYLFIDRDGTLIYEPIEDKQVDSVAKVKLEPGVIPALLQLQAAGYRLVIVSNQDGLGTDSFPEANYHVAQNHMMDIFTSQGVKFEDVLICPHFSEDNCACRKPKTGLMTGYLRSGKVDLSRSFVIGDRQTDIGLAENIGCEGILYQGDWQSITTRLLTPNRCALIERNTKETQIALRLNLDSPAKGSIETGLGFFDHMLDQIRTHANIELDIKASGDLYIDEHHLVEDIGIALGQAIKTALGTKSQIARYGFALPMDECKAEAQIDLSGRASLVLNANFSREKVGDMDVQMVEHFFKSLTDNSALSLILSISDGNCHHQVEGLFKAFSRALRMAIAKDATQVLASSKGML

SEQ ID NO: 25754 - protein, 716 aa, Pseudomonas aeruginosa
MSRKRSPAPSRISEGHPFPLGATWDGLGVNFALFSAHATKVELCLFDARGEKEIERIELPEYTDEIWHGYLPDAHPGQIYGYRVHGPYEPDAGHRFNPNKLLLDPYAKQLVGRLRWSEALFGYTIGSADADLSFDERDSAPFVPKSKVIDPAFTWAERPPVRVPWDRTVIYEAHLRGLSMRHPQVPEAVRGTFAGLMNADLLAHIRRLGVTSVELLPIHGFVDDKHLLENGMSNYWGYNSIAFFAPHPAYLASGQVNEFKEMVAHLHDAGLELILDVVYNHTAEGNELGPTLCMRGIDNASYYRLMPDQRRYYINDSGTGNTLDLSHPCVLQMVTDSLRYWATEMRVDGFRFDLATILGRHPDGFDERHGFLVACRQDPVLSKCKLIAEPWDCGPGGYQVGGFPPGWAEWNDRFRDCVRAYWRGDDGMLPELARRLTASGDLYDQRGRRPYASVNFVTAHDGFTLRDVVSYDHKHNEANGENNADGSDHNLSWNHGCEGPTDDPEIRALRLRQMRNLLSTLLLSQGTPMLVAGDEFSRTQQGNNNVYCQDNELGWIDWRLDDEGRSLLAFTQRLLALRQRYPILRRGRFLVGEYNEALGVKDVTWLAPGGEEMTEEHWHDEHARCLGVLLDGRAQPTGILRSGEDATLLLILNAYHDAVSFRLPEVAEGSGWSCLLDTQRPEDPLGERYPFASEFLVGGRSFLLFELQPPGAGAEG

SEQ ID NO: 25755 - protein, 406 aa, Streptomyces coelicolor
MTQHTDVVVIGGGQAGLAAGYHLRRQGLDFVVLDARATPGGAWRHAWDSLHLFSPAAFSSLPGRLMPAQPGEEYPEAGHVVAYLSDYEKRYGLPVRRPVQVTGVHDEGRLLRVETDSGTWHARAVISATGTWWRPFLPAVPGRGDFAGRQLHTVSYRGPQDFAGRRVIVVGGGNSGAQIAADLAYDTELTWVTRRPPRYLADDIDGRALFDAATALPHSRLRSSGGTPIAPSTPAAPAPQASHRWATSSPYRRCARPGTPGGSRRPRCSSAWTATVPSGPTARGRRSTRSSGAPASARRSRTWRPSACAAGAGTSPRWARRPRTSHACTSSATATGPAPPPPPSSASGVRPATRPALSPNSSTRQGDPRAIGRKGADTGMTTGPAGAGYRTVSSCPIAASTDGSTR

SEQ ID NO: 25756 - protein, 402 aa, Bacteroides fragilis
MEKNIFKLDNEQLKGIAHAFREKVEEGLNKNNAEIQCIPTFILPKATDIKGKALVLDLGGTNYRVAIVDFSTEKPIIYPNNGWKKDMSIMKSPGYTREELFKELADLIVEIKREEEMPIGYCFSYPTESIPGGDARLLRWTKGVDIREMVGQFVGKPLLDYLNEKNKIRFTGVKVLNDTIASLFAGLTDKSYDAYIGLIVGTGTNMATFIPSDKITKLDPECHVQGLIPVNLESGNFYPPFLTAVDDTVDATSDSLGKQRFEKAVSGMYLGDILKAAFPLEEFEEKFDARKLTAIMNYPDIHKDIYVQVAHWIYNRSAQLVAASLAGLIALLKSYNRDIHRVCLIAEGSLFWSESRKDKNYNILVMEKLQELLRELELEDVEVHINSMDNANLIGTGIAALS

SEQ ID NO: 25757 - protein, 47 aa, Pueraria phaseoloides
RITEQAGVVLSLDPKPIEGDWNGAGCHTNYSTKSMREDGGFEVIKKA

SEQ ID NO: 25758 - protein, 185 aa, Brassica napus
  misc_feature (18)..(18): Xaa can be any naturally occurring amino acid
  misc_feature (79)..(79): Xaa can be any naturally occurring amino acid
MASGCAKRGGCPSDYVAXVSIAAICFLVLLSRSVLPCLIHKAPRNNSSSFWIPVIQVFSSFNLLFSTMMSINLLQFKTXKHWWQYCYLWSVWVEGPLGFGLLMSCRITQAFQLYFIFVKKRLPPVKSYVFLPLVLLPWIFGAAIVQAKRPLDSQCHMGLEWTLPVAGLNALYVLALLAFTRAIRH

SEQ ID NO: 25759 - protein, 636 aa, Gibberella zeae
MTIDCKADDVGGDAGDLRTLFDEHPIPVVSPKTVSLISFKTHNELEQTSVVVDAFNTVLTNNDAAALQACFFPAQSYWKDSLALTYHLRTFRGPEVIAKNLLATKEARQCNPVWKLEGAVFVPATPALQFIDVSLSFRTESPAAACSARVLLLPTENSDEEIEWKIWILSTNLENLDIHPEDTSLLQNPGLSLAGMEKVETDVFIIGGGNSAAALSARLKCFGVESVMVERNANIGDNWALRYDCMKFHVPTSFAEMPYMNYQDEFQGDHLLSKDELADHLRQFVSCFDLNVITSAKIQSTTYNKLTNQWKIKVETPTKIITVIAKHVVQATGIGSQKPHVPILANAHDYKGIAIHSSDYRNGQRLVNQGVKSVLIVGSANTAFDVLEDCHAAGLQVTMVVRSPTYIVPLGYIKNKMSLGAYDFGVAAADRMFLTLPTEISGQLARNSFRMLALQEPDRYAALQKAGFPVLDSAEPNQALYSNLIERAGGHYVDIGGTELLAQGRADVKAGVEPVAFTGTGLRFSDGSAADADAVIWCTGYADHDVRNMAVEILGGDEGVHDENTLGPQEIAARVDATWGVDSEGEIRGMWKRHPRLENYWIIGGFTQQHRWYSRVLALQIKAELEGILPKAYRES

SEQ ID NO: 25760 - protein, 72 aa, Teramnus labialis
WEYQVGPSVGIEAGDHIWASRYILERITEQAGVVLSLDPKPIEGDWNGAGCHTNYSTKSMREDGGYEVIKKA

SEQ ID NO: 25761 - protein, 72 aa, Teramnus labialis
WEYQVGPSVGIEAGDHIWASRYILERITEQAGVALSLDPKPIEGDWNGAGCHTNYSTKSMREDGGYEVIKKA

SEQ ID NO: 25762 - protein, 173 aa, Methanosarcina barkeri
MVRKPGSMYRNVRQRSFTRRKYMGGVPGSQVIHYDMGDKANTSFPIKLSLLVEEKCQIRHTALEAARITANRHLIEDTGKMGYYMKLRVYPHEVLRENKQATGAGADRVSSGMRRAFGKNVGTAARVNPFQKIFTVAVEKQNFVAAKKALWHAGQKLPTPCRIVIDEGAELVQ

SEQ ID NO: 25763 - protein, 72 aa, Magnetospirillum magnetotacticum
MAKEDVIEFSGTVTELLPNAMFRVKLDNDHEILAHTSGKMRKNRIRVLAGDRVNVEMTPYDLTKGRITFRYK

SEQ ID NO: 25764 - protein, 420 aa, Rickettsia prowazekii
MNILNNNLYEMDKEIYEIIKNEKIRQNNVIELIASENFVSSAVLEAQGSILTNKYAEGYPSKRFYNGCDEVDKAEVLAIERIKKLFNCKYANVQPHSGSQANQTVYLALLQPCDTILGMSLDSGGHLTHGAAPNISGKWFNTVSYHVDQETYLIDYDEVERLAVLHNPKLLIAGFSAYPRKIDFAKFRKIADKVGAYLMADIAHIAGLVATGEHQSPIPYAHVVTSTTHKTLRGPRGGLILSDDEEIGKKINSALFPGLQGGPLMHIIAAKAVAFLENLQPEYKNYIKQVISNAKALAISLQERGYDILTGGTDNHIVLVDLRKDGITGKCAANSLDRAGITCNKNAIPFDTTSPFITSGIRFGTPACTTKGFKEKDFVLIGHMVAEILDGLKHNEDNSKTEQKVLSEVKKLMKLFPFYD

SEQ ID NO: 25765 - protein, 184 aa, Oceanobacillus iheyensis
MLQDNIHGDIQDILITEEQIQEKCKELGSIISKEYDGKFPLAIGVLKGAMPFMSDILRYSEIHLEMDFMDVSSYDGGTTSTGEVKILKDLNTKVEGRDLIIVEDIIDSGLTLSYLVDLFKYRKANSIKIVTLLDKPSGRNAAIKADVVGFEVPDEFVVGYGLDYAEKYRNLPYIGILKPEVYGG

SEQ ID NO: 25766 - protein, 601 aa, Arachis hypogaea
MAATSNTWINTKLPSSCSSLKGASCSPQTPSSFTIRSNKRRSNYNKIKCSLQTLHFPKQLQPTTTTTKPKPTKENKTASTTAAPVKDWNLIQKAAAMAIDFAESALASHERRHPLPKTADPRVQIAGNFAPVPEHPSTHSLPIAGKLPECIDGVYVRNGANPMYEPLAGHHLFDGDGMVHAVKFHNGSASYSCRFTETNRLVQEKSLGKPVFPKAIGELHGHSGIARLLLFYARGLFGLVDGKNGMGVANAGLVYFNNRLLAMSEDDLPYHVRVTPNGDLKTVGRYDFNGQLKSTMIAHPKVDPVSGELFALSYDVVSKPYLKYFKFNKDGTKSKDVDIPLKVPTMMHDFAITENFVVVPDQQVVFKLGEMMRGGSPVVYDKEKVSRFGILDKNATDSDGIRWIEAPECFCFHLWNAWEEKETDEVVVIGSCMTPADSIFNECDENLKSVLSEIRLNLKTGKSTRRAIIREEEQVNLEAGMVNKSKLGRKTQFAYLALAEPWPKVSGFAKVDLSSGEVKKYMYGGEKFGGEPMFLPRSAWSEREDDGYILAFVHDEKEWRSELQVVNAMTLELEATIELPSRVPYGFHGTFIQSKDLRKQA

SEQ ID NO: 25767 - protein, 335 aa, Paucimonas lemoignei
  misc_feature (42)..(42): Xaa can be any naturally occurring amino acid
MRISILGAGAWGTALAIALAERHDVVLWGRSEDAMAQRARSXENTAYLPGHPLPAALKATADFSLALDHVAQGDGLLIAATSVAGLRPLAQQLQGKAIPNLVWLCKGLEEGSGLLPHQVVREVLGTQLPAGVLSGPSFAQEVAQGLPCALVIAAEDAALRELVVAAVHGPAIRVYSSDDVVGVEVGGAVKNILAIATGILDGMSLGLNARAALITRGLAEITRLGIALGARAETFMGLAGVGDLILTCTGDLSRNRKVGLGLAQGKPLETIVTELGHVAEGVRCAAAVRNLAQQLQIEMPITNAVAGILFDGHSPRATVEQLLARHPRDESISAS

SEQ ID NO: 25768 - protein, 289 aa, Raphanus sativus
EFMNEVRLIARLQHVNLVRVLGCCIDADEKMLIYEYLENLSLDSYLFGKKRSFKLNWKDRFAITSGVARGLLYLHQDSRFRVIHRDMKVSNILLDKNMIPKISDFGMARIFAREETEANTSKVVGTYGYMSPEYALNGVFSEKSDVFSFGVIVLEIVSGRRSRGFYHLDHENNLLSYAWSHWTGGSALEIVDPVIVDSLSSLPSTFQPEEVLKCIQIGLLCVQERAEHRPTMSSVVWMLGSEATEIPRPNPPGYYVGRSPYENNPSSSGPGDDESWTVNQYTCSVIDAR

SEQ ID NO: 25769 - protein, 349 aa, Mycobacterium leprae
MAGIVVRSESAVAVMGAGAWGTALAKVLIDAGGPEAGVVLWARRPDVAERINTTRCNRAYLPGTLLPPGIRATADPADALRGASTVLLGVPAQRMRANLERWGGLVADGATLVSLAKGIELGTLMRMSQVIVSVTGVDPAQVAVLSGPNLASEIAQCQPAATVIACSDLGRAVALQRMLSSGYFRPYTNSDVVGTEIGGVCKNVIALACGMAAGVGFGENTAATIITRGLAEIIRLGMALGAQVTTLAGLAGVGDLVATCTSPHSRNRSLGERLGRGEIMQSILHGMDGSDGGDGYVVEGVTSCASVLALASSYDVEMPLTDAVHRVCHKGLSVEKAMALLLGRSTKSE

SEQ ID NO: 25770 - protein, 287 aa, Raphanus sativus
EFMNEVRLIARLQHINLVRILGCCIDADEKMLIYEYLENSSLDYFLFGKKRSSNLNWKDRFAITNGVARGLLYLHQDSRFRIIHRDMKAGNILLDKNMIPKISDFGLARIIARDQTEASTDTPIGTYGYMSPEYAMYGILSEKTDVFSFGVIVLEIVTGKRNRGFYQSNPEDNLVCYAWTHWAQGRALEIVDPVIVDSLSSTFQPKEVLKCIQIGLLCIQESAEHRPTMSSVVWMLGSEATAIPQPKPPVYCLIPSFYANNPSSSRPSDDDESWTMNEYTCSVIDAR

SEQ ID NO: 25771 - protein, 389 aa, Zygosaccharomyces rouxii
MAATDRLNQTSDILSHSMKKTDTSMSIVTAENPYKVAVVGSGNWGTTIAKVVAENTKEKPELFQGRVDMWVFEEQIDGTPLTQIINTKHQNVKYLPNIDLPGNLVANPDLISTTKDADVIVFNVPHQFLGRIVSQMKGQIKPDARAISCLKGFEVGPKGVQLLSDYVTQELGIQCGALSGANLAPEVAKEHWSETTVAYQVPDDFKGEGKDIDHRVLKQLFHRPYFHVNVIDDVAGISIAGALKNVVALGCGFVTGLGWGNNAAAAIQRVGLGEIIKFGRMFFPESKVETYYQESAGVADLITTCSGGRNVRVATEMAKTGKSGEQVEKDILNGQSAQGLITAKEVHQWLESSGHTEEYPLFEAVYQITYENVPMKELPSMIEELDIVE

SEQ ID NO: 25772 - protein, 308 aa, Oceanobacillus iheyensis
MRVSDNITGLIGGTPIVKLHNVTDEGSADVYAKVEFMNPGSSVKDRIAIAMIEAAEQGGKLKEGDTIIEPTSGNTGIGLAMVAAAKGYRAVLVMPDTMSQERRNLLRAYGAELVLTPGAEGMKGAIAKAVELQEENDYFMPQQFSNPANPDIHEKTTGKEIVEQMKDGLDGFVSGIGTGGTITGAGKVLKNHFQDIKLYAVEPADSPILSGGSPGPHKIQGIGAGFKPDVLDTAIYDEVLTISNEEAYEAARKVATTNGILGGISSGAAVAAAVKVAKQLGAGKKVLAILPDNGERYLSTPLYQFDKE

SEQ ID NO: 25773 - protein, 497 aa, Prunus persica
MAYAATFSLVTQVLGLTLCLLSLCCSAFTPQDYSDALEKSILFFEGQRSGKLPANQRATWRANSGLSDGSSYHVDLVGGYYDAGDNVKFGLPMAFTTTLLAWSVIEFGDSMHNQIENAKDAIRWSTDYLLKAATSTPGALYVQVADPNADHQCWERPEDMDTPRNVYKVSTQNPGSDVAAETAAALAAASIVFKDSDPSYSGKLLHTAMKVFDFADRYRGSYSDSIGSVVCPFYCSYSGYHDELLWGASWIHRASQNSSYLAYIKSNGHILGADDDGFSFSWDDKRPGTKVLLSKNFLEKNNEEFQLYKAHSDNYICSLLPGTSNFQAQYTPGGLLYKASESNLQYVTSTTLLLLTYAKYLRTNGGVATCGSSKVTAETLISEAKKQVDYILGNNPAKISYMVGFGKKYPLHIHHRGSSLPSVHEHPERISCNNGFQYLNSGSPNPNVLVGAIVGGPDSKDSFSDDRNNYQQSEPATYINAPIVGALAFFSANTNPN

SEQ ID NO: 25774 - protein, 440 aa, Unknown
  Burkholderia sp. 383
MECEGRNTMQPASRGQSFTLNWSIIMFNRTTSTVANVDPELYAAIEQENRRQEDHIELIASENYTSPAVMAAQGSQLTNKYAEGYPGKRYYGGCEYVDVVEQLAIDRVKQLFGAEAANVQPNSGSQANQGVFFAMLKPGDTIMGMSLAHGGHLTHGSPVNMSGKWFNVVSYGLNENEDIDYEAAEQLAQEHKPKLIVAGASAFSLKIDFERLAKIAKSVGAYLMVDMAHYAGLIAAGVYPNPVPHADFVTTTTHKSLRGPRGGVILMKAEYEKPINSAIFPGIQGGPLMHVIAGKAVAFKEALSPEFKAYQEKVVENARVLAETLVKRGLRIVSGRTESHVMLVDLRAKNITGKAAEAALGAAHITVNKNAIPNDPEKPFVTSGVRLGSPAMTTRGFGVKEAEIVGNLIADVLEAPEDAATLERVRGQVAELTKRFPVYG

SEQ ID NO: 25775 - protein, 290 aa, Raphanus sativus
EFMNEVTLISRLQHINLVQVLGCCIEGDEKMLIYEYLENLSLDSYLFGKTGKSKLSWKERFDITNGIARGLLYLHQDSRFRIIHRDLKVSNILLDKNMIPKISDFGMARIFARDETEANTMKVVGTYGYMSPEYVMHGTFSEKSDVFSFGVIVLEIVTGKRNRGFNNLDNENNLLSYAWVNWKEARALEIVDPVIVDSLSPLSSTSQPQEVIKCIQVGLLCVQELAEHRPTMSSVVWMLGSEATDIPQPKPPGYCVRRTPYELDPSSSRQYNDDESVTVNQYTCSVIDAR

SEQ ID NO: 25776 - protein, 436 aa, Coprinopsis cinerea
MINKNKKRLSTFQCRLAELHIPLHVATLPRRKTVVSEVIIFLDSIGCNHVFANIEYEVDELRRDIELCSKAREISKQVSLYHNKSVVEPGIIQSKGGKGYAVYSPYARQWVSIVNSHLSDYLEEAQDPAPNGAAVRSCPKIGPLFLSEIPSYVEGFVLDPEDSMIMRELWPEGEDAASQILQRFLQTKARASQLEARGPLNEGVTYDVKHNRISKYHTDRDRADKDTTSRLRLDAPISQLISIREVLRAILKVTGAQQLNTDSKTGAGRFISELAWRDFYTDVLASYPRISMGRPFLEKYSGIIWENHQAPANSKDPAGTEMDAEALFRWKRGTTGVPIVDAAMRCLNKMGWVHNRMRMIVAMYLTKHLMIDWRVGERYFMQTLVDGDLASNNGGWQWSASTGVDPCPYFRIFNPHTQSLKVQAILFVTGCQSCAT

SEQ ID NO: 25777 - protein, 337 aa, Streptococcus pyogenes
MKRIAVLTSGGDAPGMNAAIRAVVRKAISEGMEVYGINRGYAGMVDGDIFPLGSKEVGDKISRGGTFLYSARYPEFAQLEGQLAGIEQLKKHGIEGVVVIGGDGSYHGAMRLTEHGFPAVGIPGTIDNDIAGTDYTIGFDTAVNTAVEAIDKLRDTSSSHGRTFVVEVMGRNAGDIALWAGIASGADQIIVPEEEFDIEKVASTIQYDFEHKGKNHHIIVLAEGVMSGEAFAQKLKEAGDKSDLRVTNLGHILRGGSPTARDRVIASWMGSHAVELLKEGKGGLAVGIHNEELVESPILGTAEEGALFSLTEEGQIIVNNPHKARLDFAALNRSLSQ

SEQ ID NO: 25778 - protein, 435 aa, Streptomyces clavuligerus
IYNRDELLSVLPAGPAPEGDAELVLRLLERYDLHAFRLVNGRFATVVRTGDRVLLATDHAGSVPLYTCVAPGEVRASTEAKALAAHRDPKGFPLADARRVAGLTGVYQVPAGAVMDIDLGSGTAVTHRTWTPGLSRRILPEGEAVAAVRAALEKAVAQRVTPGDTPLVVLSGGIDSSGVAACAHRAAGELDTVSMGTDTSNEFREARAVVDHLRTRHREITIPTTELLAQLPYAVWASESVDPDIIEYLLPLTALYRALDGPERRILTGYGADIPLGGMHREDRLPALDTVLAHDMATFDGLNEMSPVLSTLAGHWTTHPYWDREVLDLLVSLEAGLKRRHGRDKWVLRAAMADALPAETVNRPKLGVHEGSGTTSSFSRLLLDHGVAEDRVHEAKRQVVRELFDLTVGGGRHPSEVDTDDVVRSVADRTARGAA

SEQ ID NO: 25779 - protein, 360 aa, Triticum aestivum
HNITSLYKKAGWYRSGTGLDFSKQGVAITQENSLLDNTARIEGWLDRFPMFDWVGGRTSELSAVGLLPAALQGIDVKEMLVGAALMDEETRNTVVKENPAALLALSWYWATDGIGSKDMVVLPYKDSLLLLSRYLQQLVMESLGKEFDLDGNRVNQGLTVYGNKGSTDQHAYIQQLREGVHNFFVTFIEVLRDRPPGHDWELEPGVTCGDYLFGMLQGTRSALYSNDRESISVTVEEVTPRAVGALVALYERAVGIYASLVNINAYHQPGVEAGKKAAGEVLALQKRVLTVLNEASCKDPAEPLTLEQIADRCHCPEDIEMIYKIIQHMAANDRALIAEGSCGSPRSVKVYLGECNVDDV

SEQ ID NO: 25780 - protein, 92 aa, Brassica napus
ARNNIDRLLTKLMQERRESGEAFTDMLGYLIKKEDNRYLLSDKEIRDQVVTILYSGYETVSTTSMMALKYLHDHPKALEELRVCLQEILNRL

SEQ ID NO: 25781 - protein, 167 aa, Oryza sativa
MAFASASNGAVRFTEEQEALVLKSWAIMKDDSANIGHRFFLKIFEVAPSARHLFSFLRNSDVPLEKNPNLKKHAMAVFVMTCEAAAQLRKTGRVTVRDTTIKRLGSTHFKNGVSDTHFEVARFALLETIKDGIPASMWSPEMKNAWGEAYEHLVAAIKEGMKPVALL

SEQ ID NO: 25782 - protein, 721 aa, Mycobacterium tuberculosis
MSSNNAGESDGTGPALPTVWPGNAYPLGATYDGAGTNFSLFSEIAEKVELCLIDEDGVESRIPLDEVDGYVWHAYLPNITPGQRYGFRVHGPFDPAAGHRCDPSKLLLDPYGKSFHGDFTFGQALYSYDVNAVDPDSTPPMVDSLGHTMTSVVINPFFDWAYDRSPRTPYHETVIYEAHVKGMTQTHPSIPPELRGTYAGLAHPVIIDHLNELNVTAVELMPVHQFLHDSRLLDLGLRNYWGYNTFGFFAPHHQYASTRQAGSAVAEFKTMVRSLHEAGIEVILDVVYNHTAEGNHLGPTINFRGIDNTAYYRLMDHDLRFYKDFTGTGNSLNARHPHTLQLIMDSLRYWVIEMHVDGFRFDLASTLARELHDVDRLSAFFDLVQQDPVVSQVKLIAEPWDVGEGGYQVGNFPGLWTEWNGKYRDTVRDYWRGEPATLGEFASRLTGSSDLYEATGRRPSASINFVTAHDGFTLNDLVSYNDKHNEANGENNRDGESYNRSWNCGVEGPTDDPDILALRARQMRNMWATLMVSQGTPMIAHGDEIGRTQYGNNNVYCQDSELSWMDWSLVDKNADLLAFARKATTLRKNHKVFRRRRFFEGEPIRSGDEVRDIAWLTPSGREMTHEDWGRGFDRCVAVFLNGEAITAPDARGERVVDDSFLLCFNAHDHDVEFVMPHDGYAQQWTGELDTNDPVGDIDLTVTATDTFSVPARSLLVLRKTL

SEQ ID NO: 25783 - protein, 249 aa, Oryza sativa
MAIVAVTAGGRRPPCRRVPPAASPPARLSCRCATHTVPRRNVLSTMLSTSTVFLFGPKQITLAETTGGTFREYIDTFDGYSFLYPKSWIQVRGAGADIFFRDPFFLDENMSVEISSPSSSKYMTVEDLGPPEKAAERVLQQYLTEFMSTRLGVRRTSNILSASSKVADDGKLYYEVEVNIKSFASNNELAVMPQDRVQRLEWDRRYLSVLGVENKRLYELRLQSPEKVFKEEEGDLRRVMDSFRVNKTA

SEQ ID NO: 25784 - protein, 312 aa, Campylobacter jejuni
MLDVAIIGGGPAGLSAGLYATRGGLKNVVMFEKGMPGGQITSSSEIENYPGVAQVMDGISFMTPWNEQCMRFGLKHEMVGVEQILKNSDGSFTIKLEGGKTELAKAVIVCTGSAPKKAGFKGEDKFFGKGVSTCATCDGFFYKNKEVAVLGGGDTALEEALYLANICSKVYLIHRRDEFRAAPSTVEKVKKNEKIELITSASVDEVYGDKMGVTGVKVKLKDGSIRDLNVPGIFTFVGLNVRNEILKQDDGKFLCNMEEGGQVSVDLKMQTSVAGLFAAGDLRKDAPKQVICAAGDGAVAALSAMAYIESLH

SEQ ID NO: 25785 - protein, 1478 aa, Saccharomyces cerevisiae
MPFLRKIAGTAHTHSRSDSNSSVKFGHQPTSSVASTKSSSKSPRATSRKSIYDDIRSQFPNLTPNSTSSQFYESTPVIVQSFNWTTDDHISAGTLENPTSFTNSSYKNDNGPSSLSDSRKSSGGNSVNSLSFDKLILSWDPTDPDEWTMHRVTSWFKFHDFPESWILFFKKHQLFGHRFIKLLAYDNFAVYEKYLPQTKTASYTRFQQLLKKTMTKNVTNSHIRQKSASKLKSSRSSSESIKSKLKNSKSQEDISNSRSTSESALSPTKSGPSKTDEKNFLHSTSTHQKTKSASSLYRRSFISLRGSSSSNASSAKSPSNIKLSIPARPHSIIESNSTLTKSASPPASPSYPSIFRRHHKSSSSESSLLNSLFGSGIGEEAPTKPNPQGHSLSSENLAKGKSKHYETNVSSPLKQSSLPTSDDKGNLWNKFKRKSQIGVPSPNTVAYVTSQETPSLKSNSSTATLTVQTADVNIPSPSSSPPPIPKTANRSLEVISTEDTPKISSTTASFKETYPDCINPDKTVPVPVNNQKYSVKNFLLDQKFYPLKKTGLNDSENKYILVTKDNVSFVPLNLKSVAKLSSFKESALTKLGINHKNVTFHMTDFDCDIGAAIPDDTLEFLKKSLFLNTSGKIYIKDQMKLQQKPKPAPLTSENNVPLKSVKSKSSMRSGTSSLIASTDDVSIVTSSSDITSFDEHASGSGRRYPQTPSYYYDRVSNTNPTEELNYWNIKEVLSHEENAPKMVFKTSPKLELNLPDKGSKLNIPTPITENESKSSFQVLRKDEGTEIDFNHRRESPYTKPELAPKREAPKPPANTSPQRTLSTSKQNKPIRLVRASTKISRSKRSKPLPPQLLSSPIEASSSSPDSLTSSYTPASTHVLIPQPYKGANDVMRRLKTDQDSTSTSPSLKMKQKVNRSNSTVSTSNSIFYSPSPLLKRGNSKRVVSSTSAADIFEENDITFADAPPMFDSDDSDDDSSSSDDIIWSKKKTAPETNNENKKDEKSDNSSTHSDEIFYDSQTQDKMERKMTFRPSPEVVYQNLEKFFPRANLDKPITEGIASPTSPKSLDSLLSPKNVASSRTEPSTPSRPVPPDSSYEFIQDGLNGKNKPLNQAKTPKRTKTIRTIAHEASLARKNSVKLKRQNTKMWGTRMVEVTENHMVSINKAKNSKGEYKEFAWMKGEMIGKGSFGAVYLCLNVTTGEMMAVKQVEVPKYSSQNEAILSTVEALRSEVSTLKDLDHLNIVQYLGFENKNNIYSLFLEYVAGGSVGSLIRMYGRFDEPLIKHLTTQVLKGLAYLHSKGILHRDMKADNLLLDQDGICKISDFGISRKSKDIYSNSDMTMRGTVFWMAPEMVDTKQGYSAKVDIWSLGCIVLEMFAGKRPWSNLEVVAAMFKIGKSKSAPPIPEDTLPLISQIGRNFLDACFEINPEKRPTANELLSHPFSEVNETFNFKSTRLAKFIKSNDKLNSSKLRITSQENKTE

SEQ ID NO: 25786 - protein, 961 aa, Unknown
  Azoarcus sp. BH72
MNAPDTITFELDGRAVDAAPGESILLAARRAGVDIPHLCYTDGLRADGNCRACVVEIDGERVLAPSCCRAPKPGMKVQSASSRARASQRMVLELLRADVPVEAEKADSELAYWCEQLGVGDSRFAPREQPVADTSHPGIAVNLAACIQCNRCLRACREIQVNDVIGYAHRGAESKIVFDLDVGMGTSSCVGCGECVQACPTGALAPALSLSLFDAVDGGDASAPNPIPTPTLPLKGRENIGPSLQSLPSRSHLKEREQATYTPTRQIHSLCPYCGVGCQVTYHVAGEGAAQKIVFAEGRDGPANAGRLCVKGRYGFSYSRNRERLTVPLIRKPGIPKGVNLDPANPLAAFREASWEEALDFAAGGLARIKREHGPQALAGFGSAKGSNEEAYLFQKLVRTGFGTHNVDHCTRLCHASSVAALLEGIGSGAVSNPVRDVEIADLAIVIGANPAANHPVAASFIKNAAERGMKLVMMDPRQTPLARHAWRVLQFRPDADVALLLSMACVIIEEGLIDADFIARRTEGFDAFREAALQYPPERMATITGIAADTVREVARAYARGPNSIIFWGMGVSQHTHGTDNVRCLIALALMTGQIGRAGTGLHPLRGQNNVQGASDAGLIPMMLPDYQKVADPAVRARFEALWGQPLPTEPGLTVVEIMDAACAGRIRGMYIEGENPAMSDPDLGHAREGLANLEHLVVQDIFLTETAMLADVVLPASSLYEKTGSFTNTDRLVQLARPVLPLPGEARQDWWIIQQMAQRLGLAWDYAGPDEVFAELTRAMPSYAGITWAVLEDAGAVVAPKAAVDQPSQPVLFQADFPTASGRGRFVPATPLPAAELPDSEFPMVLITGRVLEHWHTGSMTRRADVLDALDPVPWCGMHPADLARLGVASGGRVVLETRRGHIELEARADEGVQPGSVFMAFCYVEAAANLLTQPALDPFGKIPEFKYCALRVGVPVGA

SEQ ID NO: 25787 - protein, 401 aa, Zygosaccharomyces rouxii
MAATDRLNQTSDILSQSMKKTDSSMSVVTAENPYKVSVVGSGNWGTTIAKVVAENTKEKPELFQERVDMWVFEEQIDGTPLAQIINTKHQNVKYLPNIDLPDNLVANPDLIATTKDADVIVFNVPHQFLGRIVAQMKGQIKPTARAVSCLKGFEVGPKGVQLLSDYVTQELGIECGALSGANLAPEVAKEHWSETTVAYHIPDDFKGDGKDIDHRVLKQLFHRPYFHVNVIDDVAGISIAGALKNVVALGCGFVTGLGWGNNAAAAIQRVGLGEIIKFGRMFFPESKVETYYQESAGVADLITTCSGGRNVRVATEMAKTGKSGEQVEKDILNGQSAQGLVTCKEVHQWLESSGNTEDFPLFEAVYQITYENVPMKELPSMIEELDIDSTSKCVLSYKMGL

SEQ ID NO: 25788 - protein, 319 aa, Zea mays
  misc_feature (141)..(141): Xaa can be any naturally occurring amino acid
  misc_feature (183)..(183): Xaa can be any naturally occurring amino acid
  misc_feature (213)..(213): Xaa can be any naturally occurring amino acid
ATLPGCQGGLFFDSLRTWGLREFPQRWILGWTFASVFLFVDQDGQSFFDALHMVNTWGYSTINFFAPMSRYASAGGGPVAASKEFKQMVKAFHNAGIEVLQSTSLLAATCSKFQVHGETYMMEPHQFLDEFMRKTNCCPCXVYYILDLNNSAQLLNFSGCGNTLNCNHPVVKEHVLDSLRHWXIAKGSVLSRCKIIAEPWDCGGLYLVGRFPXNWDRWAEWNGKYRDDIRRFIKGDPGMKGVFATRVSGSADLYQVNNRKPYHSVNFVIAHDGFTLCDLVSYNSKHNDANGEGGRDGCNDNYSWNCVFKHNKVGTGGGK

SEQ ID NO: 25789 - protein, 631 aa, Kluyveromyces lactis
MSPVQLDEKSLRTKSPRSDSPVHGQSTVVKNIPFGHYVFERLLNSGAKSIFGVPGDFNLPLLEYLYDEDLVANGLQWIGTCNELNGAYAADGYSRYTNKLGCVITTYGVGELSALNGVAGAFAEDVKVLHIIGVSPSRFRENEQFRSHNVHHLVPAIDSQQPPNHQVYFDMVKDRVCCSSAFLDDINTAADRLDQVIVDICKNSKPGYVFIPVDFADKLVSNKNLIQNPIIDMDTVIESYKDENATKIAGDRLLQWIYESNAPSVFSDLLVDRFNLRKELRQFIETADVWNYNTAMGKSTLDERNPKYLGLYKGAETGKEMQATVDSSDLILHFGPAKNEINCGYYSFHFNENARIIELSNNIIQFIDIKDKNASTVEEANFVSVLKYVNDNLDKSKLSFSYPPVPKSNHSCEYDNNDSITQKSLKEIIPNYFNDGDVLIVETGSFQFGVPNMQFAREMKYITQSFYLSIGMALPAALGVGCGMRDYPRSHIVDQALVPKDYIPRLILCEGDGAAQMTIQEFASYIRYKIPMEILVWNNNGYTVERAINGPTRSYNDIAPFKWTALLNVFGDFENKFNESVTVEKNDELVQLLNKWKSCKERANIKLAEVMLPVMDIPQELNAMLVNGKPN

SEQ ID NO: 25790 - protein, 235 aa, Coprinopsis cinerea
MSRQVPCQLINTISIKLSFSSKAATLASRLVQPNNPGGRGRHDSDEEDDDEAIFAELEEEIENDSSASVREHAMSLLKREMDRVRQLQESNHGQYTEVTDEKEVIRITSREKRCVVHFYHSNFKRCEIMDKHLAKIAPKYFNTLFFRVFVENIPWLVEKLAIKVLPCVICFVDGVTKDRLIGFEELGNNDSFDTATLELRLKTSGVLQGANPNRLDPVFRVSSQKKDDDDDEFDL

SEQ ID NO: 25791 - protein, 185 aa, Guillardia theta
MSEKSNLAPFIKKLYQLVNDPMTNDYICWEKNETCFIVNKPTELSVYILPRYFKHNNFSSFVRQLNQYGFHKLEPNEWVFGHPYFKGGDKLKLSSIKRKKQWSSQKNVSVDFYNNEIFKKLIYELDTLKKYKQVLTKDILDVCRRQERFLIKQQSIETKIKKIEEELNNLKYLVFGYFGKILKSN

SEQ ID NO: 25792 - protein, 627 aa, Coprinopsis cinerea
MIPPVASDPDPTTQIPWPSGRNRAQDADQGDAFPDQASNGVTTVNRDGPSSRSKKTTGKRAQIAWTVELGYGTPFLLGLGLPEHLTALVWLAGPISGLVAQPVIGALSDSSTSKYRRRFWIVLSTVALVLSTLVLAYCEPLAAVVVDLLAVGQGDWDDRRNKIVTNTAIGFAVVSFYILDFALNGLQASLRNLLLDVTPPNQLNEGNAWHSRMTNAGNIVGFGFGFMPLAELPIIRLLGGSQFRKFCIICIVILVITVWMTCWFHEEEERPAHQQRRRRGFGEVLDNIYKSMINLPRPIRRVCYVQLFAFMGWFPFLFYSTTYVGQVMAHEIGKEPDHEYATRLGERAMLIYSIVGVIAGMILPHVATRDRRLLASKTFESPDEELNTLRKMVRQWRVEAARQGKPLRLPVMPFLLRNIWSAAMIFFALLMFSTIFVKTVFEATIFISLVGICWAVAMWVPFTIIMELLKETPPPPPPQSRRPSHVRNLSTPARRPSVINPTSERQPLLRRRSYDEFDSALDADSESGPLPGGTVLGIHNLAIVMPQFLVALATNVIFRLADGQMPVEGERGTYYGKNGVAWVLRFGGFCTLLGAVVARMVPPTTTEREMRRRLGEMKLLGEETSNP

SEQ ID NO: 25793 - protein, 165 aa, Zea mays
  misc_feature (104)..(104): Xaa can be any naturally occurring amino acid
MASTTETNNYKFNHSMIRVKDPKASTKFYEFLGMSLVKKLEFPDNKFDLYFFGYDSPNALSHNKSTFDRQGLIELTHNYGTENDPEYKVNNGNQDPHRGFGHTXIAVDNIQAACQRIEDAGYKFQKKLTDGRMRNIAFRLDPDGNWGPKVVARNDYQETENVKED

SEQ ID NO: 25794 - protein, 63 aa, Atriplex garrettii
PRPNIGIHRFAFILFKQNRRDSVNPPCNRDRFCTRKFAEENQLGLPVAAVYFNCQRETTARRR

SEQ ID NO: 25795 - protein, 450 aa, Oryza sativa
MESKGGKKKSSSSRSLMYEAPLGYSIEDVRPAGGVKKFQSAAYSNCSDQPAPMGVLSAADPPPVSAIGFEGYEKRLEITFSEAPVFADPDGRGLRALSRAQIDSVLDLARCTIVSELSNKDFDSYVLSESSLFIYSDKIVIKTCGTTKLLLTIPRILELAEGLSMPLAAVKYSRGMFIFPSAQPAPHRSFSEEVAVLNRYFGHLKSGGNAYVIGDPAKPGQKWHIYYATQHPEQPMVTLEMCMTGLDKEKASVFFKTSADGHTSCAKEMTKLSGISDIIPEMEICDFDFEPCGYSMNAIHGSAFSTIHVTPEDGFSYASYEVVGFDASTLAYGDLVKRVLRCFGPSEFSVAVTIFGGHGHAGTWAKELNADAYKCNNMVEQELPCGGLLIYQSFDATEDVPVAVGSPKSVLHCFEAENMVNPAPVKEGKLGNLLPWGEDALEENDGVFDE

SEQ ID NO: 25796 - protein, 210 aa, Triticum aestivum
ALAKDDDKASSPGGMFSRPIKTNLRIAESSAFLAYVKSSTPANNPLDNELQRKGNQIDVMDHQGNFSGATERIDTNSSINIQDEKAFETPVQYPLVCFSSSNLHLEQRNEGQQDVSGNPPVYHYPFYYPGMVEHGMALHSVQSFQGNINTAQAHTPPTMLHQYNVYHQSHGASMQSYQYSPAGMNVHSSHLSTRKCVVVGIKHTNSRGKT

SEQ ID NO: 25797 - protein, 438 aa, Unknown [sequence omitted]

SEQ ID NO: 25798 - protein, 708 aa, Bacteroides fragilis
MINPIVKTIELGDGRTITLETGKLAKQADGSVMLRMGNTMLLATVCAAKDAVPGTDFMPLQVEYKEKFAAFGRFPGGFTKREGRASDYEILTCRLVDRALRPLFPDNYHAEVYVNIILFSADGVDMPDALAGLAASAALAVSDIPFNGPISEVRVARIDGKFVINPTFDQLEQADMDIMVAATYENIMMVEGEMSEVSEAELLEAMKVAHEAIKVHCKAQMELTEMVGKTVKREYCHEENDEELRKAVHDACYDKSYAIAASGNRNKHERQDAFDAIRDEFKAQFSEEELEEKGALIDRYYHDVEKEAMRRCILDEGKRLDGRKTTEIRPIWCEVGYLPGPHGSAIFTRGETQSLTSVTLGTKLDEKIIDDVLAHGKERFLLHYNFPPFSTGEAKAQRGVGRREIGHGNLAHRALKRMIPEDYPYVVRVVSDILESNGSSSMATVCAGTLALMDAGVKIKKPVSGIAMGLIKNAGEEKYAVLSDILGDEDHLGDMDFKVTGTKDGITATQMDIKVDGLSYEILERALNQAKEGRMHILGKIEETISEPRTELKDHAPRIETMTIPKEFIGAVIGPGGKIIQGMQEETGATITIEEIDNVGRIEISGTNKKSIDDAIRLIKGIVAVPEVGEVYKGKVRSIMPYGAFVEFLPGKDGLLHISEIDWKRLETVEEAGIKEGDEIEVKLIDIDPKTGKFKLSRKVLLPRPEKK

SEQ ID NO: 25799 - protein, 100 aa, Arabidopsis thaliana
  misc_feature (81)..(81): Xaa can be any naturally occurring amino acid
  misc_feature (89)..(89): Xaa can be any naturally occurring amino acid
MAWAMLSSGTMVASPAQATMDAPFNGLKSYAAFPATRNANNDITYITSNCGRVNCMQVWPPIGKKNVETLSYLSDLTDFQXAKEVDYLXIRNKWISLVKY

SEQ ID NO: 25800 - protein, 585 aa, Aspergillus oryzae
MTSIDELFKKPTSAASAKRKLDATTDPNELYKAAKLDVNGDVKSKGKEPMVEDENDDDGEAGPELPPDFDAEDIPDDEEGRFFGGGMERQTAQAMQYIDQQEEGDVAPEKFDTTWLRRFALNFEKKISKNAELRGKYENDPQKFMASEADLDSEIKGLSILSEHPELYAEFSKLGCVSSLISLLSHENADIAIDAIQIISELTDEDVEAEQEQWDTLVNAMLDADLIELLAQNLSRLDEESDVDRAGVYYVLSVLENLASQSSHAERLGDDSNLLPWLLARIQKKERPVSQNQQYSAEILAILLQSSSKTRSKFISLEGVDILLQLLSQYRKRDPAKDSDEEEFVENLFDCLICLVDEEFGKEKFLEGEGIELAQIMLKEGKFSKPRALRVLDHALGGLGGRPACERFVEAACLRTVFGMFMKKQENQTIEHLLGIFASLLRLLPGGSAARIRTLAKFMEKDYEKIEKLVKLRRDYASRVLPVEQAIEKERKNFTEEEREVMAVEWLSRRFDAGLFSLQLIDVILAWLVAEDDGAKKKVVSLLADRDEGLSLIQGTLKEQIEGLSDDDPGQKDHKEMLETLLQFL

SEQ ID NO: 25801 - protein, 332 aa, Unknown
  Malus x domestica
MAKEPVRVLVTGAAGQIGYALVPMIARGIMLGADQPVILHLLDIPPAAEALNGVKMELVDAAFPLLKGVVATTDVVEACTGVNIAVMVGGFPRKEGMERKDVMTKNVSIYKSQASALEKHAAPNCKVLVVANPANTNALILKEFAPSIPEKNVTCLTRLDHNRALGQVSERLNVQVSDVKNVIIWGNHSSSQYPDVNHATVKTPSGEKCVRELVADDAWLNGEFISTVQQRGAAIIKARKLSSALSAASSACDHIRDWVLGTPEGTWVSMGVYSDGSYDVPSGLIFSFPVTCQHGEWKIVQGLSIDEFSRKKLDATAEELSEEKALAYSCLS

SEQ ID NO: 25802 - protein, 256 aa, Picrophilus torridus
MIRIALTQIHSSMDKESNLEKLRKYTEIAASNGADLIVFPEYFMFYSNDKKYLNENAEPINGIWVKNVIKIFNENSISGIVCINELNDNNVFDTAVYISGDVKGYYRKKMLYDAFGYRESDIYKSGNGPFNLYRINDISFGILICYEIRFPELFRNYSKNGADMIIIPSGWFSGPVKEEQWLSLLRARALENTVYIASSNQIYGDFTGISAVADPIGIISERAGESETMIFYDVKKERINDVRQKMPLLEQLNNLR

SEQ ID NO: 25803 - protein, 829 aa, Bordetella bronchiseptica
MARRDFIKQTAAAAAATVAGVPLTGYTQNIVTESEAAKLKWSKAPCRFCGTGCGVNVAVKDNQVVATHGDFNAEVNKGLNCVKGYFLSKIMYGSDRLTQPLLRMKDGKYAKDGEFAPVSWDQAFDVMAEQFKRVLKDKGPEAVGMFGSGQWTVWEGYAALKLMKAGFRTNNLDPNARHCMASAAVGFMRTFGADEPMGCYDDIENADAFVLWGSNMAEMHPILWTRVTDRRLSAPATKVAVLSTFEHRSYELADLTLTFEPQSDLAILNYIANHIIRTKRVNRDFVDKHTVFREGNADIGYGLRPEHPLQQAARNAGDAGGSKPITFDDFARFVSKYDLEYTAKLSGVPKNRLEELAELYADPKVRVTSFWTMGFNQHTRGVWCNNMVYNIHLLTGKISTPGNSPFSLTGQPSACGTAREVGTFSHRLPADLVVTNPEHRRHAEEIWKLPDGTIPSKVGAHAVLQNRMLKDGKINAYWVMVNNNMQAAANLMNEGLPGYRNPENFIVVSDAYPTVTTLSADLILPAAMWVEKEGAYGNAERRTQFWHQLVDAPGQARSDLWQLVEFSKRFKVEEVWPADLLAKKPEYRGKTLYDVLFANGKVNQFPNTELDAEYANQEAQAFGFYLQKGLFEEYAEFGRGHGHDLAPFDVYHKARGLRWPVVDGKETLWRYREGSDPYVKPGTGFQFYGNPDGKAVIFALPYEPPPEAPDKEYPFWLSTGRVLEHWHSGSMTRRVPELYKAFPEAVCFMHPDDAQALGVRRGVEVEVVSRRGRMRTRVETRGRDKPPRGLVFVPWFDAGQLINKVTLDATDPISFQTDFKKCAVKIVKV

SEQ ID NO: 25804 - protein, 155 aa, Humulus lupulus
IDTTLIGKSFPPTEGAFRGDIRAFIDPIIGHLVWAKTPLLANIYPYFSHKDNPGSVSLQYALFTSPNVVVWDKGLGYQNLFDAILDALYSSLEGAWGGSLDVVVSESGWPSAGGFATSDENARTYLSNLIRHVKKGTPKRPNKPIETYIFAMFNH

SEQ ID NO: 25805 - protein, 89 aa, Chara vulgaris
MITVFQSRRKNMSKQNLIEIEGLVTESLPNAMFRVCLDNGCEVLTHISGKIRKNYIRILPGDRVKVELSPYDLTKGRITYRLRSKNTNT

SEQ ID NO: 25806 - protein, 175 aa, Xylella fastidiosa
MHPKNFQHQLKTIPQPPDETRDFVFNHTMLRVKEINASLDFYARILGFRLIDQRDFPEAQFSLYFLALLPQTVHISDNDTERRLWMSGIPGVLELTHNYGTETQEGQIYHNGNSEPRGFGHICISVPDLYSACARFDTLQVPYQKRLTDGRMKNIAFIKDPDGYWVEIISNTPLP

SEQ ID NO: 25807 - protein, 488 aa, Anabaena variabilis
MQIQTPDWVKNAVFYQIFPDRFAISKQSRKRLLRDVRWEDWDAMPTLQGYKGGDLWGIMEQLDYIQDLGIDAIYFTPIFQSASNHRYHTHDYYQVDPMLGGNAAFKELLDAAHERNIKVVLDGVFNHSSRGFFFFHDVLENGPHSPWVNWFKIEGWPLAPYTGELPANYVGWADNRALPVFNHDNPDVREYIMEIAEYWLKFGIDGWRLDVPFEIKTPGFWQEFRDRVKAINPEAYIVGEVWGDSREWLDGTQFDGVMNYLFAGPTIAFTAGDRVVLEQVQSRDYQPYPPLFAAEYATKIQEVLQLYPWEIQLTQLNLLASHDTARLMTIAGGDQASIELATLLLLTFPGAPSIYYGDEVGLPGGIDPDSRRGFPLEANWDREIYQTHRQLIALRHAYPALRTGEYQVIWAQGALYVFARTLGKEELIIAVNVGTAPAQANVDVASLQTQPDKILYGEAEFSWHNTEETKQLSLNLPPRSGCILGLGD

SEQ ID NO: 25808 - protein, 229 aa, Zea mays
MDPDAVKSTLSNLAFGNVIAAAARDLQKEMVAKDKAQAAPASHDEVDLDELMDDPELEKLHAERIAALKKEVEKREVLKRQGHGEYREVIEGDFLGEVTGSERVICHFYHREFYRCKIMDKHLKALAPVYVGTKFIKLDAENAPFFVAKLAIKTLPCVILFKKGIAVDRLVGFQDLGSKDDFSTRALENILKMKGIIDEKKKDDDDDDEESESKNRRIRSSTAQDSDSD

SEQ ID NO: 25809 - protein, 432 aa, Bradyrhizobium japonicum
MTSAKTASAPDSFFTASLDQADPEIAAAIKGELGRQRHEVELIASENIVSRAVLEAQGSVMTNKYAEGYPGARYYGGCEWVDVAENLAIDRAKKLFGAGFANVQPNSGSQMNQAVFLALLQPGDTFMGLDLAAGGHLTHGSPVNMSGKWFKAAHYTVRREDQIIDMDAVQKQAEEIKPKLIVAGGSAYSRAWDFKRFREIADSVGAYLLVDMAHFAGLVAGGVHASPVPYAHVTTTTTHKSLRGPRGGLILSNDETLAKKLNSAIFPGLQGGPLMHVIAAKAVAFGEALRPDFKVYAKNVVENAKALAEAMKSHGFDIVSGGTDNHLMLVDLRPKGLKGNVSEKALVRAAITCNKNGIPFDPEKPFVTSGLRLGTPAATTRGFGVAEFQQVGGMIAEVLNAIAQSDDGKAPLVEAAIKERVKALTDRFPIYQ

SEQ ID NO: 25810 - protein, 453 aa, Listeria innocua
MEASLLKKNQSVELTIEDLTHDGSGVGKIDGYPLFIPNALPGEKITAKITKLNKNYGFARMENIEVVSAERVEPPCAVYSKCGGCSLQHLSYDGQLAFKRNQVEETMKRIGKLNVEVPDTLGMENPWRYRNKSQVPVGFVNGKLTAGFYQKRSHDIIDMSTCLIHNEKGDVAVQKTREILAKYGTEPYDEKTGKGDIRHIMTRFAHTTGQLMIVLVTTKERLPFKAEIIQDLTNQLEVTSIVQNINPQKTNVIFGDRTKTLWGSDIIEDTIHGIRFAISARSFYQVNPLQTEVLYQQAIDSAELTGEETVIDAYCGIGSISLCLAKKAKHVYGVEIVDQAIQDARANAELNNLTNTTFETGKAEEVIPQWYKNGIVADVLVVDPPRKGCDETLLETILAMKPKKVVYVSCNPGTLARDMKILTEGGYEAKKVQPVDMFPMTTHIEAVTVLTLK

SEQ ID NO: 25811 - protein, 412 aa, Rhodococcus globerulus
MTAAIAVIGNGVAGVSAAQTLRLEGFDGRLFLIGEEEHEPYDRTALSKAVLAGETAEPPPLMTSEQLEALDVESITGRTVVGVDSAAGTLRFADGGTLASDRLLLVTGARARVPRVPGVALSGVHTLRTSGDVKALRQAWRPGAHVVIVGGGLIGCEVATTARKVGLEVTLLEAGSELLTRVLGRQVGAWCRQRLEGLGVEVRLNTAVAEFVGRDYVSAVMTSDGNRFDVDSVLVCVGAEPNTVLAQSLGLKCDRGIVVDAAGSTDHPTIFAAGDAASWPLRSGGRRSLETYLNSQKQASAVVAAMLDRSIPAPQVPLSWTEVAGHHLQMIGDIEGPGEFVARGRIDDGPGSVFRLLGGEVVAAVAIDSPRDFAVVTRLVESRAVVSAHALGDGSSHLRDLLKGRSSPRAHI

SEQ ID NO: 25812 - protein, 1098 aa, Unknown
  Shewanella sp. ANA-3
MKRMLINATQSEELRVALVDGQQLYDLDIESPGHEQKKSNIYKGKITRVEPSLEAAFVDYGAERHGFLPLKEIAREYFPKGYSFQGRPNIKEVVSEGQEVIVQIDKEERGNKGAALTTFISLAGSYLVLMPNNPRAGGISRRIEGDERTELKEAMADLEVPAGMGLIVRTAGVGKESTELKWDLKVLQHHWAAITEAAQSKPAPFLIHQESNVIVRAIRDYLRRDVGEILIDHPRIFEEAKQHIALVRPDFVERVKLYEAEVPLFTHFQIESQIESAFQREVRLPSGGSIVIDPTEALTSIDINSARATKGGDIEETALNTNLEAADEIARQLRLRDLGGLVVIDFIDMTPVRHQREVENRLRDAVHHDRARVQLGRISRFGLMEMSRQRLRPSLEESAAHICPRCHGQGTIRSTESLALSILRLMEEEAIKENTSQIEAIVPVDVAAFLLNEKRKAIRITEQRHDVEVYVIPDPHMMTPDYRVIRHRTDDEIDESSYKRIEQPEAKLYEPRKLERTAAPAPALKGFTAPQKVEQAAAPTANKVEATEPGFFSKLFSAIGAFFSSSDKPAAEKTTETKKSDSQTANANRRNRRNDTRRTRNNQDADKAKEGTREPRTRNAKKSADAPQAQERPAREKDENAKRTKPEPKSRNQAPKEVVAESQDDTPKQEVARERRQRRNMRRKVRIDNANETSEAPIQEEVILAEVAAVNAANTDVATEPQSETKAPRSRRQPRKETAVANETAEATDAVSQAEASTEVAVEAPVVENRADAPSDVTESVKTEAETDADNADVSADADDKAKRESRDGQRRSRRSPRHLRAAGQRRRRDEDEQGASAPAQFVPNDALGDDQDYPAPSAQTAEAAETTEAKAIEVAAESTVTSPATVVEAADVSVVAETTASNAVETEVIEAVATEQVAEIKAEVATTKAPADTAVNNKAETSVKTKEVAVEPVKTVEAVTEAVVAPAETPAQPKAEAKAVAVEAVTPEADKAEAKEAMKSVASAPMAKPAPIVKPQAKPVVTQSVEAAPTAEAVVSKPKAASRFGSMVSSEMTKPTVEVRAQVEVPKGREYDSVASAEAAAPKLKHSNSAESDMARP

SEQ ID NO: 25813 - protein, 653 aa, Aegilops tauschii
MRRWLLRPLALLTTTTALLLNTSTSTSSSISTAHDLPALLSFKSLITKDPLGALSSWTINSSSNGSTHGFCSWTGVKCSRTHPGHVMALRLQGIGLSGTISPFLGNLSRLRVLDLSNNKLEGQIPPSLGNCFALRRLNLSFNSLSSAIPPAMGNLSKLVVLSIRKNNISGTIPPSFADLATVTVFSIASNYVHGQIPPWLGNLTALKDLNVEDNMMSGHVPPALSKLTNLRFLFLGTNNLQGLIPPVLFNMSSLERFDFESNQLSGSLPQDIGSTLPNLKEFSLFYNKFKGQIPSSLSNISSLERIVLHGNRFHGRIPSNIGQNGCLTVFVLGKNELQATESRDWDFLTSLANCSSLSTVDLQLNNLSGILPNSISNLSQKLETLQVGGNQIAGHIPTGIGRYYKLTVLEFADNLFTGTIPSDIGKLSNLRNLFLFQNRYHGEIPLSLGNMSQLNKLILSNNNLEGSIPATFGNLTELISLDLSSNLLSGQIPEEVMSISSLAVFLNLSNNLLDGPITPHVGQLVNLAIMDLSSNKLSSAIPNTLGSCIELQFLYLQGNLLHGQIPKEFMALRGLEELDLSNNNLSGPVPEFLESFQLLKNLNLSFNQLSGPVPDTGIFSNASIVSLTSNGMLCGGPVFFHFPACPYLAPDKL

SEQ ID NO: 25814 - protein, 383 aa, Lactuca sativa
MAIDCMIKTPSCMSSLKEELKEDQQRSLVFDASVLQHETNIPQQFIWPDNEKPNSKKSKDLEVPLIDLGGFLSGRSSSTKEASKLVGNACQKHGFFLVVNHGVDANLISDAQTYMDLFFELPLSEKQRAQRKAGESCGYASSFTGRFSSKLPWKETLSFRFSAEKNSADIVKDYFENTMGEEFVRLGKVYQEYCNAMSRLSLGIMELLGLSLGVNRSHFKEFFEENNSIMRLNYYPRCQKPELTLGTGPHCDPTSLTILHQDNVGGLEVFVDNEWRSITPNSNAFVVNIGDTFMALSNGRYKSCLHRAVVNNKTPRKSLAFFLCPKKDKVVSPPKELVDENNPRVYPDFTWATFLEFTQKHYRADMNTLQAFSNWVEQKTSTT

SEQ ID NO: 25815 - protein, 555 aa, Coccidioides immitis
MWLREYGESVRHRGPDWSGNFVSNNTILAHERLSIVGVESGAQPLVNDDETLALAVNGEIYNHRILRKGLKTQYKFKTHSDCEVIIPLYMEHDIDAPKFLDGMFSWVLFDKKQNRVIAARDPIGITSFYQGWSSQTPGAVYFASELKSLHPVCDKIISFPPGHVYDSKTDTMTRYFQPKWWDPTNVPSTPIDYKLIRESLVRSVRKRLMAEVPYGVLLSGGLDSSLVASIAQRETQRMMVAQNGTVTNGESGAGLVGIDDSNELSTVTSFPQLHSFSIGLPGAPDTKAALEVANFLGTKHYAFTFTVDDGLNALSDVIYHLETYDVTTIRASTPMYLLSRKIKAMGVKMVLSGEGSDEIFGGYLYFHAAPDKKAFHEETVRRVKNLHLADCLRANKSTSAWGLEARVPFLDKQFLEVSMGVDPQEKMITKERIEKYVLRKAFDTSDEPETKPFLPDNILWRQKEQFSDGVGYSWIDALRDNAELQVTDEMMKNPKPEWGDDIPDTKEAYWYRMMFDEHFPPCCASTVMRWTPTWSKQTDPSGRAISTHVAKYDHA

SEQ ID NO: 25816 - protein, 595 aa, Exiguobacterium sibiricum
MLKEAVFHRAMSPFVYKYDDKTIHVRLQTKKNDVDHVDLIWGDPYDWHTENPDDADWNFDPSKSNYWNTFETPMKRSGSDELFDYWFIDVVPPFRRLRYGFRLHDGHSSQVFTERGWFDEKPLDDTGYYFCVPFLNKVDVFHAPDWVKDTVWYQIFPDRFANGDSTNDPAGTLPWNSTAPTTTNLFGGDFQGVIDKIDYLVDLGITGIYFCPIFEAKSNHKYDTIDYLEIDPQFGTKEKFKEMVDLLHANGIRIMLDAVFNHAGFHHKAFADIREHGSNSSYRDWFHLRNFPLVTEPMPNYDTFAFVPEMPKFNTENPEVKEYLLHVARYWVEEFGIDGWRLDVANEVDHAFWRDFRSVVKEADPETYILGEIWHDSQEWLLGDQFDAVMNYPFTNAALNFFALDKTSASTYANDMSHVLFSNTVNVNEVSFNLIGSHDTPRALTRAGNDKNKMRLLLLSMLTFSGSPVIYYGDEIGLDGDQDPGCRKCMPWNPEEQDLNLLMYTKHLLQLRKQHRTLANHGQISFVHADDETNTIVMRRMSQDGTYYVYFNNSNHQATIPAPQSGQGMDLFSNTPLPSLEVTLAPYTGTIIQVI

SEQ ID NO: 25817 - protein, 369 aa, Lactuca sativa
MPSLHKEHINAQPKPLVFDSLILQHETNIPEQFIWPDHEKPNSQKAKELAVPLVDLRGFLSGRASSAKEASVVVGEACKKHGFFLVTNHGVDASLIVDAHRYMDLFFELPFLDKQRVQRKIGESCGYASSFTGRFSSKLPWKETLSFQFSGEKKSSKIVEEYFEKTMGKEFARLGKVYQEYCNAMSRLSLGIMELLGMSLGVEQSHFKEFFKENDSIMRLNYYPPCQKPDLTLGTGPHCDPTSLTILHQDTVGGLEVFIDNEWRSIAPNLNTFVVNIGDTFMALSNGQYRSCLHRAVVNNKIHRKSLAFFLCPKKDKVVSPPDELVDEKNPRIYPDFTWSTFLEFTQKHYRADMNTLQAFTNWIQQKNS

SEQ ID NO: 25818 - protein, 343 aa, Zea mays
AVGSVMTNKYSEGYPGARYYGGNEFIDMAESLCQKRALEAFRLDPAKWGVNVQPLSGSPANFHVYTALLKPHERIMALDLPHGGHLSHGYQTDTKKISATSIFFETMPYRLDESTGLIDYDQLKKSAVLFRPKLIIAGASAYARLYDYDRMRKICTKQKAILLADMAHISGLVAAGVVPSPFDYADVVTTTTHKSLRGPRGAMIFYRKGVKEINKQGKEVMYDFEDKINAAVFPGLQGGPHNHTITGLAVALKQATTPEYRAYQEQVISNCAKFAQSLISKGYELVSGGTDNHLVLVNLKNKGIDGSRVEKVLESVHIAANKNTVPGDVSAMVPGGIRMGTPA

SEQ ID NO: 25819 - protein, 421 aa, Xanthomonas axonopodis
MSLSPDSAPVPGRRRAALIFIFITVLIDVLSFGVIIPVLPDLVRHFTGGDYVVAAGWIGWFGFLFAAIQFVCSPLQGALSDRFGRRPVILLSCLGLGLDFILMAIAHSLPMLLLARVISGVCSASFSTANAYIADVTPPDKRAGAFGMLGAAFGIGFVAGPLIGGWLGSIGLRWPFWFAAGLALLNVLYGWFVLPESLPAQRRTARLDWSHANPLGALKLLRRYPQVFGLASVVFLANLAHYVYPSIFVLFAGYQYHWGPREVSWVLAGVGICSIIVNALLVGRLVRRLGERRALLLGLGCGVIGFIIYGLADSGTAFLIGVPISALWAIAAPSAQALITREVGADAQGRVQGALTGLVSLAGIVGPLLFANVFAWFIGSGAPLHLPGAPWLLAAVLLAAGWGMAWKRAARGAGTTPAAQT

SEQ ID NO: 25820 - protein, 262 aa, Pseudomonas fluorescens
MSILQRLQPYPGLRVMISGGAAGIGEVLAAAYLEAGAQVHVCDVSEAALAAFRDRYPEALATRTDVADPAQIEALFKLQVQHFGGLDVLVNNAGIAGPTAGIDAVSDADWQRTIDINLTAQYRFAHHAVPLLKASDKAHLLHIASVAGRLGYAWRTPYAATKWAIVGLMKSLAAELGASDIRVNALLPGIVEGPRMEAVIQARAEQTGVPVAQMREQYLEKISLKRMVSAEDVAAMALFLCSPAACNVTGQAISVDGNVEYL

SEQ ID NO: 25821 - protein, 226 aa, Arabidopsis thaliana
MSQCVDGIKHLCTSVLGCFDLDLYKQSGGLGDPELLARDTVFSVSEIEALYELFKKISSAVIDDGLINKEEFQLALFKTNKKESLFADRVFDLFDTKHNGILGFEEFARALSVFHPNAPIDDKIHFSFQLYDLKQQGFIERQEVKQMVVATLAESGMNLKDTVIEDIIDKTFEEADTKHDGKIDKEEWRSLVLRHPSLLKNMTLQYLKDITTTFPSFVFHSQVEDT

SEQ ID NO: 25822 - protein, 716 aa, Thermoanaerobacterium thermosulfurigenes
MRKIIPINNNWYFKADYEEGYEKVDDLRSFENVNLPHTNIELPYNYFDEKMYQIKSCYKYPLHISEKYRDKVIYIHFEGVMAYAQVYLNGLYIGEHKGGYTPFDIRIDEVYDWKKELNMLTVVVDSTERSDIPPKGGQIDYLTYGGIYREVSLGIYDDVFIKNIKVETHGIYDNEKSLNLIVHLENLNHQSGNVKFKVKINDKNGKEVFYKEFNTYLDAVKDVYSFNIENLKDIKLWDVDNPNLYEIKVGMKINNFSDEYDNKFGFREAVFKPDGFYLNGRKLKLRGLNRHQSYPYVGYAMPRRVQEKDAEILKNELHLNIVRTSHYPQSKHFLNKCDELGLLVFEEIPGWQYIGNSEWKKVAEQNLREMITRDWNHPSIILWGVRINESQDDDAFYKNMNKIAHEIDPTRQTGGVRYITNSSFLEDVYTFNDFIHDGINKPLRKQQEVTGLEHNVPYLVTEYNGHMYPTKRFDNEERQMEHCLRHLRIQNASYLDDSISGAIGWCAFDYNTHKDFGSGDRICYHGVMDMFRLPKFASYVYKSQVSPDIEPILEPVTFWARGERSIGGVIPLIIFTNCDYIELQYGNKTKIDNIYPNRDAYKGIPYPPIIIDYDIVKPEMIGAWGMVWEDLTLKGFYKGNKVIERKFSREPIPTYLYVVPDDTILSATQKDATRIVVKILDQYGNLLPFINEVIKIEIEGPAKLQGPNEVALIGGA

SEQ ID NO: 25823 - protein, 265 aa, Unknown
  Petunia x hybrida
MAQLRADDLSFIFGLLGNIVSFMVFLAPVPTFYKIYKRKSSEGYQAIPYMVALFSAGLLLYYAYLRKNAYLIVSINGFGCAIELTYISLFLFYAPRKSKIFTGWLMLLELGALGMVMPITYLLAEGSHRVMIVGWICAAINVAVFAAPLSIMRQVIKTKSVEFMPFTLSLFLTLCATMWFFYGFFKKDFYIAFPNILGFLFGIVQMLLYFVYKDSKRIDDEKSDPVREATKSKEGVEIIINIEDDNSDNALQSMEKDFSRLRTSK

SEQ ID NO: 25824 - protein, 423 aa, Burkholderia xenovorans
MDIDQYMTDLGRRARQASRAMARASTAAKNAALAAVAEAIERDAASLKEANARDVAKAREKGHDAAFIDRLTLSDKALKTMVEGLRQVAALADPIGEISNLKYRPSGIQVGQMRVPLGVIGIIYESRPNVTIDAAALCLKSGNATILRGGSEALECNTALAKLIGEGLEAAGLPQDAVQVVATSDRAAVGKLITMTEYVDVIVPRGGKSLIERLMNEARVPMIKHLDGICHVYVDDRADLTKALTVCDNAKTHRYGTCNTMETLLVARGIAAEVLPPLGKLYRDKQVELRVDAAARAVLADAGVGPLGDATEEDWRTEYLAPVLAIKVVDDLDAAIEHINEYSSQHTDAIVTEDHDRAMRFLREVDSASVMVNASTRFADGFEFGLGAEIGISNDKLHARGPVGLEGLTSLKYVVLGHGEGRQ

SEQ ID NO: 25825 - protein, 538 aa, Coprinopsis cinerea
MRLYQSISLLTILGLVPAYAAPSLFDDAQRVLSNPFLDRARNDVKDAASQYLSDAKKTILKGKKNMEKWIHDGREYIKQDNLLYELVTHPSFREQRLRITEPDLCDSSVQQYSGYLDVAEEKHLFFWFFESRHTPEDAPLILWLNGGPGCSSSTGLLFELGPCSIADEGRNVMHNPYSWNTHANIIFLDQPINVGFSYSDDGSTVNSSPLAGKDVYAFLELFLNRFPQYSTQPFHIAAESYGGTYAPNFASIIHKANKELAANPDPKLKHINLASVVLANGLTDPYIQYGSVADYACDGPYPVYDDPQGPQCQALRGKIPTCQRLVKSCYNYNSRFACVPAVLYCNSQIFAPLMQTGLNPYDVRMKCDRQKDGQLCYKQMAWIENWLNKPDVKASLGVSPDREFASCNMDVNQAFTMNGDGMRNSALLLPELVNDGIRLLGNERWVEAMETKFSQEFRRTKSTPWTPLHPGVIAGEIRSAGGSESSAGNVTYLNIHEAGHMVPFDQPEASLAMITRWIFDLPLNLPVGAEELGSIPPL

SEQ ID NO: 25826 - protein, 405 aa, Methanosarcina acetivorans
MGDMETEKTDGAVEIARGVYWVGAIDWNGRDFHGFTTPGGTTYNSYLVVGEKTALIDTVKAPFAGEMLRRITQIIDPSKLDYIVVNHMELDHAGSLAELKKQTDAKIFITKRGVDILNGYFRGLGSENWDLEVVQTGDELDLGGKTLMFLEATMLHWPDSMETFLKEDRILFSNDGFGQHIATSKRYDFEVGDVIPDAAEYYANILMPFHMPLLRFMGVLDKMGVDPLQIAPSHGIIWKQDLKKILEAYRAWANGEVNEKVLVIYDTMWGSTEIMATEIAEAVRAAGVEVKLLNLRKNTRNHIMKEMLDAAAFAVGSPTLNNGLFPTVGDFLVYLKGLRPQKKKAVAFGSYGWGGGAVKTVEKELKDTGIEVLEPGLQIRYRPYEKELERCRKLGEQLAAVAKEQ

SEQ ID NO: 25827 - protein, 475 aa, Pseudoalteromonas tunicata
MNLMWLRRDLRIDDNPALIAALQSGPTQALFIATPEQWQQHDMAPIQVDFIERHLNLLAEQLAKYGIPLTVLTVPNYASCTIALKEFCHTQQISQIFANQEVELNECIRDRQILAAGLNLTLYEADVIVPKGTVKTGKGDMFHVFTPFRNAWVKQLQQHSIKTSSHPSEVLTHYQSIRAEKIVLEATKKSSEKWPLVSDIKKHVMPEFLQTKHADYKQYRDFPALKGTSGVSPYLAIGALSSKMLASQVLQHVPFILDNAKADIFCWLNELAWRDFYKHLLFAYPNLIKGITFSEKYSNLNWPNSNEYFIAWCEGRTGYPLVDAAMRQLRQTGWMHNRLRMVVASFLTKHLLVDWRLGEQFFMQHLIDGDFSANNGGWQWAAGTGCDAQPYFRIFNPITQSEKFDPDGSFIRKYLPELSNVPVKYIHLPHSYLAATGQSECYWPAIVEHSQARQIALAFYKQQLGAPENDSNARN

SEQ ID NO: 25828 - protein, 330 aa, Yersinia pseudotuberculosis
MTLQHKLTQFPRLDLVGNATPLEKLSRLSDYLGREIYIKRDDVTPVALGGNKLRKLEFLAADALRQGADTLVTAGAIQSNHVRQTAAVAAKLGLHCVALLENPIGTEQANYLTNGNRLLLDLFNVDVVMCEALNDPNQQLAELATRVEAQGFRPYVVPIGGSNALGALGYVQCSLEIAAQAAGNVAFSSVVVASGSAGTHAGLAVGLQQLLPDAELIGVTVSRSADEQRPKVAQIQQALATSLGMTDPLAKITLWDSYFAPQYGMPNEEGIAAIKLLARLEGILLDPVYTGKAMAGLLDGIEQQKFCDKGPILFIHTGGAPALFAYHPQV

SEQ ID NO: 25829 - protein, 527 aa, Corynebacterium glutamicum
MSTPDIKEGSAESPGEVMVVGDRREWRRQATGIIAGLVLAALVYLLFPSNSVETVMQSSGVDPETEYTNNAMRLTAAVTILMAVWWMTEAIPLAATALIPLVAFPAFQVVDFGKAAAPYANPTIFLFLGGFLMALGLQKWNLHRRMALAVVLAVGTKPKQLVLGFMVATGFLSMWVSNTATAVVMLPIGMSVLALTAETVGGMKNQKKFATGLMLSIAYSASIGSLGTLIGTPPNALLAAYMSESHDIHIGFGQWMILGVPIAVVFTIIAWLVLTTVFKPEMKEIPGGRELIKREIAEMGPWTAPQVTVGVIFAAAALAWVFIPLTLDWTGSQLSINDSLIGIAAGLLMFIVPANFKTGERILDWRTAGELPWDVLLLFGGGLSLSAMFTSTGLSLWIGELAKGLDALPIFILIFAIAVLVLFLTEFTSNTATAATFLPIMGGVAVGIGLTAGGEQNVLLLTIPVALSATCAFMLPVATPPNAIAFGSGYIKIGEMVKGGLWLNIIAVILITIFTYFVAIPLFGIML

SEQ ID NO: 25830 - protein, 981 aa, Xylella fastidiosa
MMSHTLSSLRDLEYHGAFVERHIGPNDVEIAHMLRVVGYDSLESLTDAIVPEKIRSTVALDLPKGITEEEALAKIRVIANKNRVFRSFIGQGYYGTHTPKVILRNILENPAWYTAYTPYQAEISQGRMEALINFQTMCADLTGMEIANASLLDEATAAAEAMSLAKRSAKSRSDLFFVHDAVHPQTLELLRTRAEPLGIVLRVGTPEEALQADVFGILLQYPDTFGRIGDHRVLANAVHAQGGLVVVASDLLALTLITPPGEWGADIVVGNSQRFGVPFGFGGPHAGFMACRDIYKRSIPGRLIGVSVDAAGHPAYRLALQTREQHIRREKATSNICTAQVLLAVMASMYAVYHGPQGLLRIAWRTHRMAAILAAALRGAGLTVGEYFFDTLHIVGIDAVAIHCAAAAAGMNLRMIDNAQLGISLDETVTRSDVVALGQVFGVQVDVEALDAITADALPAGLLRSSAFLTHPVFNTHHSEHELLRYLRMLADKDLAMDRTMIPLGSCTMKLNATAEMIPVTWQEFACIHPLAPVVQWSGYRQLIDELEAMLAECTGYDAISLQPNSGAQGEYAGLLAIRAYHRSRGEERRNVCLIPESAHGTNPASAQLCGMQVVIIKCDRSGNVDVDDLRMKAEKYSDTLAALMVTYPSTHGVFEEAITEICEIVHAHGGQVYTDGANMNALVGVAKPGRWGSDVSHLNLHKTFCIPHGGGGPGVGPCAVKAHLAPFLPKTLPLPGDAAGLPVQGTQEAKVGMVSAANFGSASILPVSWMYITMMGAAGLRKATQVALLNANYIAKRLAPHYKTLYTGRHGLVAHECILDVRSLEKVSGVSAEDIAKRLIDFGFHAPTLSFPVAGTLMVEPTESESQQELDRFVDAMIQIRGEIAAIEKGHLDPEDNPLKQAPHTAVQVMASQWEHAYSRELAAFPLGVLHHAKYWPPVARVDNVYGDKHVMCACIPVEAYKEKEDSEIQDLIEEDASRC

SEQ ID NO: 25831 - protein, 473 aa, Prosthecochloris aestuarii
MESISLLNTGPAVPRLRNGCLLKPPPLGILSLAAWLRSHGVTLNIADYQLAGGDMGEQLLPSRFASFIEEHSPAPIIGISTMGGMLPVVLMAVEEYKARHPEKTIILGGSGPAGVAAHILRAFPAVDCIFCGEGEAALLEFLEKNGDPSSVAGVVYREGDSIVENPARKRISDLDVLPVPAYDLIDMDRYAVVNVSTSRGCPYRCAFCESPAFWGKGVVYRSLDNVMNEIRELRTRWAKRQINLCDDTFVARRPRVEEFCRRVISEKLDFRWECFARVDLVDPDLMKLMAEAGCSGVFFGVESGSDSVLSRIDKRFTVARARDVISQAVKIFPHVYTSFVWGLPFETMEDFYDSILLMTEFGNSGVRVQRPHFSLRPGAPLFAEYGYDLAYSSSLPYHFLEVPRRFLPPEVEETIRRYPEIFITFYHITGLEFEEKQLFMRNLEALGEEKWRIMAEHLGCVVNEIHGDKNNNM

SEQ ID NO: 25832 - protein, 186 aa, Oryza sativa
MLLCYSLNFSLPCLKIYSLQENFQIRLVRAKKLILITRYIIFRNPSQKISQQQTVRTTHFMLLEHLMITIEDQMFREQQMQRGGRHHQHHTAREQEQQQKQQQRRRLMNNAANGGGGDGGGRSYFSTEAILVLACVTVSLLVLPLILPPLPPPPTLLLLLPVCLLALLVVLAFMPTDMRTMASSYL

SEQ ID NO: 25833 - protein, 336 aa, Aspergillus nidulans
MPSQDVPLPEPFASVPRETLTFGPSPIQYLPNITAALGGKVNIYAKREDVNSGLAFGGNKTRKLEYLASDALAQKADTLVSIGGFQSNHTRQVAAVARKLGLEVALVQEKWVDWDDKNGVYDKAGNIQLSRLMGADTRLDMSGFGIEHKLTLKNLEEEIRARGGKPYYIPAGASDHPLGGLGFARWAFEVEMQEKELGVFFDTVIVCAVTGSTMAGMIAGFKLAQKVNGSRKRKIIGIDASATVEQTFEQILRIAKFTGVKIGLDEEDITAEDVILDDRYHAGVYGIPDEATIEAIKFGARTEAFITDPVYEGKSLNGMMDMGLLSCCRIVFRVKS

SEQ ID NO: 25834 - protein, 310 aa, Listeria innocua
MQKHARVIYNPTSGREIIKKNLADVLSILEQAGYVTSAHATTAEPGDAKHAAEEAVRDRYDLVVAAGGDGTINEVINGIAEQPYRPKVGIIPTGTTNDFARALHVPRDVIKATKIIAAGQSVAMDIGKANDTYFINIGGGGRLTELTYDVPSRLKTMLGQLAYYLKGIEMLPSLKATKVKVEYDQGVFEGEVMFFLLGLTNSIGGFEKIAPDAKLDDGKFSLIIVKKVNLAEFIRLVTLALRGDHIKEPNVIYVKSEKVSVHSEDKMLINLDGELGGETPMEFRNLKQHIEFFASVDDIPATDLFIKENS

SEQ ID NO: 25835 - protein, 550 aa, Hebeloma cylindrosporum
MENEKTEHEKRESSSNLEKGDHVVAQTNPQFHFDVHDLDRVQRRLKQRHVQMIAIAGTIGTGLFLGSGGALEAAGPLGALIAYALVGTVAYSSLCAVGEMSTWAPISGTFPHFAARWVDPALGFATGWNYFYTNAISTPVEITAAVILLTFWDHNSKHISLYTAILCVLVCMINIFGVRYFGESEFIFAIIKLTLIIGLLLVGLIVDLGGGPQGDRIGFRYWKNPGAIAGSGLDRNIFGLDRFLAILSVIVQAAFSFQGMELVVIAASETESPRRNIAKAVRRVFYRILVFYILGILMIGMLVAYNDKDLLFLQGNNTAAKSPFVIAINRAGIKVLPHIVNGAIFTSAFSAGNSFLFCSSRVLYGLALRGQAPKVLTYCTKKGLPLYAVLVASAFSFLSFMSVSSGSNRVFGWFVNLSTTGGFTSWFVMNVTYIFFRRGLLAQGYDPTTNSYHNRFQPYIAYWGAGWTLFFILINGFSVFWKFTAAGFLTAYINIPIFLVLYFGYKIVFRTKFWKPLEMDFVTGIPTLEETETPEKPPKNLGERIANIIF

SEQ ID NO: 25836 - protein, 987 aa, Saccharomyces cerevisiae
MQSQDSCYGVAFRSIITNDEALFKKTIHFYHTLGFATVKDFNKFKHGENSLLSSGTSQDSLREVWLESFKLSEVDASGFRIPQQEATNKAQSQGALLKIRLVMSAPIDETFDTNETATITYFSTDLNKIVEKFPKQAEKLSDTLVFLKDPMGNNITFSGLANATDSAPTSKDAFLEATSEDEIISRASSDASDLLRQTLGSSQKKKKIAVMTSGGDSPGMNAAVRAVVRTGIHFGCDVFAVYEGYEGLLRGGKYLKKMAWEDVRGWLSEGGTLIGTARSMEFRKREGRRQAAGNLISQGIDALVVCGGDGSLTGADLFRHEWPSLVDELVAEGRFTKEEVAPYKNLSIVGLVGSIDNDMSGTDSTIGAYSALERICEMVDYIDATAKSHSRAFVVEVMGRHCGWLALMAGIATGADYIFIPERAVPHGKWQDELKEVCQRHRSKGRRNNTIIVAEGALDDQLNPVTANDVKDALIELGLDTKVTILGHVQRGGTAVAHDRWLATLQGVDAVKAVLEFTPETPSPLIGILENKIIRMPLVESVKLTKSVATAIENKDFDKAISLRDTEFIELYENFLSTTVKDDGSELLPVSDRLNIGIVHVGAPSAALNAATRAATLYCLSHGHKPYAIMNGFSGLIQTGEVKELSWIDVENWHNLGGSEIGTNRSVASEDLGTIAYYFQKNKLDGLIILGGFEGFRSLKQLRDGRTQHPIFNIPMCLIPATVSNNVPGTEYSLGVDTCLNALVNYTDDIKQSASATRRRVFVCEVQGGHSGYIASFTGLITGAVSVYTPEKKIDLASIREDITLLKENFRHDKGENRNGKLLVRNEQASSVYSTQLLADIISEASKGKFGVRTAIPGHVQQGGVPSSKDRVTASRFAVKCIKFIEQWNKKNEASPNTDAKVLRFKFDTHGEKVPTVEHEDDSAAVICVNGSHVSFKPIANLWENETNVELRKGFEVHWAEYNKIGDILSGRLKLRAEVAALAAENK

SEQ ID NO: 25837 - protein, 775 aa, Burkholderia thailandensis
MTETVALKIVQRIADELSVQPRQVAAAVQLLDEGSTVPFIARYRKEVTGNLDDTQLRQLEERLLYLRELEERRATIIASIDEQGKLTDELRAAIDAADSKQTLEDLYLPYKPKRRTRAQIAREAGLEPLAQALLANPLLDPQTEAAAYVDADKGVADVKAALDGARDILSEQFGETAELLGKLRDYLFERGVVSSAVVEGKEGEEGEKFRDYYDYAETIKTVPSHRALALFRGRNAGVLTIKLGLGEELDAQVPHPGEATIARHFGIANQNRPADKWLSDVCRWCWRVKVQPHIETELLTQLRETAEHEAIRVFARNLKDLLLAAPAGPKAVIGLDPGLRTGVKVAVVDRTGKLLATDTIYPHEPRRDWDGSIARLARLAAHTQAELISIGNGTASRETDKLASELIAKHPELKLQKIVVSEAGASVYSASELAAKEFPELDVSLRGAVSIARRLQDPLAELVKIEPKAIGVGQYQHDVNQRELARSLDAVVEDCVNAVGVDANTASAALLARVSGLNSTLARNIVDYRDANGPFPSREHLRRVPRLGDKTFEQAAGFLRINGGENPLDRSSVHPEAYPVVERMLAKISKRIDDVLGNRDALAGLSPAEFVDERFGLPTVRDILSELEKPGRDPRPEFKTATFREGVEKVSDLAPGMVLEGVVTNVAAFGAFVDVGVHQDGLVHVSAMSTKFIKDPHEVVKAGQVVKVKVLDVDVKRQRISLTMRLDDDAAPSPAGNRGGAERGAMRGGGARPQRSREPEPAGAMAAAFAKLKQR

SEQ ID NO: 25838 - protein, 237 aa, Unknown
  uncultured archaeon GZfos27A8
MYSNAGIEATEVIGMADEKKNDIPEKGAVVQRDRETYAIAPDTPAGVVSPDVLRKIAEVAEKYGAAAIKITSAQRMVIVGLKEEDIDPAWNDLGMSPGAAIGLCVRSVKICPGTTFCKKGISDSLGLGMALHDEYHGMSLPAKFKIGVSGCPNCCGESWVKDLGFFGFKNGFKVVVGGEAGKKPRIAQELTYVESIDDAKKVARSVFDYYTANAKPKERIGDFIDRIGFEEFTKGVL

SEQ ID NO: 25839 - protein, 416 aa, Unknown
  Azoarcus sp. BH72
MNAPAEHANIARQHLIDPEICIRCNTCEEICPVDAITHDNLNYVVKFDVCNGCLACISPCPTGAIDSWRNVEKAVPYTLEEQFTWDVLPDTRELDQFEAGIVSGPAGETPAEVQQITDVATAGHGGPALAPWSASHPYINLYGPTNPVTATVTGNYRLTDADASSDIHHVVLDFGSTPFPVLEGQSIGIIPPGVDEKGKPHLLRMYSVASPREGERPHHNNLSLTVKRVTEDHEGKPARGVASNYVCDLKKGDKVQVTGPYGSTFLMPNNPGSSIMMICTGTGSAPMRAMTERRRRRMELKEGGDLILFFGARSPGELPYFGPLQKLPKDFIDINFAFSRVPGEPKMYVQDRIRERADKVFAMLMDDNAYIYICGLKGMEAGVVEAFRDICRARGADWDTLRPQLLAKGRFHIETY

SEQ ID NO: 25840 - protein, 900 aa, Xanthomonas campestris
MALICLCTTAGVVTAAEPTNAPRERISLNADWRFRRGDPPGNTVRLEYDVRPEVVRSEDGKVADARPEQAQRIDADARNVLKPWILPTANSLIADPTQRHVRPPGHPGSAVAYVQPMFDDSAWQRVDLPHDWAIAGPFLADGPHGGMGRLPSWGVGWYRKALQIPASDRGRSLFLDLDGAMSYATVWLNGKLVGGWPYGYTSWRVDLTPYVVPGGHNQLTIRLDNPPDSARWYPGGGLYRNVWLTKTGPLRVAQWGTQLSTPQVSAERAQVQLAVQLDNAGAAPVQAQVSTALYALDDASGLRRGPAVAQIAAVQVQVAAGGNARVQGSTQIEAPRRWGPPPTQQPHRYVAVTEVSQGGRVVDRVETPFGVRSVVFDPDKGLVINGEHVPIRGVNNHHDLGALGAAFNVRAAERQLQLLQHMGANAIRMSHNPPAPELLELTDRMGLLVVDEVFDSWEMKKTPLDFHLIFPQWHEPDLRAMLRRDRNHPSIILWSVGNEVGEQYTGEAGAAIARRLHAIVHAEDPTRPATAAMNYASPEMPLPAALDVISLNYQGEGIRDTPEFEGTERIRKPPQYPAFHAKFPRKAILSSETASALSSRGVYLFPVSAQSSAPVRDGRGGDSVAHQVSAYELHAVDFGSSADKVFAALDRHPFVAGEFVWTGFDYLGEPTPYYSSRSSYSGILDLAGFPKDRYWLYQARWRPELPMAHLLPHWSWPGREGQVTPVHVFTSGDEAELFVNGVSQGRKRKAPLQYRLRWDAVVYQPGELRVQAYKHGRPWASDRVQTAGRATRMQLSADRNQIRGDGKDLSFITVRLLDADGRPAPTAGDRLRFRVEGAGELVATDNGDPTNLEAFVLPERNAFNGLCLVIVRAKPGAQGPITVHVQSDTLQSASVQVLAE

SEQ ID NO: 25841 - protein, 323 aa, Escherichia coli
MSKIFEDNSLTIGHTPLVRLNRIGNGRILAKVESRNPSFSVKCRIGANMIWDAEKRGVLKPGVELVEPTSGNTGIALAYVAAARGYKLTLTMPETMSIERRKLLKALGANLVLTEGAKGMKGAIQKAEEIVASNPEKYLLLQQFSNPANPEIHEKTTGPEIWEDTDGQVDVFIAGVGTGGTWTGVTPYIKGTKGKTDLISVAVEPTDSPVIAQALAGEEIKPGPHKIQGIGAGFIPANLDLKLVDKVIGITNEEAISTARRLMEEEGILAGISSGAAVAAALKLQEDESFTNKNIVVILPSSGERYLSTALFADLFTEKELQQ

SEQ ID NO: 25842 - protein, 518 aa, Pisum sativum
MAMAMALRKLSSSVNKSSRPLFSASSLYYKSSLPDEAVYDKENPRVTWPKQLNSPLEVIDPEIADIIELEKARQWKGLELIPSENFTSLSVMQAVGSVMTNKYSEGYPGARYYGGNEYIDMAETLCQKRALEAFRLDPAKWGVNVQPLSGSPSNFQVYTALLKPHDRIMALDLPHGGHLSHGYQTDTKKISAVSIFFETMPYRLDESTGYIDYDQLEKSATLFRPKLIVAGASAYARLYDYARIRKVCDKQKAVLLADMAHISGLVAAGVIPSPFDYADVVTTTTHKSLRGPRGAMIFFRKGLKEVNKQGKEVFYDYEDKINQAVFPGLQGGPHNHTITGLAVALKQATTPEYRAYQEQVLSNSSKFAKALSEKGYDLVSGGTENHLVLVNLKNKGIDGSRVEKVLELVHIAANKNTVPGDVSAMVPGGIRMGTPALTSRGFVEEDFVKVAEYFDAAVSLALKVKAESKGTKLKDFVEALQTSSYVQSEISKLKHDVEEFAKQFPTIGFEKATMKYNK

SEQ ID NO: 25843 - protein, 140 aa, Brassica napus
MDPDAVKSTLSNLAFGNVLAAAARDYKKEVLANEKAQSSNPVNEEVDLDELMDDPELEKLHADRIAALKREVEKREAFKRQGHGEYREVSEGDFLGEVTRSQNVICHFYHKEFYRCKIMDKHLKSLAPRHVDTKFIRVDA

SEQ ID NO: 25844 - protein, 420 aa, Aggregatibacter actinomycetemcomitans
MFKKSMNIADYDPVLWQAIENENRRQEEHIELIASENYASPRVMQAQGSQFTNKYAEGYPGKRYYGGCEYADIVEQLAIERAKELFGADYVNVQPHSGSQANAAVYMGLLNPGDTILGMSLAHGGHLTHGASVSFSGKIYHAEQYGITDEGLIDYDALRKQAHDVKPKMIVGGFSAYSQVVDWKKMREIADEVGAYLFVDMAHVAGLVAAGIYPNPLPYAHVVTTTTHKTLGGPRGGLILSSCGDEEIYKKLNSAVFPAGQGGPLVHIIAAKAVCFKEALEPEYKVYQQNVLKNAKAMVEVFKQRCYKVVSNGTENHLFLVDLVSHGLTGKAADAALGKANITVNKNSVPNDPQKPFITSGIRVGTPSVTRRGFNEADVKELAGWMCDVLDAIGKDNEAEVIADTKDKVLAICKRLPVYA

SEQ ID NO: 25845 - protein, 237 aa, Zea mays
MATAGGGAGHLKLLGAWPSPFVNRVRMALHLKGLEYENVEEDLTNKSDLLLASNPVHKLVPVLLHGDKPISESLVIVEYLDDAFPGAGQAVLPADPYERAVARFWAKYVDGKLHGMMVKALMGATEEERATATVDALAAMDTLEGAFAECSGGKKFFAGDAPGYLDVALGGFIGWLRAWDKVGGVKLLDAGRVPRLATWAERFAALDVAKEVIPDPDHIAEFAKVLQARSAAAATSN

SEQ ID NO: 25846 - protein, 434 aa, Hyphomicrobium methylovorum
MSSAPAAGTASTSRFFKSHVSETDPDIFSAIQKEFGRQQHEIELIASENIVSQAVLDAAGSVLTNKYAEGYPGKRYYGGCQYVDIVEDIAIDRAKKLFNCEFANVQPNSGSQANQGVFNALAQPGDTILGLSLAAGGHLTHGAPVNQSGKWFKAVHYMVKPDSHLIDMDEVRKLAQEHKPRIIIAGGSAYPRKIDFAAFRAIADEVGAIFLVDMAHFAGLVAAGLIPSPFPHAHVVTTTTHKTLRGPRGGMILTNDADIAKKINSAIFPGIQGGPLMHVIAGKAVAFGEALRPDFKVYIKQVMDNARALGEVLVQNGFALVSGGTDTHLVLVDLRPKKLTGTKAEKALGRANITCNKNGIPFDPEKPMVTSGIRLGSPAGTTRGFGVAEFQEIGRLISEVLDGVAKNGEDGNGAVEAAVKAKAIALCDRFPIYA

SEQ ID NO: 25847 - protein, 241 aa, Brassica napus
  misc_feature (225)..(225): Xaa can be any naturally occurring amino acid
MSTALISSLTYYLSEHPYIVGFRWGHSQSWSSTWSFLITSIFLYIAVSSSLHIILSAFLPRNRSVSLGHIPDIHSLLMSILSATIFAGILLSTAAEIRDTRWFWRRSKTATPLQWLLCFPLGTRASGRVFFWSYVFYLTRFLHMLRTIFAVFCRRRLAVSQLFCNSAMAFTSFLWLEFSQSYQVLAILSTTLVYSVVYGYRFWTGFGLPGSTFPSFVVNCQLVLXGCNLVSTLGSGDAPHK

SEQ ID NO: 25848 - protein, 140 aa, Litchi chinensis
AWHSAGTFDLRSKTGGPFGTIRHPDELAHEANNGLDIAVRLLEPIKEQFAILSYADFYQLAGVVTVEITGGPEIPFHPGRPDKSDPPPEGRLPAATEGSDHLRDVFGHMGLSDKDIVALSGGHTLGRCHKERSGFEGPWT

SEQ ID NO: 25849 - protein, 537 aa, Unknown
  Rhodococcus sp. RHA1
MVSYMSLPVTDTSAPPAGVRHIDTLIIGSGFAGLGAAIKLTQAGKTDFLVLERGSDVGGTWRDNTYPGAACDVPSHLYSYSFALNPEWTRSFSTQPEIQKYIQSVADKYKVRNKHLFGCDVQSAHWNESTTRWEVTTTKGNFVAKVLVSAVGALCEPSLPDIKGIEGFEGEIFHSARWNHDADLTGKRVAVIGTGASAIQIVPAIGKKVSHLDVYQRTAPWILPRADREYTKLEHTAFKYLPGFQKLCRTGIYWMRESQVVGLAKAPVFMKPLQFAAERHLRRQIKDKALRKKVTPNFQIGCKRMLISNNYYPTLAQDNVDLVTDGIAEVTADSVVSKDGTVREVDAIVVATGFHVTDSPTFEGIFGKDGRSLADVFDEGGQQGYKGAAIANFPNMFFLVGPNTGLGHTSMVFMIESQLNYLVDALQTLDKYDIGKIEVRQDAQDRYNAELQEKLSHSVWNNGGCASWYLDKHGNNTTLWPGFTFQFRNETKRFDLTAYDSVATADLPAPVHVNGKTPGPAAIPAQIDLDDDKVTAQ

SEQ ID NO: 25850 - protein, 830 aa, Cellvibrio japonicus
MKHLISPRILTGLFVIGLGGQAVADCNAPAWSSTTQYKGGEAVVYQGGAFKARWWANVGVAPDTSNPWDVWQFIQPCSSGGNSSSVQASASVSSSGIIVGAQCNWYGNSYPVCQQAASGWGWENQQSCIAYADCASLPAPYGVMGGNSSSVLSGSSVSSSSRLSSSSSIPLSSSLPSSSSSVSSIASSSLSSSSSSMAVPEGNSWTYTAASASITAPAQLVGNVGELQGAGSAVIWNVDVPVTGEYRINLTWSSPYSSKVNTLVMDGTALSYAFAEATVPVTYVQTKTLSAGNHSFGVRVGSSDWGYMNVHSLKLELLGGLTIRSPANFAQLPSGSNIQVVYEKQGSGRLTYSVNDGATQLYGGESPLTIPTQGDGVYRLKFGLEGTVLSSNLRVTVGSANVPEFVEASGTQFVLGNKPFYFNGSNQYYLMYKPEPMANDFFARAKALDMKVVRTWMFCNSSSTHDGVCINKKSGSSFILVKPESERTADEKALITRSFERFDNYVAQAEANDMRLVLSLSDYWDYFGKIEDYGPYGSASGRALFKTFITNLLNHVNPLTGKAYKDDPTIMMWELANEPRYTTGNFADFKVWVADIAAHIKSIAPHQLVSIGSESSFGIALDDTYASLVELNRDPNIDAISAHLYPTSWRMTDEQVLSNIQKLADLAREVGKPAYIGELGWPAHAQRTTGSNFIELSSFTDQAAVDSFVSISLTQRANYMESWYAKAYANKDAIGGFLIWQLSGKEWGNGGTPLRGCQWCAGPYGEPTGGWSGNHDGYQFYCALNEAEMSLTQLGALGSNKEGDKIHMDLHKLSCDVMKAYSGKYRSLMQ

SEQ ID NO: 25851 - protein, 261 aa, Passiflora edulis
VLNHGIPNEFMDTVERMTKAHYNKCMEQRFNELVASKALEGVQVELKDMDWESTFYIRHLPESNIAEIPDLDDEYRKVMKDFAAKLEKLAEELLDLFCENLGLEKGYLKKALYGSRGPTFGSKVSNYPPCPKPELVKGLRPHTDAGGIVLLFQDGKVGGLQLLKDGQWVDVPPIPHAIVINIGDQLEVITNGKYKSVDHRVVAQTDGARMSLASFFNPGSDAVIYPAPALVEKEAEEKKQLYPKFVFEDYMKIYAGLKFHA

SEQ ID NO: 25852 - protein, 413 aa, Thermoanaerobacter tengcongensis
MDIEIIRKTDPEIAEVILKELNRQRNKIELIASENFVSRAVMEAMGTPLTNKYAEGYPGRRYYGGCEYVDMAEELARERLKKLFGAEHANVQPHSGAQANMAAYFALLKPGDTVLGMDLAHGGHLTHGSKVNFSGQIYNFVSYGVREDTGYIDYDQVEDLAKKHKPKLIVAGASAYPRIIDFKKFREIADKVGAYLMVDMAHIAGLVAAGLHPNPVPYADVVTTTTHKTLRGPRGGAILCKQEHAKAIDKALFPGTQGGPLMHIIAAKAVCFKEALSDEFKEYQKRIVENAKALANALMERGINLVSGGTDNHLMLLDLRNTGITGKELETRLDEVNITCNKNAIPFDPLGPNVTSGVRLGTPAVTTRGMKPEDMVEIADIIANMIKDENYKEKAKERVAKLLEKYPLYPDLL

SEQ ID NO: 25853 - protein, 1034 aa, Klebsiella pneumoniae
MQISDTGRSHTPDFHAVLAREDWHNQTITHLNRLPAHPVFASWRDELAARDNLPSSRRRQLDGSGSSLTPAARLPSMRVVTQDLPDCRGTPVPSNWQMEGYDAPIYTNVRYPIDTTPPRVPEDNPTGCYSLHFTVEDTWRENGQTQIIFDGVNSAFHLWCNGVWVGYSQDSRLPAAFDLSPFLRPGDNRLCVMVMRWSAGSWLEDQDMWRMSGIFRSVWLLNKPQQRLCDVQLTPALDALYRDGTLQVQATIEATEAALAGLSVGVSLWRGEEQFAAGRQPLGTPTVDERGHYAERVDFSLAVATPAHWSAETPNCYRAVVTLWRGDELLEAEAWDIGFRRIEIADGLLRLNGKPLLIRGVNRHEHHHLRGQVVTEADMVQDILLMKQNNFNAVRCSHYPNAPRWYELCNRYGLYVVDEANIETHGMVPMNRLSDDPAWLPAFSARVTRMVQSNRNHPCIIIWSLGNESGGGGNHEALYHWLKRNDPSRPVQYEGGGADTTATDIICPMYARVERDQPIPAVPKWGIKKWISLPGEQRPLILCEYAHAMGNSLGNFADYWQAFREYPRLQGGFIWDWADQAIRKTFADGSVGWAYGGDFGDKPNDRQFCMNGLVFPDRTPHPSLVEAKHAQQYFQFTLLSTSPLRVRIISEYLFRPTDNEVVRWQVQAAGEPLYHGDLTLALPPEGSDEITLLDSLILPEGARAVWLTLEVTQPQATAWSEAEHRVAWQQFPLPAPLGCRRPPCLPALPDLIVSDEVWQIRAGSQCWTIDRRTGLLSRWSVGGQEQLLTPLRDQFIRAPLDNDIGVSEVERIDPNAWVERWRSAGLYDLEAHCVQCDAQRLANETLVDCRWHYLRGEEVVIVSHWRMHFTADGTLRLAVDGERAETLPPLPRVGLHFQVADQQAPVSWLGLGPHENYPDRRSSACFARWEQPLAAMTTPYIFPTENGLRCDTQALDWGRWHISGHFHFSVQPWSTRQLMETDHWHKMQAEDGVWITLDGLHMGVGGDDSWTPSVLPQWLLSQTRWQYEVSLRSL

SEQ ID NO: 25854 - protein, 317 aa, Bartonella henselae
MVQSHVRLLIIGSGPAGYTAAIYAARGMLKPVLITGLQQGGQLMITTDVENYPGFADPIQGPWLMEQMAKQAENMGTKIVYDNITKADLSKRPFILYGDSGAQYCCDALIIATGAQARWLGLESEQVFMGGGVSACATCDGFFYRDKDVIVVGGGNTAVEEALYLSHLAKRVSVVHRRDYFRAEKILQDRLFARDNVCVLWDHVVEEIIGLPARASIGAVVTGVRLKNVKTGQKVHVDTDGIFIAIGHDPAVSLFEGQLKQKSGGYLWTAPDSTATSIAGVFAAGDVVDDVFRQAITAAGRGCMAALEAERFLELQI

SEQ ID NO: 25855 - protein, 194 aa, Thermoanaerobacter tengcongensis
MRKAEVKRKTAETDIYVELNIDGKGSYDIKTGIGFFDHMLSLFAKHGLFDLKVIAKGDLEVDTHHTVEDVGIVLGTAFLKASGDKKSIKRFSTFYVPMDEALVRVSLDISGRPYLYYDLPLKAERVGNFETETVEEFFRAFAYNFGITLHVELLHGVNTHHIIEASFKALGKALDEALKLDERIDGIPSTKGIL

SEQ ID NO: 25856 - protein, 555 aa, Shewanella oneidensis
MTESFADLFEQSLQTLEFRPGSIVRGTVVAIENGMVLVDAGLKSESPIPAEQFKNAQGVLEIAVGDEVDVALDSVEDGFGETQLSREKAKRHEAWIVLEKAYEDAETVIGIINGKVKGGFTVELNGIRAFLPGSLVDVRPVRDTAHLEYKELEFKVIKLDQKRNNVVVSRRAVIESESSAERDALLENLQEGQAVKGIVKNLTDYGAFVDLGGVDGLLHITDMAWKRVKHPSEIVNVGDEINVKVLKYDRERTRVSLGLKQLGEDPWLEISKRYPENTKLTGRVTNLTDYGCFVEIEEGVEGLVHVSEMDWTNKNIHPSKVVNLGDEVEVLVLDIDEERRRISLGLKQCKTNPWDDFATRYNKGDKVSGKIKSITDFGIFIGLDGGIDGLVHLSDISWNGTGEDAVSEYKKGDEIHAVVLSVDPERERISLGVKQTEDDPFNAYLADKKKGTIVHGTVSAVDAKGVTVELADTVEGYIRVADISRERIEDASTVYSVGDAIEAKFMGVDRKNRSISLSIKAKDEAEEKEVMATLNKQEDAVISNAMAEAFKAARK

SEQ ID NO: 25857 - protein, 361 aa, Triticum aestivum
  misc_feature (25)..(25): Xaa can be any naturally occurring amino acid
  misc_feature (58)..(58): Xaa can be any naturally occurring amino acid
MALLTDLLNLDLTDSTEKIIAEYIXIYCRIGGSGMDLRSKARTLPGPVTDPSKLPKWXNYDGSSTGQAPGEDSEVILYPQAIFKDPFRKGNNILVMCDCYTPAGVPIPTNKRYNAAKIFSNPDVAKEEPWYGIEQEYTLLQKDINWPLGWPVGGFPGPQGPYYCSIGADKSFGRDIVDSHYKACLFAGVNISGINGEVMPGQWEFQVGPTVGISAGDQVWVARYLLERITEIAGVVVTFDPKPIPGDWNGAGAHTNYSTESMRKDGGFKVIVDAVEKLKLKHKEHIAAYGEGNERRLTGKHETADINTFSWGVANRGASVRVGRETEQNGKGYFEDRRPASNMDPYVVTSMIAETTILWKP

SEQ ID NO: 25858 - protein, 120 aa, Glycine max
  misc_feature (88)..(88): Xaa can be any naturally occurring amino acid
MLKYIARDKEFRRIPVIMMPAQDEVSIVVKCLRLGAADYLVKPLRTNELLNLWTHMWRRRRMLGLVEKNILNYDFDLVVSDPSDANTXSTTLFSDDTDDKSKRSTNPEAGISVQQEQEST

SEQ ID NO: 25859 - protein, 481 aa, Candida albicans
MLLHHTLGNGDFTVFHRMSTNICETTAFLDDLATACNEIDRCLRTAYTMQRPVYIALPSNMVDMKVPQAMLEKSIDLSLEPNNIQSQNEVIDRILGMVSKASNPIVLVDACASRHDCKKEVKQLVETTQFPVYVTPMGKGMIDEGGIGGEDLADASAFKNLASNLSSGTSVASRYGGVYIGSLSKPEVKEGIENSDLIFSCGALLSDFNTGSFSYSIGTKNVIEFHSDHAKIKSAIYSGIKMKELMQALNKKISSVLTNYVPKSVPKVKLVNAPTELSAPLTQAWFWTRVSSWFKEEDIIITESGTAAHGILEARFPNNVVGISQILWGSIGYSVGATLGASVAAKEVDPKKRVILFVGDGSLQLTMQEVSTMIKNGVHPYIFVVNNAGYTIEKLIHGLNAKYNNIQPWNHSQILSLFNAKDSQSAKISTVGEADDLFRNKYFGVNSKIRLIELMFSSLDAPKALVQQAKAAADVNRGTTD

SEQ ID NO: 25860 - protein, 153 aa, Triticum aestivum
  misc_feature (94)..(94): Xaa can be any naturally occurring amino acid
  misc_feature (106)..(106): Xaa can be any naturally occurring amino acid
  misc_feature (112)..(112): Xaa can be any naturally occurring amino acid
  misc_feature (140)..(141): Xaa can be any naturally occurring amino acid
TASTCICERPCRTSWPPVKQSASIQSILCIPVMGGVLELGTTDTVPEAPDLVSRATAAFWEPQCPTYSEEPSSSPSGANETGEVAADDGTFAFXELDHNNGMDDIXAMTAAXGGHGQGGRLRLKRTEPCQTTNLGHITRXXRILHLCDKWPAR

SEQ ID NO: 25861 - protein, 372 aa, Unknown
  Oceanobacter sp. RED65
MSRQSVANAKRIVIKIGSALLTNDGAGLNKAGIANWVDQIAELKAQGKEIILVSSGSVAEGMTRLGWSERPTALHELQAAAAVGQMGLVQCYESNFSRHQYVTAQVLLTHADLSNRTRYLNARSAITSLLSFGVVPIINENDTVITDEIRFGDNDTLGALVANLIEADALIILTDQDGLYTADPRKDKNAKLIEQARAEDPDIEAVAGGGGKLGRGGMTTKVRAAKLAARSGCFTVIVGGRIENVITRLNKDEVLGTLLCSDQEPMAARKQWLAGHLQTRGQITLDPGAVRAVIEQGRSLLSVGVVHVDGNFGRGEVVACINEQGQIIAKGLINYNALETQKIMGKESKEILDILGYMDEPELIHRDNLVLV

SEQ ID NO: 25862 - protein, 905 aa, Hordeum vulgare
MAVGETGASVSAAEAEAEATQAFMPDARAYWVTSDLIAWNVGELEAQSVCLYASRAAAMSLSPSNGGIQGYDSKVELQPESAGLPETVTQKFPFISSYRAFKVPSSVDVASLVKCQLVVASFGADGKHVDVTGLQLPGVLDDMFAYTGPLGAVFSEDSVSLHLWAPTAQGVSVCFFDGPAGPALETVQLKESNGVWSVTGPREWENRYYLYEVDVYHPTKAQVLKCLAGDPYTRSLSANGARTWLVDINNETLKPASWDELADEKPKLDSFSDITIYELHIRDFSAHDGTVDSDSRGGFRAFAYQASAGMEHLRKLSDAGLTHVHLLPSFHFAGVDDIKSNWKFVDECELATFPPGSDMQQAAVVAIQEEDPYNWGYNPVLWGVPKGSYASDPDGPSRIIEYRQMVQALNRIGLCVVMDVVYNHLDSSGPCGISSVLDKIVPGYYVRRDTNGQIENSAAMNNTASEHFMVDRLIVDDLLNWAVNYKVDGFRFDLMGHIMKRTMMRAKSALQSLTTDAHGVDGSKIYLYGEGWDFAEVARNQRGINGSQLNMSGTGIGSFNDRIRDAINGGNPFGNPLQQGFNTGLFLEPNGFYQGNEADTRRSLATYADQIQIGLAGNLRDYVLISHTGEAKKGSEIHTFDGLPVGYTASPIETINYVSAHDNETLFDVISVKTPMILSVDERCRINHLASSMMALSQGIPFFHAGDEILRSKSIDRDSYNSGDWFNKLDFTYETNNWGVGLPPSEKNEDNWPLMKPRLENPSFKPAKGHILAALDSFVDILKIRYSSPLFRLSTANDIKQRVRFHNTGPSLVPGVIVMGIEDARGESPEMAQLDTNFSYVVTVFNVCPHEVSMDIPALASMGFELHPVQVNSSDTLVRKSAYEAATGRFTVPGRTVSVFVEPRC

SEQ ID NO: 25863 - protein, 72 aa, Glycine max
  misc_feature (35)..(35): Xaa can be any naturally occurring amino acid
LNSSNALVISLYTVLSLYWGRIVVFNLQRENVALXEPDQNGLAHFEAGDTRAMEYVILLYSNDSVGFNIVDV

SEQ ID NO: 25864 - protein, 680 aa, Staphylococcus aureus
MEIFETILIFIAVVILSSFVHTFIPKVPLAFIQIFLGMLLFITPIPVQFNFDSELFMVTMIAPLLFVEGVNVSRVHLRKYIKPVMMMALGLVITTVIGVGLFIHWIWPDLPIGAAFAIAAILCPTDAVAVQAITKGKVLPKGAMTILEGESLLNDAAGIISFKIAVGVLVTGAFSLVDAVQLFLIASIGGAVVGLLIGMALVRFRLTLMRRGYENINMFTIIQLLTPFVTYLIAELFHASGIIAAVVAGLVHGFERDRIMQVRTQLQMSYNHTWNILGYVLNGFVFSILGFLVPEVIIKIIKTEPHNLIFLIGITIVVALAVYLFRFVWVYVLYPYFYLAISPFQKMMTKNDDDNPTTEKPPKRSLYALIMTLCGVHGTISLAIALTLPYFLAGHHAFTYRNDLLFIASGMVIISLVVAQVLLPLLTKPAPKTVIGNMSFKVARIYILEQVIDYLNQKSTFETSFKYGNVIKEYHDKLAFLKTVEKDDENSKELERLQKIAFNVETKTLESLVDEGQITNSVLENYMRYAERTQVYRQASLIRRMIVLLRGALLKRRVQTRVNSASSLSVTDNLMELNKINKLVHYNVVSRLSKETTKDNTLEVGMVCDGYLMRIENLTPSNFFNSASEDTITKIKLNALREQRRILRELIDTDEVSEGTALKLREAINYDEMVIVDSMT

SEQ ID NO: 25865 - protein, 214 aa, Cistanche phelypaea
NINLEEMLEAGVHFGHGIRKWNPKIAPYISAKRKGIHITNLTRTARFLFEACNLVFDAASRGKQFLIVGTKNKAANLVAWAAIKARCHFVNKKWLGGMLTNWSTTETRLHRFRDLRMEQKMGRLNRLPRRDSAVVKRQLYRLQTYLGGIKYMTRLPDIVIIVDQHEEYTALQECITLGIPTICLIDTNCDPDLADISIPANDDAISSIRLILNK

SEQ ID NO: 25866 - protein, 293 aa, Burkholderia xenovorans
MSAPLLFRPSLDAVYGFPHAKRVTQVVSPYQRIEVWDTPQLGRLFTLDGRPMTSTGDEFIYHECMVHPAALAHPSPQAALVLGGGDGGAARQLLRHAGIERIVVAELDAEVVRLTREHLPEVHGGAFDDPRVELVIGDAAHYVAHAAPARFDLVVFDLTPPDSPAAGLYTPTFYQQLKRVMRPIAAVSVHLGSPYFHAARIARLLDDLRAAFAVVRTMNTFIPLYGSLWIMATASDTLDPAALAADTLIERLAARRIGPLMHYDAGTHAALFSASRSVRDKLRRCCEIKFWVC

SEQ ID NO: 25867 - protein, 479 aa, Unknown
  Nostoc sp. PCC 7120
MSDLVLFWHRRDLRIADNIGLAAARQQSSKVVGVFCLDPNILERDDVAPARVTYMIGSLQELQQRYVQAGSQLLILHGDPVQAIPHLAEALNAKAVFWNWDVEPYSQTRDRAILDILKDKGIQFLTHKWDQILHSPDEIRSGSNTPYTVYTPFWKNWSSKPKAKPVETLQNAEGLTESEQELAQKAGVKTLPTAKDLGFFWDADLIIAPGEAAAQAKLEEFTAKAITEYQEQRNFPAVDGTSQLSAALKFGVIGIRTVWQATLEALENSRSEEASAAIRTWQQELAWREFYQHAMYNFPELADGAYRETFKNFPWETNEEHFQAWREGKTGYPIVDAAMRQMNESGWMHNRCRMIVASFLTKDLLINPQLGEKYFMQKLIDGDLSANNGGWQWSASSGMDPKPLRIFNPASQSQKFDPDAEYIRRWVPELRSMDTEYLVTGKITPLERHAVGYVKPIVDHQKQQQLFKQRYQQQKATSL

SEQ ID NO: 25868 - protein, 214 aa, Euphrasia disjuncta
NINLEELLEAGVHFGHGTRKWNPKMAPYISAKRKGIHITNLTRTARFLSEACDLVFDAASRGKQFLIVGTKNKAADSVVWAAIKARCHCVNKKWLGGMLTNWSTTETRLHKFRDLRMEQKTGRLNRLPKRDAAVVKRQLSHLQTYLGGIKYMTGLPDIVIIVDQHEEYTALRECITLGIPTICLIDTNCDPNLADISIPANDDAISSIRLILNK

SEQ ID NO: 25869 - protein, 290 aa, Oryza sativa
  misc_feature (168)..(168): Xaa can be any naturally occurring amino acid
MSSGGELALRQEYVIGDEIGRGRFGTVRRCYAVATGEAFAVKSTPKAPLREAEAADALDLALAEQEPKVHLVASAPGPGASPHVVALHAAFEDDAAVHLVVDLCAGGDLLSLVSSRGRLPEHEAADLVAQLASALASCHRRGVAHRDVKPDNLLFDGGGVLKLGDFGXSAGWFGDGRPMTGLVGTPYYVAPEVVAGREYGEKVDVWSAGVVLYMMLSGTLPFYGATAAEVFQCVLRGNLRFPPRAFASVSPEAKDLMRRMLCKDVSRRFSADQVLRHPWIVSRGGAAVMG

SEQ ID NO: 25870 - protein, 246 aa, Oryza sativa
MSAAAEGRPPAAAAAGEMVREATAWCALHGLVVGDRADPRSGTVPGVGLVHAPFSLLPTHLPESHWRQACELAPIFNELVDRVSLDGDFLQDSLSKTKQVDDFTSRLLEIHRKMMEINKEENIRLGLHRSDYMLDSETNSLLQIELNTISASFPGLGSLVSELHRTLIDQYGHLFCLDSKRVPGNEASSQFAKALARAWDEFNVDSAVIMMIVQPEERNMYDQYWLAKHLKESHGITTIRENFGQR

SEQ ID NO: 25871 - protein, 216 aa, Triticum aestivum
MGRRPARCYRYCKNKPYPKSRYCRGVPDAKLRIYDLGRKKASVDDFPLCIHLVSNEYEQLSAEALEAGRICANKYMAKTSGKDSFHMRIRVHPYHVTRINKMLSCAGADRLQTGMRGAFGKPNGLVARVNIGQIIFSVRSKDSNKAVVIEALRRCKYKFPGQQKIIISKKWGFTPLDRADYVEARSKGLVKPDGCYVKFVPQKGSLANYFKEAVKA

SEQ ID NO: 25872 - protein, 341 aa, Solanum melongena
MADLLSNYSSKLEAVPPSHCLPLHERPVDPVEIVNTIPVIDLGKAKGDERPAVVQQLMKAFEEYGFFQIINHGVPEKLMEEAMKVYKEFFSLPAEEKERYAKDAANNTATGAAKMYSSSAKHYDSEEHRYWRDVLEHSANLDGKDRETWPDKPSRYREVIGEYSDELRRVSKVILGMVAEGLGLEPGFFDKGLGQRMLVNHYPACPDPSLTLGVGGHCDPNLITIIQQEVYGLQILKDDKWIGVEPKPNAFVVNSGLPITVISNGKLASVAHRVVTNTTHSRTSIGTFICPENIVEPAKALVGPGNPPQFKSFNWGIDFMPHYLSKKSVYHAALEPFKIDA

SEQ ID NO: 25873 - protein, 196 aa, Unknown
  Halobacterium sp. NRC-1
MTDRTAAVTRETAETDVAVTLDLDGDGEHTVDTGIGFFDHMLAAFAKHGLFDVTVRCDGDLDVDDHHTVEDVGIALGAAFSEAVGEKRGIQRFADRRVPLDEAVASVVVDVSGRAVYEFDGGFSQPTVGGLTSRMAAHFWRTFATHAAVTLHCGVDGENAHHEIEALFKGVGRAVDDATRIDQRRAGETPSTKGDL

SEQ ID NO: 25874 - protein, 135 aa, Erwinia chrysanthemi
MSEALKILNNIRTLRAQARECSLETLEEMLEKLEVVVNERREEENQAQAEIEERTRKLQQYREMLIADGIDPNELLQSLGSSKVAGKAKRAARPAKYQYTDENGELKTWTGQGRTPAVIKKAIEEQGKSLDDFLL

SEQ ID NO: 25875 - protein, 307 aa, Bacillus licheniformis
MNVIKDITELIGKTPLLQILDFRIPKGVNIYAKLEMMNPGGSIKDRLGEVLIAEAIGSGKLKPGGTVIEATAGNTGIGLALAARKHGIRPVFCVPEHFSMEKQSIMKALGARIVHTPRSAGMKGAIEKALELEKEIPDSYCVLQFKNPVNPLAYYKTIAPEIWNDLGGRIDVFVAGAGSGGTFAGTAKFLKEKNPSIKTVIVEPEGSILNGGEPHGHKTEGIGMEFIPEYMEESYFDEIYTVLDEDAFRLVKEAAEKEGLLIGSSSGAALFAALKEAEKAKAGTNIVTIFPDSSDRYLSKKIYEGGI

SEQ ID NO: 25876 - protein, 209 aa, Triticum aestivum
  misc_feature (11)..(11): Xaa can be any naturally occurring amino acid
  misc_feature (72)..(72): Xaa can be any naturally occurring amino acid
ARAVANSTEGXLNPVIGSELVQKYVGEGARMVRELFQMARSKKACIIFFDEIEAIGGARFDDGAGGDNEVQXRTMLEIVNQLDGFDARGNIKVLMATNRPDTLDPALLRPGRLDRKVEFGLPDLEGHTQIFKIHTRTMNCERDIRFELMAGICPKATGAEIRSVCTEAGMYAIRARRKTVTEKDFLESVNKVIKGYQKFSATPKYMVYN

SEQ ID NO: 25877 - protein, 515 aa, Corynebacterium efficiens
MSGAAIDPIVPPDPRHRAVGVVIGATEAGMWGAVAHPQNAGELTWPPHFLIWGVGGYAEFVPVPRVRSYTRDSSCERLADLMTDAHHADDVRYQPLSEIDPEVAQAIAGELSRQRDTLEMIASENFVPRSVLQAQGSVLTNKYAEGYPGRRYYGGCEQVDIIEDLARDRAKALFDAEFANVQPHSGAQANAAVLMTLADPGDKIMGLSLAHGGHLTHGMKLNFSGKLYEVAAYGVDPDTMLVDMDQVREQAIKEQPKVIIAGWSAYPRHLDFAAFREIADEVGATLWVDMAHFAGLVAAGLHPSPVPYADVVSSTVHKTLGGPRSGIILAKQDYAKKLNSSVFPGQQGGPLMHAIAAKATALKIAGTDQFAERQARTIEGARILAERLTASDAKAAGIDVLTGGTDVHLVLADLRNSEMDGQQAEDLLHEVGITVNRNAVPFDPRPPMVTSGLRIGTPALATRGFDATAFTEVADIIGTALAQGKSADLESLQARVTKLAEQYPLYEGLEDWTIV

SEQ ID NO: 25878 - protein, 631 aa, Coccidioides immitis
MENTQSGGGTSTGNSSDFVRKLYKMLEDPSYAQVVRWGDDRDSFVVLECEKFTKSILPKHFKHSNFASFVRQLNKYDFHKVRQNNEETGQSPYGPGAWEFKHPEFKADNKDSLDNIRRKAPAPRKPPQSAEDSIPTQQLDLMNQQIVAQQQQFQHLADRFAVDQQLMMQEIRRVQKTVLGHEQVIHYMMTFLHSVDARQRRENRAAAAAFQGQPGGSELSPAQAQAQNDEPASPLQHAMKLLSEMNSDIQFNLSSLESMGEMQNRLPGAVPTPPLDQTQRNGTVRPPTSTGPASAMAFPKLNGDLEQVVYPVGVTNGIDPMYGDHINSIPYTMSSKEADPSDPRRQFVDRKKSTGTSTYADPGWIRSPHILLVEDDQTCRQIGGKFLYSFSCVIDTAFDGLEAVNKIQSGSKYDLILMDIIMPNLDGVSACSVIRRFDATPIIAMTSNIRSSDIELYFQNGMNDVLPKPFTRQSLLNMLEKHLVHLKNIPTAIDATQSAPPTAIPQNSATQSVKEETTPGQSPGTSIGNWQSPAQFPGVSPINVSIPNQFMQQQAGAPATPFTIDQNGGIQYPGNQMGSMNVAAAPRTSHRRQMSDISSGADAHNLAKRQRMFATPANNTVVNPMQTNRMP

SEQ ID NO: 25879 - protein, 208 aa, Oryza sativa
MIKQPSVSLAPNTSCQPQHALARAAAGSARSRRISCLHLAVLHVGRHHARALCSHESAFSGANNNTNHDVKLRPRKFFEMEMSVRDCELDQYGVVNNVVYGSYVERAREELAEFLGVSASTAACTGNAMAVSEQNFKYFTPLKRGDNFVVKVTIQIKGVRIYADQFIETLPDRKATIVCLDGEYRPTRVFPELSSKVLDFFSHREASD

SEQ ID NO: 25880 - protein, 126 aa, Exiguobacterium sibiricum
MLYEDLGQKQAIEQLVARFYERVYADHLLRPLFPSDRRQVEQAQTRFLIQLTGGPKQYESYDERMNLAMIHRLLPITEVHAIRWIELMTMTIEETISDSEAATRLIERLRIGALNVLRICDAHQNR

SEQ ID NO: 25881 - protein, 882 aa, Arabidopsis thaliana
MAAWSPSVGIGSCCLNNGITRTWKFPSARLFTGRKNKIKLGSETLMFTRKRFMGDLVTSALQSYQFSKICASKTSIELREALSSRRAEADDLKKVTSYSFRTKAGALVKVKVEKKREKYSILVYVSSLELSGDDKSRLVMVWGVYRSDSSCFLPLDFENSSQDSQTHTTETTFVKSSLSELMLGLEFDGKESPFYLSFHLKLVSGRDPDGREMLTHRDTDFCIPVGFTAGHPLPLGLSSGPDDDSWNFSFFSRSSTNVVLCLYDDSTTDKPALELDLDPYVNRTGDVWHASVDNTWDFVRYGYRCKETAHSKEDVDVEGEPIVLDPYATVVGKSVSQKYLGSLSKSPSFDWGEDVSPNIPLEKLLVYRLNVKGFTQHRSSKLPSNVAGTFSGVAEKVSHLKTLGTNAVLLEPIFSFSEQKGPYFPFHFFSPMDIYGPSNSLESAVNSMKVMVKKLHSEGIEVLLEVVFTHTADSGALRGIDDSSYYYKGRANDLDSKSYLNCNYPVVQQLVLESLRYWVTEFHVDGFCFINASSLLRGVHGEQLSRPPLVEAIAFDPLLAETKLIADCWDPLEMMPKEVRFPHWKRWAELNTRYCRNVRNFLRGRGVLSDLATRICGSGDVFTDGRGPAFSFNYISRNSGLSLVDIVSFSGPELASELSWNCGEEGATNKSAVLQRRLKQIRNFLFIQYISLGVPVLNMGDECGISTRGSPLLESRKPFDWNLLASAFGTQITQFISFMTSVRARRSDVFQRRDFLKPENIVWYANDQTTPKWEDPASKFLALEIKSESEEEETASLAEPNEPKSNDLFIGFNASDHPESVVLPSLPDGSKWRRLVDTALPFPGFFSVEGETVVAEEPLQQLVVYEMKPYSCTLFETINTTA

SEQ ID NO: 25882 - protein, 443 aa, Clostridium acetobutylicum
MEILKHVMDDVIKRNPNEPEFHQAVKEVLLSLEIVAEKHPEWVKDKIFDKIVEPERQIIFRVPWVDDNGEEHINRGFRIQFNSAIGPYKGGLRFHPSVNLGIVKFLGFEQIFKNSLTGLPIGGGKGGSDFNPKSKSNSEIKRFCQSFMLELNKYIGANTDVPAGDIGVGSREIGYLYGMFKKIRNESTGVLTGKGLTLGGSLVRTEATGYGLCYFMNEALKAKGKSFDGATVIISGSGNVAIYANQKATQLGAKVVAMSDSNGYIYDANGINLNTIRKIKEVERKRIHEYTKYHPNASYTEGCDGIWKLKCDIALPCATQNEIDENSAKTLIANGCYAVGEGANMPSTIEAVDLFIKNKVIFGPAKAANAGGVATSALEMSQNSMRYSWTFEEVDTKLQNIMKNIYIKCSNAANEYGFEDNLVAGANIAGFTKVAEAMYSLGF

SEQ ID NO: 25883 - protein, 435 aa, Pseudoalteromonas tunicata
MPSYANRYISNLTRETYALILAGGRGSRLHELTDWRAKPAVYFGGKFRIIDFPLSNCINSGIRRVGIATQYKSHSLIRHVNRAWGHFKKELGESVEILPASQRYGDEWYCGTADAVFQNMDIIRHELPKYVMILSGDHVYRMDYGALLAKHVETGADMTVCCIEVPCEEAAGTFGVMTVDNDKRVMRFDEKPADPSEIPGKAGQCLASMGNYVFNTEFLFEQLKKDSERAGSGRDFGHDIIPAIIEEHNVFAFPFSDPSHDSQPYWRDVGTLDSFWEANMELVTPEPQLDLYDARWPIWTYQEQLPPAKFIFDDDDRRGMAVDSTVSGGCIISGSTVRKSLLFSKVHIHSYCLIEEAVLLPGVVIGRHCKIRRAIIDRSCEVPENTVIGFDREQDQANGFRVSNKGIVLVTRDMLIAYVAKQAKREQALEESEVV

SEQ ID NO: 25884 - protein, 492 aa, Saccharomyces cerevisiae
MSKAVGDLGLVGLAVMGQNLILNAADHGFTVVAYNRTQSKVDRFLANEAKGKSIIGATSIEDLVAKLKKPRKIMLLIKAGAPVDTLIKELVPHLDKGDIIIDGGNSHFPDTNRRYEELTKQGILFVGSGVSGGEDGARFGPSLMPGGSAEAWPHIKNIFQSIAAKSNGEPCCEWVGPAGSGHYVKMVHNGIEYGDMQLICEAYDIMKRIGRFTDKEISEVFDKWNTGVLDSFLIEITRDILKFDDVDGKPLVEKIMDTAGQKGTGKWTAINALDLGMPVTLIGEAVFARCLSAIKDERKRASKLLAGPTVPKDAIHDREQFVYDLEQALYASKIISYAQGFMLIREAARSYGWKLNNPAIALMWRGGCIIRSVFLAEITKAYRDDPDLENLLFNEFFASAVTKAQSGWRRTIALAATYGIPTPAFSTALAFYDGYRSERLPANLLQAQRDYFGAHTFRILPECASAHLPVDKDIHINWTGHGGNISSSTYQA

SEQ ID NO: 25885 - protein, 534 aa, Haloarcula marismortui
MARLESAEMLDAPQQEAIPTLADDEAGTVVWHREHLRIRDQGAVARAAASEYVLPLFVFDPAFYGADGLACDSRIRFLHDCLADLSDQYHTATGCGLTYAHGDPVDVLGRFREAGWDIVTMAAPTGRYGRERDRRVREQCDVTFVDGDGLVRDRAATRDGWQDDVSAWFAADQHDWDPSTVTSRSFDSGIDISTIEDHYDIAPSKSDVPRGGTGPARERLSAFAERIDDYPGNISAPVDARDGTSGLSPYLAFGCLSVRQVIQYIDEHAPDGRGKEMFVSRLFWNKHYEQKLEDWPGWLETAVNPVLEGFNAEQYDPDLVAAWKHGQTGFPMVDASMRCLRQTGWLNFRMRSMSASVYYHLLQQPWRIGADWFYHHLIDASAAINYTQWQSQCGLVGKPALRLYNPRKQVRDQDPDGEFIRQWVPELESLPDEYLDRPEQTPVHVQASCGVDIGDDYPHPVVDYDAARQAFHRRYEAVRPDAADALHDPTIARRVSFSGGREAAARIAAEHGTDASNGTENSRTQASLDSFGDE

SEQ ID NO: 25886 - protein, 146 aa, Unknown
  Mesorhizobium sp. BNC1
MRYLHTMVRVRDIGESLDFYCNKLGMKEVRRIENEAGRFTLIFLAAPEDVEAAERHKAPLVELTYNWDPEDYQGGRNFGHLAYEVDDIYAFCQHLMDAGITINRPPRDGNMAFIRSPDGISIEILQKGEAKPKAEPWASMPNTGAW

SEQ ID NO: 25887 - protein, 385 aa, Glycine max
MDEDEQLERFDSEFASTSSISSTLSTDDFRNLTSSGDISSISSGSGEIPPVAVLAPPFLYREGSNDVETAPAPREKCVGRSNKGVSWGHTSVIGRRKEMEDAIAVIPGFMSRTCDRVGGCTAPGSRSSGEIAPLHFFGVYDGHGGSQVAKFCAKRMHDVIAEEWDREMGGAAEWQRRWEAVFANSFERTDNEILSDAVAPEMVGSTASVVVLSGCQIITSNCGDSRVVLCRRTQTIPLTVDQKPDRQDELLRIEGGGGKVINWNGARVFGVLAMSRAIGDRYLRPWIIPVPEITFTARTDEDECLVLASDGLWDVMTNEEVGEVARRILRRRRRSLSMEETSPAQVVAESLTEIAYGRNSKDNISIIVVDLKSKRKRQQRPPLIS

SEQ ID NO: 25888 - protein, 296 aa, Rickettsia prowazekii
MSKISPINIKELLDAGVHFGHKTSRWNPKMASYIYGERDDVHIIDLRQSAALMSVALNAIYETVKKDGKILFVSTKIQASDIIAEYAEKCGQYYVNNRWLGGMLTNWKTIACSIEKLEKLEKTLESEEARICYTKKEILDMSRKKDKLLLSLAGIRNLNSKPDLLVVIDTNKEHIAINEAVKLNIPVVAVVDTNSNPDNVDYPIPGNDDSIRSIRLYCSLFADAALQGLEESMKVSGVDIGTMQDHTDKALTSSKTVSKLKQSKKLSKTQNIDEETNTEFDQALGGACENNNSDNT

SEQ ID NO: 25889 - protein, 467 aa, Pseudomonas fluorescens
MTTTTERKGIHLTRSLKSRHIFMLSLGGVIGTGLFMGSGVTINQGGPWGAILSYLGAGFLMYLVMVCLGELSVQMPVSGSFQAHATKYIGPATGFMIGWVYWMSWATTVGLEFTAAGMLMQRWFPGVPIWYWSALFVALLFGINALATRAFGEAEYWFAGVKVLAILSFIVVGALVIFGVIDLPSGAPAPMFDNLKGDSLFPNGLPAVFAVMMTVVYAFQGCEIMGVAAGETDQPEKSIPRAVRNVVFRVLIFYVLAVMVLAAIIPWQQAGLVESPFVQVFDMVGIPYAADLMNFVILTAILSVGNSGLYASTRILWAMSKSGMAPKALSPLSKQGVPLRALFITLCFALISLMTSFIAADTLFMVLMAVSGMAGTVTWIVIALAQYRFRRQFLREGGQLEQLKYRAPWFPLVPLLCIVLCSSLFVFLALDETQRPSLYWGSGFIALCYGAYYLMQRKRQLQPAAAV

SEQ ID NO: 25890 - protein, 472 aa, Unknown
  Candidatus Kuenenia stuttgartiensis
MQKNSFGLIGLAVMGQNLVLNVADHGFSVSVYNRTAERTHEFMSGEAKNKKITATYSPKEFVASLERPRIIQIMVKAGGAVDAVIAELKPWLDEGDIIIDGGNSYFSDTERRTKELESNKLRYIGMGVSGGEEGARFGPSLMPGGTKEAYALIEPLMSAIAAKAPEDGLPCVAYIGHGGAGHYVKMVHNGIEYADMQLIAESYALLKSTINPAPEEFHEIFTEWNNGELSSFLIEITAFIFTKSDDKTGRPLLEMILDKAGQKGTGKWTSQNAIDIGAPVPTITAAVDARILSSMKKERQEASKILSGPKNNYADERGKIIAAVRDALYASKICSYAQGMNLLKRASEEYGYNMDLGEIASIWRAGCIIRAKLLDDITRAYRSRSDLPNLLLDAGFKHAVQSRQASWRFAVKTAFELGIPAAALSASLAYFDAYRSGFLPANLIQAQRDYFGAHTFERIDTSGVFHANWKEK

SEQ ID NO: 25891 - protein, 121 aa, Triticum aestivum
  misc_feature (111)..(111): Xaa can be any naturally occurring amino acid
  misc_feature (118)..(118): Xaa can be any naturally occurring amino acid
MRRRPARCYRQIKNKPYPKSRFCRGVPDPKIRIYDVGMKKKGVDEFPFCVHLVSWEKENVSSEALEAARIACNKYMAKFAGKDAFHLRVRVHPFHVLRINKMLSCAGADRXQTGMRGXFGK

SEQ ID NO: 25892 - protein, 765 aa, Anabaena variabilis
MLFKVNGRIYEEESGVGIANLVVEAFDKDILKNDKLGQTKTDQDGKFAINYSEANFKSALEKFEGNPDLYIVVKTPDLANILYSSEKNIRPDASTNEHFDVPIPKTTLIAYQERSTQENKQLLKILLGMAWLDGELEPGEKEYLSKVAAQKRLTEDAEIKSLLSDSKPIQPQQCFDWLQAYLGKNPSPYKFEALDEVLESLFTSGAEIDEREKEMLAAFADKNTRQTVLQERLGSIFLDPDFLAKVTPDTPDSPQTARKNLKKGFAYARVPQAVLSKLTSAQSDPQVKEELAHRFLTLNYAPVRKEITADNLEVIGKLPQELSGTFLRIGPNPRFAPLGLYHWFDGDGMIHGVQIKNGKASYRNRYVRTEGWKIEEKEGQAIWPGLLNLPRFDEPHGIMMKNVANTALVWHHGRLLALWEGGEPYEISLPNLDTVGSYTFNEQLTFPFCAHPKVDARTGEMMFFGYQPLTKPYVQYGIVSPEGKIVKTIPIDIPSPISMHDFAITEKYTIFLDMPLALKPMRVMQGKVPLVFERNKPSRFGIIPRHGGEIRWFTVPSCMVYHVVNAYEEGNEVILVAYRMDWTQLFIPDRENALDFVNTDTSSEKLAPEMTKLYRWRFNLSTGQVKEEILDKDEICEFPRINDRLIGCKMRYVYSGIGAMYMERPLFDGVKKYDLESGTAQSVYFGRGRFGGECVFAPRPGGKTEDDGWVLTYIYDAVNKRSEFIVLDAQNITAEPVARVILPQRVPFGFHCEWVSSEKMATANR

SEQ ID NO: 25893 - protein, 346 aa, Prosthecochloris aestuarii
MRWRFHAEKKCVMKGFKTVLVMVMCSMFSFIIISCATAGDDNDSSMKQANNGLKESEMGYRVLTSEEERVIVGKGTEMPFSGKYVDFHEEGTYVCRRCDAPLFRSSDKFESGTGWPSFDDEIPGAVTRKTDADGRRTEILCANCGAHLGHVFLNEGLTGKNVRHCVNSISLDFKGADDRAIKPAQVSEKAIFAGGCFWGMEYHFGKVNGVLGTTVGYTGGSKEDPTYREVCSGKTGHAEAMEVEFDPAVVTYEELARLFFEIHDPTQVNRQGPDIGTQYRSAVYYVDDTQKAIAEKLIGQLKENGYAVVTELEKANAFYPAEEYHQDYYEKTGHQPYCHIYQKRFK

SEQ ID NO: 25894 - protein, 467 aa, Unknown
  Frankia sp. EAN1pec
MAPRGGGQPLVQELSGQVEAGDPARPARAALMRPGARDAGWSLADVPDQRGRTAVVTGANSGIGFEAAKALAERGATVVLACREPARAEQAAARIRAAAPRADVHVEPLDLISMTSVRAAAERIRAAHPRLDLLVNNAGVMLPSPGPGGAALGAGFGDDGLGDHGIEPTFGVNHLGHFALTGLLLDRLLATPHSRIVTVSSLAHLVGRLDLEQLRRLPPHADRPGGSPPVVVPDQRAGSPSEPPLASPARQRSQRRSETQRRSETQRRSETQRGSGTPRAQGMQRLQSLQGTRGPQSRRLPRQRLPYPTSKLANLMFTFELQRRLAATGASTIAVAAHPGIARTGLTRNLMPPARVFMGQRLAPLMSWLVQEPEIGALATVRAALDPAVHAGEYYGPSGLFRSTGPPAVGRSSARSRDARQQQRLWAESERLTGVTYDFDPSSGTGPGGVGSWRNNGRSASRSAELT

SEQ ID NO: 25895 - protein, 590 aa, Arabidopsis thaliana
MASNPHRSGAGGSLYGGAAPYRSREGLSTRNAAGSEEIQLRIDPMHSDLDDEITGLHGQVRQLKNPFGFESGSVYVFLFQSTMIVYLYAGTGLNSGGYWQMTLIRAQAGVKNNIRKLNMSIIRSGNNHIMHVGPMALLSTKSLQPIGSPSAKALPGFELISQSSIEIFSGKRASSSPSTTRNQKMQSLSQLGPSEIFLVARREKPSTRVEFSPRPVPPNLIAAEKEEAKAVLTLFFKKQGLSNSLSSRLHSVHKARYLVGRELTTLEIRDSLIPYLEQLHEEHGDLLAELVVSFPDPPAEPRLVASSPVSVLPPRGDTDSAADTRKLRAVSRVSELDTEGALRPQTLYLLDLGLNLEQIKTITRKFAAFPYYSLDGKIKPVVEFLLDLGIPKSDIPTILCKRPQICGISLTDNLKPTMAFLETLGIDKNQWAKIISRFPAILTYSRQKLTSTVEFLSQTGLTEEQIGRILTRCPNIMSYSVEDKLRPTMEYFRSLNVDVAVLLHRCPQTFGLSIESNLKPVTEFFLEKGFGLDEIGIMISRYGALYTFSLKENVMPKWDYFQTMDYPKSELCEVPSVFWVQFTREDQAEI

SEQ ID NO: 25896 - protein, 530 aa, Arabidopsis thaliana
MEASISFLGSTKPNISLFNPSSNVLPRRDFPLPALKLKKVSVLPRILHQKRLIRAQCSDGFKPEEDDGFVLEDVPHLTKFLPDLPSYPNPLKESQAYAIVKRTFVSSEDVVAQNIVVQKGSKRGVHFRRAGPRERVYFRSDEVKACIVTCGGLCPGINTVIREIVCGLNNMYGVNNILGIQGGYRGFYSKNTMNLTPKVVNDIHKRGGTFLQTSRGGHDTAKIVDNIQDRGINQVYIIGGGGTQKGAEKIYEEVERRGLQVAVSGIPKTIDNDIAVIDKSFGFDTAVEEAQRAINAAHVEVESVENGVGIVKLMGRYSGFIAMIATLANRDVDCCLIPESPFFLEGKGGLFEFIEERLKENRHMVIVIAEGAGQDYVAQSMRASETKDASGNRLLLDVGLWLTQQIKDHFTNVRKMMINMKYIDPTYMIRAIPSNASDNVYCTLLAQSAVHGAMAGYSGFTVGPVNSRHAYIPISQVTEVTNTVKLTDRMWARLLASTNQPSFLTGEGALQNVIDMETQEKIDNMKISSI

SEQ ID NO: 25897 - protein, 115 aa, Glycine max
  misc_feature (88)..(88): Xaa can be any naturally occurring amino acid
MGRRPARWYRQIKNKPYPRARSCRGVPESTIRIYDVGMKKKGVDELPLCVHLVRCEKENDIREALEADHIACNKYMAKLAGKDAFHLXVWERSFHVLRNNKMLPRAGADRLQTGM

SEQ ID NO: 25898 - protein, 160 aa, Zea mays
MAGMGDMPMRPARPGPPMQHRGPPPMARLRPEPIDREKTCPLLLRVFTRVAGHHQNEEFAVRGKEPKDEVQIYTWKDATLRELTDLVKEVALPARKRNARLSFAFVYPDKNGRFVVRQHVLVGRQKVGSTFAYGHGRGDDAKTLAELGFQIGDYLSVAIM

SEQ ID NO: 25899 - protein, 544 aa, Coccidioides immitis
MPKATDRLDVRETEANGHDPEEARSLLSHSVDDDDLVDHPEPSQSTRPPAPKRQSSLALPTLNNGQPRAPRTPNRVRFDLGDGTEEEPGRDSTSAAPDRSWLNEADYLDSEAHRSRSSTGQVAPLLTDIEAPIVTLATSNSDFFPEEYLESARPKSGLRNAFMNMANSIIGAGIIGQPYAFRQAGMVMGVILLVGLTCAVDWTIRLIVVNSKLSGADSFQATVEFCFGRTGLIAISIAQWAFAFGGMIAFCIIVGDTIPHVLAALFPSLKDLPFLWLLTDRRAVIVLFVLGISYPLSLYRDIAKLAKASTFALGVGVQSDLRGDIKGSIFVNSGFFQAVGVISFAFVCHHNSLLIYGSLKKPTLDRFALVTHYSTGISMVMCLIMAFAGYLTFGSKTKGNVLNNFPADNVLVNIARLCFGLNMLATLPLEAFVCRSVMTTFYFPDEPYNAGRHLIFTTSLVVTSVVMALMTCDLGSVLELIGATSACVLAYILPPLCYIKLSSQGWKSKIPAVLCIIFGVCVLCMSVLQALVKIIRHEGGPMTC

SEQ ID NO: 25900 - protein, 770 aa, Kluyveromyces lactis
MSEQKSEISAVKNQEHPDTEPKQEQEGESPNKRIHLDTRDGKEQPEKSGQEKKDDKSNGSNATEGTSNVKSEVQPTVQNSSTPQNPHFIHKLYSMLEDDDLKNLIWWSPSCDSFLIRPTERFSKALSAFFKHTNVASFVRQLNMYGFQKVSDHKSTWAANTDDSDEPSINLWEFKHSSGYFRKGDTESLKSIKRGSSKYHMSNNRKNSAPTASTFSGSGSQDSASWNEFPPPNRSHSYTSHDAAHIMPNPLYNTQDGLALYPTGANYPVNLVPSVDYYNSPQHHIKNKQQQQQQHQHQQQQQQQQSIDTNVHELHQSISGLRNEHSDLQHSYEMAVEELRATNIDMIKMLDIVQKTMVERIGSPLNEDGSVPRPRTPLSNATRKGSMLSPGSKPPAHTLKTNKEFNSDEQRASTMNELAKIRESIFARFQKFHETMQHSISVMDLKPQSFSSLQPNMNSSTLPSSVNLLQHQYNAFNGNAGPSPQSYHMNPRGSQSDQHVNLMMNPFERRISSTGSSKKRHMSVLMDPLAPAPPQQPLQAQIQLQPQQQPQQQSQQQSQQQQQQQQQQQPHQQQHQQQHQQLQANQNPQQAFTIAQGSSQPNVISYKPYYPYGTVPVSNFSGSQLYSNTPINSTPGHSSVPSEYGLAIEAQGNFVINGPQTPVNIIKPIPAKVPYTVLSDHTTPTGLGPLHGSATQLPQVLSQHQHQHPAFQPAHTLVQPQPISQPQSLSQPPQAPPSMNTSQFSVSKQPQHQSGSNSGLHSLLTHDSRN

SEQ ID NO: 25901 - protein, 144 aa, Exiguobacterium sibiricum
MNIALIAHDEKKDEMMMFTRAYEAYFAKNTLYATGTTGQRIMEATALTVHRCKSGPLGGDQEIGAMVARGEIDIVIFLRDPLTAQPHEPDVSALIRLCDVYDLPLATNVGTAEILINGLEQGEFQWREIIRKRHEEEQRKFLTD

SEQ ID NO: 25902 - protein, 290 aa, Exiguobacterium sibiricum
MNICVVTGANSGMGMVTIQELLERGDRVIATVRSQKKATLLIQLLREHAVSDANLEVEIVQLDQLDSVRRFADVLFDRIGRIDRLILNAGIMVPPYHVTKDGFESQFQVNYLSHFYLIERLLPLIEQGHDPRVISISSLAGEGGMIRTDIELEAIAHVRKEQYNPMKSYRESKLLQMVHMRELAEQYGTLATFVSVHPGIVNTDLFYRGKYGKVLKTVLKPVAQVGYWTGKLYTPEYGAKTALYLATTDDVIDNGGYYADSAPRLSNPVVEDEAYRQQARALSKRWVGLD

SEQ ID NO: 25903 - protein, 379 aa, Ralstonia solanacearum
MVPPDPPRRATRRGILKALGTLGAGATLGHPALTALAATASRITLPFDNGERELVVFPQKRALILQTSRPPQLETPFAVFNEGLITPNDAFFVRYHWSGIPTSIDSATYRLQVGGNVDTPLDLSLSELRALGETREIVAVNQCSGNGRGYFQPRVGGGQLSNGAMGNARWTGVPLRQVLDRAGVRAGSVQVVFDGLDHPPLADANSPDFIKALDIDHARDGEVMIAWAMNGTDLPMLNGYPIRLVMPGYYGTYWVKHLSAIRVVDKPFDGFWMRTAYRIPDDPCACVAPGTAPARTVPIGRLNVRAFITSLTDGATVAAGREHIVRGIAFDGGYGIAEVAFSADGGRTWSEAQLGETWAGMRSANGVRRSGPRGAAPMR

SEQ ID NO: 25904 - protein, 52 aa, Thermoanaerobacter tengcongensis
MEKWQCTVCGYIYDPEKGDPSQGIPPGTPFEELPDDWVCPDCGAGKDLFEKM

SEQ ID NO: 25905 - protein, 280 aa, Chlamydomonas reinhardtii
MVFKFPTPPGTQKKAGTTATKPAPKATTKKVATSTGTRSGGVGYRKYQGDALWLPNTTRPEWLDGSLPGDRGFDPLGLSKPSEFVVIGVDENDQNAAKNNKGSVEAIVQATPDEVSSENRLAPYSEVFGLARFRECELIHGRWAMLACLGALVAEATTGVSWVEAGKVELDGASYAGLSLPFSITQLIWIEVILVGGAEFYRNSETNPEKRCYPGGVFDPLKLASEDEERAFRLKTAEIKHARLAMVSFFGYGVQALSTGEGALGSLAKFADGLNNGKGL

SEQ ID NO: 25906 - protein, 595 aa, Unknown
  uncultured sulfate-reducing bacterium
MYPVMLDLKDRRVLVVGGGGVALRKVQGLIEDEALVTVVAVAAVDNLSDLAGQGRITLECRSYRDGEAASFVLVFAATDDRSVNRRIFEDARAAGIWANVADDPELCSFHLPARVRRGPLQLAIASEGQAPFVVRRLRQLFDRRLGSEWAEWVPAAVRFRRSVRRADLSRPEQESRYDRFFEGTVDAQNLTARVPSAEEEATWLEAAAEDHCQPLRTVSTGSAKDDSGQGHVSLVGAGPGCSGLLTVLGRKRLSEADAVVYDRLAAAALPCELDAKVELHPVGKIAGNHPIPQDEINALLVRLAREGRRVVRLKGGDPFVFGRGSEEAEVLETEGIPFDVVPGVTSGVAAAAWMGVPVTHRREAVRLTLLTAHEAVKSDGPQVRWDLLAMDPHATLVGYMGVKAMPVVSEKLIAAGMDPQTPAAMVEQGTTSAQRHVVSTLEDLPQAVADSAIKPPALFIIGPTVGHQRRLDWYGRLPLAGQRLVVVATLRDLVCALERGGADVVAVPIPLTPAARVVLSALPLTGCVVLSGAEVDALHEELDGPGWSSDARRWCIGEEAGRRAGERGWRMVHVLEGSTDGAAVAEWVAGQLGKG

SEQ ID NO: 25907 - protein, 372 aa, Arabidopsis thaliana
MGKREKKPNRRRHKGEYSNDAEDFYDQHPPAVASVDEEDEENSDEEEEENDGNESSDLPSKFLLYQQSVQSPKGDISYLQKFFLMYVGGRQPFHFQEDFCGTALLSAEWLKTDTRRTAIGLDFDLDALEWCMDNNISKLGSDVYSRMSLFHGNVLTPLEAKQVKSKSHELIQNISLDDGDDNEDLADPSVVESLEKDGPDSLPKRDIVCAFNFSCCCLHKRSELVSYFKNARDALSKKGGIFVMDLYGGASAEGQLKLQRKFPNFTYTWEQAEFDILSRKTRISLHYHLQKQNRKIRHAFSYSWRLWSLPEIKDCMEEAGFSSVHFWLREMPDASEMRRTDGFGAGRDIKYEQVKSFQQCDSWNAYIVAVSL

SEQ ID NO: 25908 - protein, 328 aa, Unknown
  Nostoc sp. PCC 7120
MVEDLVIIGSGPAGYTAAIYAGRAQLKPVVFEGFSAGGIPGGQLMTTTEVENYPGFAEGVQGPKLMQQMRQQALRWGARLITDDVIAVDFTQYPFLIASADLLEVKARAVIICTGATAKRLHLPGEEKFWNNGISACAICDGANPLFANADIAVVGGGDSAVEEALYLTKYASKVHLLVRSDRLRASKTMQERIFNHSQFHIHWHSLPISVDGDEVLRSVQIRDTQTGGVADLTVSGLFYAIGHTPNTQLFQDQLELDEAGYIKTQGKSTATNIPGIWAAGDVQDHVYRQAITAAGTGCMAALEAERWLSERQLSPADGTPTLVSFAA

SEQ ID NO: 25909 - protein, 833 aa, Sphingomonas elodea
MEFLEATAILADASSAEAVRSAETRQHLVVIGNGMAGCRAVEELLARDGTGFRVTIFGAEPHVNYNRIMLSPVLAGEKTFQEIVINDSDWYAQHGIELVAGDPVVAIDRAACTVTAKSGRITGYDKLLIATGSDPFIIPVPGHDLPGVISFRDMADVNVMLAAASEGGDAVVIGGGLLGLEAAHGLTLRGMKVTVLHLMPTLMERQLDEAAGWLLKSALEARGQTILTGADTAAILGDGKVEGVQLKDGRILPAKLVVMAVGIRPSVKLAREAGLAVGRGIQVDDHMVTSDAKVLAVGECVEHDGQCYGLVAPLWDMCRSLADGLVARTNPYRGSVTSTKLKVAGLDVFSAGDFSGGEGCEDIVLRDAARGIYKRVVLKDDRVIGAVLFGDTSDGSWYFDLLKKGEDVAPIRDMLIYGQAFASGGGQPDPKAAVAALSDDAEICGCNGVSKGQVVATINGGACSLDAVRAGCKASASCGSCTGIVETLLALTLGEDGVQSGPKTMCKCTTYSHDEVRRAIVEGAMKSIPEVMQRLHWSTPDGCSSCRPALNYYLLCAWPGEYVDDQQSRFVNERLHANIQKDGTYSVVPRMWGGVTTPAELRAIADVVEKFNAPMVKVTGGQRLDIFGIRKEDLPAVWADLNAAGMVSGHAYAKALRTVKTCVGSEWCRFGTQDSTGLGIKLERGFWGSWMPHKFKMAVSGCPRNCAEATIKDFGVVCVDSGYELHVGGNGGIHVRATDLLVKVATEEEAMHYAAAFVQLYREEARYLERTAPWIERVGLASVKARVVEDEPGRDALAARFWHSQSFSQDDPWAERVAGADAGLHQPLLAAAE

SEQ ID NO: 25910 - protein, 496 aa, Unknown
  Candidatus Kuenenia stuttgartiensis
MNILLIDPPFYRFFQYYNRYFPLGLSYLASILKKAGHNVTIYDADCNKDSKGMDYTRLPEMYAAYLKELRNPENHIIKELSETLKTCRPDIVGITVMTPKAASAFTVASLVKKYDKKCHVVFGGPHATLKPEEVLTISGDVDFVISGEGEGAFPELVHLLEKKEGGFEKIAGLSYYRDGRKASSGSGKFIDNLDTLPFPDRESLLGADTYTSEDMGLIMGSRGCPFNCSYCATQIWTRKVRYRSIPNIIEEIKYVNERYGTHQFTFKDDSFTVSKKRVAEFCDALLKVGLKVKWDCNTRADLVDLPLLKTMKKAGCNSIKVGVESGSERILKIMDKGVSLEQVKESAKLFRKAGIHWTAYFMMGVPTETKEDVKETVKLLYEIKPSFASVGVYEPFPGTKLFDIGVERGLVKRDMAYEEYFLRIPSDYYLKDVKKRSDTMDEEEFTALEREVKETFHDYNKNITRIYERAKARSSVYVRNPKIFLSDIEKFLGWMR

SEQ ID NO: 25911 - protein, 338 aa, Enterobacter cloacae
MNLNRFERYPLTFGPSPITPLKRLSQHLGGKVELYAKREDCNSGLAFGGNKTRKLEYLIPEAIEQGCDTLVSIGGIQSNQTRQVAAVAAHLGMKCVLVQENWVNYSDAVYDRVGNIEMSRIMGADVRLDAAGFDIGIRPSWEKAMSDVVEQGGKPFPIPAGCSEHPYGGLGFVGFAKKLRQQEKELGFKFNYIVVCSVTGSTQAGMVVGFAADGRSKNVIGVDASAKPEQTKAQILRIARHTAELVELGREITEEDVVLDTRFAYPEYGLPNEGTLEAIRLCGSLEGVLTDPVYEGKSMHGMIEMVRRGEFPEGSKVLYAHLGGAPALNAYSFLFRDG

SEQ ID NO: 25912 - protein, 861 aa, Sphingomonas elodea
MSDAVRTTCAYCGVGCGIRATVTGERAVRIEGDPDHPANHGRLCSKGTHLGETIGLEGRLLHPMIGDRRASWDKALDLVARRFREAIAEHGPDSVAFYVSGQLLTEDYYVANKLMKGFIGSANIDTNSRLCMSSAVAGHMRAFGEDVVSGSYADLDAADLIVLVGSNTAWCHPVVYQRIMAARAERGTKLVVIDPRRTETAEEADLHLAVRPGSDVALFNGLLAHCRAEGLADAANLDVPAGFWEALGEGHDLWSTAQTCDLVPADLQRFYQLFAAHPRTVTLFSQGINQSIRGTDQVNAILNLHLATGRIGTPGAAPFSITGQPNAMGGREVGGLASTLAAHRGFGAQDIADVGRFWAAERMATRPGLKAVDLFRAVGEGRIKALWIMATNPAVSMPDAGRVREALAACPFVVVSDVIAQTDTSVHAHVRLPAAAWGEKDGTVTNSERTISRQRAFLPLPGEAKPDWWIVSQVARRMGFRTAFPFDRPAEVWREHARLTAYRNGGARMLDLQAKAAIGNQAYDEMAPFSWHPQPFADGRYPTPSGRARLVPVAQRPLDAPLRDWPMTLNTGRYRDQWHTMTRTGLSPRLARHREEPLVEIHPDDAAALALADGALARVATPQGNSLFRVAHHAGQRRGELFTPIHWTDRQSRGGRTGLLARDLADPHSGQPGFKLSPARITPVAVDWRGFLIVRGEGAAPDCLWATRVTVPGGVLYELAGTGDAAPLDRALPAGERIEAIDPARGTRRVAVLRDGRLAAVLFVTRAGALPSRDWLIGQLDQPQGPQVLAGRAPGRAADRGPVVCACFDVGLHTITAAIRDQRLLDVAAIGTALGAGSNCGSCRPALARILTDMPKDAAHG

SEQ ID NO: 25913 - protein, 698 aa, Unknown
  Oceanobacter sp. RED65
MLNLTPVTKTFQFGNQEVTLETQRIARQASGAVLVTMGEIQVLATVVGKKETKPGQDFFPLTVNYQEKYYAAGKIPGGFIKRENRPSEKETLTSRLIDRPIRPLFPEGYMNEVQVVLTVVSADKENDPDIAAMIGASAALAISGIPFDGPIGAARVGYDAENGYVLNPTYAQLETSLLDMVVAGTEDAVLMVESEAKELSEDQMLGGVLFAHQEFQVAVNAVKEFAAAVGTERWDWQAPEIDTELYGKMKEVAFADLTAAYQIKDKLARQDAVDAANTKLKEALLVDTEEESNAEELSKLFKKLQKEVVRERILSNEPRIDGRDNKTVRDLNIQTDVLKGTHGSALFTRGETQSIGTVTLGSTRDAQVVEFLHEVQKDNFLFHYNFPPYSVGECGRMGAPGRREVGHGRLARRGVQAMMPSLEDFPYTVRVVSEITESNGSSSMASVCSASLALMDAGVPIKAPVAGIAMGLVKEGERFSVLTDILGDEDHLGDMDFKVAGSEAGITALQMDIKIQGITEQIMEIALEQALDARMTILKQMNEVIAEPRSEMPSNAPTYLTVKIPADKIAEAIGKGGATIRGITEETGADVDISEEGVISIFALTKDAAEKAKGMFEAVTAEAEVGTIYEGKVNKIVDFGAFVNILPGKDGLVHISQISDERVENVADYIQEGAVIKVKVLDVDNKGRIKLTMKGIEA

SEQ ID NO: 25914 - protein, 257 aa, Sphingomonas elodea
MVEDFSAGSVWLVGAGPGDPELLTRKAERLLRAASVVFYDALVGQGVLDMIPADVRLVPVGKRAGRHSKEQGSINDLLVAAALAGERVVRLKGGDPSIFGRSMEELTALAGAGIAVRICPGITAASAAAASAGVSLSLRGLARRVQFATAHRRGDAPLDLDWAALADPGCTTVFYMGRSAADEISRNLLAAGLSGATPVLVASDISLGTERLLRTRLDLLPLAARAITEDQPTLILVGDAVAGGADRPAAVRESVLP

SEQ ID NO: 25915 - protein, 571 aa, Aspergillus oryzae
MTTIYIDEDVGRDDSTATGTESAPYKTLVHAFLQHAPSEGFQYLTRKSQTEPADKDVDKLEWKPATKSAMKKATNLYEQRKKKAAKEQELAIREKQEAEKRRLVLEEAKKIIIKEDTSLPKPVRIRLDVTDPAVVKLGSPESEGPGTRVRVLGRVHRLRSQKDVVFITLTDGYGYLQCILTGDMVKAYDIMTLTLGTSMSIHGEMRAVPPKQHAPNNRELHADFFTIIGRAAGDKEAITTRVAPDSDPQTLYDNRHLVLRGETASAVMKVRAATLRAFRKVFEENRMLEVTPPAMVQTQVEGGSTLFKFDYYGENAYLTQSSQLYLETCLPSLGDVFCVCPSFRAEKSLTRRHLSEYTHIEAELDFITFTDLLDHLEAVICRVIELILAEPETAAFINQLNPDFKPPSRPFRRMKYSDAIQWLIEHEIPNEEGKPHQFGDDIAEAAERKMTDIINQPIFLTHFPAEIKAFYMKKDPEDRRVTESVDVLMPGVGEIVGGSMRMDDWDELMGAYKHEGMDPSPYYWYTDQRKYGTSPHGGYGLGLERFLAWLCARYTVRECSLYPRFTGRCTP

SEQ ID NO: 25916 - protein, 554 aa, Pseudomonas syringae
MAYYRNPSDVTALPAWQALSKHRQSMQNFSMREAFNSDPQRFSQFTLSSAGLFLDYSKNLITTETRDLLVSLAGEVNLKDAIKAQYDGELVNSSEGRPALHTALRRPVGDKLKVNGVDVMPDVHRVLNQMTELVGRIHDGLWRGYTEKPITDVVNIGIGGSFLGPELVSEALVAYAHKGVRCHYLANIDGSEFHELSMKIRAETTLFIVSSKSFNTLETLKNAQAARAWYLAQGGSEVELHRHFIAVSSNNAAAVAFGIREENIFPMWDWVGGRYSLWSAIGLPIALAIGMSNFKELLSGAYTMDQHFQSAPFEQNMPVLLALLGVWYGNFWNAQSHAILPYDHYLRNITKHLQQLDMESNGKSVRQDGTPTSTDTGPVIWGGVGANGQHAYHQLLHQGTQMIPADFIVPIVSFNPVADHHQWLYANCLSQSQALMMGKTRAEAEAELREKGMSEEEVQKLAPHKVIPGNRPSNTLVVERISPRRLGALVAMYEHKVFVQSVIWGTNAFDQWGVELGKEMGKAVYQRLTGGTEEPADDASTQGLINYFRGRHRG

SEQ ID NO: 25917 - protein, 322 aa, Rhizobium leguminosarum
MRGVQQPLLTGFGAAASATEVARNLDLTGRVALVTGGSSGLGLETARALRMSGASVHVTALDPVAARTALNGIGGIEVWPLDLADHASVKAFAKAFLEHQGRLDILVLNAGIMAQPLFRDKRGREGHFSINYLGHYELTVRLWPALLAAGTSRVVVLSSRGHQMSDVDLEDIDFARRPYDKWMAYGQSKTATALFSVSLDRRGRGHGVRAFSVHPGMIVTPGIRHLSRSEFDAFGALEADGTPVIDPTMDKKTPEQGAATSVWCATSPALSSSGGVYCENCDIASVQTDRPFGVRPYAIDPERAEILWRMSALLTGLDIVIT

SEQ ID NO: 25918 - protein, 491 aa, Bacillus cereus
MKNQDQALIFEVSKEGRIGYSLPKLDVEEVKLEDVFESDYIRVEDAELPEVSELDIMRHYTALSNRNHGVDSGFYPLGSCTMKYNPKINESVARFAGFANIHPLQDEKTVQGAMELMYDLQEHLIEITGMDTVTLQPAAGAHGEWTGLMLIRAYHEANGDFNRTKVIVPDSAHGTNPASATVAGFETITVKSNEHGLVDLEDLKRVVNEETAALMLTNPNTLGLFEENILEMAEIVHNAGGKLYYDGANLNAVLSQARPGDMGFDVVHLNLHKTFTGPHGGGGPGSGPVGVKADLIPYLPKPILEKTEDGYRFNYDRPEAIGRVKPFYGNFGINVRAYTYIRSMGPDGLRAVTEYAVLNANYMMRRLAPFYDLPFDRHCKHEFVLSGRRQKKLGVRTLDIAKRLLDFGYHPPTIYFPLNVEECIMIEPTETESKETLDGFIDKMIQIAKEVEENPEVVQEAPHTTVIKRLDETMAARKPVLRYEKPAPVQV

SEQ ID NO: 25919 - protein, 554 aa, Oryza sativa
MESKGGKKKSSSSRSSLMYEAPLGYSIEDLRPAGGIKKFRSAAYSNLLPSDREGHQSCFLSSSSLASSFETMAVLSVADSPPVSAIGFEGYEKRLEITFSEAPVFADPNGRGLRALSRAQIDSVLDLARCTIVSELSNEVFDSYVLSESSLFVYPYKIVIKTCGTTKLLLAIPRILELAEELSLPLEAVKYSRGTFIFPEAQPSPHKNFSEEVAVLNRYFGGLKSGGNAYVIGDPAKPGQKWHVYYATQHPEQPVVTLEMCMTGLDKKKASVFFKTSADGHTTYAKEMTKLSGISDIIPEMEVCDFDFEPCGYSMNAIHGPAFSTIHVTPEDGFSYASYEVMGFNPASLAYGDLVKRVLRCFGPLEFSVAVTIFGGRNHAGTWAKGLDVGAYSCSNMVEQELPSGGLLIYQSFTATAEIATGSPRSVLHCFADENTEKAGKMEALYWEDDAVEEIDGTEGNELSTLYADLILCTNTTAIGKYDFCSAPITVLHLSVTQVVLQQGLRQGVLVVVGRSNAKESSFKNQFHMRSDFSYCHFMAKRAGMQQQQQQQLQ

SEQ ID NO: 25920 - protein, 461 aa, Streptomyces coelicolor
MQFHDSMISLVGNTPLVRLNSVSKGIRATVLAKVEYFNPGGSVKDRIALRMIEAAEKSGELQPGGTIVEPTSGNTGVGLAIVAQQKGYKCIFVCPDKVSTDKINVLRAYGAEVVVCPTAVDPEHPDSYYNVSDRLVRETPGAWKPDQYSNPNNPLSHYHSTGPELWEQTEGKITHFVAGVGTGGTISGTGRYLKDASDGAVTVIGADPEGSVYSGGSGRPYLVEGVGEDFWPTAYDREVADEIVAVSDKDSFQMTRRLAKEEGLLVGGSCGMAVVAALEVAARLGEDDVVVVLLPDSGRGYLSKIFNDEWMADYGFLEDTGPSARVAEVLNHKEGGHIPSLVHMHPDETVGQAIEVLREYGVSQMPIVKPGAGHPDVMAAEVVGSVVERELLDALFAKRASLEDPLEKHMSAPLPQVGSGEPVADLMSVLGGADAAIVLVEGKPTGVVSRQDLLSFLAKVK

SEQ ID NO: 25921 - protein, 177 aa, Glycine max
  misc_feature (125)..(125): Xaa can be any naturally occurring amino acid
  misc_feature (169)..(169): Xaa can be any naturally occurring amino acid
MASSMISSPAVTTVNRAGAGMVAPFTGLKSMAGFPTKKTNNDITSIASNGGRVQCMHVWPPFGKKKFETLSYLPDLDDAQLAKEVQYLLKKGWIPCLKFKLKHNFMYHEHNKSPKYYDKHYCTIXNLPIFNYTDTSQVFKELQHANTTYPNNFIHIIIFDNVQQVHDIXFHHYEPQS

SEQ ID NO: 25922 - protein, 72 aa, Oceanobacillus iheyensis
MAKDDVIEVEGTVTDTLPNAMFKVELENGHTVLAHVSGKIRMHFIRILPGDKVTVELSPYDLTRGRITYRYK

SEQ ID NO: 25923 - protein, 881 aa, Coprinopsis cinerea
MSDIESQRQQIISSVFARRNANGSDETYVCHLKIWEDAGDAGGRKPRYILLSQSNSEGGFMHKSKLNANGTFSVGKTWRVRELRALQVVNPLSLNITLSRRYTWDTESREEQAQFLEALVRLFRTTVGPAAPLHLEGVNDYESQDRLLAQNTDSQIDIDGEEESARATLTNVEEMIEGYEWASDDVIGRKSTRGAVDLIQARLLDELTALEKANVHSFLESDDRIGIVMKFLDEAITELDNMDSLISSYKIHLNAVSEDILFIQSQNRGLQVQTQNQRALLQEIQNLLRTVHVDQDALITLTQGSLEKAQSIQRLEEAAAELYKALQAGRDTDMAATMERLQEYRTHNAQFCKRMFDFLTIMFTAQSKLLIGDTSGLSKSARGYPLLLEHQAIEEYLGRYAGLMLYLKEMDESVYAKLCASYFSTVSELHQTQITGLLSAYLGLIKKAQDDEQDASGFAGSGPPLSKSAAGMRRAGTILRSPLENRRDKEKPVDGELRASVAFDLALEQIQAAVYREFDFITDFLQINDAGLTFADYMGLDSYFRRQAARAAGLSQTTLKLIRNAMDLIFGFLPAELKTWLDNAIAKDNIEIVGILVTLERYFASAEQKNTNFLLNLLDKQQTRLKTAFERHISDQLKGIEQTRLVGKKRRGVTHFIKYFSSYVTRVENQLGGAEGFEIRTLVDSGYEKIVQAMFESLKQLAKLEGEGEDKGQLNYHIIMIENMHHFVTEISKMELGATRNFAQRAQSIYDENLNAYIKVLMRRPLAKLVDFFDAVERVGQDPGALAANSNYSKSSLKKVVKEFNAKDMRKHIDGMFKRVEKHFTEDGTEEMVAIVWKACEQGLVNMTGRIGGLISQHYGDSGVTLEFTKTDIESACRKQL

SEQ ID NO: 25924 - protein, 144 aa, Solanum tuberosum
MASISGTMISTSFLPRKPVVTSLKAISNVGEALFGLKSGRNGRITCMASYKVKLITPDGPIEFECPDDVYILDQAEEEGHDLPYSCRAGSCSSCAGKVTAGTVDQSDGKFLDDDQEAAGFVLTCVAYPKCDVTIETHKEEELTA

SEQ ID NO: 25925 - protein, 172 aa, Unknown
  Malus x domestica
MKRASEPLVVGRVIGDVLDSFTATTKMSVTYNTKLVCNGLELFPSVVTAKPRVEIQGGDMRSFFTLVMTDPDFPGPSDPYLREHLHWIVTDIPGTTDATFGREVVSYEMPKPNIGIHRFVFVLFKQNQRQSINTPSSRDHFSTRSFAAENDLGLPVAAVYFNAQRETAARRR

SEQ ID NO: 25926 - protein, 564 aa, Arabidopsis thaliana
ESTLGRHLSRRLVQAGVTDVFSVPGDFNLTLLDHLIAEPELNNIGCCNELNAGYAADGYARSRGVGACVVTFTVGGLSVLNAIAGAYSENLPVICIVGGPNSNDFGTNRILHHTIGLPDFSQELRCFQTVTCYQAVVNNLEDAHEQIDKAIATALKESKPVYISISCNLAATPHPTFARDPVPFDLTPRMSNTMGLEAAVEATLEFLNKAVKPVMVGGPKLRVAKASEAFLELADASGYPLAVMPSTKGLVPENHPHFIGTYWGAVSTPFCSEIVESADAYIFAGPIFNDYSSVGYSLLLKKEKAIIVHPDRVVVANGPTFGCVLMSDFFRELAKRVKRNETAYENYERIFVPEGKPLKCKPGEPLRVNAMFQHIQKMLSSETAVIAETGDSWFNCQKLKLPKGCGYEFQMQYGSIGWSVGATLGYAQATPEKRVLSFIGDGSFQVTAQDISTMIRNGQKAIIFLINNGGYTTEVEIHDGPYNVIKNWNYTGLVDAIHNGEGKCWTTKVRYEEELVEAIKTATTEKKDSLCFIEVIVHKDDTSKELLEWGSRVSAANGRPPNPQ

SEQ ID NO: 25927 - protein, 369 aa, Pseudomonas fluorescens
MNSASLMCLLHRHDWPGWPGCCATGRSRAPGIPLGTSSLLHKDPAMSRIFADNAHSIGNTPLVQINRIAPRGVTILAKIEGRNPGYSVKCRIGANMIWDAESSGKLKPGMTIVEPTSGNTGIGLAFVAAARGYKLMLTMPASMSIERRKVLKALGAELVLTEPAKGMKGAIEKAAEIVASDPARYFMPQQFDNPANPAIHEKTTGPEIWNDTDGAVDVLVAGVGTGGTISGVSRYIKKTQGKPILSVAVEPATSPVITQKLAGEEIKPSPHKIQGIGAGFVPRNLDLAMVDRVELVTDEESKAMALRLMQEEGILCGISCGAAMAVAVRLAETPEMQGKTIVVILPDSGERYLSSMLFSDLFTEQENQQ

SEQ ID NO: 25928 - protein, 447 aa, Bacillus cereus
MLHRYLPMTEEDKKEMLQTIGVQTIDELFSDIPESVRFKGDLKIKEAKSESELLKELSQMASKNANLKEYASFLGAGVYDHYAPVIVDHVISRSEFYTAYTPYQPEISQGELQAIFEFQTMICELTGMDVANSSMYDGGTALAEAAMLAAGHTRKKKILVSSAVHPESRAVLETYAKGQHLEVVEINHKDGVTDLDVLQSEVDDTVACVIVQYPNFFGQVEKLADIEKIVHQQKSLFIVSSNPLSLGALTPPGKFGADIVIGDAQPFGIPTQFGGPHCGYFATTKAFMRKIPGRLVGQTVDSDGKRGFVLTLQAREQHIRRDKATSNICSNQALNALAASVAMTALGKQGVKEMARQNISKAQYAKRQFEAKGFTVTFAGPFFNEFVVDCKRPVKEVNDALLQKNIIGGYDLGRDYKEHENHMLVAVTELRTKEEIDTLVNEMGAIQ

SEQ ID NO: 25929 - protein, 462 aa, Arabidopsis thaliana
MMMILGLLVIIVCLCTALLRWNQMRYSKKGLPPGTMGWPIFGETTEFLKQGPDFMKNQRLRYGSFFKSHILGCPTIVSMDAELNRYILMNESKGLVAGYPQSMLDILGTCNIAAVHGPSHRLMRGSLLSLISPTMMKDHLLPKIDDFMRNYLCGWDDLETVDIQEKTKHMAFLSSLLQIAETLKKPEVEEYRTEFFKLVVGTLSVPIDIPGTNYRSGVQARNNIDRLLTELMQERKESGETFTDMLGYLMKKEDNRYLLTDKEIRDQVVTILYSGYETVSTTSMMALKYLHDHPKALEELRREHLAIRERKRPDEPLTLDDIKSMKFTRAVIFETSRLATIVNGVLRKTTHDLELNGYLIPKGWRIYVYTREINYDTSLYEDPMIFNPWRWMEKSLESKSYFLLFGGGVRLCPGKELGISEVSSFLHYFVTKYRWEENGEDKLMVFPRVSAPKGYHLKCSPY

SEQ ID NO: 25930 - protein, 336 aa, Citrus sinensis
MAPVVLFLLGLLMATLDTTSAQIGVCYGMLGNNLPSKRDVIALYNQNNIRRMRLYDPNREALEALRGSNIEVMLGLPNDDLRRIASNQAEANTWVQNNVRNFANNVKFKYIAVGNEAKPGDNFAQYLVPAMRNIQNAINRAGLGNQIKVSTAIETGALGESFPPSRGSFKQDYRPILDPLIRFLNENRSPLLVNLYPYFAIAGNRQISLDYALFRSQQTVVSDGSLSYRSLFDAILDAVYAALEKTGGGSLDIVISESGWPTAGGDGALTNVDNARTYNNNLIQHVKRGSPKKPGRPIETYIFAMFDENGKTGPEIERHWGLFAPTRQPRYQINFN

SEQ ID NO: 25931 - protein, 130 aa, Unknown
  Shewanella sp. ANA-3
MSEFLEILTHGRRFKAAVKDLSIEELRDLAAKLDKILVERESMAAEEQQAIAARNAKIEEIRQQMEAVGLSIDDLGGVAVKAAGKKRAPRPAKYQIEVNGEVIQWTGQGRMPTVFKNEVNKGRSMDDFLI

SEQ ID NO: 25932 - protein, 319 aa, Brevibacillus choshinensis
MSEQKIYDVIIAGAGPAGMTAAVYTSRANMSTLMLERGIPGGQMANTEEIENYPGFTTILGPDLSTKMFEHAQAFGAEYAYGEIKEIRDEAPYKRVISGDKEYLAKSVIVATGAEHRLLGVPGEKELSGRGVSYCAVCDGAFFRNKELVVVGGGDSAVEEAVFLTRFASKVTIVHRRDQFRAQKILQKRAFENEKIEVIWDTAVKEIRGEGKVQSVLLENTKTGEQREFSTDGVFIYVGMDPLTESVRSLGITNEAGYVLTDEKMYTKVKGVFAAGDVREKMLRQVVTATGDGSIAAQSAQHFVEELNEALKEQNVTIS

SEQ ID NO: 25933 - protein, 257 aa, Nicotiana tabacum
MATTSAAVLNGLSSSFLTGGKNSQALLGAPVAARIGGLATPKRCIVAAAAAPKKSWIPAVKGGGNLLDPEWLDGSLPGDYGFDPLGLGKDPAFLKWYREAELIHGRWAMAAVLGIFVGQAWSGIPWFEAGADPGAIAPFSFGSLLGTQLLLMGWVESKRWVDFFNPESQSVEWATPWSKTAENFANFTGEQGYPGGKFFDPLSLAGTLQDGVYIPDTEKLERLKVAEIKHARLAMLAMLIFYFEAGQGKTPLGALGL

SEQ ID NO: 25934 - protein, 317 aa, Triticum aestivum
MTVLALMAPDKCLWTEGKRSIVGVSQSLTCRNNNSLTVHEGLCLSDISQGKESIPICVINTIDGVLPTPFKYITKVIYPPSYAKAPSVGCDCTNGCSDSSECACAVKNGGEIPFNLNSAIVYTKPLIYECGPSCRCPPTCHNRVSQHGPKVPLEIFKTGKTGWGVRSLSFIPSGSFVCEYVGEVLQETEAERTENDEYLFDIGRDDDDDEEEEEGSESSKSEMTAEGLGYTIDAAKCGNVGRFINHSCSPNMHAQDVLWDHDDRRMPHVMLFAEKNIRPLQELTYDYNYNIGNVRKNGKVKEKKCFCGSSKCRLRLY

SEQ ID NO: 25935 - protein, 104 aa, Oryza sativa
  misc_feature (87)..(87): Xaa can be any naturally occurring amino acid
  misc_feature (95)..(95): Xaa can be any naturally occurring amino acid
MSGRGKGGKGLGKGGAKRHRKVLRDNIQGITKPAIRRLARRGGVKRISGLIYEETRGVLKDFLENVIRDAVTYTEHAKRTTETAMDXVFYALKRXGRTLYGFGG

SEQ ID NO: 25936 - protein, 663 aa, Haloarcula marismortui
MHHPGPPRFVATGDEVELAPRDPDPSATYTWRLTQAPKESTVSLGDDPVEHLVPDAPGRYVIRLTAPDGEHDLTVRAFPGRLQPSGTHTSGRSGGHSGVSSGRSGSGHSGSGEYTSARDSGDEDGGGGQPRLTLRPEIEGDEAVVRADCSPHPEGTETAGDLTVEFLLDDRDDIDADAVTRDGTALRIPLDALPDRARIHAVAIGDHGYSVPDAVEFSRDGGGIETVTSGDGVAASRPYDAPAWAEDAVIYEIYVRTFAGESDASPFDAIIDRLDYLDSLGVDAIWLTPVLQNDHAPHGYNITDFFEIASDLGTRADYERFIEAAHDRGFKVLFDLVCNHSARTHPYFESAVEGPDADYREWYEWRSDTEPETYFEWEHIANFNFDHLPVRRHLLDAVAQWAELVDGFRCDMAWAVPNGFWREIHDYCKDRDSEFLLLDETIPYIPDFQAGLFDMHFDSTTYAALRQVGDGGDAEAVLSAIEGRAEIGFPEHASFMLYAENHDETRYIVDYGRDAAEAAAGALFTLPGAPLLYAGQEFGQRGRRDDLAWDHADKALQSFVSDLSATRHDQPALSADADLVRIPYEVRDGPSDRVVAYARATDEDAAVVVLNFGSEPTTVRLPAGTDDTDLVSGEHRGAAGDGGATVTVDSVSVFPADESDLSQ

SEQ ID NO: 25937 - protein, 411 aa, Clostridium acetobutylicum
MSKFKSHNSNNTKQTINKHALIFGLISVFLSGIGFTIISPVIPFLVQPYINNPGNQAIIVTLLTSVYAICMFFSAPGLGALSDKYGRRPVLLVCLLGSSIGYLIFGIGGALWVLFAGRIIDGITGGTISTIFAYFADIIPENERTKYFGWVSAVVGVGTIIGPTLGGLLAKFGYSVPLYFGAIITLLNVVYGFFFMPESLDKNIRLKEITFVRLNPFTQLANLLSIKSLKRLLISAFLLWIPNGSLQAVFSQFTIDTFSWKPAIIGLMFSIMGFQDIISQSLIMPKLLVKLSDKYIAILGMISEVIGYSLIAASALFYFYPLFIAGMFIFGFGDSIFGPSFNGMLSKSVDSSEQGRIQGGSQSIQALARMIGPIIGGQIYVSLGHATPAFMGIVLITVAIPVLYKNIHINI

SEQ ID NO: 25938 - protein, 265 aa, Anabaena variabilis
MPVVSLAQMMESGVHFGHQTRRWNPKMSPYIYTSRNGVHIIDLVQTAHLMDEAYNYMRSQAEQGKKFLFVGTKRQAAGIIAQEAARCGSHYINQRWLGGMLTNWATIKTRVDRLKDLERREESGALDLLPKKEASMLRRELAKLQKYLGGIKTMRKVPDVVVIVDQRREYNAVQECQKLSIPIVSMLDTNCDPDVVDIPIPANDDAIRSIKLIVGKLADAIYEGRHGQLDVEEEYEDYEGAEDDYEYDETEYTDSVIPDDEEEAE

SEQ ID NO: 25939 - protein, 112 aa, Yersinia pestis
MKKIDAIIKPFKLDDVREALAEVGITGMTVTEVKGFGRQKGHTELYRGAEYMVDFLPKVKIEIVVADDIVDTCVEAIMQTAQTGKIGDGKIFVFDVSRVVRIRTGEQDEEAI

SEQ ID NO: 25940 - protein, 319 aa, Clostridium perfringens
MKKIAVLTSGGDAPGMNAALRAVTRMALHHGLEVMGVQRGYAGLINGELFKMDRKSVSEIINRGGTILRTARCLEFKQEEVREKAAQILKAYGVEALVVIGGDGSFMGAKLLSKLGVKTVGLPGTIDNDLSYTDYTIGFDTALNTVVDAINKLRDTSTSHERVSIVEVMGRNCGDLALYAGIAGGAEAIIVPEMPFDKDELIKTILEGRTNGKTHSIIVVAEGVGGSAELAKEIESVTGIETRATILGHIQRGGSPTADDIVLASRMGAKAVEVLLEGKTSKVIGIKENRIFDMDIDEALDIERSFDESLYEMANAINK

SEQ ID NO: 25941 - protein, 290 aa, Pseudomonas syringae
MSQETAYIFDATAANFDQMVIDKSFDQPVLVDFWAEWCAPCKVLMPLLQQITESYQGELLLAKVNCDIEQDIVARFGIRSLPTVVLFKDGQPVDGFAGAQSESEIRKILEQHVVMPPPSAADPLKQAQELFAESRFAEAEALLKALLGEDNTNAAALILYARCLAERGELSEAKAVLDAVTGDAHKAELAGAKAQLTFLAQAATLPDVAELKSRLAQNPQDDEAVHQLAIQQLSRQQYEAALDGLLKLFIRNRNYAEGLPHKTLLQVFDLLGNEHPLVTAYRRKLFAALY

SEQ ID NO: 25942 - protein, 334 aa, Brassica napus
  misc_feature (21)..(21): Xaa can be any naturally occurring amino acid
RMTENLSEKYIIGHGASRSGXKCVLKNCKPVAIKRLYSHSNPQSVKQFETELELLSSIKHRNLVSLQAYSLSPLGSLLFYDYMDNGSLWDLLHGPAKKKKNTLFDWDTRLKIAYGAAQGLAYLHHDCSPRIIHRDVKSSNILLDKDLEARLTDFGIAKSLCVSKSHTSTYVMGTIGYIDPEYARTSRLTEKSDVYSYGIVLLELLTGRKAVDDEFNLHHLIMSKTVSNAVMEMADPDITSTCKDLAVVKKVFQLALLCTKRQPNDRPTMHQVVRVLGSFMFSEQPPAANAVPAAAAATSATLASSCYVDEYANLKAPHNVNCSSMSASDAELFL

SEQ ID NO: 25943 - protein, 634 aa, Bacillus clausii
MCGFVGDLLIRNGSHLPDHLWIQTLEAIHHRGPDSTGTYKDETVRFGFKRLSIIDLEHGDQPLAYSKGRYHIVFNGEIYNYIELRSQLIQRGYTFRTDSDTEVLLALYAADGKNAVKQLRGMYAFAIWDKHKKELFCARDRFGIKPFYYLKTDERFFFASEQKSIMPLLEQISIEQEALQHYATFQFVPEPNTLTKGIHKLLPGHTLTVNADFCVQIEAYAERTFQPRSGPTVTELANQTRKLLTDSVEKHMRSDVPVGAFLSSGIDSTSIAALAQQVHPNLLTFTVGFETEGYSEIAVAKETAKALGVKNIHKVISADEFIQELPNIVWHMDEPVADPAAVPLYFVAQEASKHVKVVLSGEGADELFGGYNIYREPLDLAWFKKLPPTFHAGLKRVVAHMPSKLKGRNYIIRGTTPLNERYIGNAFIFSEKEKTQLFRDYDRTKPYTNVTAPLYEQAKGMDESTIMQFVDMHTWLPGDILVKADRMTMAHSIELRVPFLDKDVFAFARMLGQDMKLSHKTTKFVLRQAMKDLIPANIVPRKKLGFPVPIRVWLKNELYDWAKQLIESSNTEDVFHKPFLLQMLQAHRDGHGDYSRRLWTVLTYMMWHDIHVAKRLISTHQQKDAERCKTLAHF

SEQ ID NO: 25944 - protein, 676 aa, Bacillus subtilis
MQLVEQTIVTRKKYTAIGIDNPTTQGRLCIKGMNAHQHALNSSRITRPLLKKNGEFMPVSWEEALNHIKDQVTMIQTEHGHDAMAVYGSASITNEEAYLLGKFARVGLQTKYIDYNGRLCMSAAATAANQTFGADRGLTNPLSDIPHTRVIILAGTNIAECQPTIMPYFEKAKENGAYFIAIDPRETATTKIADLHLKIKPGTDAALANGLVKIIIDEQLINEDFIQSRTNGFEELKQHTDSLDLNDIAEQTSVSLVDIRKAAVKFAKETSGMLFTARGIEQQTDGTAAVKGFLNMVLITGKIGKPYSGYGAITGQGNGQGAREHGQKADQLPGYRSIENEEHRAHIAKVWGIHQDDLPRKGVSAYEVMEKINDGDIKGLFLMCSNPAVSSPNANLVKKALRRLTFFVAIDLFISETAKYADVILPASSYLEDEGTMTNVEGRVTLREASRPCPGEAKHDWQIICDLASALGKGRYFSYTSAEDIFNELREASRGGIADYSGISYGRLRREGGIHWPCPESDHPGTGRLFTESFAHPDQKAALSVIPNEPPVPKEKPTADYPLYLTTGRVMSHYLTGVQTRKSAALAARHFESFMEIHPQTAATYNIEDRVLVKIESPRGSITVRSKLSEQIRKDTVFVPIHWADAQNVNDLIGEALDPACKMPGFKVCAVRIIPI

SEQ ID NO: 25945 - protein, 436 aa, Prochlorococcus marinus [sequence omitted]

SEQ ID NO: 25946 - protein, 246 aa, Unknown
  Halobacterium sp. NRC-1
MTGTVYLVGSGPGDPELLTVKATRLLEAADVVLHDKLPGPEILSSIPEGKREDVGKRAGGERTPQSETNARLVELAEDGNDVVRLKGGDPFVFGRGGEEMLYLAEHGVDFEVVPGVTSPVAAPAAADIPVTHRDHASSVSFVTGHEDPGKDESAVDWGALADTGGTIVVLMGVGKLPEYTAALRDAGMDPETPVALVEKGTRPGQQVATGTLATIVAARDEAGISPPAITVIGGVAGLWDGVEGEP

SEQ ID NO: 25947 - protein, 436 aa, Glycine max
MAVTQFNPTCSKTHLHSSQLPFLSRTLPRHRHCTIAPLHRTQQARICCSVAPNEVQVPAVKTSDPKSKPECYGVFCLTYDLRAEEETRSWKKLINIAVSGAAGMIANHLLFKLASGEVFGPDQPIALKLLGSERSIQALEGVAMELEDSLFPLLREVSIGIDPYEVFQDAEWALLIGAKPRGPGMERADLLDINGQIYAAQGRALNAVASRNVKVIVVGNPCNTNALICLKNAPNIPAKNFHALTRLDENRAKCQLALKAGVFYDKVSNVTIWGNHSTTQVPDFLNARIDGLPVKEVVKDQKWLEEEFTEKVQKRGGALIQKWGRSSAASTSVSIVDAIRSLVTPTPEGDWFSSGVYSDGNPYGIAEGIVFSMPCRSKGDGDYELVKDVIFDDYLQQRIAKTEAELLAEKRCVAHLTGEGIAVCDLPGDTMLPGEM

SEQ ID NO: 25948 - protein, 354 aa, Arabidopsis thaliana
MSLLSDLVNLNLTDATGKIIAEYIWIGGSGMDIRSKARTLPGPVTDPSKLPKWNYDGSSTGQAAGEDSEVILYPQAIFKDPFRKDNNILVMCDAYTPAGDPIPTNKRHNAAKIFSHPDVAKEEPWYGIEQEYTLMQKDVNWPIGWPVGGYPGPQGPYYCGVGADKAIGRDIVDAHYKACLYAGIGISGINGEVMPGQWEFQVGPVEGISSGDQVWVARYLLERITEISGVIVSFDPKPVPGDWNGAGAHCNYSTKTMRNDGGLEVIKKAIGKLQLKHKEHIAAYGEGNERRLTGKHETADINTFSWGVANRGASVRVGRDTEKEGKGYFEDRRPASNMDPYVVTSMIAETTILG

SEQ ID NO: 25949 - protein, 550 aa, Arabidopsis thaliana
MVSKECCRNEIRAAIRQLSDRCLYSAAKWAGEQLVGIEQDPSNFTPANTRFQRGSSSIRRRFSTNESISTPLPSVGFSQAATPLPEEDEAIDGDIYLLAKSYFDCREYRRASHMLRDQVSKKSLFLRYYALYLAGEKRKEGEMIELEGPLGKSDAINRELVSLERDLSALRRTGAIDSFGLYLYGVVLKEKGNESLARASLVESVNSYPWNWSAWSELQSLCTSIEILNSLNLNNHWMKEFFLGNAYQELRMHTESLAKYEYLQGIFSFSNYIQAQTAKAQYSLREFDQVEIMFEELLRNDPYRVEDMDLYSNVLYAKEACAALSYLAHKVFLTDKYRPESCCIIGNYYSLKGQHEKAVMYFRRALKLNKKYLSAWTLMGHEYVEMKNTPAAIDAYRRAVDINPTDYRAWYGLGQAYEMMGMPFYALHYFRKSIFFLPNDSRLWIAMAKCYQTEQLYMLEEAIKCYKRAVNCTDTEGIALNQLAKLHQKLGRNEEAAYYFEKDLERMDAEGLEGPNMFEALVFLATHFKNHKKFEEAEVYCTRLLDYSGP

SEQ ID NO: 25950 - protein, 274 aa, Triticum aestivum
  misc_feature (221)..(221): Xaa can be any naturally occurring amino acid
  misc_feature (256)..(256): Xaa can be any naturally occurring amino acid
  misc_feature (263)..(263): Xaa can be any naturally occurring amino acid
AYLGDILEQVCTKKQAGTGPEFPGYRRPTRPRVHGLAGTFAHGLKKLGTVTVQELPYFDTVKITCADANAIAEEARKNEMNLRVVDANTITVAFDETTTLEDVDKLFKVFSGGKPVDFTAESIAPEVSSSIPPSLVRDSPYLTHPIFSMYHTEHELLRYLHKLQSKDLSLCHSMIPLGSCTMKLNATVEMMPVTDPKFANMHPFAPIDQAAGYHEMFDNLXDLLNTITGFDSFSLQPNAGASGEYAGLMVIRAYHXARGDHHXNVCIIPVSAHG

SEQ ID NO: 25951 - protein, 259 aa, Unknown
  uncultured bacterium
QPNAMGGREAGGLANQLAIHRGFDHQSIELISEFWQTDRLARKPGLKAIEMFEAVERGDIQVIWIMATNPVVSIPDNRFVQQALKKCPLVIVSDVTAESDIAQYADLLLPAAGWGEKQGMVTNSERMLTRQRQFQKPKGLAKPDWQAIAMVASKVSARLAMQDGFKFLTEAEVFGEYAAMTGLNKNSSLLLDLSAYAQISEQEYAAWQPVQWGGAHPFANGQFSFDDGKARFIVPSHSQASDKMQWWLNTGRQRDQWHT

SEQ ID NO: 25952 - protein, 183 aa, Xanthomonas axonopodis
MSQTLYDIPVTRIDGQPTTLADYRGKVLLVVNVASKCGLTPQYEGLEALYRDKRAQGLEVLAFPANDFNGQEPGSEAEIAQFCQLTYDVTFPMFAKIAVAGDQAHPLYGALTSTHPHTTGEGPMREKLAGYGIAPNPAPGVVWNFEKFLIGRDGKIIDRFAPDIPADDARLRAAIDAALATRS

SEQ ID NO: 25953 - protein, 133 aa, Brassica napus
  misc_feature (2)..(3): Xaa can be any naturally occurring amino acid
  misc_feature (9)..(9): Xaa can be any naturally occurring amino acid
  misc_feature (12)..(12): Xaa can be any naturally occurring amino acid
  misc_feature (16)..(16): Xaa can be any naturally occurring amino acid
  misc_feature (21)..(21): Xaa can be any naturally occurring amino acid
  misc_feature (31)..(31): Xaa can be any naturally occurring amino acid
  misc_feature (35)..(35): Xaa can be any naturally occurring amino acid
  misc_feature (50)..(50): Xaa can be any naturally occurring amino acid
  misc_feature (53)..(53): Xaa can be any naturally occurring amino acid
  misc_feature (57)..(57): Xaa can be any naturally occurring amino acid
  misc_feature (59)..(59): Xaa can be any naturally occurring amino acid
  misc_feature (62)..(62): Xaa can be any naturally occurring amino acid
  misc_feature (64)..(66): Xaa can be any naturally occurring amino acid
  misc_feature (69)..(69): Xaa can be any naturally occurring amino acid
  misc_feature (71)..(71): Xaa can be any naturally occurring amino acid
  misc_feature (73)..(73): Xaa can be any naturally occurring amino acid
  misc_feature (85)..(87): Xaa can be any naturally occurring amino acid
  misc_feature (90)..(90): Xaa can be any naturally occurring amino acid
MXXSMLSSXAAXTSPXQATMXVPFTGLKSSXAFPXTRKANNDITSIVSNXGRXSCMXVXPPXGXXXFEXLXYXPDLTKVELGKEXXXYFXRNKWISLNSQGKYVATPPPEWGNGEFPLLGPFSHVFRYPHPPS

SEQ ID NO: 25954 - protein, 294 aa, Spirulina sp.
AKTDIPVNIYKPKNPYIGKCLSNEELVREGGTGTVRHLIFDISGGDLRYLEGQSIGIIPPGTDNNGKPHKLRKYSIASTRHGDHVDDKTVSLCVRQLEYKHPETGETVYGVCSTYLCNLEAGADVAITGPVGKEMLLPEDEDATIIMMATGTGIAPFRAFLWRIFKEQHEDYKFKGLWALFFGIPYSPNILYQQELEELQEEFPENFRLTLAISREQQNPEGGKMYIQDRIKENADQLWELIQKPNTHTYICGLKGMEGGIDEGMSAAAGKFDVDWSDYQKELKKKHRWHVETY

SEQ ID NO: 25955 - protein, 259 aa, Unknown
  uncultured bacterium
QPNAMGGREVGGLANQLAVHRGFDPDSIKLISEFWQTDNLATRPGLKAIELFEAVERGDIQVIWIMATNPVVSMPDNVFIQRALQKCPLVIVSDVTHDSDITQYADLLLPAAGWGEKQGMVTNSERMLTRQRKFLPSKGEAKPDWKIIAEGRKKLCERLDKPNAFDFKSESSVFREYAAMTGLNKDTPFLLDLSKYAEISDEEYKSWNPVQWGSSRPFADGKFSTENRKARFVVTTAPLIKGESSLWLNTGRQRDQWHT

SEQ ID NO: 25956 - protein, 268 aa, Unknown
  uncultured bacterium
QPNAMGGREVGGLSNMLAANMDIDNPEHHATVKAFWQAPHLITKPGLRAVDMFQAAADGKVKCLWIMATNPVASMPNRALVEAALKNCELVIVSDTAAQTDTLNYAHIALPATGWSEKNGTVTNSERRISRQRGLVEPMGEARHDWDILSMVGRAMGFEAAFAYQHPAEIFAEHCALTAANNNGSRALDLGPLANLTIAQYDNLRPQQWPLSDTHRIGTARLFADGSFYTPNGKANFVAITPRLPDQQTSADYPFVLNTGRVRDQWHT

SEQ ID NO: 25957 - protein, 539 aa, Triticum aestivum
MMGGGVAMMDRRMAFPADGGAAASKGRPRRPPSQQDQQARRKKMSRAQDGILKYMLKMMEACSAQGFVYGIVPENGKPVGGASDNLRAWWKEKVRFDRNAPAAIAKHRSDNAAPLCGGEDGAGAAAGPRSLHELQDTTLGSLLSSLMQHCDPPQRRFPLEKGVPPPWWPQGPSEAWWPEAGVPDDLGPPPYKKPHDLKKAWKVAVLTAVIKHMSPDVDKVRRLVRQSKCLQDKMTAREIVTWLAVLKAEEELSHKLHPGACLPPRPSAGALSFDASSGEYDVDFFGEEAANQIKARSEAAPFVDLTMDASSSNEFMVMPPALMKEETTTDVDFTHAQKRSAADAEPELMLNGSARVYTCENVQCPHAGHALGFLDRNARSAHQYTCRYNNPAVAAAQSKPPSSFFPGAPYSPQSQALGGFDFGLPVADQRCLSGLMSMYETGVAAHRGATNDADAPGMQLGGGNVLAPRSLAGANNVMQQQQQQQQQSAAFFMGDDAPFGMAAPELGRFGPGFDLSAADYAGAMQQPQPQKHVGPNWFY

SEQ ID NO: 25958 - protein, 806 aa, Emericella nidulans
MTPSTSHISSQLRQLIYYHLDNNLARNALFLAGRLHAYEPRTSEASYLLALCYLQNGQVKAAWETSKHFGSRGAHLGCSYVYAQACLDLGKYTDGINALERSKGQWTSRNHWNKHSETRRQHLPDAAAVLCLQGKLWQAHKEHNKAVECYAAALKLNPFMWDAFLNLCETGVDLRVSNIYKMSPELYSMVSSAALEDVESQVLPPDGPLQTQVNPNPSLDPFTAGTTRSDSTSTHGSSALWEKLNGSTVSVASSGTGPHLPREGMETPGGQSSESDDPRVTNGNGTDVFEPPLAPAKKNRTIQTIGGDHPMDPPPKMRPTGIRPRTRTKFESDEGHTERDAGMGHRLGDRKRTVSGQVAHPSVPHSTDQGVGQRRSVRLFNQIKPSTNKISSTALGVKEGREVKKVRTTGNKARTTTSSNVGRVVSGNNRRHAGEIHDGDSKEYRGTSSTSNGSQNASSKLAISERTKSVEALAWILDLFFKIASGYFCLSRYKCSDAIQIFSSLSQGQRETPWVLAQIGRAYYEQAMYTEAEKYFVRVKAMAPSRLEDMEIYSTVLWHLKNDVELAYLAHELMDVDRLSPEAWCAVGNSFSHQRDHDQALKCFKRATQLDPHFAYGFTLQGHEYVANEEYDKALDAYRSGINADSRHYNAWYGLGTVYDKMGKLDFAEQHFRNAAKINPSNAVLICCIGLVLEKMNNPKSALIQYNRACTLAPHSVLARFRKARALMKLQDLKSALTELKVLKDMAPDEANVHYLLGKLYKMLRDKGNAIKHFTTALNLDPKAAQYIKDAMEALDDDEEDEEDMA

SEQ ID NO: 25959 - protein, 266 aa, Unknown
  uncultured bacterium
QPNAMGGREVGGLANQLAAHMDFSDESIKLVSDFWNAPNIAEKPGLKAVELFSELEAGKIKALWIMATNPAVSMPQASRINQALANCDYLVVSDCITSNDTTRHANVLLPATTWGEKDGTVTNSERRLSRQRAFLPAPGQARPDWWIICQVAQKMGYTQSFTYQTPADIWREYASLSGYQNGGMRDFDVSALANISNQQYQNMQPQQRPVNSSQARVSSLFSDKRFYHADHKARFISVTANCTYPQTSEQFPLVLNSGRIRDQWHT

SEQ ID NO: 25960 - protein, 201 aa, Saccharum officinarum
MAPKRSTSPTGSSSGGVRAAATEQPRLRGVRKRPWGRYAAEIRDPVLKARVWLGTFDTPEQAARAYDAAARRLRGPGATTNYPAASEPMVPAVSGSAVLSESSSSSSWSLLPESVTAAVAAPPPSLDLSLALPASAAAANTYQVFMDPTPALLQFLPPKSEEEQSCSGSLSSSSGVFDAAPPVGLGLDLNLALLPPAEMVM

SEQ ID NO: 25961 - protein, 117 aa, Glycine max
  misc_feature (36)..(36): Xaa can be any naturally occurring amino acid
  misc_feature (87)..(87): Xaa can be any naturally occurring amino acid
MAATSLSPSTILSLNRKGSSTVSAFTPRSISAVKFXFPLRRIRTGDLNLSSLSSSTRSTPRPIEAKKQTYNSFDDLLVNSDKPVLVXDFYATWCGPCQFMVPILSEVSETLKDKIQV

SEQ ID NO: 25962 - protein, 281 aa, Unknown
  uncultured archaeon GZfos18F2
MRNPYLPCPVRIDETVIETEDRNLKTFKLVFPDPVDEQRFSYAAGQFAELSVAGMGEVPIGIASSPTEKGYLMFTVNKVGLVTTHLHSMKGGDIMGIRGPLGNSYPWEIMEGKNVVIIGGGFAFTTLRSSIVYMLDPANRPKFKDIHVIYGSRSPGMLLYRDELAAWEARDDINMHITVDSTDDPEWKYNVGFVPTITEQKAPPGDAETYVIVCGPPIMIKFTQPVLDNLGYAHDHIIMSLEMRMKCGIGMCGRCNIGKEFVCKDGPVFTLAQLNEMPREY

SEQ ID NO: 25963 - protein, 427 aa, Anabaena variabilis
MTRTNSDFLTNSDPAIAGLINQELQRQRDHLELIASENFTSAAVLAAQGSVLTNKYAEGLPGKRYYGGCEFIDKIEQIAIDRAKQLFGAAHANVQPHSGAQANFAVFLTLLAPGDKIMGMDLSHGGHLTHGSPVNVSGKWFQVCHYGVSQQTEQLDYDQIRELALRERPKLLICGYSAYPRIIDFEKFRSIADEVGAYLLADIAHIAGLVASGLHPDPIPYCHVVTTTTHKTLRGPRGGLILTGDAELGKKLDKSVFPGSQGGPLEHVIAGKAVAFGEALKPEFQGYSAQVIENARALANQLQNRGLKLVSDGTDNHLMLVDLRSVNMTGKRADQLVSEVNITANKNTVPFDPQSPFVTSGLRLGSPAMTTRGMGEAEFTEIGNIIADRLLNPDSDTVAQDCKRRVAALCDRFPLYPHLEIPVPVLA

SEQ ID NO: 25964 - protein, 241 aa, Chara vulgaris
MSDQSFYFLSPMNHLYSKTNLEEMLEAGVHFGHQSHKWNPRMAPYIFSERKGVHIIDLIQTSNLLHEACDFLANAASNKKEFLLVGTKFQASDLIKSEALKSRCHYVNQRWLGGMLTNWMTIETRIQRLKNLETQEKLGAFHHLPKKDAAHLKRQLNQLQKYLGGMKYMKNLPDVVIIVDQQKEIIAVQECRVLGIPIIALVDTNCDPEIVDIPIPANDDARSSIRWILSKLTAAIRDNRF

SEQ ID NO: 25965 - protein, 278 aa, Brassica napus
MADRVKGPWSQEEDEQLRLMVEKYGPRNWSAISKSIPGRSGKSCRLRWCNQLSPEVEHRPFSPEEDETIVSARAKFGNKWATIARLLNGRTDNAVKNHWNSTLKRKCLDGNPTTEEDQDRAKKRRSMSSESVPPVDTGLYMSPESPTHVASDSSAVPPQLFKPMPVSGGFTVPSPVEMTSSSEEDPATTLSLSLSLPVSQESRNTGSSDNSLPFPKFESQMKINVEERGEARRAEFMTVVHEMVKAEVRSYMAEMQRNNGGGFVVGGFYDSGITPKVE

SEQ ID NO: 25966 - protein, 507 aa, Wolinella succinogenes
MTKFKLLLAGSLVAIVSMGLLASNINEREKERVALNKTAHSQGIKGKAMSEEWARYYPRQFDSWKKTKESDNITDMLKEKPALVVAWAGYPFSKDYNAPRGHYYALQDNINTLRTGAPVDGKTGPLPSACWTCKSPDVPRIIEQDGELEYFTGKWAKYGDEIVNTIGCYNCHDDKSAELKSKVPYLDRGLSAAGFKTFAESTHQEKRSLVCAQCHVEYYFKKTEWKDDKGVDKTAMVVTLPWSKGISTEQMEAYYDEINFADWTHGISKTPMLKAQHPDWELYKTGIHGQKGVSCADCHMPYTQEGAVKYSDHKVGNPLDNMDKSCMNCHRESEQKLKDIVKQKFERKEFLQDIAFDNIGKAHLETGKAMELGATDAELKEIRTHIRHAQWRADMAIAGHGSFFHAPEEVLRLLASGNEEAQKARIKLVKVLAKYGAIDYVAPDFETKEKAQKLAKVDMEAFIAEKLKFKQTLEQEWKKQAIAKGRLNPESLKGVDEKSSYYDKTKK

SEQ ID NO: 25967 - protein, 493 aa, Candida albicans
MLSSTLRRSVRAQSKNLPAFARRAYAVSPSAQALISKSVQDVDPEMADILNQERTRQKNSITLIPSENFTSKAVMDLLGSEMQNKYSEGYPGERYYGGNEIIDKAEALCQKRALEAFGLDPSQWGVNVQPLSGAPANLYAYSAILEVGDRIMGLDLPHGGHLSHGYQTNTTKISYISKYFQTMPYRLNEETGIIDYDTLEKNAQLFRPKVIVAGASAYSRVIDYKRMRQIADKVGAYLLSDMAHISGLVSAGVTDSPFPYSDIVTTTTHKSLRGPRGAMIFFRKGIRKVTKKGKEIPYELERKINFSVFPGHQGGPHNHTISALAVALKQCTEPEYVKYQQEVVSNAKHFADALVSKGFKLVSDGTDTHLILVDLRSRNIDGARVEAVLERANIAANKNTVPGDVSALFPSGLRVGTPAMTTRGFGPEEFDKVAEFIDQAVNIAIELKAQEQGKVPKELLASFKKLADESDKVKQLDKEVVSWVSKYPVPGEL

SEQ ID NO: 25968 - protein, 704 aa, Lactobacillus sakei
MAIIEAVILLVMLLIVANIIGHYVPRLPVSLIEIGLGLLVALLFSVEIPLKTDWFMLVFVAPLLFNDGRRFPKRELWALRGPIIGNAIFLVFVTTLIGGLAIHLLVPKLPLAASFALAAILSPTDPMAVQSISEQADLPPRVLHLVSGESLINDASGLISFKYGIAAAVTGYFSIQQAAGDFLYISIVGAIAGMLLMYAIHFIRLFMLQQGIEDVVFHTVLQLITPFVIYLVVEDLLHASGVIAVVVAGIISHASRNIYLDYLPELKLVTEQTWSIGVYLLNGLVFLILGIELPVAMRGTVHSPLINTGEEILLVLAVWGILILIRTCWTLSYLLYTNKSNPKQLKDNLKISVLSGLSGVRGAITMAGVLSVPTVLADGSPFPERGLMLFIAAGVIIVSLVMAIIFIPILTKVRTPIELRGTAHEDTNDETGLVPVDDQLLSEFDAKIYMYRVAVGTVESLRHIENNRAALDLIAEYQLMMRRFENQQNEQTEGDELPPLIAEELILRQVAFEGERQKLETLRSDGEITAKTYRRGKRKLRQKQIALSVIGSNFSWRHIQLMFYRGLTMLKRLIARLKTSQKSTAALTEWRTTEKEMAKAGIKQLSYFLKQPENRQHHYNRQVIYQIIIRYRNQIENMKNIGHTKTDIYEQQLQKLRIKALTSERLAIQELLEQHKISWELADELRKDINYAENALILADTDTE

SEQ ID NO: 25969 - protein, 413 aa, Nicotiana tabacum
MAGLAPEGSQFDARQYDAKMTELLGTEQEEFFTSYDEVYDSFDAMGLQENLLRGIYAYGFEKPSAIQQRGIVPFCKGLDVIQQAQSGTGKTATFCSGVLQQLDYSLVECQALVLAPTRELAQQIEKVMRALGDYLGVKVHACVGGTSVREDQRILQSGVHVVVGTPGRVFDMLRRQSLRPDHIKMFVLDEADEMLSRGFKDQIYDIFQLLPPKIQVGVFSATMPPEALEITRKFMNKPVRILVKRDDVTLEGIKQFYVNVDKEEWKLETLCDLYETLAITQSVIFVNTRRKVDWLTDKMRTRDHTVSATHGDMDQNTRDIIMREFRSGSSRVLITTDLLARGIDVQQVSLVINYDLPTQPENYLHRIGRSGRFGRKGVAINFVIKDDERMLSDIQRFYNVVIEELPANVADLL

SEQ ID NO: 25970 - protein, 761 aa, Oryza sativa
MTLERLYFYGLKFGTSQYVSTGKYKILPNNIFKGHVRNSCYSLKEGEAPTLAVVQETMLDGEKAILEQKITAATARMNELRRTNHDMEVKLIIYDVIAGRRKNLDDLSPNFINDLQKEVAKHREEGRKDQIAFFDKECSKVADHVYLGGDAVAKNRDILRKNGITHVLNCVGFVCPEYFKSDLVYRTLWLQDSPTEDITSILYDVFDYFEDVREQGGRVFVHCCQGVSRSTSLVIAYLMWREGQSFDDAFQLVKAARGIANPNMGFACQLLQCQKRVHAIPLSPNSVLRMYRMAPHSPYAPLHLVPKMLNEPSPAALDSRGAFIVHVLSSIYVWVGMKCDQVMEKDARAAAFQVVRYEKVQGHIKVVREGLELPEFWDAFSSAPVNSDSNTKISKDQIDSASKTGPGNRRVESYDADFELVYKAITGGVVPAFSSSGAGDETHLPARESTWSSLRRKFISRSLARVYSDSALIRDLDPRVDRVQHLAAEASTSPPFLSPSSLSSDSSISSKYSSDSPSLSPSTSSPTSLGLSPASSNFSHTLVPSSRSPLHQSSNEEPSKSGLGSIRSPSKTSSIAERRGGFSSLKLPSFQKDLVLPPRVPTSLRREEEVTDKSNNNSVKQLTGVCCPEKCTGNTSTVHTKTGITERTDSISEACGNLQLLVYRWPSKEKLTTFTRKDLDPKSVLIFVTPEDSRSEAVKTVHIWVGGEYESSKCVDTVDWQQVAGDFFHLKELGNTLPVKLWTKYFSGIQKYRIICYAITV

SEQ ID NO: 25971 - protein, 413 aa, Nicotiana tabacum
MAGAAPEGSQFDARQYDSKMTELLNAEGQDFFTSYDEVYHSFDAMGLKENLLRGIYAYGFEKPSAIQQRGIVPFCKGLDVIQQAQSGTGKTATFCSGILQQLDYELLDCQALVLAPTRELAQQIEKVMRALGDYLGVKVHACVGGTSVREDQRILSSGVHVVVGTPGRVFDMLRRQSLRPDHIKMFVLDEADEMLSRGFKDQIYDIFQLLPPKIQVGVFSATMPPEALEITRKFMNKPVRILVKRDELTLEGIKQFYVNVDKEEWKLETLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRFGRKGVSINFVTSDDERMLSDIQRFYNVVIEELPANVADLL

SEQ ID NO: 25972 - protein, 536 aa, Prochlorococcus marinus
MHQLMSFPDFSASDAHVQWQRFNNLLWYHNDLGIWLDISRMHINAEDFERLGPRFDQAFKAMQALEQGSIANADEQRMVGHYWLRQPQLAPDQEVRDHIAKEIDLIETFGSNVVNGLIKAPNGKQFTDVLWIGIGGSGLGPLLMIRALQNAEQGLRFHFFDNVDPDGMSRVLGNLGDALSTTLVVTVSKSGATPEPHLGMEQARQRLEEMGGRWSGQAVAVTMLNSQLDQLAQKESWLKRFDMFDWVGGRTSITSAVGLLPAALIGCNTRDFLAGAAQMDEATRVPDLHSNPAALMAAAWFVAGDGLGRRDMVVLPYRDRLEVFSRYLQQLVMESLGKRLDRDGNVVHQGLAVYGNKGSTDQHAYVQQLRDGVDNFFATFIEVLEDIENIPAINNEHPGDFLDGFLQGTRAALSQGGRQSLSISMRRFDPRRLGALVALFERAVGLYGELVNINAYHQPGVESGKKAAAAILNLQSRVEALLADGVDRSAGEIHQVIGEGSEEAIFWIMRHLTANKRGYVAEGDWGIPTSLRFSKG

SEQ ID NO: 25973 - protein, 413 aa, Nicotiana tabacum
MAGLAPEGSQFDARQYDAKMTELLGTEQQEFFTSYDEVYESFDAMGLQENLLRGIYAYGFEKPSAIQQRGIVPFCKGLDVIQQAQSGTGKTATFCSGILQQLDYSLVECQALVLAPTRELAQQIEKVMRALGDYLGVKVHACVGGTSVREDQRILQSGVHVVVGTPGRVFDMLRRQSLRPDNIKMFVLDEADEMLSRGFKDQIYDIFQLLPPKIQVGVFSATMPPEALEITRKFMNKPVRILVKRDELTLEGIKQFYVNVDKEEWKLETLCDLYETLAITQSVIFVNTRRKVDWLTDKMRGRDHTVSATHGDMDQNTRDIIMREFRSGSSRVLITTDLLARGIDVQQVSLVINYDLPTQPENYLHRIGHSGRFGRKGVSINFVTKDDERMLFDIQKFYNVVIEELPANVADLL

SEQ ID NO: 25974 - protein, 203 aa, Mycobacterium avium
MGVAQISSAITPAQPAELYPGDIKSVLLTAEQIQARIAELGREIGDNYRDAAAETGQDLLLITVLKGAVIFVTDLARAIPLPTQFEFMAVSSYGSSTSSSGVVRILKDLDRDIQGRDVLIVEDVVDSGLTLSWLLRNLSTRHPRSLRVCTLLRKPDARGAHVDIAYVGFDIPNDFVVGYGLDYDERYRDLSYIGTLDPRVYQQ

SEQ ID NO: 25975 - protein, 965 aa, Thermus caldophilus
MDPLWYKDAVIYQLHVRSFFDANNDGYGDFEGLRRKLPYLEELGVNTLWLMPFFQSPLRDDGYDISDYYQILPVHGTLEDFKRLLDEAHGRGMKVIIELVLNHTSIDHPWFQEARKPNSPMRDWYVWSDTPEKYKGVRVIFKDFETSNWTFDPVAKAYYWHRFYWHQPDLNWDNPEVEKAIHQVMFFWADLGVDGFRLDAIPYLYEREGTSCENLPETIEAVKRLRKALEERYGPGKILLAEANMWPEETLPYFGDGDGVHMAYNFPLMPRIFMALRREDRGPIETMLKETEGIPETAQWALFLRNHDELTLEKVTEEEREFMYEAYAPDPKFRINLGIRRRLMPLLGGDRRRYELLTALLLTLKGTPIVYYGDEIGMGDNPFLGDRNGVRTPMQWSQDRNAGFSRAPYHALFLPPVSEGPYSYHFVNVEAQRENPHSLLSFNRRFLALRNQHAKIFGRGSLTLLPVENRRVLAYLREHEGERVLVVANLSRYTQAFDLPLEAYQGLVPVELFSQQPFPPVEGRYRLTLGPHGFALFALKPVEAVLHLPSPDWAEEPAPEEADLPRVHMPGGPEVLLVDTLVHERGREGLLNALAQTLKEKSWLALKPQKVALLDALRFQKDPPLYLTLLQLENHRTLQVFLPLLWSPQRREGPGLFARTHGQPGHFYELSLDPGFYRLLLARLKEGFEGRSLRAYYRGRHPGPVPEAVDLLRPGLAAGEGVWVQLGLGQDGGLDRTERVLPRLDLPWVLRPEGGLFWERGASRRVLALTGSLPPGRPQDLFAALEVRLLESLPRLRGHAPGTPGLLPGALHETEALVRLLGVRLALLHRALGEVEGVEGGHPLLGRGLGAFLELEGEVYLVALGAEKRGAVEEDLARLAYDVERAVHLALEALEAELWAFAEEVADHLHAAFLQAYRSALPEEALEEAGWTRHMAEVAAEHLHREERPARKRIHERWQAKAGKA

SEQ ID NO: 25976 - protein, 279 aa, Unknown
  uncultured bacterium
QPNAMGGREVGGLANQLAAHMDFSGPERERVKRFWQSPQLAEKPGLKAIELFQAAARGEIRFLWIMSTNPMVSMPDTSLVQRALEKVELVVVSDCMADTDTTAMAHVLLPAASWGEKNGTVTNSERCLSRQRGFLPSPGEAKPDWWILTQVAHRLGFRQQFPYQHAHDIFSEHARLSGFENKGSRDFDISALAQLSRQQYDALSPIQWPVNSDYPNGRQRFFEDGRFYTDNGKARFIATCCQLPQDIPATEFPTTELPTPDIPTMLNMNSGRIRDQWHT

SEQ ID NO: 25977 - protein, 110 aa, Rhizobium leguminosarum
MASVKVDINNFQSEVLESAEPVVVDFWAEWCGPCKMIAPIIEEIAVEMEGKVKVAKLNIDENPELAAQFGVRSIPTLAIFKGGEVADISVGEKPKSFFVDWIQRMVADCG

SEQ ID NO: 25978 - protein, 266 aa, Unknown
  uncultured bacterium
QPNAMGGREVGGLANQLAAHMDFAAADRERVKRFWNAPGVAEKPGLKAIDLFKAAEKGDIKFLWIMSTNPVVSMPDADLIKRALKKVELVVVSDCMADTDTAAFAHVLLPAASWGEKNGTVTNSERRISRQRGFLPSPGEAKPDWWMLTQVAQRLGFSEQFDYQKPYDVFIEHARLSAFENEGKRDFDLSGLADINEAQFEALAPIQWPVNNTFPQGRARFYDDGYFYTPSGKARFVSNAAIMPERVDQPGLLSMNTGRIRDQWHT

SEQ ID NO: 25979 - protein, 476 aa, Arabidopsis thaliana
MEDDGYYLDTDLDLSFTSTATDRTFTSSSARSSLARSSLTLSFNDRLSTATTPSTTTSSAATTLHHRRYDPHWTSIRAATTLSSDGRLHLRHFKLVRHLGTGNLGRVFLCHLRDCPNPTGFALKVIDRDVLTAKKISHVETEAEILSLLDHPFLPTLYARIDASHYTCLLIDYCPNGDLHSLLRKQPNNRLPISPVRFFAAEVLVALEYLHALGIVYRDLKPENILIREDGHIMLSDFDLCFKADVVPTFRSRRFRRTSSSPRKTRRGGGCFSTEVEFEREEIVAEFAAEPVTAFSKSCVGTHEYLAPELVAGNGHGSGVDWWAFGIFLYEMLYGTTPFKGGTKEQTLRNIVSNDDVAFTLEEEGMVEAKDLIEKLLVKDPRKRLGCARGAQDIKRHEFFEGIKWPLIRNYKPPEIRGLVKKTKAHAGHVTAAVTPRRNKWLWWALSHLLRSKSLSKSSSKIQSNNNYYHYVGKKL

SEQ ID NO: 25980 - protein, 131 aa, Rhizobium leguminosarum
MSLLEKFERYPLTFGATPIEHLPRLTAALGGKVEIYAKRDDCNSGLAMGGNKLRKLEYIVPDAIASGADTLVSIGGVQSNHTRMVAATAAKIGMKCVVIQEKWVPHYDAVYDRVGNILMTRLMGADSRLVD

SEQ ID NO: 25981 - protein, 275 aa, Unknown
  uncultured bacterium
QPNAMGGREVGGLSNQLAAHMDIDNEVHRGIVQRFWNSPGIADKQGLKAVDLFEAIHDGKIKAVWIMSTNPVVSLPGADRVKSALEKCEYVVVSDCMEKTDTTSLANVLLPAATWGEKNGTVTNSERCISRQRSFLSSPGEAKPDWWAVAEVARRMGFVDGFDYAAPHEIFREHAELSGFENQDSSEKRRDFDISALTDIDSDMYENFDPVQWPVYKNAQGAITGTPRMFADGKFFTPNQKARIITVEPRLPVNNTSTEFPLILNTGRCRDQWHT

SEQ ID NO: 25982 - protein, 266 aa, Unknown
  uncultured bacterium
QPNAMGGREVGGLANMLAAHMELDNEAHRDIVQTFWQSPKIVNKPGLKAVDLFNAIDEGTIKAVWIMATNPAVSMPDADKVREALYKCEFVVVSDIMQSTDTTACAEVLLPALGWGEKDGTVTNSERRISRQRAFLSAPGEAKADWWVICQVAKRMGYAKAFEYKNSYEIFKEHARLSGYENQGTRDFDIASLADQTFQQYDEILPVQWPTQGHQGTARMFTTSRFYTPNKKARFIPVTPRLPVNLTSGAYPLILNTGRVRDQWHT

SEQ ID NO: 25983 - protein, 501 aa, Oryza sativa
MDPTPQSHPILAYVLSRLPSLLPVSPSLSTPRARDIEQPSPRAPSGAAEFDLVSRMPGLRHPSVLSAMTRAVADVSSARDALRLLGPRPDHELVDSARAFLRSHAAEEAEEEEEDEKVAKSREVVRLDEAHESYGGLLREAEERLDRVYRTAMRGRDMQVVAAAHGGGGEEEAGVVDDEVVRVLRDAEEGKAVERLLLADRQLRHLPEQLGRIRGLLVLDVSRNQLKNVPDAIGGLEHLEELRLASNALVSLPDSIGLLTSLKILDVSGNKLRSLPDSISKCRSLVELDVSYNVLSYLPTGIGQEMARLEKLWVHLNKLRSLPSSVCEMRSLRLLDAHFNQLRGLPAGIGRLAALESLNLSSNFSDMRDLPASFGDLLGLRELDLSNNQIHALPDCFGRLQRLERLRLDQNPLAVPPKEVVAGGVGAVKEYMARRWRDARAEEERRGSAVAESPRVSTPKEWLVRSVSSLGSWVSDVTRYGAGQDKAAAEEEEDAYLQQNL

SEQ ID NO: 25984 - protein, 267 aa, Unknown
  uncultured bacterium
QPNAMGGREVGGLANQLAAHMDFSEQDIETVKTYWNSPNIAKQPGLKAVDMFNAITSGQVKAVWIMATNPLVSMPEADKVRQALKQCELVIVSDCVKQTDTTELADVLLPALAWGEKDGTVTNSERRISRQRAFLPTPGEAKADWWIINEVAKRMGFNDAFNYQSPDEIWREHAALTAANNDGQRDFDLTGLKDLSKSDYSRLQPVQWPCRDNSSTDKNHMFEDRHFFHPDKKARFIPVKSCGDFPKASVEYPLILNSGRIRDQWHT

SEQ ID NO: 25985 - protein, 189 aa, Legionella pneumophila
MTIPDKIKAVYEKSTCLYTSNEVEAALDRMAIKIHETLQDKNPVIICVMVGGLVPLGNLLHRLDFPLEVDYVHATRYRGDLTGGDILWKVRPSSNLAGRTVLVVDDILDGGITLAAIINEIKAMGAAEVYSAVLVDKYRKRVPNGLQKADFVGLQVEDHYIFGYGMDYHEYLRNAPGIFIVHPDHEASK

SEQ ID NO: 25986 - protein, 568 aa, Clarkia arcuata
MASPALISETEAWKDLKAHLEGIKRTHLRELMGDTERCQSMMVEFDNIFLDYSRQQASSDTINKLYKLADAAHLKQKIDRMYNGDHINSTENRSVLHVALRAPRNSAICSDGKNVVPDVWNVLDKIKDFSDRVRNGSWIGATGKKLKDVIAVGIGGSFLGPLFVHTALQTDPEASKNARGRELRFLANVDPIDVARNISGLNPESTLVVVVSKTFTTAETMLNARTLREWISSALGPSAVAKHMVAVSTNLPLVEKFGIDPINAFAFWDWVGGRYSVCSAVGVLPLSLQYGFAVVEKFLQGAHSIDQHFSSASFEKNIPVLLGLLSVWNVSFLGYPARAILPYSQALEKLAPHIQQVSMESNGKGVSIDGLPLPFESGEIDFGEPGTNGQHSFYQLIHQGRVIPCDFIGVVKSQQPVYLKGEVVNNHDELMSNFFAQPDALAYGKTPEQLKKENVSEHLIPHKTFTGNRPSISILLPTLDGYRIGQLLAIYEHRVAVQGFVWGINSFDQWGVELGKSLATQVRKQLHASRVKGEPVEGFNFSTKTLLERYLEATSDVPADPSTLLPNI

SEQ ID NO: 25987 - protein, 1411 aa, Mycobacterium avium
MAPENAVNTMCAYCGVGCGMVLQITTDPQTGRRHVAKSVGNKEHPANFGRLCTKGATTADLLAAPGRMDSAHARAGRGEPLEPIDTDQAITRCAKQLRAIIDEHGPDAIAMYVSGQMSLEAQYLANKLTKGFIGTNQIESNSRLCMASAGSGYKLSLGADGPPGSYQDFEHADVFFVIGANMADCHPILFLRMMDRVKAGAKLIVVDPRRTATAEKADLFLQIAPGTDLALLNGLLHLIVENGHTDREFIAEFTEGWEVMPSFLEQYTPDRVSEITGIPEQDIRAAAQLIGEADNFMSCWTMGLNQSTHGTWNTNAICNLHLATGAICKPGSGPFSLTGQPNAMGGREMGYMGPGLPGQRSVASVADREFVEDVWGVPRGRLRTEVGTGTVDMFSRMADGQIKACWIICTNPVASVANRKTVLAGLERAELVIAQDAYLGTETSEYADVLLPAALWAETEGVMVNSERNITLSQPAVAAPGGAMPDWQIIARIACEMGFSEAFSYSCAEEVFEEIKRFWNPTTGYDLRGVSYERLRRQPLQWPCPPQSTADRNPIRYLNDGVSQTQLVREDGTVPRLAFPTPSGRAVFFARPHLQPEEMPDDDYPFLLNTGRLPHQWHTMTKTGKVAKLNKLNPGPFVEIHPDDAARLGIGEHDRVEIASRRGRAVLPAVVSDRVRPGNCFAPFHWNDAFGEYLSINAVTNDAVDPISNQPEFKACAVTLTKVAVSHPDSAIGTGPSAGHDTPESSPTEVREISVSQVDALGELLGVATSFKPEFNELGRSYLAGMLTGLRSDVGRRAGGVPTLPPSAPFDSRTRLWVDGLLAGLFSRADASQQAALPEPPQPAAQQPPAAPAGATPAPERAPVVVLWASQTGNAEELAADVAAQLAAAELPVALHSMDDFPAAELAATRELLLITSTTGDGDAPDNGSGLWRALTGDAAPRLGNTRYAVLALGDSNYDDFCGHGRKLDARLAELGATRIAERVDCEPDYEQAAAKWVADVIDALTRTPTAVGGDGGATVSARTSPVAAPSRPNTPAPHTYSKKHPLITDMVRNTTLNGPKSTKDVRHLVFNLPEDAVSYEAGDALGVWPRNSDELVDEWLAVTGLDGQTPVEVGEHGLMSLRSALTERIEIAHISRDLVRFVQERTGDAKLAELLKPENKRALADWTWGRQSIDLLAQLPVSASAHEWLRVLKRLQPRLYSISSSPKACPGEVHLTVSPVRYNFQGVPRRGVCSTYLAARSPGDRVAVYLQPSSNFRPPSDPDTPMIMIGPGTGIAPFRGFLQERRALGHRGPNWLFFGEQHAATDFYYRDELEQMREDGFLTELDLAFSRDQQHKVYVQHLMRNRGKQLWSWLQDGAQLYVCGTADPMAKDVDRALCDIAAEFGNLDPDAAKAYVQSLSADKRYHRDVY

SEQ ID NO: 25988 - protein, 569 aa, Clarkia concinna
MASPALISETEAWKDLKSHLEGIKKTHLRELMGDTERCQSMMVEFDNIFLDYSRQQASPDTISKLYKLADEAHLKQKIDRMYNGDHINSTENRSVLHVALRASRNSAISSDGKNVVPDVWNVLDKIKDFSDRARNGSWVGATGKELKDVIAVGIGGSFLGPLFVHTALQTDPEASKNARGRELRFLANVDPIDVARNISGLNPETTLVVVVSKTFTTAETMLNARTLREWISSALGPSAVAKHMVAVSTNLPLVEKFGIDPNNAFAFWDWVGGRYSVCSAVGVLPLSLQYGFAVVEKFLQGAHSIDQHFSSAPFEKNIPVLLGLLSVWNVSFLGYPARAILPYSQALEKLAPHIQQVSMESNGKGVSIDGLPLPFESGEIDFGEPGTNGQHSFYQLIHQGRVIPCDFIGVVKSQQPVYLKGEVVNNHDELMSNFFAQPDALAYGKTPEQLKKENVSEHLIPHKTFTGNRPSLSILLPTLDAYRIGQLLAIYEHRVAVQGFVWGINSFDQWGVELGKSLATQVRKQLHASRVKGEPVEEGFNFSTKTLLTRYLEATSDVPADPSTLLPNI

SEQ ID NO: 25989 - protein, 568 aa, Clarkia franciscana
MASPALISETEAWKDLKAHLEGIKTTHLRELMGDTERCQSMMVEFDNIFLDYSRQQASPDTINKLYKLADAAHLKQKIDRMYNGDHINITENRSVLHVALRAPRNSAICSDGKNVVPDVWNVLDKIKDFSDRVRNGSWIGATGKELKDVIAVGIGGSFLGPLFVHTALQTDPEASKNARGRELRFLANVDPIDVARNISGLNPETTLVVVVSKTFTTAETMLNARTLREWISSALGPSAVAKHMVAVSTNLPLVEKFGIDPINTFAFWDWVGGRYSVCSAVGVLPLSLQYGFAVVEKFLQGAHSIDQHFSSAPFEKNIPVLLGLLSVWNVSFLGYPARAILPYSQALEKLAPHIQQVSMESNGKGVSIDGLPLPFESGEIDFGEPGTNGQHSFYQLIHQGRVIPCDFIGVVKSQQPVYLKGEVVNNHDELMSNFFAQPDALAYGKTPEQLKKENVSEHLIPHKTFTGNRPSLSILLPTLDAYRIGQLLAIYEHRVAVQGFVWGINSFDQWGVELGKSLATQVRKQLHASRVKGEPVEGFNFSTKTLLTRYLEATSDVPADPSTLLPNI

SEQ ID NO: 25990 - protein, 568 aa, Clarkia mildrediae
MASPALISETEAWKDLKAHLEGIKRTHLRELMGDTERCQSMMVEFDNIFLDYSRQQAIPDTIKKLYKLADAAHLKQKIDRMYNGDHINSTENRSVLHVALRAPRDSAICSDGKNVVPDVWNVLDKIKDFSDRVRNGSWIGATGKELKDVIAVGIGGSFLGPLFVHTALQTDPEASKNARGRELRFLANVDPIDVARNISGLNPETTLVVVVSKTFTTAETMLNARTLREWISSALGPTAVAKHMVAVSTNIPLVEKFGIDPNNAFAFWDWVGGRYSVCSAVGVLPLSLQYGFAVVEKFLQGAHSIDQHFSSAPFEKNIPVLLGLLSVWNVSFLGYPARAILPYSQALEKLAPHIQQVSMESNGKGVSIDGLPLPFESGEIDFGEPGTNGQHSFYQLIHQGRVIPCDFIGVVKSQQPVYLKGEVVNNHDELMSNFFAQPDALAYGKTPEQLKNENVAEHLIPHKTFTGNRPSLSILLPTLDAYRIGQLLAIYEHRVAVQGFVWGINSFDQWGVELGKSLATQVRKQLHGSRVKGEPVEGFNFSTKTLLTKYLEATSDVPADPSTLLPNI

SEQ ID NO: 25991 - protein, 183 aa, Burkholderia xenovorans
MNREEALHIFSHSEEIVSADDVNASISGMAAAIRDEMSEDFPLVLSVMGGAAVFTGMLLPHLDFPLEFDYIHLTRYRNTTKGGNEMQWRVAPAESVKDRVVLVLDDILDEGETMAAIRDRILAMGAKRFLSAVLCEKIIPKAKPLRPDYCGFEVPDRYVFGCGMDAKGYWRNLPTIRALTEGA

SEQ ID NO: 25992 - protein, 311 aa, Aspergillus oryzae
MGLFSSAEPPLTEANLSNQSGMTFVVTGATSGYGLHLATILYQHGGKVYLAARNASRAQSVIDDITRRHPESKGQLVYLHLDLGDLSTIKKSAEEFLTKESKLHVLWNNAGVMIPPQGSTTAQGYELQLGTNVIGPFLFTKLLYPALAKAAADSPPNSVRVVWLSSSAVRMAPTPAIDFSNMDYHKDEGAWTKYGRSKAANVLLAVEFARRSKKDGVASIVGPLKRISPAENNALLASRCRVGQRPEVGAYTELFAGLQPDIDPVNSGNWSLTCRVVVPPGRVVAGRKDLYDPELSEKFWQWNEEQVRSYL

SEQ ID NO: 25993 - protein, 417 aa, Oryza sativa
MNEKNPRPLDEDDIALLKTYGLGPYSTSIKKVEKEIKEMAKKINDLCGIKESDTGLAPPSQWDLVSDKQMMQEEQPLQVARCTKIISPNTDDAKYVINVKQIAKFVVGLGDKVSPTDIEEGMRVGVDRNKYQIQIPLPPKIDPSVTMMTVEEKPDVTYNDVGGCKEQIEKMREVVELPMLHPEKFVKLGIDPPKGVLCYGPPGTGKTLLARAVANRTDACFIRVIGSELVQKYVGEGARMVRELFQMARSKKACIVFFDEVDAIGGARFDDGVGGDNEVQRTMLEIVNQLDGFDARGNIKVLMATNRPDTLDPALLRPGRLDRKVEFGLPDLEGRTQIFKIHTRTMNCERDIRFELLARLCPNSTGADIRSVCTEAGMYAIRARRKTVTEKDFLDAVNKVIKGYQKFSATPKYMVYN

SEQ ID NO: 25994 - protein, 264 aa, Guillardia theta
MKFYLRLYENIVPSVGEIVQGLVREIKSFGSYVELYEYGNIESMLLFSEISRKKIKFIKKFVKEGNKEILVVIRTFPEKGYIDVSKKQITQNEMNSMSYKSNFNRIFLSLLNDLKRIKKLSIEDFNIRLSWIISRKFNHPTSGFLKLFNNDANFFKSLDYKKDEYIRILNYLKTRIHLKIWKIEVQFQFLSFEVDGLDKIKKINEYLKIFNSLNSGRIRINSSPNYSLVVETKSYKNALNEIKQFFLKMKFFIANLNLNFSFLE

SEQ ID NO: 25995 - protein, 308 aa, Bacillus clausii
MEVYRHIHELIGSTPMLELTAFPLPRRVRLFAKLEYTNPGGSIKDRLGIKLLKEAIATGKITPKGTLIEPTAGNTGIALALAAIGTDVKVICVVPKAFSIEKQQLMRALGAVIVHTPSEHGMKGAIAKAKALEQELDDAYCPQQFSNKANPLAYYETLGPEIVHELDGKVDVFVAGAGTGGTFSGTAAYLKEVIPGIRTVVVEPEGSILNGGEPGPHRTEGIGMEFIPDFVNRSLFEAIYTISDNQAFKRTRELAEHQGVLVGSSSGAALEAALREAEMADEGAHIVTVFPDGAERYLSKGIYEEEPL

SEQ ID NO: 25996 - protein, 372 aa, Burkholderia xenovorans
MRSVIADSRRLVVKVGSSLVTNDGRGLDHAAIGRWAGQIAALRAQGKEVVLVSSGAIAEGMQRLGWTRRPREIDELQAAAAVGQMGLAQVYESRFAEHSIQTAQILLTHADLADRERYLNARSTLLTLLRLGVVPIINENDTVVTDEIKFGDNDTLGALVANLIEGDALVILTDQQGLFTADPRKDPAATLVQQADAGAPELEAMAGGAGSSLGRGGMLTKILAAKRAAHSGANTVIASGREVDVLSRLASGEAIGTQLIARTARMAARKQWMADHLQVRGHVVIDDGAVEKLTEGGKSLLPIGIVGVQGAFARGEVIACLSAAGREVARGLTNYSSAETKLIQRRPSGEIESVLGYMLEPELIHRDNLVLV

SEQ ID NO: 25997 - protein, 276 aa, Wolbachia endosymbiont
VTVRDLAESGVHFGHKISRWNAKIAPYIYGVHQENRIHIIDLRKTLPLLQVAMKVLYDVAFQGGRILFVGTKFQAFDIIASEAIRCGQYYVNHRWLGGMLTNWGTVSSSIKTLMQYEKILNDEDSILTKKELGNIEKKKQKLDKALGGIREMGAIPDILFIIDTNKEHIAVKEAKKLGIPIVAILDTNSDPDGITYLIPGNDDSRKSIELYCKLATDSILAGIESSLAKSGVKIDDIRGDEFIQEKEDGIVQTKRRRSKVYKEEEREVVTNEDESR

SEQ ID NO: 25998 - protein, 413 aa, Nicotiana tabacum
MAGLAPEGSQFDARQYDAKMTELLGTEQEEFFTSYDEVYDSFDAMGLQENLLRGIYAYGFEKPSAIQQRGIVPFCKGLDVIQQAQSGTGKTATFCSGVLQQLDYSLVECQALVLAPTRELAQQIEKVMRALGDYLGVKVHACVGGTSVREDQRILQSGVHVVVGTPGRVFDMLRRQSLRPDHIKMFVLDEADEMLSRGFKDQIYDIFQLLPPKIQVGVFSATMPPEALEITRKFMSKPVRILVKRDDVTLEGIKQFYVNVDKEEWKLETLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRFGRKGVAINFVTKDDERMLFDIQKFYNVVIEELPANVADLL

SEQ ID NO: 25999 - protein, 614 aa, Unknown
  uncultured archaeon GZfos18F2
MAHARLSIIDLAGGDQPIHNEDRSIWIVFNGEIFNYPELRKELKSRGHRFYTRSDTEVLVHLYEDHGPEFIHELNGQFAIALWDVRKKQLLLARDRMGIRPLFYFEKAGRLVFASEIKGLLADDRVPRTLDLKALSDIFTCWSPFGALTPFESVRQLLPGHYAMFSSNGMQIRSYWQPVFSAPPSKERSLDDWTEELNGLLYDAARIRLRADVPVGAYLSGGLDSTYISSLVKRSFNNRLCTFSVGFTDERFDETSFQEKAVQSLETDHRIVRCSERDIGKVFPQVIWHTETPILRTAPAPLFMLSGLVRENNFKVVLTGEGADEVFAGYNIFKEDRVRRFWARQPDSKLRPLLLERLYPYIFSRKNSRTRVFLENFFRKSLIQVDSPCYSHLIRWNNTALLKAFFSDELQAMAGKPPDFEERFISTLPSDFMSWDPLSRSQYTEMTIFLANYLLSSQGDRMAMGHSVEGRFPFLDHRVVEFACSMPPEYRLNGLKEKYILKHASRDLIPPELRRRPKQPYRAPISRCFFGKGSPDYVGELLSENAIRRAGYFHPKKVGRLVDKCQKQEGHLASERENMAVAGILSTQLLDHLFLRNFPPHPIQEPENVRVFGL

SEQ ID NO: 26000 - protein, 691 aa, Unknown
  Synechococcus sp. CC9311
MSTIHRGSPWPLGSTITPRGVNFSVAAPTANRLELLIFSHPEAKTPEQVIELSEEHRSADYWHVEVEGVGAGCCYCYRVFGPIEPGGHGFRPAKVLVDPCARAIDGWNIYQRAAATGASPNTDRCLKSVVCERDPFDFQAHPRPRHSWQETVIYELHIGGFTKRPDSGVSPDQRGTYLGVIEKIPYLKELGVTTIELLPIQAFDPNDAPAGRDNVWGYSPLSWFAPHHEYATGSDPHSARDQVRDLVAACHDEGIEVLLDVVYNHTTEGNRNGPTLSWRGFADRNYYHQSDAGEYMDVSGCGNSIAANDPLSRQLILESLRCWSNELGIDGFRFDLGIALSRGEKLKPLEHPPLFEAMEADPQLSELKLVSEPWDCGGLYRLSDFPAKRIGTWNGHFRDALRSFWKGDEGSTWPLGQRFRGSPDLYNGKAASLGSSVNLITAHDGFSLLDLVSFNNKHNLANGENNRDGENHNNSWNHGVEGPSSDRAIQTLRRRQQRNLLSTLLLSRGVPMLLMGDEVGRSQGGNNNTWCQDSPLSWMIWGDDHCDHELQAYVQRLLNVRQQLAVLFNPIRPHIEKKPLRSNDSDELWRQWHGVELSKPDWANWSHCLAMSLQQGHQGAVLWMGFNAYFKSMHFDLPEAASPWCRLIDTALPAGEDLPTRIERWSPSGVPLEARSLVVMVAQEYADRLSL

SEQ ID NO: 26001 - protein, 186 aa, Bordetella parapertussis
MSSSQPAGPATEAAVLGGGCFWCVEAVFKDLRGVTGIEPGYAGGHVEHPTYEQVCGKDTGHIEVARVEFDPAVLSYGDLLRVFFATHDPTTPGRQGNDVGPQYESAIFWQDERQREQAQAVMDELRAQQVFDAPIVTRLLAPAKFWPAEDYHRDYYALHPEQGYCQFVIAPKVAKFRKQFQDRLAR

SEQ ID NO: 26002 - protein, 156 aa, Exiguobacterium sibiricum
MGYISELRQLIGSRPIISVGATVLVTNDQQEVLFQHRSDTLDWGLPGGSMELGETLEEVAIRELQEETGLHTNQLELIGVFSGPRFYYQYPNGDEVHGVIHLYHAQNVTGTLAMLDGESLDLAYFSQATIPESIESRANELMQQLGDSFWTLGSSF

SEQ ID NO: 26003 - protein, 482 aa, Unknown
  Photobacterium sp. SKA34
MKGDIGVIGLAVMGQNLILNMNDHGFNVVAYNRTVAKVEEFLEGPAKGTNIIGATSLEDLVAKLEAPRKVMLMVRAGDVVDAFIDQLIPLLDEGDIIIDGGNTNYPDTNRRVAHCREKGIYFIGTGVSGGEEGARFGPSIMPGGAPEAWEAVKPIFQGISAKTDAGEPCCDWVGNDGAGHFVKMVHNGIEYGDMQLITEAYQFMKDGLGMSADEMQAVFADWNKTELDSYLVEITADILGYKDEDGEALVEKILDTAGQKGTGKWTGINALDLGIPLTLISESVFSRCLSALKDQRVEAATLFGKTITPVEGDKQEWVDALRQALLASKIISYAQGFMLMREASNENGWDLNYGNVALMWRGGCIIRSAFLSNIRDAYEANPDIAFLGSDEYFKNILQSSLAAWRKVAAKSLESGIPMPCTISALSFLDGFTTARLPANLLQAQRDYFGAHTYERTDRPRGEFFHTNWTGTGGNTASTTYDV

SEQ ID NO: 26004 - protein, 102 aa, Guillardia theta
MTDKITKKKRNETYSIYIYKVLRQVHPKIGVSSKAMNIMNSFVNDLFERLVSESYNLSNSSRSKTLTAREIQTSVRLVIPGELAKHSVSEGTKAVAKYRSSI

SEQ ID NO: 26005 - protein, 117 aa, Impatiens niamniamensis
CYVQCGYCTTILLVSVPCSSLSMVVTVRCGHCTSLLSVNMTKSTFLPLHLLASMSPDEPKFDASPTVLKEGENDQNPTDKRSSSHIMSSDDEDDDLIPLNHVVNKPPEKRQRAPSAY

SEQ ID NO: 26006 - protein, 356 aa, Vigna aconitifolia
MSLLSDLINLNLSDTTEKIIAEYIWIGGSGLDLRSKARTLPGPVSDPSKLPKWNYDGSSTGQAPGEDSEVIIYPQAIFKDPFRRGNNILVMCDAYTPAGEPIPTNKRHNAAKIFSHPDVVAEEPWYGIEQEYTLLQKDVNWPLGWPVGGFPGPQGPYYCGAGADKAFGRDIVDAHYKACLYAGINISGINGEVMPGQWEFQVGPAVGISAGDELWVARYILERITEIAGVVLSFDPKPIKGDWNGAGAHTNYSTKTMRNDGGYEVIKSAIEKLGKRHKEHIAAYGEGNERRLTGRHETADINTFLWGVANRGASIRVGRDTEKAGKGYFEDRRPASNMDPYVVTSMIADTTILWKP

SEQ ID NO: 26007 - protein, 370 aa, Saccharomyces cerevisiae
MAEASIEKTQILQKYLELDQRGRIIAEYVWIDGTGNLRSKGRTLKKRITSIDQLPEWNFDGSSTNQAPGHDSDIYLKPVAYYPDPFRRGDNIVVLAACYNNDGTPNKFNHRHEAAKLFAAHKDEEIWFGLEQEYTLFDMYDDVYGWPKGGYPAPQGPYYCGVGAGKVYARDMIEAHYRACLYAGLEISGINAEVMPSQWEFQVGPCTGIDMGDQLWMARYFLHRVAEEFGIKISFHPKPLKGDWNGAGCHTNVSTKEMRQPGGMKYIEQAIEKLSKRHAEHIKLYGSDNDMRLTGRHETASMTAFSSGVANRGSSIRIPRSVAKEGYGYFEDRRPASNIDPYLVTGIMCETVCGAIDNADMTKEFERESS

SEQ ID NO: 26008 - protein, 205 aa, Impatiens niamniamensis
CGYCTTILLVSVPCSSLSMVVTVRCGHCTSLLSVNMTKSTFLPLHLLASMSPDEPKFDASPTVLKEGENDQNPTDKRSSSHIMSSDDEDDDLIPLNHVVNKPPEKRQRAPSAYNNFIKEEIRRLKARNPSMSHKEAFSAAAKNWAQFPPIDQYKRDEEIRCSQGAEREISGETHHVGNEFHSKNNLRYSEWETTTSTTFDRKYCP

SEQ ID NO: 26009 - protein, 352 aa, Alnus glutinosa
MASTLTSKPQRLALFENSASSFYGTPLAPSSIRVQPTKAGAKPSISMSGAPSPPYDLKAFTFDPIKESIVSREMTRRYMMDMITYADTDVVVVGAGSSGLVCYELSKNPSVQVAIIEQSVSPGGGAWLGGQLFSGMVVRKPAHLFLDELGIEYDEQDNYVVIKHAALFTSTIMSKLLARPNVKLFNAVAAEDLIVKGGRVGGVVTNWALVSMNHDTQSCMDPNVMEAKVVVSSCGHDGPFGATGVKSLRSIGMIDTVPGMKALDMNVAEDAIVRLTREIVPGMIVTGMEVAEIDGAPRMGPTFGAMMISGQKAAHLALKALGLPNALDGSYVGGIHPELILAAADSAEIADA

SEQ ID NO: 26010 - protein, 267 aa, Unknown
  uncultured bacterium
QPNAMGGREVGGLANQLAAHMGFSEQDIETVKTYWNSPNIARQPGLKAVDMFNAITSGQVKAVWIMATNPLVSMPEADKVRQALKQCELVIVSDCVKQTDTTELADVLLPALAWGEKDGTVTNSERRISRQRAFLSTPGGAKADWWIINEVAKRMGFNDAFNYQSPDEIWREHAALTAANNDGQRDFDLTGLKDLSKSDYSRLQPVQWPCRDNSSTDKSHMFEDRHFFHPDKKARFIPVKSCGDFPKASVEYPLILNSGRIRDQWHT

SEQ ID NO: 26011 - protein, 318 aa, Haemophilus influenzae
MSDTKHAKLLILGSGPAGYTAAIYAARANLKPVLVTGLQQGGQLTTTDEIENWPGDFEMTTGSGLMQRMLQHAEKFETEIVFDHINRVDLSSRPFKLFGDVQNFTCDALIIATGASARYIGLPSEENYKGRGVSACATCDGFFYRNKPVGVIGGGNTAVEEALYLANIASTVHLIHRRDSFRAEKILIDRLYKKVEEGKIVLHTDRTLDEVLGDNMGVTGLRLTDTKTGEKEELKLDGLFVAIGHSPNTEIFQGQLELNNGYIVVKSGLEGNATATSVEGVFAAGDVMDHNYRQAITSAGTGCMAALDAERYLDAQEA

SEQ ID NO: 26012 - protein, 376 aa, Coprinopsis cinerea
MPENTQKKTVLVLGAGNFGSCLASHLGDVQHNVYMWAREENIVKHFNEHKRNPVYLQDHEFPRNITAIGPELPTKEFIATMDVLIFAIPTQANLEALRPRLDTANLPLLIFVNKGIEIGTHALTLEIIADTCGSEIAKASTFISGPSFAKEIVQRQPTSVSVASFTEEEADKAANLFHQPHFRCYTGGDPIGIELSGALKNVYAIAAGMSDGLGFENNTRAMIITRGLAEMTCIGTAYGASPLTFLGLSGVGDLFLTCSSSNSRNYTVGYRLGKGESLDVIMKTLGSVAEGVSTTKGAKKIIDELGVNAPIANSVYDVLYNGKDTRAAMSDLLKLPPSRELELPPIIGGPARQLNKKLGLGTPEAVTPPLQFQSSL

SEQ ID NO: 26013 - protein, 152 aa, Zea mays
MCRGLPTPAPAPALQFQSQDCSRQQRGTTQAPPGRASESVRACMAAERKAASRPAACGRMRGAEGAKPRGRQAKAARAPPGQGYFTAGLAALFLCLTTLLVFLPLVLPPLPPPPLLLLLVPVGLMAVLLALALVPSDGRAAAAAVASSSCVC

SEQ ID NO: 26014 - protein, 238 aa, Unknown
  Synechococcus sp. RS9917
MLPSWLTGQPAAADAGTAERHAVLKTPLHAPLMDDQEEALFGCGCFWGAEKGFWRLPGVVTTTVGYAGGTSPSPSYQQVCSGRTGHAEIVRVVWSTPAIDFSDLLKLFWECHDPTQGDRQGNDRGSQYRSAIFTTTAQQLELAQASKEAYQQALSERGLGRITTDIRPDQTYYPAETYHQQYLAKPGSRPYCSAMPTGVPLGAFPGAAYKLPARVWSHYDWSIDHCVLRGDNAPIQLA

SEQ ID NO: 26015 - protein, 268 aa, Unknown
  uncultured bacterium
QPNAMGGREVGGLANQLAAHMSFNAEDLNVVREFWQAPNPAEKEGLKAVDLFDAIHSGKVKAVWIMGTNPVVSMPNANKIKEALNKCEMVVVSECNADTDTARLANVIFPSSTWGEKQGTVTNSERTISLQRGFLPIPGEAKNDWEIICEFAKTMGYGEAFNYASAAEIFAEHAALSGFKSEKFSSRAFNISKYANITAKEYNALKPVQWPLKDTQDTGTKRLFSDGKFFTDNQKAKFVVIEARLPKVSPKKNQFIMNTGRIRDQWHT

SEQ ID NO: 26016 - protein, 174 aa, Staphylococcus epidermidis
MAYATLAGGCFWCMVKPFTSYPGIKSVVSGYSGGHVENPTYEQVCTNQTGHVEAVQIEYDPNITTFENILDVYFKTFDPTDDGGQFFDRGESYQPVIFYHDENQLKAAELKKQQIDEEGIFKKPVITPIKPYKNFYPAEEYHQDYYKKNPTHYEQYQRGSGRKAFIESHWGGSK

SEQ ID NO: 26017 - protein, 271 aa, Unknown
  uncultured bacterium
QPNAMGGREVGGLANTLAAHMDYDSPGARSRVADFWGTGAVADGPGYKAVDMFEAVHRGDIRVIWIMGTNPAVSLPDSARVREALARCPTVIVSDCVAHTDTTDLADILLPAAGWGEKDGTVTNSERRISRQRCFLPLPAEVKPDWWIMSSVAGKLGFGEAFNYKRPADIFREHAALSAHENNGERLFNLAGLANLSDAGYEALIPVQWPVMEGAGVEAEGSTRLFSDGRFVTDNQRARFVAINTRLPAQQTSDDYPMVVNTGRIRDQWHT

SEQ ID NO: 26018 - protein, 493 aa, Candida albicans
MTETSISGLRGPKSMYFMEIVDVSSQESSVLSSIVESFTSAVSASNLGVYSEEVLCDIKSSLKENSPITMLPNYNVSPTGNEHGQYLVIDLGGSTLRIAVVDISKPHPNLSRSERITIVVEKSWIIGNDFKRIDGEFFKYIGSKINEILVGQNVIDVKSVINTGITWSFPLETTDYNRGKIKHVSKGYTVGEDIYDKDLKMVLEDTLRQEYGLTLDVQSILNDSLAVYSAGCFIDSKMKLAMVLGTGINMCCSLKRSSDIHPSKMLADATLFNCELSLFGQNLCKDFATKYDIIIDKRFAGFSHHFKTFMEPDPITKTLFQPHELMTSGRYLPELTRLVVVDLIEAGEIFQNVDHQQMYQEYGGFSGELMCFVHENDDYDDIHDKLCKAYGWTTVGLSDIVSLKEVVSCIIKRAAFIVANAIIAFFKLLGSDELGGDVTIGYVGSVLNYFHKYRRLIVEYVNNAEEAKGIKVDLKLIENSSIIGAAIGAAYHK

SEQ ID NO: 26019 - protein, 570 aa, Clarkia rostrata
MASPALISETEAWKDLKAHLEGIKMTHLRELMGDTERCQSMMVEFDNIFLDYSRQQASPDTISKLYKLADEAHLKQKIDRMYNGDHINTTENRSVLHVALRAPRNSAICSDGKNVVPDVWSVLDKIKDFSDRVRNGSWIGATGKELKDVIAVGIGGSFLGPLFVHTALQTDPEASKNARGRELRFLANVDPIDVARNISGLNPETTLVVVVSKTFTTAETMLNARTLREWISSALGPSAVAKHMVAVSTNLPLVEKFGIDPNNAFAFWDWVGGRYSVCSAVGVLPLSLQYGFAVVEKFLQGAHSIDQHFSSAPFEKNIPVLLGLLSVWNVSFLGYPARAILPYSQALEKLAPHIQQVSMESNGKGVSVDGLPLPFESGEIDFGEPGTNGQHSFYQLIHQGRVIPCDFIGVVKSQQPVYLKGEVVNNHDELMSNFFAQPDALAYGKTPEELKKENVSEHLIPHKTFTGNRPSISILLPTLDAYRIGQVLAIYEHRVAVQGFVWGINSFDQWGVELGKSLATQVRKQLHGSRVKGEPVEEGFNFSTKTLLTRYLQATSDVPADPSTLLPNII

SEQ ID NO: 26020 - protein, 101 aa, Camellia sinensis
NNILVMCDTYTPGGEPIPTNKRFNAAKIFSHPDVVAEEPWYGIEQEYTLLQKQVKWPLGWPLGGFPGPQGPYYCGIGVDKAYGRDIVDSHYKACLYAGVNI

SEQ ID NO: 26021 - protein, 568 aa, Clarkia williamsonii
MASPALISETEAWKDLKAHLEGIKMTHLRELMGDTERCQSMMLEFDNIFLDYSRQQASPDTISKLYRLADAAHLKQKIDHMYNGDHINSTENRSVLHVALRAPRNLAICSDGKNVVPDVWNVLDKIKDFSDRVRNGSWIGATGKELKDVIAVGIGGSFLGPLFVHTALQTDPEASKNARGRELRFLANVDPIDVARNISGLSPETTLVVVVSKTFTTAETMLNARTLREWISSALGPSAVAKHMVAVSTNIPLVEKFGIDPNNAFAFWDWVGGRYSVCSAVGVLPLSLQYGFAVVEKFLQGAHSIDQHFSSAPFEKNIPVLLGLLSVWNVSFLGYPARAILPYSQALEKLAPHIQQVSMESNGKGVSIDGLPLPFESGEIDFGEPGTNGQHSFYQLIHQGRVIPCDFIGVVKSQQPVYLKGEVVNNHDELMSNFFAQPDALAYGKTPEQLKKENVSEHLIPHKTFTGNRPSISLLLPTLDAYRIGQLLAIYEHRVAVQGFVWGINSFDQWGVELGKSLATQVRKQLHGSRVKGEPVEGFNFSTKTLLTRYLEATSDVPADPSTLLPNI

SEQ ID NO: 26022 - protein, 271 aa, Unknown
  uncultured bacterium
QPNAMGGREVGGLANTLDRSHGLRSPGARSRVADFWGTGAVADGPGYKAVNMFEAVHRGDIRVIWIMGTNPAVSLPDSARVREALARCPTVIVSDCVAHTDTTDLADILLPAAGWGEKDGTVTNSERRISRQRCFLPLPAEVKPDWWIMSSVAGKLGFGEAFNYKRPADIFREHAALSAHENNGERLFNLAGLANLSDAGYEALIPVQWPVMEGAGVEAEGSTRLFSDGRSVTDNQRARFVAINTRLPAQQTSDDYPMVVNTGRIRDQWHT

SEQ ID NO: 26023 - protein, 568 aa, Clarkia xantiana
MASPALISETEAWKDLKAHLEGIKMIHLRELMGDTERCQSMMVEFDNIFLDYSRQQASPDTISKLYKLADAAHLKQKIDRMYNGDHINSTENRSVLHVALRAPRNSAICSDGKNVVPDVWNVLDKIKDFSDRVRNGSWIGATGKELKDVIAVGIGGSFLGPLFVHTALQTDPEASKNARGRELRFLANVDPIDVARNISGLNPETTLVVVVSKTFTTAETMLNARTLREWISSALGPSAVAKHMVAVSTNLPLVEKFGIDPNNAFAFWDWVGGRYSVCSAVGVLPLSLQYGFAVVEKFLQGAHSIDQHFSSAPFEKNIPVLLGLLSVWNVSFLGYPARAILPYSQALEKLAPHIQQVSMESNGKGVSIDGLPLPFESGEIDFGEPGTNGQHSFYQLIHQGRVIPCDFIGIVKSQQPVYLKGEVVNNHDELMSNFFAQPDALAYGKTPEQLKNENVSEHLIPHKTFTGNRPSISILLPTLDAYRIGQLLAIYEHRVAVQGFVWGINSFDQWGVELGKSLATQVRKQLHASRVKGEPVEGFNFSTKTLLTRYLEATSDVPADPSTLLPNI

SEQ ID NO: 26024 - protein, 569 aa, Clarkia concinna
MATPSLISETEAWKDLKAHLEGIKRTHLRELMGDTERCQSMMVEFDNIFLDYSRQQASPDTINKLFKLADAAHLKRKIDRMYNGDHINSTENRSVLHVALRAPRNSAICSDGKNVVPDVWSVLDKIKDFSERVRNGSWVGATGKELKDVIAVGIGGSFLGPLFVHTALQTDPEASKNAIGRELRFLANVDPIDAAKNISGLNPETTLVVVVSKTFTTAETMLNARTLREWISSALGASAVAKHMVAVSTNLPLVEKFGIDPNNAFAFWDWVGGRYSVCSAVGVLPLSLQYGFAVVEKFLQGAHSIDQHFSSAPFEKNIPVLLGLLSVWNVSFLGYPARAILPYSQALEKLAPHIQQVSMESNGKGVSVDGLPLPFESGEIDFGEPGTNGQHSFYQLIHQGRVIPCDFIGVVKSQQPVYLKGEVVNNHDELMSNFFAQPDALAYGKTPEQLKKENVSEHLIPHKTFNGNRPSLSILLPTLDAYRIGQLLAVYEHRVAVQGFVWGINSFDQWGVELGKSLATQVRKQLHASRVKGEAVEEGFNFSTKTLLTRYLEASSDVPADPSTLLPKI

SEQ ID NO: 26025 - protein, 400 aa, Enterococcus hirae
MNTTINKHALVFGFTSVFLIGLGLTIVNPVIPFMVEQYTKNTQQQATTVTLLSAIYAFSMFLAAPMLGALSDRFGRKIILISSLFGSAIGYYLFGFGGALWILFLGRIIEGLTGGEISAILAYFADLTPIESRTKYFGWISATVGIGTAAGPLIGGFLAQYGPAIPLYVASFLSLSNAVYGYFFMPESLTKRERTRNLSLQQINPFKQLQLVFTFRSVKWLLITGFLIWLPNGSFQAIFAQFSIDTFHLSPIIIGFTFSLIGIMDIFAQLLIMPILLKFWRENQIITMGITSEMIGYSVIILSAFYGSIPCFIIGMVFFGLGDAIFSPSYNGLISTYASKEDQGKIQGASQSIQALARVIGPMIGGQLYANFHHTMPFIIGFILLGLATFIVKPKVKRSP

SEQ ID NO: 26026 - protein, 268 aa, Unknown
  uncultured bacterium
QPNAMGGREVGGLANTLTAHMTLENSDHRALVKEFWQCGDLPDKAGLKAVDLFNAVNEGKVKAIWVMGTNPVVSMPNANLVREALQKCDFVVCSDAVKRTDTLDLAHVKLPAAGWGEKSGTVTNSERRVSRQRAIFPLHGDAKPDWRIVSEVAKRMGFGAASDYQSPREVFVEFAALSGYQNKGERDFDISAYAELAEAEFEAMTPKQWPITAETLDGTPRMFVDGRYFTPNRKAKFIPTIARAPQEKVSDDYPLILNTGRIRDQWHT

SEQ ID NO: 26027 - protein, 569 aa, Clarkia xantiana
MATPSLISETEAWKDLKAHLEGIKRTHLRELMGDTERCQSMMVEFDNIFLDYSRQQASPDTINKLYKLAEAAHLKQKIDRMYNGDHINSTENRSVLHVALRAPRNSAICSDGKNVVPDVWNVLDKIKDFSERVRNGSWVGATGKELKDVIAVGIGGSFLGPLFVHTALQTDPEASKNARGRELRFLANVDPIDAARNISGLNPETTLVVVVSKTFTTAETMLNARTLREWISSALGVSAVAKHMVAVSTNLPLVEKFGIDPNNAFAFWDWVGGRYSVCSAVGVLPLSLQYGFAVVEKFLQGAHSIDQHFSSAPFEKNIPVLLGLLSVWNVSFLGYPARAILPYSQALEKLAPHIQQVSMESNGKGVSIDGLPLPFESGEIDFGEPGTNGQHSFYQLIHQGRVIPCDFIGVVKSQQPVYLKGEVVNNHDELMSNFFAQPDALAYGKTPEQLKKENVSEHLIPHKTFTGNRPSLSILLPTLDAYRIGQLLAIYEHRVAVQGFVWGINSFDQWGVELGKSLATQVRKQLHASRVKGEPVEEGFNFSTKTLLTRYLEATSDVPADPSTLLPKI

SEQ ID NO: 26028 - protein, 374 aa, Clostridium acetobutylicum
MNFKKLGISEALVEVLKKSGITEPTPVQAESISHIKGGRDVIGEAQTGTGKTLAFLLPIFENISPTLSAVQALIVTPTRELALQITEQALKLKEAKDINILAAYGGKDIASQQKKLRGSTHLIIATPGRLLDLIQRKTVDLRKLKSFVLDEADQMLLMGFKNDVEEILKNAPKKRQMLCFSATISPAVKKLAYRYMTNPLTISTKKKEVTLENIEQFVVETTDRKKLEDLCTALKQDNPFMAIIFGRTKRRVDELEVELYRRGFDCQKLHSDLTQTKRERIMKSFRNGDFQYLLATDVASRGLDISGVSHIYNYDVPDNPESYIHRIGRTGRAGEEGYTCLFAAERDKRKLEDIEAAIKFKIPRRDLTGGKNER

SEQ ID NO: 26029 - protein, 493 aa, Synechococcus elongatus
MTATASSASTETFSRADWLRGYESQTEERDYWIDDIEGEIPAELEGTVFRNGPGLLEIGGQSLHHPFDGDGMISAIAIRQGRAYFRNRYVRTEGFLAEQKAGKILYRGVFGTQKPGGWLANIFDLGLKNIANTNILYWGDRLLALWEAAEPHRLDPQTLETFGLDRLDGLLADGDPFSAHPRIDPGSERTGGQRRLVNFAVKTGPSSRIRLYEFDESGRCVEQQERVIPGFAFLHDFALTPNYAIFFQNPIRFNPLPALLGQRTAGQCLASDRNKSTQILVIPRDPKAPLQTFETESCFVFHHANAFETADGAIVVDSVCYDEFPMLEPDRNFKEVDFDSYPRGELFRFTLHPGQPRAERKLLESRTCEFPTQHPRTVGQDARYYYIGAAAAPTGNAPLQSLLKIDLETGDRKLWTVAPRGFIGEPLFVPRPGGIAEDDGWVLSLIYDAARHSSALVILSAQTLEPLARLNLKQHIPYGLHGCFTPQYFGPED

SEQ ID NO: 26030 - protein, 340 aa, Streptococcus agalactiae
MKRIAVLTSGGDAPGMNAAIRAVVRKAISEGMEVYGINQGYYGMVTGDIFPLDANSVGDTINRGGTFLRSARYPEFAELEGQLKGIEQLKKHGIEGVVVIGGDGSYHGAMRLTEHGFPAVGLPGTIDNDIVGTDYTIGFDTAVATAVENLDRLRDTSASHNRTFVVEVMGRNAGDIALWSGIAAGADQIIVPEEEFNIDEVVSNVRAGYAAGKHHQIIVLAEGVMSGDEFAKTMKAAGDDSDLRVTNLGHLLRGGSPTARDRVLASRMGAYAVQLLKEGRGGLAVGVHNEEMVESPILGLAEEGALFSLTDEGKIVVNNPHKADLRLAALNRDLANQSSK

SEQ ID NO: 26031 - protein, 445 aa, Aspergillus oryzae
MFIGGLNWETTDQSLKDYFSQFGEVQECTVMRDSATGRSRGFGFLTFRDPKTVNTVMVKEHYLDGKIIDPKRAIPRDEQEKTSKIFVGGVSQEANEQDFKQFFMQFGRVVDATLMIDKDTGRPRGFGFVTFDSEAAVEAALSRPLEILGKPIEVKKAQPRGNLRDEEDRRNRRGRDGFREGAQIGSDGSQQQGSQGPAGMPGGLTPQMMAQYWQRMQQYFALMQQQMAVAAQGQGMGAMGMGGMNPAMMQQMQMKQMQQMQMGNSQQQGSMSPPSQSQTPQMQNMMNSTMMQQMQQMQNQGQGGQMGNAINIGSSSPGNVSMSGNYSGPRGGPGYNAHEQIAFEQQKYEQQQARRAMENRAFSPYQQGGPTSWEGMYDEVPQPNIPTGPQAMNRAGSMGRGPTPQPQSAAPANAPTGPKNAGKPGANYRGGGRGGHRGFHPYARG

SEQ ID NO: 26032 - protein, 517 aa, Staphylococcus aureus
MSEEKHVVEHEQQKKEKTKKQYKPFWIVMSFIILIVVLLLPAPSSLPIMAKAVLAILAFAVIMWVTEAVSYPVSATLIIGLMILLLGFSPVQNLGEKLGNPKSGSAILAGSDLLGTNHALSLAFSGYATSAVALVAAALFLAAAMQETNLHKRLALLVLSIVGDKTRNIVIGAIIVSIVLAFFVPSATARAGAVVPILLGMIAAFKVSKDSKLASLLIITSVQAVSIWNIGIKTAAAQNIVAINFINHQLGFDVSWGEWFLYAAPWSIVMSVALYFIMIKVMPPEINTIEGGKDLIKEELHKLGPVSPREWRLIVISMLLLLFWSTEKVLHPIDSASITIIALGVMLMPKIGVMTWKHVENKIPWGTIIVFGVGISLGNVLLKTGAAQWLSDQTFGVLGLKHLPIIATIALITLFNILIHLGFASATSLSSALIPVFISLTSTLHLGDQSIGFVLIQQFVISFGFLLPVSAPQNMLAYGTGTFTVKDFLKAGIPLTIVGYILVIVFSMTYWKWLGLL

SEQ ID NO: 26033 - protein, 457 aa, Staphylococcus aureus
MAIAVLLNRMFRMEHNPLFEYIYQQKEDIDACYFIIPEEDMSSASDLKAQFYRGTLQRFYQSLHAEKLTPYVMSYDDIISFCKENNISEVVTAGDIMSYHLEEYDILHQRSLFNEARIAVTLIRGNHYFKASKTMNQQGEPYKVFTSFYKKWRPYLRHRDVYHYDLKSFEDFVIASPDDLVFDDIAFGSSQIIEQNKWQHFLDQDIQNYESGRDYLPEVLTSQLSVALAYGLLDIIEIFNDLLARYDEDEANYEAFIRELIFREFYYVLMTQYPETSYQAFKPKYRQIKWSQNEADFNAWCEGQTGFPIIDAAIMELTQTGFMHNRMRMVVSQFLTKDLFIDWTWGEKFFRKHLIDYDAASNIHGWQWSASTGTDAVPYFRMFNPIRQSERFDAKALYIKTYLPIFNQIDAKYLHDTQRNESNLFEQGIELGSHYPRQIVDHQEKRTQVLATFKALD

SEQ ID NO: 26034 - protein, 259 aa, Sinorhizobium meliloti
MMKFAALQMKSIGGDVAANLARIERAAIGASGEGASLLVAPELAITGYGAGEAIRRLAEPADGRIVRELGRISLKTGIAIVAGFAEQGADAVYNSAVHVDGDAVPVVYRKSHLYGDYERSLFTPAEPSTRLFKHRGVTCGMLICYDVEFPENVRRLALAGADAVLVPTALPAGWSGTFITDHMIQTRAFENQVFVAYVNHCGSDDMFSFAGLSLIASPDGQALAKAGSSDETLIIAEIDPQAFAISRAENTYLMDLKHD

SEQ ID NO: 26035 - protein, 363 aa, Triticum aestivum
  misc_feature (101)..(101): Xaa can be any naturally occurring amino acid
  misc_feature (126)..(126): Xaa can be any naturally occurring amino acid
  misc_feature (156)..(156): Xaa can be any naturally occurring amino acid
  misc_feature (327)..(327): Xaa can be any naturally occurring amino acid
MAAPTSAIGFEGYEKRLEITFSEASIFADPHGRGLRALSRAQIDSVLDLARCTIVSELSNKDFDSYVLSESSLFIYSQKIVIKTCGTTMLLLTIPRILELXEELCMPLAAVKYSRGMFIFPGAQPXAPHRSFSEEVDVLNRYFGHLKSGGNAYVIXGDPAKPGQKWDIYYATEQPEQPMVTLEMCVSGLYNNKASVFFKTQADGHVTCANEMTKLSGISDIIPDMEVCDFDFEPCGYSMNAIDGSAVSTIHVTPEDGLSYTSYEVMGMDASALAYGDIVQRVLRCFGPSEFSVEVTIFCGRGPAATWGNKLQAEAYHCNNVVDQELXPCGGVPHLPGALPANEEGSCLCRGRPRFVFPVASRA

SEQ ID NO: 26036 - protein, 395 aa, Mesorhizobium loti
MFLTFSGRELSREARLDDTTTVAIIGAGPAGLAVAACLRQAGVDFIIIEKEQQAAPAWRRHYERVHLHTTKRYSSLPFVPFPKHYPRYVPRALFVDYLDAYAQRFDLRPQFGETVKAVTQDGRGWRVDAASGPLRAKDVVIASGYNAEPLRPAFAGIDTFTGKTLHSADYRNAKPFAGQSVLVIGMGNTGAEIALDLAENGAQPTISVRGGVHIVPRELFGVPIQMVGMAARLGPQRLNDALFPVILDLVLGRLDKYGLKRPGQGLLEQIAVASRIPVIDVGTIGKIREGAIKVAPDITEISQRGARFADGKHGEFDAIIFATGYRPGYARFLEPGIQPDRSGVTPKASDLGLYLIGFHNAVTGLLREIGIEAQAIADDIRHRLNRKKAAEILPV

SEQ ID NO: 26037 - protein, 251 aa, Rhizobium leguminosarum
MQRFEGKVVLVTGAGSGIGAATVKRLHAEGATVIAVDVTEEGVSKVVQEIGDRTRVEGLALDVCDHSASIETVADVRKRHGALHGLVNCAGIKGVGSIVDVKPESFGRVMAVNLEGTINLCQAFVQAVKDDTGDRAIVNISSGAGVMGVANRLPYVASKFAVSGITKSMSPELGPLGIRVNAVAPGMTKTPFTEYMLQDPAAVERVNAKHPIGRMGEPEEIAAVIVFLLTKDASFMTGAIVAVDGGQTACL

SEQ ID NO: 26038 - protein, 621 aa, Listeria monocytogenes
MCGFVGCVHDRITEITGADKETFRQMNSMITHRGPDDEGYFTDDHVQFGFRRLSIIDVENGHQPLTYENERYWIIFNGEVYNYVELREQLVAEGMTFETESDTEVIIATYAKYKEKTAERLRGMFGFVIWDKQEELVYGARDPFGIKPFFYAEEDDKLFMGSEKKSILHALKEKELDEVSLQNYMTYQFVPEPDSLTKNVKRLEPGHQFTKKIGQPMEITTYWKASFAPVTKSEDAWIKEVRDVMYDSVKMHMRSDVPVGSFLSGGIDSSIIAAIAKEYHPAIKTFSVGFERDGFSEIDVAKETADKLGVENISYVISPEEYMKELPKIVWHMDDPLADPAAIPLYFLSREARKQVTVALSGEGADELFGGYNIYNEPNSLAMFNKMPGVFKSLLNNVARIMPEGMRGKSFLERGTTPMEERYIGNAKMFTEKEKQILLPKYQAGHDYTNITDPFYAETTNYHPVERMQYIDIHTWLRGDILLKADRMTMANSLEVRVPFLDKEVYNVARNIPDTMKTTNGTTKYILRKAAATFVPEHVLNRRKLGFPVPIRHWLKDEMNAWVKNIIKESPTDHLINKQYVLDLLDDHCAGKFDYSRKIWTVVIFMIWYDVYVADKYDFGK

SEQ ID NO: 26039 - protein, 328 aa, Escherichia coli
MPLHNLTRFPRLEFIGAPTPLEYLPRFSDYLGREIFIKRDDVTPMAMGGNKLRKLEFLAADALREGADTLITAGAIQSNHVRQTAAVAAKLGLHCVALLENPIGTTAENYLTNGNRLLLDLFNTQIEMCDALTDPNAQLEVLATRVEAQGFRPYVIPVGGSNALGALGYVESALEIAQQCEGAVNISSVVVASGSAGTHAGLAVGLEHLMPESELIGVTVSRSVADQLPKVVNLQQAIAKELELTASAEILLWDDYFAPGYGVPNDEGMEAVKLLARLEGILLDPVYTGKAMAGLIDGISQKRFKDEGPILFIHTGGAPALFAYHPHV

SEQ ID NO: 26040 - protein, 275 aa, Prochlorococcus marinus
MTDFLVAALQITSTSNVEANFAEAEEQIELASRRGSELIGLPENFAFLGEDNEKLRMASELSIKCTNFLKTMSQRYQVFLLGGGYPVPAGDNRHTFNRSALFGKDGQVLAKYDKIHLFDVDLPDGNLYKESSTILSGEEHPPVIDVPGLCKIGLSICYDVRFPELYRHLSSKGAELIMIPAAFTAFTGKDHWQILLQARAIENTAYVVAPAQTGIHYGRRQSHGHAMVIDPWGTVLSDAGKTQGAAIAPADKERVQKIREQMPSLKHRKTKMFAK

SEQ ID NO: 26041 - protein, 960 aa, Oryza sativa
MQMLLHANSLLLAPTTSRLSASASPGRSGTARPLPPPQGHAHSARAAARGTRRPPAVAAASPRTPMAVGEECAAAVASQGFVSDARAYWVTRSLIAWNVNDQDTSLFLYASRDATMHVSDGAIHGYDSKIELEPEHASLPDNVAEKFPFIRSYRTFRVPSSVDVTSLVKCQLAVASYDAHGRHQDVTGLQLPGVLDDMFAYTGPLGAVFSDKDVDLYLWAPTAQDVRVCFYDGPAGPLLQTVQLKELNGVWSVTVPRYRENQYYLYEVKVYHPSTSQVEKCLADDPYARGLSANGTRTWLVDINSETLKPASWDELSDEKPNLESFSDISIYELHIRDFSAHDSTVDCNSRGGFRAFTFQDSAGIRHLRKLSAAGLTHVHLLPSFHFASVDDNKSNWKFVDEAQLAKLPPGSDEQQAAIVSIQQEDPYNWGYDPVLWGVPKGSYASNPDGPSRIIEYRQMVQALNRIGLRVVMDVVYNHLDSSGPFGVSSVLDKIVPGYYLRRNVNGQIENSAAMNNTASEHFMVDRLIVDDLLNWAINYKVDGFRFDLMGHIMKSTMIRAKSAIRSLTRDVHGVDGSKIYLYGEGWDFGEVAQNKRGINASQINMSGTGIGSFNDRIRDSVNGGNPFGNPLQQGFSTGLFLEPNGYYQGNEADTRRELATYADHIQIGLAGNLKDYVLRTHTGEAKKGSDIYTFDGSPVGYTSSPVETINYVSAHDNETLFDIVSIKTPIGLSIDEKCRINHLASSMIALSQGIPFFHAGDEILRSKSLDRDSYNSGDWFNKLDFTYETNNWGVGLPPRDKNEENWHLIKPRLENPSFRPLKNHILSVFDNFVDILKIRYSSPLFRLSTASDIEQRVRFHNTGPSMVPGVIVMSIKDAQNEKCKMAQLDKNFSYVVTIFNVCPHEVSIEIHDLASLGLELHPIQVNSSDALVRQSAYEASKGRFTVPRRTTAVFVQPRC

SEQ ID NO: 26042 - protein, 356 aa, Escherichia coli
MMSQKYLFIDRDGTLISEPPSDFQVDRFDKLAFEPGVIPQLLKLQKAGYKLVMITNQDGLGTQSFPQADFDGPHNLMMQIFTSQGVQFDEVLICPHLPADECDCRKPKVKLVERYLAEQAMDRANSYVIGDRATDIQLAENMGINGLRYDRETLNWPMIGEQLTRRDRYAHVVRNTKETQIDVQVWLDREGGSKINTGVGFFDHMLDQIATHGGFRMEINVKGDLYIDDHHTVEDTGLALGEALKIALGDKRGICRFGFVLPMDECLARCALDISGRPHLEYKAEFTYQRVGDLSTEMIEHFFRSLSYTMGVTLHLKTKGKNDHHRVESLFKAFGRTLRQAIRVEGDTLPSSKGVL

SEQ ID NO: 26043 - protein, 630 aa, Escherichia coli
MCGLAGFLESNLNDNNSAKVLHSMGESIYRRGPDGTGIWFENIENKINVGFVHTRLAIIDLSDAGQQPMHSHCGRYVIAFNGEIYNHLELRYLLESNNHISWRGHSDTETLLACFGIWGIDKTLQACVGMFAIALWDKKEHRLTLARDRVGEKPLYWGWQDDALLFGSELKALKTHPAFSAEINRDALCLLLRHNYIPAPHTIYRGIQKLQPGHYLSVELSNDERKETLHQYWSYEKVVQEGLVNPFMGSPIQAVEHLESLIAQSINGQLISDVPLGAFLSGGIDSSLIVSIMQSLSSSPVKTFSIGFDDKKYDEAIFAVEVARHLGTDHTEMYVNDKDIQDVIPLLPEVYCEPFADSSQLPTFLVSKMAQQHVTVALSGDAGDELFGGYTPYSFTPKYWNYARNIPLQIRKFASRYIDKLPVNPKFKKLIECMAVQNPQLFYRNIISHWLNPEELVKNSSEPSTAFSSSTTFPVNGGYVDWMMSVDAQVYMTDDILVKVDRAAMYNSLETRVPLLDHRIIEFAWQLPVSLKINNGVGKWPLREILYKRVPKSMIERPKKGFSVPLSSWLRGPLRDWAEELIAYKRLADEGYFNVAAVRSCWNLHIQGQADYSRKLWSILMFQSWLENQK

SEQ ID NO: 26044 - protein, 392 aa, Unknown
  Synechococcus sp. RS9916
MRVSTAGSGGSDERMFTVISQVPQADRQRKTERSYFVPYSRLEATLRFITSSGGQVLSVTPASESPAASDQPKPTPAKAVPSKASSKKAPVTKKPAHQAVPVNLYKPKTPFIGTVTENYSLLQEGAIGRVNHITFDLSGGEPHLHYVEGQSIGIIPDGEDAKGKPHKLRLYSIASTRHGDDMADNTVSLCVRQLQYEKDGETINGVCSTFLCDIEPGAKVKITGPVGKEMLLPDDEEANVIMFATGTGIAPMRTYLRRMFESSEREKNGWNFRGKAWLFMGAPKTPNLLYDDDFNRYESEYPENFRYTKAISREQQNTKGGRMYIQDRVLEHADEIFAMIEDPKTHVYMCGLRGMEPGIDEAMSAAAAAKGLDWSVLRPQLKKAERWHVETY

SEQ ID NO: 26045 - protein, 1372 aa, Cercospora zeae-maydis
MPTSNGGRTSPASLRSHHVRYASDSNIALRSTIMEQPEGPPELETYDSSGTNSSGNDGDEYAGTQESHSDSDGISSRHFVPGSGQAYAQDEVTPLTNVSTYGWSQPGSSNVSRTTTRGSVGSALPGTPAYEGTGTAMTNGTRRPANTRKESSNIYAPNRGPGSSMRYALNTGTRPRNGFTHMRRRNPNDEYRAQEKAYVQRIRQDGPDNDFQTEPRTPSLDYSFGSEDDEESPTNANYADHDPAEVDTLLYYGQEDLEPSVEELNIPANRERLEWHAMLANVLTGDVVKQEKKRLIGGPEQQGENTLKTEVWIGVRAKTCGRSIAAQKRLVEDGRSKVKQTIESIVAFEIKGEAEVGQSPMQQVQDVVKKIEKIEGLYPPRQAFRAAHPPAASSAYEHTCDAVIAWNNTTELIGTELGILQSWVGNMELDFTTARVRPEGEQHNELFDDSSFIDRILKEDGLKSLQGDKNLLNGVNTVIHKAKATLIANAEAFSDRHLPPYIEELLTLINFPSRLIQEIIRMRLSYAKKMKDAAQQGVMTAEQMILQFQILLQLAVKIKEQYLLIGQPEPGWDLPPCIDDNFDSVVLDALKFYFKMLNWKLMANKNTFKEAEILEQEWDFSNELGRHLDGGDVEVAEQFSSLTSKSMGRLAAPFEKELQRPADEVAGTAEMDKRYKSILDSVRVRQRKIFRFSRILSQRFENATEYNINIDNELYEDFLLALRLSGHFLVETNAESSVPTPGENEKAGGKVYILASPVLKERPKDIQSMLGTCYHAEDSPEDPSNPYVLILRPELPLVWEGDRMDASHSGKETLKVPQTLDLKTGRLRLVADGSLQRLQNANMAFTTATGNFDLTILVEQRANLCRESTKNWQRFAKLHTSSPTHSWTRSPLFALRSKPREGKAKAKNSTHPELLCFCYGIWSAFCHSHGRTTAGGQSHKLTKLALDWVSFICDDCVASDRKTFRWAVVALEFAMVMTRGQNILSISDEEYALLRSKVAGCRSLLISHFDIMGARGTVAAQAEKQRMDAMVGKLRLDIGKLKDDDESSRIVRAQWLDELEKLDQARKDREAERQALGRVLEDSNDADRALTHLSASAGNVHLRWQQGQFVGGGTFGSVYAAINLDSGHLMAVKEIRLQDPKMIPTVVSQIRDEMGVLQVLDHPNVVQYYGIEPHRDKVYIFMEYCSGGSLAGLLEHGRIEDETVVQVYALQLLEGLGYLHEASVVHRDIKPDNILLDHNGVIKFVDFGAAKVIAKQGKTMVADGPTGNGRQRSVQGTPMYMSPEVIKGGKHTGRLGAADIWSLGCVISEMATGSRPWANMDNDFAIMYNIANGNSPQMPTRDQMSDVGLDFLQAMLRTRPCEACVRCGASAT

SEQ ID NO: 26046 - protein, 354 aa, Zea mays
MATTAASSLLKSSFAGSRLPSATRTTTPSSVAVATPRAGGGPIRASISSPNPPYDLTSFRFSPIKESIVSREMTRRYMTDMITHADTDVVIVGAGSAGLSCAYELSKDPTVSVAIVEQSVSPGGGAWLGGQLFSAMVVRRPAHLFLDELGVGYDEAEDYVVVKHAALFTSTVMSRLLARPNVKLFNAVAVEDLIVRRGRVGGVVTNWALVSMNHDTQSCMDPNVMEAKVVVSSCGHDGPFGATGVKRLQDIGMISAVPGMKALDMNAAEDEIVRLTREVVPGMIVTGMEVAEIDGAPRMGPTFGAMMISGQKAAHLALKALGRPNAVDGTIPEVSPALREEFVIASKDDEVVDA

SEQ ID NO: 26047 - protein, 355 aa, Glycine max
STNPESTIAIAAAVEEPPDAHASECGPDVDGVNDHQTAHFSSGPKKSELRIGESSAFFTYVKASILKSNLEGVVNVDKNGATHVRMEVMHQTCAQQGVNDLQIRENGEAYESQSQDDLPSSTSIPDSLSIERSCTPPASMEVSQQKHYREENLHQGVMHPRNGTHCSELEVSGMASQHAYPYYISGVVNHVMMPSSAQMYHQKNIQDLQNHTSSAMISQYNHLPQGGPHGTGMTSFPYYPMSICLQPGQIPNPHSWQSFGNSSPSEAKLIKVDRREAALMKFRQKRKERCFDKKIRYINRKRLAERRPRVRGQFVRKLNGANVDLNGEPASIDYDEDDEEDEDDQGARDSSPEDA

SEQ ID NO: 26048 - protein, 119 aa, Triticum aestivum
  misc_feature (26)..(26): Xaa can be any naturally occurring amino acid
  misc_feature (102)..(102): Xaa can be any naturally occurring amino acid
WNYYEVWLQLAHQATEETDPTRVARXREAQHRSPTWRAEKDPALPLLKKLIGGRHAEDLVTELLAEGAPSLGSRSFLDYLREHPCDDWTVLKKRSMIETSFXDRPWHATGEFIAAMDAG

SEQ ID NO: 26049 - protein, 304 aa, Thermus thermophilus
MRVEGAIGKTPVVRLAKVVEPDMAEVWVKLEGLNPGGSIKDRPAWYMIKDAEERGILRPGSGQVIVEPTSGNTGIGLAMIAASRGYRLILTMPAQMSEERKRVLKAFGAELVLTDPERRMLAAREEALRLKEELGAFMPDQFKNPANVRAHYETTGPELYEALEGRIDAFVYGSGTGGTITGVGRYLKERIPHVKVIAVEPARSNVLSGGKMGQHGFQGMGPGFIPENLDLSLLDGVIQVWEEDAFPLARRLAREEGLFLGMSSGGIVWAALQVARELGPGKRVACISPDGGWKYLSTPLYAEP

SEQ ID NO: 26050 - protein, 921 aa, Oryza sativa
MASKGTEGGHGGVERKEQQQQRGYQLPRDSRGSLEVFNPSSASSFRTAAAAPKSASPFLAIPDREEDNVVAQQRAAEWGLVLQTDHHTGLPQGVSARPSSGSARTSSEDNPQQQQSAAAIPRVSEELRAALSVFQQTFVVSDATHPNHPIMYASAGFFNMTGYTSKEVVGRNCRFLQGSGTDPHEIDKIRQSLANGSNYCGRILNYKKDGTPFWNLLTIAPIKDEDGRLLKFIGMQVEVSKYTEGKKDTVVRPNGLSESLIKYDARQKDHARSSVSELLLALKNPRSLSESSNNTLKRKSQESLSMSMSEVPSKRSSESGSRRNSRSGTRSSLQKINEVPDQVNRTRKSGLRAFMGFLGMGHGSVEKNMLKPRDEDPLIDSDDERPESFEDEFRRKEMRRGIDLATTLERIEKNFVITDPRLPDNPIIFASDSFLQLTEYNREEILGRNCRFLQGPETDRATVRKIRDAIDNQAEVTVQLINYTKSGKKFWNLFHLQPMRDQKGDVQYFIGVQLDGTEHVQDDAAKEGVVLVKKTADNIDEAAKELPDANLRPKDLWANHSKVVLPNPHMKDTASWRAIQKVLESGESIGLKHFRPVKPLGSGDTGSVHLVELLNTGEYFAMKAMDKSIMLNRNKVHRATAERQILDLLDHPFLPTLYASFQTKTHICLITDYCPGGELFVLLDNQPLKVLHEDAVRFYAAEVVVALEYLHCQGIIYRDLKPENILLHRDGHISLTDFDLSCLTSCRPQVFLPEDADEKKGRKNGSYPIFFAEPMRASNSFVGTEEYIAPEIITGAGHTSAVDWWALGILLYEMLYGYTPFRGKTRQRTFANILHKDIRFPASISVSLAARQLMYRLLHRDPANRLGSYEGANEIKGHPFFRGINWPLIRATAPPKLEIPLFSKDDMEKKGLVTNNRTDMF

SEQ ID NO: 26051 - protein, 468 aa, Escherichia coli
MSKQQIGVVGMAVMGRNLALNIESRGYTVSIFNRSREKTEEVIAENPGKKLVPYYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLTNEELAQIFTEWNNGELSSYLIDITKDIFTKKDEDGNYLVDVILDEAANKGTGKWTSQSALDLGEPLSLITESVFARYISSLKDQRVAASKVLSGPQAQPAGDKAEFIEKVRRALYLGKIVSYAQGFSQLRAASEEYNWDLNYGEIAKIFRAGCIIRAQFLQKITDAYAENPQIANLLLAPYFKQIADDYQQALRDVVAYAVQNGIPVPTFAAAVAYYDSYRAAVLPANLIQAQRDYFGAHTYKRIDKEGVFHTEWLD

SEQ ID NO: 26052 - protein, 434 aa, Saccharum spontaneum
MGLSTAYSPAGSGLVPGPLGAGAGAARRRSAQVRRPRLATVRCSVDAAKQVQDGVATAVAAEAPASRKECFGVFCNIYDLKAEDKTKSWKKLVNIAVSGAAGMISNHLLFKLASGEVFGLDQPIALKLLGSERSFQALEGVAMELEDSLYPLLREVSIGIDPYEVFQDVDWALLIGAKPRGPGMERAALLDINGQIFADQGKALNAVASRNVKVLVVGNPCNTNALICLKNAPNIPAKNFHALTRLDENRAKCQLALKAGVFYDKVSNVTIWGNHSTTQVPDFLNAKIDGRPVKEVIQDTKWLEEFTMTVQKRGGALIQKWGRSSAASTAVSIVDAIKSLVTPTPEGDWFSTGVYTTGNPYGIAEDIVFSMPCRSKGDGDYELATDVSMDDFLWERIKKSEAELLAEKKCVAHLTGEGDAFCDLPEDTMLPGEK

SEQ ID NO: 26053 - protein, 271 aa, Unknown
  uncultured bacterium
QPNAMGGREVGGLANTLAAHFEFGDPQSHQTVSDFWQTDNLATRAGLKAIDLFDAMNDGKIKAVWVMATNPVVSLPDSEKIKAAIEKCPFVVVSDCIADTETTRLADVVLPAQGWSEKSGTVTNSERRISRQRRVLPSPGEAKPDWWILKEVAQKMGFKDQFDYRHEGEIFKEYCEMTALGNETGKARDLCLIGLTKLDEKGYGELTPQQWPVLEYQPEIIEQRMFTNGEFFTESGKAQFIAVEHDKPIADTSVEFPLIMNTGRIRDQWHT

SEQ ID NO: 26054 - protein, 271 aa, Unknown
  uncultured bacterium
QPNAMGGREVGGLANTLAAHFEFGDPQSHQTVSDFWQTDNLATRAGLKAIDLFDAMSDGKIKAVWVMATNPVVSLPDSEKIKAALEKCPFVVVSDCIADTETTRLADVVLPARGWSEKSGTVTNSERRISRQRRVPPSPGEAKPDWWILKEVAQKMGFKGQFDYRHEGEIFKEYCEMTALGNERGKARDLCLIGLTKLDEKGYGELTPQQWPALEYQPDIIEQRMFTNGEFFNESGKAQFVAVEHDKPIADTSVEFPLIMNTGRIRDQWHT

SEQ ID NO: 26055 - protein, 267 aa, Unknown
  uncultured bacterium
QPNAMGGREVGGLANQLAAHMDFAEQDIETVSTFWNAANIARQPGLKAVDMFDAILSGEIKAIWIMATNPLVSMPEVHKVRQSLENCELVIVSDCIQDTNTSQYADVLLPALAWGEKDGTVTNSERRISRQRAFLDAPEEARADWWIVNEVAKRMGFEDAFSYQTIDEIWREHAALSAFENNGQRDFDLSGLMDLPAEDYDQLQPLQWPFYRNASPDKSHMFEDRGFLSCRLKARFIPVQRCSELSLTSVEYPLILNTGRIRDQWHT

SEQ ID NO: 26056 - protein, 568 aa, Oenothera mexicana
MASPALISETEAWKDLKAHVEDIKRTHLRELMGDTERCQSMMVEFDNIFLDYSRQQASPDTINKLYKLADAAHLKQKIDRMYNGDHINSTENRSVLHVALRAPRNSAICSDGKNVVPDVWNVLDKIKDFSERVRNGSWVGATGKELKDVIAVGIGGSFLGPLFVHTALQTDPEASKNARGRELRFLANVDPIDAARNISGLDPETTLVVVVSKTFTTAETMLNARTLREWISSALGPSAVAKHMVAVSTNLPLVEKFGIDPNNAFAFWDWVGGRYSVCSAVGVLPLSLQYGFAVVEKFLQGAHNIDQHFSSAPFEKNIPVLLGLLSVWNVSFLGYPARAILPYSQALEKLAPHIQQVSMESNGKGVSIDGLPLPFESGEIDFGEPGTNGQHSFYQLIHQGRVIPCDFIGVVKSQQPVYLKGEVVNNHDELMSNFFAQPDALAYGKTPEQLKKENVSEHLIPHKTFTGNRPSVSILLPTLDAYRIGQLLAIYEHRVAVQGFIWGINSFDQWGVELGKSLATQVRKQLHASRVKGESVEGFNFSTKTLLTRYLEATSDVPAAPSTLLPKI

SEQ ID NO: 26057 - protein, 262 aa, Unknown
  uncultured bacterium
QPNAMGGREVGGLANQLAVHLDIDNPEHHAAVPNFWQTDTLATENGLTAVDLFNAVESGQVKAVWIMPTNPVDSLPEADRVRHALMACDTVVVSDCVASGDTLACADIRLPALGWGEKSGMVTNSERCVSRQRPFVKAPGDARADWWIISEVARRMGYASAFPYQHEHQIFAEYSALTALAGRFGKRLDMTAAAELSADQYEQWQPQQWPLQGEPRCFGDGHFATPDGRVRFVACENPNVHRIGDAFPIILNSSRIRDQWHT

SEQ ID NO: 26058 - protein, 305 aa, Thermoanaerobacter tengcongensis
MYDLIILGGGPAGLTAGLYAARSRLKTVLIEKTYLGGQIVNTYQLENYPGYEEITGADLVAKMEAQVRKHGLEIVLEDVESLDITGEIKRVKTANNKVYEAKAIILAMGATPRKLGVPNEDRFIGAGISFCATCDGAFYRDAVVAVIGGGNTAVEDALYLTKFAKKVYIIHRRDQLRATKIEQEKAFANEKIEFIWNTVVVDVEGEYGVERIRLKNVKTGEESTLNVDGVFVAIGYDPNTELVKGIVELDEYGYIITDDDMKTNIPGVFAAGDIRHKLLRQVITAAGDGATAAYAAEKYIESLKK

SEQ ID NO: 26059 - protein, 151 aa, Glycine max
MGAFTEKQEALVNSSFEAFKANLPHHSVVFFNSILEKAPAAKNMFSFLGDAVDPKNPKLAGHAEKLFGLVRDSAVQLQTKGLVVADATLGPIHTQKGVTDLQFAVVKEALLKTIKEAVGDKWSEELSNPWEVAYDEIAAAIKKAMAIGSLV

SEQ ID NO: 26060 - protein, 263 aa, Unknown
  uncultured bacterium
QPNAMGGREVGGLANMLANHLDIENAEHRDAVQTFWQSPTICTAPGLKAVDLYEACADGKIKALWVMSTNPAASMPDAAGVAEAIANVPFTVVSDIMERTDTCDLADVLLPAAGWGEKDGTVTNSERRISRQRAFLPVPGAARPDWQIICDVAREMGHGDAFDFDSPASVFREYAALSASLTRFGRDFDISGLTEISDRDYAAFAPTQWPIPKQKSAGGRFFEGGGFFHSDGRARMLPVSAPLAQVANGYQLNTGRIRDQWHT

SEQ ID NO: 26061 - protein, 310 aa, Mycobacterium avium
MSIAENVTQLIGNTPLVRLNRVTEGAVADVVAKLEFFNPGNSVKDRIGVAMIDAAEQAGLIKPDTIILEPTSGNTGIALALVAAARGYRCVLTMPETMSVERRMLLRALGAEIVLTPGADGMPGAIAKAEELAKSDDRYFVPQQFENPANPAIHRSTTAEEVWRDTDGKVDIFVAGVGTGGTITGVAQVIKERKPSAQFIAVEPAASPVLSGGQKGPHPIQGLGAGFVPPVLAMDLVDEVIAVGNEESIALARRLAAEEGLLVGISSGAALVAALQVARRPENAGKLVVVVLPDFGERYLSTPLFADLAD

SEQ ID NO: 26062 - protein, 597 aa, Anabaena variabilis
MNLIQSIKDWAKSTRFLQFFDKPKTKSMSDSKPRDVQVLPIATNTKVLRARSWSRLRFEIEYALERGTTSNSYVIEGDKTAIIDPPVESFMGIYLEALQQTINLKKLDYVILGHFSPNRIPTFKALLELAPQITFVCSLPAAGDLRAAFPDDNLNILAMRGKETLDLGKGHVLKFLPIPSPRWPAGLCTYDVQTQILYTDKIFGAHICGDDVFDDNWESFKEDQRYYYNCLMAPHAIHVEAALEKISDLQVRMYAVGHGPLVRTSLIALTQAYADWSKAQKEREISVALLYASAYGNTATIARAIALGLTKGGVAVKSINCEFATPEEIQSNLEQVDAFLIGSPTIGGHAPTPINTALGIVLKVGDNNKLAGVFGSYGWSGEALDMIEGKLRDAGYRFGLETLKVKFKPDDVTLKFCEEVGTDFAQTLKKAKKVRVPQQAATPVEQAVGRIVGSVCVITAKQGDVSTGMLGSWVSQATFNPPGLTVAIAKERAIESLMYPGGKFALNILPEGSHLEYMKHFRKNFAPGEDRFANFTTTEADNGCTVLADALAYVECSVDQRLECGDHWVVYATVDNGKLLKPDDVTAINHRKTGTHY

SEQ ID NO: 26063 - protein, 579 aa, Anabaena variabilis
MVSMSTTGNAHTENVQHRLTVETVEIAPNTTAIRCLDWDRDRFDIEFGLQNGTTYNSYLIRGEQTVLVDTSHQKFRQLYLETLKGLINPKAIDYIIVSHTEPDHSGLVEDVLQLAPRATVLASKIALQFLEGLVHDPFSKRIVKSGDRIDIGKGHEIEFVSAPNLHWPDTIFSYDRKTEVIYTCDAFGMHFCDNRTFDEDLEAIEADFRFYYDCLMGPNARSLLNAMKRMGELGKIKIIANGHGPLLYHHLDVLTECYQSWSQRQAKAETTVGLFYVADYGYSNLLVQAIGEGIQKTGVAVEMIDLSTAEIQEIQELAGRAAGLIIGMPPTTSVAAQAGISSLLSVVKDKQAVGLFECFGGDDEPVDTIRRKFIDLGVKEAFPAIRIKDVPGASAYQLCTEAGTDLGQLLTRERNIKQIKSLDVNMEKALGRISNGLYIVTTKKGDVSSAMLASWVSQASLQPLGFTIAVAKDRAIDTLMQVGDRFVLNVLEEGNYQELKKQFLKRLHPGADRFAGVRTQIAKNGSPILTDALAYMECEVQSSLECSDHYILYCTVEDGRVSKPDGLTAVRHRKVGNYY

SEQ ID NO: 26064 - protein, 682 aa, Listeria monocytogenes
MEIFLYVLALLVAIFISNLLNRFVPFVSVPLIQIGLGVLIAIMPITFNLQLNPELFLVMFIAPLLFNDGRQTDKAALWGMRMPILVLALGLVFATVVVIGYFVHWMIPTIPLAAAFALAAALAPTDAVAVSSLSGRINLPKRIMNLLEGEALINDASGLVAFQFAIAAMVTGVFSLMDASISFFVIAIGGILVGLILSWLKFRLLKWVRGLGMEDVTFHMLIQILTPFIIYLAAEEIHVSGILAVVAAGIMHSMEQKKMDPQLVKLNVVSQSTWSVIIFVLNGLVFLLLGTQLPAITEVVWNDSGSSNLQVMAYILSITAALILLRFLWVYISWSIGAKQRQKQNKKTQLPKFRPVVLTSLSGVRGAVTLASALAIPFFLDDGSLFPQRSLIIFIASGVILCTLVIATFILPLLAKSEEVTTEDERAEIATRIRILRNVIRELKEQTLPETKAATDEVIEDYRKRIYDLQQNNSSNRGMDERERAKRLEIIQWERENTQKMTDEGRIVATDSYRYQHYLNMMEQAIKQRFRTKVKTAWMFLYRLIMLVIHPKKWGRITHKVKKGISKDSERFKAIRQLREDNEILIISKLKEQLTKENADIIGPLITEHTIFLERVRKEHSPRGKRAKFEQKKREVQVVAFQLERDIIQNMFEKGGISRDLARDLRQNLNMIETYLYDDFLE

SEQ ID NO: 26065 - protein, 159 aa, Burkholderia thailandensis
MSKLYSFNAQALSGGEVPLEQYRGKVLLIVNTASECGFTPQYAGLQQLYDRFRERGLAVLGFPCNQFGKQEPGDASQIGAFCEKNYGVTFPMFAKIDVNGANAHPLYRYLTEESPGILGLKAIKWNFTKFLVNREGEIVKRYAPSTKPEDIAADVEKLL

SEQ ID NO: 26066 - protein, 77 aa, Nandina domestica
MKEQKWIHEGLITESLPNGMFRVRLDNEDLILGYVSGRIRRSFIRILPGDRVKIEVSRYDSTRGRIIYRLRNKDSND

SEQ ID NO: 26067 - protein, 437 aa, Unknown
  Mesorhizobium sp. BNC1
MAQASTVAAETETFFSRPLEETDSEIFSAIRSELGRQRHEIELIASENIVSRAVLEAQGTVLTNKYAEGYPGKRYYGGCQFVDVVEQLAIDRAKKLFNCQFANVQPHSGSQMNQAVFLALLQPGDTFMGLDLNSGGHLTHGSPVNMSGKWFNVVSYGVRRDDNLLDMDEVERLATEHKPKLILAGGTAYSRIWDWKRFREIADSVGAYLMVDMAHIAGLVAGGAHPSPLPHAHVVTTTTHKSLRGPRGGMVLTNDEDIAKKVNSAVFPGLQGGPLMHVIAAKAVALGEALQPEFKAYAHQVVANARALAASLQETGLEIVSGGTDNHLMLVDLRPKNATGKRAEAALGRANITCNKNGIPFDPEKPFVTSGIRLGTPAGTTRGFGVAEFSQIGQLIAEVLDGLRAVNSDDGNIAVEEAVKKKVIALTERFPLYSYLD

SEQ ID NO: 26068 - protein, 449 aa, Desulfitobacterium hafniense
MPTLLMITPENSEINKFKAHQLNNFTQLTMPYLAGFVPEEYSIRLLDEYTEPILFEKVDLVAITVNTPNAPHVYSVSKRFRELGAWVALGGPHVTLNPEEAACHGDTIFVGEAEETWPEFLKDFLSGNMQKVYTSLQVPSLDGLPIPRRDLIVGHRFTSGAVFASRGCPHHCSYCSLKKIYHNKLRTRPVDEVIKDIGSMPNKYFVFWDDNFFADPVYTKALLKELARLNKRWAAQVTAYSCEDEELLSLAKSAGCLYLFLGLESFSEQGLRDANKNFNKIEEYGKVVNKLHRHGISIQAGIVFGFDSDTLDVFETTLKACNKIGVDGVTASILTPFPGTSIYEQYKKEGRLLDVDWDHYNGKTRVAYVPKRMNCKELLNGYNEFRGKFHSWRSIVKRISKSRVNIFYSLAMNYGYKRAYRNFTRLGIGERSDESLGQRMEQHLRNWPR

SEQ ID NO: 26069 - protein, 176 aa, Lactobacillus plantarum
METAIFAGGCFWCMVQPFDSQPGIDSVVSGYTGGHTKNPTYEDVKAHTTGHTEAVKITFDPDIISYTELVNIYWHQTDPTDAMGQFQDRGDNYRPVIFVNGPEQRRIAEASKRALQVSERFSKPIVTAIEDAKPFYPAEARHQRFYKNNPVVFAEQEAGGRADFIAEQWADAPKVD

SEQ ID NO: 26070 - protein, 450 aa, Zea mays
WPPPPPSSFPPPRILGTASPPPPAALHPASPAPPTPCRYRRTRSTSDDDADDDGAPRRSGRRDRRRAVRVAWEKLVRWSRSWRRRNRSDVLETTRKVDSLAPSMCGLGRVASSFAGSDREGLHGESLLFQVVVLGGGSFGTAMAAHVAAKKADLEVAMLLRDDHICRSINNAHVNWLVTSAAFVFSIHELLAFYCSKYLSEHRLPENIVATTSAADALAGADFCFHAVPVQFSSSFLESISTHVDPKLPFISLSKGLELNTLRTMSTIIPRALGNRRQPFVVLSGPSFAVELMNKLPTAMVVASKDNKLASSVQQLLASPNLRISTSSDVTGVEIAGALKNVLAIAAGIVEGMSLGNNCMAALVAQGCSEIRWLATKMGAKPTTLSGLSGSGDIMLTCFVNLSRNRTVGLRLGSGEKLDRIMGSMNQVAEGVSTAGAVIALAQKYKVKMP

SEQ ID NO: 26071 - protein, 413 aa, Unknown
  Frankia sp. EAN1pec
MRSPRVLGLVLAGGAGKRLAPLTADRAKPAVPFGGIYRLVDFVLSNLVNGGYLRIAVLTQYKSHSLDRHITTTWRMSNLLGNYVTPVPAQQRLGPQWFAGSADAIHQSLNLVHDEAPDVVVVFGADHVYRMDPRQMVAQHLETGAGVTVAGLRVPRSEGSAFGVIRTADDGVTIAEFLEKPADPPGLPGSPDEIFASMGNYVFTTDVLIDALRADAADPESVHDMGGSIVPMLVEQGTAAVYDFAANQVPGALERDHGYWRDVGTLDSYFDAHMDLCALDPVFNLYNRDWPIYTNVPPSVPPAKFVHDTPGRVGVATDSIVSNGVIISGGAVRRSVLSPGVRVNSWSVVENAVVMDNSVIGRRAVVRDAILDKNVVVPPGATVGVDKEHDRARGYQVSEAGVTVVGKGVTIAD

SEQ ID NO: 26072 - protein, 246 aa, Pseudomonas putida
MNAKVWLVGAGPGDPELLTLKAVRALQQAAVVMVDDLVNPAVLEHCPQARIMTVGKRGGCRSTPQAFIQRLMLRHARQGRCVVRLKGGDPCIFGRGGEEALWLQGHGIEVEVINGITAGLAGATQCGIPLTSRGVSRGVTLVTAHTQDDSELNWAALAQGGTTLVVYMGVARLEQVRQGLLAGGMAPGMPVAMIENASLPQQRECRSDVQGMVEAARAFGLRSPAILVIGEVVGEQQAMGRIAIAG

SEQ ID NO: 26073 - protein, 468 aa, Escherichia coli
MSKQQIGVVGMAVMGRNLALNIESRGYTVSVFNRSREKTEEVIAENPGKKLVPYYTVQEFVESLETPRRILLMVKAGAGTDSAIDSLKPYLDKGDIIIDGGNTFFQDTIRRNRELSAEGFNFIGTGVSGGEEGALKGPSIMPGGQKEAYELVAPILKQIAAVAEDGEPCVTYIGADGAGHYVKMVHNGIEYGDMQLIAEAYALLKGGLALSNEELAQTFTEWNEGELSSYLIDITKDIFTKKDEEGKYLVDVILDEAANKGTGKWTSQSSLDLGEPLSLITESVFARYISSLKDQRVAASKVLSGPQAQPAGDKAEFIEKVRRALYLGKIVSYAQGFSQLRAASDEYNWELNYGEIAKIFRAGCIIRAQFLQKITDAYAQKAGIANLLLAPYFKQIADDYQQALRDVVAYAYQNGIPVPTFSAAIAYYDSYRSAVLPANLIQAQRDYFGAHTYKRTDKEGVFHTEWLE

SEQ ID NO: 26074 - protein, 320 aa, Arabidopsis thaliana
MSNPTRKNMERIKGPWSPEEDDLLQRLVQKHGPRNWSLISKSIPGRSGKSCRLRWCNQLSPEVEHRAFSQEEDETIIRAHARFGNKWATISRLLNGRTDNAIKNHWNSTLKRKCSVEGQSCDFGGNGGYDGNLGEEQPLKRTASGGGGVSTGLYMSPGSPSGSDVSEQSSGGAHVFKPTVRSEVTASSSGEDPPTYLSLSLPWTDETVRVNEPVQLNQNTVMDGGYTAELFPVRKEEQVEVEEEEAKGISGGFGGEFMTVVQEMIRTEVRSYMADLQRGNVGGSSSGGGGGGSCMPQSVNSRRVGFREFIVNQIGIGKME

SEQ ID NO: 26075 - protein, 305 aa, Magnaporthe grisea
MQIFVKTLTGKTITLEVESSDTIDNVKSKIQDKEGIPPDQQRLIFAGKQLEDGRTLSDYNIQKESTLHLVLRLRGGMQIFVKTLTGKTITLEVESSDTIDNVKSKIQDKEGIPPDQQRLIFAGKQLEDGRTLSDYNIQKESTLHLVLRLRGGMQIFVKTLTGKTITLEVESSDTIDNVKSKIQDKEGIPPDQQRLIFAGKQLEDGRTLSDYNIQKESTLHLVLRLRGGMQIFVKTLTGKTITLEVESSDTIDNVKSKIQDKEGIPPDQQRLIFAGKQLEDGRTLSDYNIQKESTLHLVLRLRGGQ

SEQ ID NO: 26076 - protein, 272 aa, Unknown
  uncultured bacterium
QPNAMGGREVGGLANTLAAHMDYDSPGARSRVADFWGTGAVADGPGYKAVDMFEAVHRGDIRVIWIMGTNPAVSLPDSARVREALARCPTVIVSDLRRPHRYHGPRGHPPTRRWAGGKRMATVTNSERRISRQRCFLPLPAEVKPDWWIMSSVAGKPGFGEAFNYKRPADIFREHAALSAHENNGERLFNLAGLANLSDAGYEALIPVQWPVMEGAGVEAEGSTRLFSDGRFVTDNQRARFVAINTRLPAQQTSDDYPMVVNTGRIRDQWHT

SEQ ID NO: 26077 - protein, 468 aa, Propionibacterium acnes
MAVAATGIPAESGEPAMDKPRMKGRHLVMMSLGSAIGTGLFVGSGKGVAAAGPATLVAYIVAGLLVIAIMYMLGEMVAAHPDSGAFSVYTSRAMGSAAGFAMGWVWWIELVVVVAAEAIAAASTLVAMWPIAPVWLLTLIFLVVLTAINLLGADRFGEFEFWFALLKVVAVVVFLTIGVLLICGVLAAPAAGTSNLVGHGGFLPNGWSGVATALLLVAFSFGGIEIMAVAAAETEDPAHNVSRAVRTIVWRILVFYMGSVAIMVIAVPWDDPELGASPFVAVLNRAGIPAASEVMTLVIVLALLSSLNANLYGAARMLGSLAERGMAPRVAMRTRGRSVPTVAVLASVAFGFCCVLATFEWGDAVLGTLLNIVGSTIIVTYFFTICSHYVLRRRAEKEGAPLPMRLKGFPVVNWAAMILLIGIVVLGMFSPDVRAQLMSTGALVVILYVIGVGWSHHAGRSPFHPTTD

SEQ ID NO: 26078 - protein, 259 aa, Unknown
  uncultured bacterium
QPNAMGGREAGGLANQLAIHRGFDHQSIELISEFWQTDRLARKPGLKAIEMFEAVERGDIQVIWIMATNPVVSMPDNRFVQQALKKCPLVIVSDVTAESDIAQYADLLLPAAGWGEKQGMVTNSERMLTRQRQFQRPKGLAKPDWQAIAMVASKVSARLAMQDGFKFLTEAEVFGEYAAMTGLNKNSSLLLDLSAYAQISEQEYAAWQLVQWGGAHPFANGQFSFDDGKARFIVPSHSQASDKMQWWLNTGRQRDQWHT

SEQ ID NO: 26079 - protein, 607 aa, Oryza sativa
MQRSRRALLKRKAAAAAKEEEEEAGVGVATAAAAGRRRRRRLYGFSVSLVVACWVVLLLLNPLVGHGNGQRDEGIFADEGSSDPSFDSVEPTLSEGSVDSVVQQENGENHALPGDSCAKPDENHVLSEETLLEKDQLCSNDEAQGDSMDALPKDNVDQGENLPRTDDDSVVHPEGEVESEGVPRPARLSRVVPPGLDEFKTRAIAERGKGVPSGQPGNVIHRREPSGKLYNYASAAKGAKVLEFNKEAKGASNILDKDKDKYLRNPCSAEGKFVIIELSEETLVDTIAIANFEHYSSNLKEFEMLSSLNYPTDSWETLGRFTVANAKIAQNFTFPEPKWARYLKLNLLSHYGSEFYCTLSMLEVYGMDAVEKMLENLIPVENKRLEPDDKMKEPVDQQTQLKEPTEGKESSHEPLDEDEFELEDDKLNGDSSKNGAHDQVTETRPIQAGRIPGDTVLKVLMQKVQSLDVSFSVLERYLEELNSRYGQIFKDFDADIDTKDALLEKIKLELKHLERSKDDFAKEIEGILSWKLVASSQLNQLLLDNVIIRSELERFREKQADLENRSFAVIFLSFVFGCLAIAKLSIGMIFNTCRLYNFEKFDRFQIS

SEQ ID NO: 26080 - protein, 268 aa, Unknown
  uncultured bacterium
QPNAMGGREVGGLANQMAAHMDFNNPEAVDLVSRFWNAENMAQKDGLKAVDLFQAVEEGKIKAIWVMGTNPAVSLPNTDQVVRALQACPLVVVSDCIADTETLRYADVCLPATGWSEKNGTVTNSERRISRQRSILAPSGEAQHDWWIISEVAKRMGFGEAFNYGHPYEIFAEHAALSGFENNGSRDFDISLFQDIDRETYDALQPIQWPVTANSPYGTARMFSDGKFFTPTGKARFIPATTQTARQQPTEELPYILNTGRIRDQWHT

SEQ ID NO: 26081 - protein, 376 aa, Deinococcus radiodurans
  misc_feature (78)..(78): Xaa can be any naturally occurring amino acid
MDYYELLGVSRTASADEIKSAYRKLALKLHPDRNKEEGAAEKFAQVSEAYSVLSDTEKRAHYDRFGSAPGAGMPGGDXFGGMGGMGGVGFDPMDIFEQLFGGAAGMGGRGRRGPARGDDLETEVRITLEQARAGEEVEVTVDRLTECEHCHGTRTEPGGKPPVTCSTCNGSGAVRGQARTIFGVVETQQVCPTCKGDGKMVVDPCTVCHGRGRTLKSEPVKVKLPKGIDEGYRIRVAGQGNEGPGGNGDLYVHIEMEPHPELHRQDENLIFPARIGFATAALGGRIQVPTLDGPQEVEVKPGTQHGELHRLRGQGMPRLQGAGTGDLIVDYEIVVPKHLNAEAKDALQAYARAVGDEVPEEHEGLFGKIGKLFGRD

SEQ ID NO: 26082 - protein, 235 aa, Unknown
  Mesorhizobium sp. BNC1
MTKEKKAGSGTRVLKTRVKKKRGLKSSSRRWLERHLNDPYVRRANSEGMRSRAAYKLIEIDDKHHILAPGMKVIDLGAAPGGWCQVAAASVKSDPAKPSVVGIDYLEMDPVPGAAVLQMDFLDDAAPDRLIEVLGGSPDVVLSDMAAPTTGHRRTDHLRTMQLCEAAADFAISVLKTGGNFLAKTFQGGTEGELLSLLKRNFRSVHHVKPPASRDESVELYILAKDFKGRQAAEG

SEQ ID NO: 26083 - protein, 266 aa, Unknown
  uncultured bacterium
QPNAMGGREVGGLANQLAAHMDYSSEEMIDRVGRFWNAPNMARSDGLKAVDLFEAVEAGKVKAIWIMGTNPVVSLPNADQVKRALEACPLVVVSECIANTDTLKVANVCLPATGWSEKNGTVTNSERRISRQRSLLPPSGESRHDWWIVSEVAKRMGYGDAFAYEHPAQIFAEHAALSGFENNGSRDFDISLLQNIDEKAYDNLAPVQPNDAAPYGTARMFADGKFFTPSGRARFIPIITRAPVQQPTAEQPLIMNTGRIRDQWHT

SEQ ID NO: 26084 - protein, 119 aa, Triticum aestivum
MSLTNCRFYEEKYPEIDSFVMVNVKQIAEMGAYVKLLEYDNIDGMILLSELSRRRIRSIQKLIRVGRNEVVVVLRVDKEKGYIDLSKRRVSPEDIIKCEERYNKGKMVHSIMRHVAEKT

SEQ ID NO: 26085 - protein, 259 aa, Unknown
  uncultured bacterium
QPNAMGGREVGGMANTLAAHMDFDAQSIGRVERFWQAPALARKPGLKAVDMFDAVASGQIRAIWIMATSPVASLPDKDFVAQALVQCPLVVVSDCYKDTDTVGLADVRLPAQGWGEKDGTVTNSERCISRQRRLVTPRFDARPDWKIVCDVAKAMGFTHGFDYVSPGQIFAEHAALSVFENSGERLFALPDHVGLSEEAYDGLKPVSWPLEGRPFASRRFSTSDGRACFVATPPALTSAVSDRFPLLLNTGRLRDQWHT

SEQ ID NO: 26086 - protein, 244 aa, Streptococcus suis
DRLGVSKNASPDEIKKAYRKLSKKYHPDINKDPGAEDKYKEVQEAYETLSDPQKRSAYDQYGPAGANGGFGGGAGGFGGFDGAGFGGFEDIFSSFFGGGGATRNPNAPRQGDDLQYAVNLKFEEAIFGVEREVSYNREATCRTCTGSGAKPGTSPVTCGRCHGSGVINVDTQTPLGTMRRQMTCDVCHGRGKQIKDPCTTCHGTGHEKQAHTVTVKVPAGVETGQRIRLAGQGEAGFNGGPYGD

SEQ ID NO: 26087 - protein, 294 aa, Saccharomyces cerevisiae
TTPLVHVASVEKGRSYEDFQKVYNAIALKLREDDEYDNYIGYGPVLVRLAWHTSGTWDKHDNTGGSYGGTYRFKKEFNDPSNAGLQNGFKFLEPIHKEFPWISSGDLFSLGGVTAVQEMQGPKIPWRCGRVDTPEDTTPDNGRLPDADKDADYVRTFFQRLNMNDREVVALMGAHALGKTHLKNSGYEGPWGAANNVFTNEFYLNLLNEDWKLEKNDANNEQWDSKSGYMMLPTDYSLIQDPKYLSIVKEYANDQDKFFKDFSKAFEKLLEDGITFPKDAPSPFIFKTLEEQGL

SEQ ID NO: 26088 - protein, 251 aa, Picrophilus torridus
MKSLPDVGDLVVVTIKEIKNYGAIVTLDEYENVTGFIHITEVATGWIKHIKDYLKENQKTVCKVLDVDKSRRHVDLSLKRVNEHQRREKIEEWKNEEKAFKLLEIVANNLGISKEDAMKEFGDRLIENYGTLYDAFFDAASNDEFMSSDNSKWRSVFVRIARENIVIPKVEISGYLELYSLSSNGIENIKKVLENEESEDVTISYAGAPKYRIVVTESNYKVAEEVLKNKLNEISEKSKKNNVSYDFEREE

SEQ ID NO: 26089 - protein, 177 aa, Glycine max
MNALAATNRNFRLASRLLGLDSKLEKSLLIPFREIKVECTIPKDDGSLATFVGFRIQHDNARGPMKGGIRYHPEVEPDEVNALAQLMTWKTAVANIPYGGAKGGIGCDPADLTVAELERLTIVLTQKIHDLIRVQTDLPTPMKGTGPQTMAWILDEYSKLHGHSGVGKLDIYGFCFQ

SEQ ID NO: 26090 - protein, 531 aa, Streptomyces coelicolor
MSSALDDRAVAAPPNPPADHHTRGARFLLLLAVFLCAACGLVYELALTALGSYLIGNSVLQTSVVISVMVFAMGVGSLAAKPLRHRPVVAFAVVEGVLALVGGLSVLMLYAAFAWLQLYMPAMIVVSLVVGLLIGAEIPLLMTLLQRIRTQEASSAVADMFAVDYIGALVGGLCFPLFLLPTFGQLKGALVVGVVNAVAGVIVVVFIFRRQTGRLVKAGLLAGVALVLAALGTTYVLADDLEVTARQHMYADPIIHSETTQYQDIVVTRSTAFTGEPDVRLFLNGDLQFSSVDEYRYHESLVHPALSGPHSNVLIMGGGDGLALREVLRHEGVRHVTLVELDPAMTRLARTFEPLRKLNQGSLDDPRAKVVNADAFTWLREARQQYDAVIIDFPDPDSASLAKLYSVEFYDLLRRVLAPDGQVMVQSGSPFFAPKTYWSIAKTIETAGYATTEFQIDVPSFGNWGFVLARPGTEAPPLRLARDTPKLRYLDAAVLKAATVFPVDRRRTDVRPSTLMDPAVLEYVQDEWRDY

SEQ ID NO: 26091 - protein, 367 aa, Oryza sativa
MGVLSAADPPPVSAIGFEGYEKRLEITFSEAPVFADPDGRGLRALSRAQIDSVLDLARCTIVSELSNKDFDSYVLSESSLFIYSDKIVIKTCGTTKLLLTIPRILELAEGLSMPLAAVKYSRGMFIFPSAQPAPHRSFSEEVAVLNRYFGHLKSGGNAYVIGDPAKPGQKWHIYYATQHPEQPMVTLEMCMTGLDKEKASVFFKTSADGHTSCAKEMTKLSGISDIIPEMEICDFDFEPCGYSMNAIHGLAFSTIHVTPEDGFSYASYEVVGFDASTLAYGDLVKRVLRCFGPSEFSVAVTIFGGHGHAGTWAKELNADAYKCNNMVEQELPCGGSSSTRASTLPKTYLLLLGRPNLFCTASRLRIW

SEQ ID NO: 26092 - protein, 409 aa, Oryza sativa
MATFFRSANLASRVFDRQFLSPRPGATVNTVRQFYENLVPSYTICDIDCPDYSFRKFTDDGNYLVAFSRNHQDLIVYRPIWPTFSCNEPCDSHDLPPKAKKFDSFFKQLYSISLASSNEYICKDFFLYMECHQFGLFATSTAQSNDSSATEGAIHGVPSIEKITFYLVRLDDGAILDEKAFRNDFINLAHSIGAYLYEDLLCIVSLRYQTIHVLQIRDSGNLVEVRKIGAFCQEDDELFLHSHGQAARGVSFLPGIKQRLLSFIFRKTWNEESDQTLRVQHLKKKFYFHFQDYVDLIIWKVQFLDRHHLFIKFGSVDGGVSRSTEQNSAFFAVYNMETTDIVSLYQNSSEELYSLFEYFYDHFHTNPQNSSHGNFISSHSNNVHALDQLRTIKNKANSTSQVILIASGV

SEQ ID NO: 26093 - protein, 333 aa, Prochlorococcus marinus
MIKDKNILITGGNSGIGFFTTINLLKTQNNLYIPIRSISRKEEFLLKLIKYFDKKYIEKHLNLIDNIDLSDLENIYKVRDFLIRKNVSLDVVILNAGLQYTGSFYPKVSKQGIELTFAVNHLAHFYLVNILIELINSKKESRIIITSSDVHDPKSSGGNVGEKAGLNNLINFKEEISGKYTNFNSDKAYKNSKLCNVLFAKELSKRLQIKSSKITVISWAPGLVIPNEDLGFFRYSTKFNFFGYIVFSIIAKNILGISENVENAGKLLSDIVFDNDFNNIKYLHLSNKLVFYKKHKLLKSEVSEEASKKELASRLWSFSEELCRSFGFVSFNI

SEQ ID NO: 26094 - protein, 168 aa, Avena agadiriana
VMASSATSVAPFQGLKSTAGLPVSRRSNAGLGSVSNGGRIRCMQVWPIEGIKKFETLSYLPPLSEEALLKQIDFLIRSKWVPCLEFSKVGFIFREHGSTPGYYDGRYWTMWKLPMFGCTDASQVIKEVEEVKKEYPDAYVRIIGFDNIRQVQCVSFIAFKPPGCEESG

SEQ ID NO: 26095 - protein, 336 aa, Unknown
  Synechococcus sp. CC9311
MQSGSIETPQRILITGGSSGIGLEASKRLIRKGHQLTLLCRTEERCLETIKTLSANKAEQITAEGLSINLEDLHSVETGCRTLLQEDEPIDTLILNAGIQNVGIKEPQFTKQAIEETFCVNHLAHQHIVMRLLPLLLKSKKPRLVITSSEVHNPASGGGRVGKPATLGSLDGLRQHKQFAMINGETIFDADKAYKDSKLCNILMARHLANKLKKSGKEIPVITWSPGLVIPKGSGGFFRTSRQQNPIGLALFAFVARDLLRLTETLEKAGALLADLTNRDNYEKNGFQYISNQLISPGRHIFKEIETSQEGKNEQIGEELWTLSKNLIHQKLLKAP

SEQ ID NO: 26096 - protein, 532 aa, Oryza sativa
MTTLPTAILLLLLLLALPPPSAVVALTADGLALLALKAAVTDDPLSVLSSWSESDPDPCRWPGVTCSNVTAAGGEPRRRVVGVALAGKNLSGYIPSELGSLLFLRRLNLHDNRLAGGVPAALSNASSLHSLFLYGNRLTGALPAALCDIPRLQNLDVSRNTLSGGLPGDLRNCRSLQRLILAGNSFSGEVPAGIWAEMASLQQLDISSNGFNGSIPADLGELPRLAGTLNLSHNRFSGVVPPELGRLPATVTLDLRFNNLSGAIPQTGSLASQGPTSFLNNPGLCGFPLQVPCRAVPPPTQSPPAPTTTTTTTTPSSASAAAAAASEHHQPIRTSLIALISIADAAGVALVGVILVYVYWKVKDRKKQGRSSTVAAGDENESRHGLCRCIWGHRGVDSDTDTDDSSASENGGGGGKYGEGELVAIDRGFRVELDELLRSSAYVLGKGGKGIVYKVVVGNGATPVAVRRLGGGGGGGERCKEFAAEARAVGRARHPNVVRLRAYYWSADEKLVVTDFVGNGNLAAAMRGKHSL

SEQ ID NO: 26097 - protein, 466 aa, Escherichia coli
  misc_feature (345)..(345): Xaa can be any naturally occurring amino acid
MGQSSQPHELGGGLKSRHVTMLSIAGVIGASLFVGSSVAIAEAGPAVLLAYLFAGLLVVMIMRMLAEMAVATPDTGSFSTYADKAIGRWAGYTIGWLYWWFWVLVIPLEANIAAMILHSWVPGIPIWLFSLVITLALTGSNLLSVKNYGEFEFWLALCKVIAILAFIFLGAVAISGFYPYADVSGISRLWDSGGFMPNGFGAVLSAMLITMFSFMGAEIVTIAAAESDTPEKHIVRATNSVIWRISIFYLCSIFVVVALIPWNMPGLKAVGSYRSVLELLNIPHAKLIMDCVILLSVTSCLNSALYTASRMLYSLSRRGDAPAVMGKINRSKTPYVAVLLSTGAXFLTVVVNYYAPAKVFKFLIDSSGAIALLVYLVIAVSQLRMRKILRAEGSEIRLRMWLYPWLTWLVIGFITFVLVVMLFRPAQQLEVISTGLLAIGIICTVPIMARWKKLVLWQKTPVHNTR

SEQ ID NO: 26098 - protein, 179 aa, Aeromonas punctata
MHQRAVLAGGCFWGMQDLIRKRPGIISTRVGYTGGDIPNATYRNHGTHAEGIEIVFDPTVTSYRHILEFFFQIHDPTTLNRQGNDRGLSYRSGIYYVDEEQKRVAEDTIADVDASGLWDGKVVTEVQPVGEFWEAEPDHQDYLEKRPGGYTCHFVRPDWVLPKRHEAGDVSPAAGAAAE

SEQ ID NO: 26099 - protein, 134 aa, Escherichia coli; identical to SEQ ID NO: 388

SEQ ID NO: 26100 - protein, 430 aa, Staphylococcus epidermidis
MKTTIKQAKKHLNQEVTIGAWLTNKRSSGKIAFLQLRDGTGFMQGVVVKSEVDEETFQLAKDITQESSLYITGTITEDNRSDLGYEMQVKSIEIVHEAHDYPITPKNHGTEFLMDHRHLWLRSKKQHAVMKIRNEIIRATYEFFNENGFTKIDPPILTASAPEGTSELFHTKYFDEDAFLSQSGQLYMEAAAMAHGRVFSFGPTFRAEKSKTRRHLIEFWMIEPEMAFTNHAESLEIQEQYVSHIVQSVLNHCQLELKALDRDTTKLEKVATPFPRISYDDAIEFLKKEGFDDIEWGEDFGAPHETAIANHYDLPVFITNYPTKIKPFYMQPNPDNEDTVLCADLIAPEGYGEIIGGSERINDLELLEQRINEHELDEESYSYYLDLRRYGSVPHSGFGLGLERTVAWISGVEHVRETSPFPRLLNRLYP

SEQ ID NO: 26101 - protein, 104 aa, Glycine max
MGRKLVRCYMQINNTPYSKSRLCRCVSYPKITIYYNIMKKNGADEFTFWVHLNSWQNENDGIEALDADLIPCLMFKDKFAGKYALHLRLKVHPLDDIRINKMLL

SEQ ID NO: 26102 - protein, 271 aa, Unknown
  uncultured bacterium
QPNAMGGREVGGLANTLAAHMDYDSPGARSRVAGFWGTGAVADGPGYKAVDMFEAVHRGDIRVIWIMGTNPAVSLPDSARVREALARCPTVIVSDCVAHTDTTDLADILLPAAGWGKRMAPSPIRNAVFSRQRCFLPLPAEVKPDWWIMSSVAGKLGFGEAFNYKRPADIFREHAALSAHENNGERLFNLAGLANLSDAGYEALIPVQWPVMEGAGVEAEGSTRLFSDGRFVTDNQRARFVAINTRLPAQQTSDDYPMVVNTGRIRDQWHT

SEQ ID NO: 26103 - protein, 477 aa, Nostoc punctiforme
MHTIEKKSTTKAWAGAIVQPAKEFPSTQLPIISGKIPDGLRGTLYRNGPARLGRGGIHMGHWFDGDGAILAVNFTDAVATGVYRYVQTSGYQEEAAAGKLLYGNYGMTAPGPIWNQWQKPIKNAANTSVLALPDKLLALWEGGKPHALDLQTLETWGEDHLGGLTKGLNYSAHYKRDKQTGEIFNFGISPGQNATLNIYKSDSTGRIIKQAAYQLDGVPLVHDFVLAGQYLVFFIPPVRLNVLPLLIGINNYSDSLEWQPRLGTQILVIDRETLSVVSRGETEPWFQWHFGNGYVDASGSVIVDIARFEDFQTNQYLKEVATGETHTPAKSTLTRVHLHPQTGKVTSIQQLFNGHCEFPNVPQQNVGQASRYTYMSTSRSGTDISQEILNAIARFDNKTETLTEADFGENRYPSEPIHAQNTQNPAQSWVLTVVYDANSHTSEVWIFDSDRLDAEPVCKLGLPSVIPHSFHGTWNPA

SEQ ID NO: 26104 - protein, 269 aa, Unknown
  uncultured bacterium
QPNAMGGRKWAGWPIPLPLTWINSPSPSRVADFWGTGAVADGPGYKAVDMFEAVHRGDIRVIWIMGTNPAVSLPDSARVREALARCPTVIVSDCVAHTDTTDLADILLPAAGWGEKDGTVTNSERRISRQRCFLPLPAEVKPDWWIMSSVAGKLGFGEAFNYKRPADIFREHAALSAHENNGERLFNLAGLANLSDAGYEALIPVQWPVMEGAGVEAEGSTRLFSDGRFVTDNQRARFVAINTRLPAQQTSDDYPMVVNTGRIRDQWHT

SEQ ID NO: 26105 - protein, 273 aa, Unknown
  uncultured bacterium
QPNAMGGREVGGLANMLAAHMDLDNAQHRELVQEFWQSPTIADKPGLKAVDLFRDIEAGKVKAVWVMATNPVVSMPDRDFVARALEKCELVVVSDCVASNDTLKYAHVALPATGWSEKNGTVTNSERRTSRQRGLLAPAGEARHDWQIISDVAKKMGLSEGFDYRHSYEIFNEHSALSGYKNGRDKNESLRDFDISGLGQLSLRQYDNLRPVQWPLTNEKPQGSKRLFSDGKFFTASGKAQFIVIKPRLPEQSINRDFPFVLNSGRIRDQWHT

SEQ ID NO: 26106 - protein, 268 aa, Unknown
  uncultured bacterium
QPNAMGGREVGGLANMLTAHMTLKNSDHRALVKDFWQCGDLPDKAGLKAVDLFNAVNEGKVKAIWVMGTNPVVSMPNANLVREALQKCDFVVCSDAVKRTDTLDLAHVKLPAAGWGEKSGTVTNSERRVSRQRAIFPLHGDAKPDWWIVSEVAKRMGFGAAFDYQSPREVFVEFAALSGYQNEGERDFDISAYAELDEAEFEAMTPKQWPIKAEAPNGTPRMFVDGRYFTPNRKAKFIPTVARAPQEKVSDDYPLILNTGRIRDQWHT

SEQ ID NO: 26107 - protein, 141 aa, Brassica napus
MGEAVEIMFGNGFPEIHKDTSPIQTLLSNQQDCHWYEETIDDDLKWSFALNSVLHTGTSEYQEIALLDTKHFGKVLVIDGKMQSAERDEFIYHECLIHPALLFHPNPKTVFIMGGGEGSAAREILKHKTIEKVVMCDIDQE

SEQ ID NO: 26108 - protein, 200 aa, Triticum aestivum
MVDPRFRTQPMGASSVAFHLLSSNTMAPTVMASSATSVAPFQGLKSTAGLPISRRSSSAGLSSVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNLRQVQCVSFIAFRPPGSEESGKA

SEQ ID NO: 26109 - protein, 256 aa, Unknown
  uncultured bacterium
QPNAMGGREVGGLATQLCAHMGFDPISRDKVSRFWQTNRLAHEPGYKAVDMFEQVASGKIKAIWIMATNPVVSLPRSSKIAEALSVCPLVIVSDCVANTDTSRYADVFLPAAGWGEKDGTVTNSERQISRQRSFLPARKEVRPDWTIICDVARKMGFQEAFDFHHPNEIFAEHAALSGFENEGERLFDISHLESITRDEYDALEPFQWPRHKPFSDQAYPNPTQRANFIPVGDPSLHRGDHEFLLNTGRIRDQWHT

SEQ ID NO: 26110 - protein, 704 aa, Yersinia pseudotuberculosis
MLTPIIRKFQYGQHTVTIETGMMARQATAAVMVSMDDTAVFVTVVGQKKAKPGQSFFPLTVNYQERTYAAGRIPGSFFRREGRPSEGETLTSRLIDRPIRPLFPDSFLNEVQVIATVVSVNPQINPDIVALIGASAALSLSGIPFNGPIGAARVGFINDQYVLNPTTDELKESRLDLVVAGTAGAVLMVESEADILSEEQMLGAVVFGHEQQQVVIENINALVAEAGKPKWDWQAEPVNEALHARVAELAEARLGDAYRITEKQERYTQVDAIKADVTEALLAQDDTLDAAEIQDILASVEKNVVRSRVLRGEPRIDGREKDMIRGLDVRTGILPRTHGSALFTRGETQALVTATLGTARDAQNIDELMGERTDSFLLHYNFPPYCVGETGMVGSPKRREIGHGRLAKRGVLAVMPSASEFPYTIRVVSEITESNGSSSMASVCGASLALMDAGVPIKAAVAGIAMGLVKEGDNFVVLSDILGDEDHLGDMDFKVAGSRDGVTALQMDIKIEGITREIMQVALNQAKGARLHILGVMEQAISTPRGDISEFAPRIYTMKINPEKIKDVIGKGGSVIRALTDETGTTIEIEDDGTIKIAATDGDKAKHAIRRIEEITAEIEVGRIYAGKVTRIVDFGAFVAIGGGKEGLVHISQIADKRVEKVTDYLQMGQDVPVKVMEVDRQGRIRLSIKEATTPDAEAPEAAE

SEQ ID NO: 26111 - protein, 242 aa, Methanosarcina acetivorans
MQLPDILNRFKIPAFKFEEKGSIMKDNLPEKGAIVQRDRETYAIAPHLPGGVVDPDTLIKIAEVAKKYGAAALKATSAQRIAIVGLKEEDLDNVWADLNIKPGAAIGLCVRSIKICPGTTFCKQAKQDSLGLGLKLDEKYHGMPMPSKLKIGVSGCPNSCAEPAIKDIGIMGTAKGYNLMVGGSAAATPRLADVVAKGLSEDEVLDAVERILTYYKNSGTKKRLGKFIDGMSLEEFKTQVGL

SEQ ID NO: 26112 - protein, 726 aa, Salmonella typhimurium
MSTTDDTHNTLSTGKCPFHQGGHDRSAGAGTASRDWWPNQLRVDLLNQHSNRSNPLGEDFDYRKEFSKLDYSALKGDLKALLTDSQPWWPADWGSYVGLFIRMAWHGAGTYRSIDGRGGAGRGQQRFAPLNSWPDNVSLDKARRLLWPIKQKYGQKISWADLFILAGNVALENSGFRTFGFGAGREDVWEPDLDVNWGDEKAWLTHRHPEALAKAPLGATEMGLIYVNPEGPDHSGEPLSAAAAIRATFGNMGMNDEETVALIAGGHTLGKTHGAAAASHVGADPEAAPIEAQGLGWASSYGSGVGADAITSGLEVVWTQTPTQWSNYFFENLFKYEWVQTRSPAGAIQFEAVDAPDIIPDPFDPSKKRKPTMLVTDLTLRFDPEFEKISRRFLNDPQAFNEAFARAWFKLTHRDMGPKARYIGPEVPKEDLIWQDPLPQPLYQPTQEDIINLKAAIAASGLSISEMVSVAWASASTFRGGDKRGGANGARLALAPQRDWDVNAVAARVLPVLEEIQKTTNKASLADIIVLAGVVGIEQAAAAAGVSISVPFAPGRVDARQDQTDIEMFSLLEPIADGFRNYRARLDVSTTESLLIDKAQQLTLTAPEMTVLVGGMRVLGTNFDGSQNGVFTDRPGVLSTDFFANLLDMRYEWKPTDDANELFEGRDRLTGEVKYTATRADLVFGSNSVLRALAEVYACSDAHEKFVKDFVAAWVKVMNLDRFDLQ

SEQ ID NO: 26113 - protein, 231 aa, Methanosarcina acetivorans
MLCREAIPMKSTIPEKNAIIQRDGETYVIAPRTPGGIVDPATLRKIADVAEKYGAATLKMTSEQKMAIVGLKEEDIDAAWSDLGMDAGIVTGPFVKGVKFCPGTTFCRKGQQDAVSLGMKLEARYRGMKLPYMMKMAVSGCPSSCSEPVIKDVGVMGTAKGYILMVGGAAGLKPRLADVVAKGLSEEEILAAVDRIVEFFKDYGENRKRLGTIIDEIGLEEFKKEVGLWEK

SEQ ID NO: 26114 - protein, 374 aa, Methanosarcina acetivorans
MFKFADELGPFKIIHVYEPSVGLKAVLVVDNVARGPAIGGVRIAPDVSTEECFRLARAMTLKNAAADLSYGGGKVVIYGDPKMPLEKKSQILRALASALRYTEEYIFAPDMGTDEVCMACIKDEIGRVVGLPCEVGGIPLDEVGATGWGLFHATEVALQYCDFELKGARVAVQGFGAVGKHAARFLTRKGAVLVGAADSQGTIHDLEGLDVDTLIRLKREGKSVLDYPGGEKLGCDEILSVPCDIWIPAARPDVINEGNVHLLKAKLVVEGANIPVTEGAEKILYEKGILYVPDFIANAGGVICAASEYQGATRCTAFGSIEEKVRGNTEQVLEAAKTKGILPREAAVELAVKRIKRAMRYRRWSIFSSAPGFV

SEQ ID NO: 26115 - protein, 303 aa, Bordetella parapertussis
MSTPTYPTIEQTVGNTPLVRLQRIPGAAGQARGNVILAKLEGNNPAGSVKDRPALSMILRAEERGEIHPGDTLIEATSGNTGIALAMTAAMRGYRMVLIMPDNLSLERRAAMTAYGAELILTPAAKGGMEYARDLATAMQAEGKGKVLDQFGNPDNPRAHIEGTGPEIWNQTDGRVTHFVSAMGTTGTIMGVSTYLKSRNAAVQVVGAQPAEGSQIPGIRKWPEAYMPKIFDRSLVDAYESIAQAEAETMARRLAAEEGIFAGISSAGALVAALRVAERVENATIVFIVCDRGDRYLSTGVFN

SEQ ID NO: 26116 - protein, 882 aa, Chlamydomonas reinhardtii
MTVAEQPVALVPSGKVQAPDAIVSQAVELGAPYEPPLSPEDADWSQHVLPSAVDKRDQDTPDNWVRRDPRILRLTGRHPLNCEPPMSVLMQYGFITPPAVHFVRNHGAAPRIRWDEHRIEINGLVNKPLTLTMDELVALPSVTFPVTLVCAGNRRKEENMLKKSIGFNWGPCATSTTYWTGVRLRDLLQHAGIKTPAEGARFVCFRGPKGELPRGEDGSYGTSLTYAKAMDPASDVIIAYKQNHRWLTPDHGFPVRIIIPGFIGGRMVKWLSEITVMDTESQNFYHFMDNRVLPSHVDEELAKKEGWWYKPEFIINDLNINSAMARPWHDELVPLDANRPYTIKGYAYAGGGRKIIRCEVSLDDGKTWRLGDIQRFEEPNEYGKHWCWVHWTLEVNTFDFLSAKEVLCRAWDETMNTQPAVITWNLMGMMNNCYFRIKIHPEVDPATGVMGLRFQHPAPVELGDKGNMGWREEDNLVAQAVAAARDGGGAAAAPPPPPPAALLANGGPKQYTLEEVAEHASEESCWFVHEGRVYDATPYLNDHPGGAESILITAGADATDEFNAIHSSKAKAMLAQYYIGDLVASKPATANGTATANGNGTATANGTAAAAPPADPLVVLTGRAKVKLPLVERIELNRNTRIFRFGLPSPEHRIGLPVGKHVFVYAQVGGENVMRAYTPISGDEEKGRLDMLIKVYFKGEHASYPEGGKMSQHFDSLAIGDCLEFKGPLGHFVYNGRGSYTLNGKVTKHASHMSFVAGGTGITPCYAVIKAALRDPEDNTKLALLFANTHEDDILLREELDELANNHPERFRLWYTVSQPKDAATWKYDVGRVSKDMFTEHLFASTGEDCLSLMCGPHGMIEHCCVPFLEAMGYSKDRQIQF

SEQ ID NO: 26117 - protein, 319 aa, Moorella thermoacetica
MRTIGVLTSGGDAPGMNAAIRAVVRQAAALKIDVIGISRGYAGLIQGDFRRLNTGSVAGIIHRGGTILLTARSEEFRTEAGRATALDNLHREGIEGLVVIGGDGSFHGAVHLAKKGLPVIGIPGTIDNDIAGTDYTIGFDTAVNTAVEAISRIRDTATSHERIFIIEVMGRRSGQIALAAGIAGGAESILIPEYPVNYDRVVEKLEQGRHRGKLHSIIVVAEGVGSALEVSEEIARRTRLESRVTILGHIQRGGAPTAFDCMLASRLGARAVDLLADGASSRMVGIAANELVDRDLETVLREKKSIDPELYRLAEVLAL

SEQ ID NO: 26118 - protein, 221 aa, Yarrowia lipolytica
MARRPAKCYRYQKNKPFPKSRYNRAVPDPKIRIYDLGRKRAHVDDFPLCIHLVSNEREQLSSEALEAARICANKYITKVSGREAFHMRIRAHPFHVLRINKVLSCAGADRLAQGMRGAWGKPAGLAARVDIGQVLISIRTKDNNKATVIEGLRRCRYKFPGQQKIIISKKWGFTNLDREEYMTRRQNGEIKEDGAYVKFLTKKGPLAESLAEFPDYNGVSV

SEQ ID NO: 26119 - protein, 288 aa, Unknown
  Halobacterium sp. NRC-1
MPEDATPQDAIDAASQQRQRGRDARVYDHTAGDTQAGIPFIGAGPGDPGLLTVTGKELVEDADLVVHAGSLVNSELLDEYCADAETVSSVGKDLEALIPLMRDAHEDGDTVVRLHSGDPAIYGAALEQMDALEQEGVPTYIVPGVTSAFASAATLRTQLTLNGTANHVAFTRPQGKTLDAEDDHIAEFVEMGDVTTCIYLGTHAIPDVMERLLADGHDPETPVTVVYHASWPDEDVIEGTIETIGDRVEDAGYRASALAVIGDAGAGAGYERSYLYGDWANRGSDTDQ

SEQ ID NO: 26120 - protein, 851 aa, Saccharophagus degradans
MSKQRIVVVGNGMVGHKFIENLLAHEKADDYEIVAFSEEPRLAYDRVQLSKYFSGSTAEDLMLTSEDFYKENGVNYVLNEKVTAVKHDENKVVVASGKEIAYDKLILATGSFPFVPPIPGKDQPHCLVYRTIEDLEAITASAKESKVGVVVGGGLLGLEAGNALQNLGLEVHVVEFAPRLMAVQLDEGGGNLLRKKIEALGVNVHTEKNTQEIVAGETCRYRMNFADGSHLETDMILFSAGIRPQDELARNNDVLEIGERGGIVINNNCQTNIENIYAIGECALWDGKIFGLVAPGYQMSKVAISHITGGEDQFTGADMSTKLKLLGVDVASVGDAQGRTPGCLSYVYQDGVADVYKRIIVNAEKTRLLGAVLVGDVEAYGTLQQMYVNEMDLPEMPEAMILPSIDGSAASAGMGVDALPEGAIICSCNDVTKGQICCAVQDGSVTIGDIKANTKAGTSCGGCVALATQVMNSELTKLGVEVITDLCEHFAHTRQELHHIVRVEKIKTFGELIEKHGTGLGCDICKPTAASIFASVWNEYVLENQHAGLQDTNDHFMANMQKNGTYSIVPRVAGGEITPEKLIVLGQVAQKYKLYTKITGGQRIDLFGAQQHELPLIWKELVDAGFETGHAYGKSLRTVKSCVGSTWCRYGMLDSVGMAIRLEDRYKGLRSPHKIKFAVSGCTRECAEAQSKDVGVIATETGWSLYLCGNGGMKPRHADLFATGLDDETLIKYIDRFLMFYVRTADRLQRTSVWMDNLEGGLDYLKSVVIDDKLNVNAELESEMALVIDTYQCEWKTTIEDPEKLKRFRTFVNSDEKDNTVVFVEEREQIRPATEEERVRFVNAEEVAEIA

SEQ ID NO: 26121 - protein, 168 aa, Rhodospirillum rubrum
MSPLYDIEVTTLDGAPQTLADYAGKVLLIVNVASKCGFTPQYKGLEALQRRYRDRGFCVLGFPCNQFGHQEPGDAGEIKSFCTLTYDVSFPMFAKIDVNGPDAHPLYRLLKAEAKGLLGSEAIKWNFTKFLVSADGETISRFAPTDTPESLRARIEALLPAAQGPLGA

SEQ ID NO: 26122 - protein, 522 aa, Glycine max
MATTKIGLGVGPVPTTTHRVTAVAAPSSAVFSPPPHRLFLINSRRPPLRPRPSPLPLRVASSSSSSSSVAAPGKGVENVVIIGSGPAGYTAAIYAARANLKPVVFEGYQAGGVPGGQLMTTTEVENFPGFPDGISGPDLMDRMRRQAERWGAELYQEDVEVIDVKSSPFTVQSSERKVKSHTVIYATGATAKRLRLPREDEFWSRGISACAICDGASPLFKGQVLAVVGGGDTATEEALYLTKYARHVHLLVRRDHLRASKAMQDRVFDNPNVAVHFNTEAVDLVSNTKGQMSGILVRKIDTGEEYVLEAKGLFYGIGHSPNTELLKGQVELDHSGYVQVQEGTAKTSVEGVFAAGDVQDHEWRQAITAAGSGCVAALSVERYLVSNDLLIEFHQPKTEEVKKELTDRDVHEGFDITLTKHKGQYALRKLYHDSPRLICVLYTSPTCGPCRTLKPILSKVIDEFDQNVHFVEIDIEEDPEIAEAAGIMGTPCVEYFKNKEMLKTVSGVKMKREYREFIEANK

SEQ ID NO: 26123 - protein, 262 aa, Saccharophagus degradans
MSNSKPGKVWLVGAGPGDPDLLTVKALRVIQNADLVLFDNLVSQEIRALFPKSVPAFYVGKCKDNHSIAQKDLNSLLVKKAAKGLNVVRIKGGDPFVFGRGGEELLTLIKAGVDAEVVPGITSASGCTTAAGIPLTHRGLAQGCTFVTAHAETELSVDWNALAQINHTLVFYMGVSRAEMIASNLLKAGLSAATPVAIIENGCRENQREVIGQIKDLVSLVANNNVQSPALIVVGEVVSLANDLNPELRAAVSAETLNQHVA

SEQ ID NO: 26124 - protein, 473 aa, Lactobacillus sakei
MSQPQIGVIGMAVMGKNLALNIESRGYTVAIYNRTGAKTEAVIQDHSEKKLVASYTIEDFVKSLEKPRRIILMVKAGAGTDAVINELLPLLDKGDILIDGGNTFFGDTIRRNAELDKSGINFIGMGVSGGELGALEGPSMMPGGQKEAYDLVAPILEQMSAKAEDGQPCVTYIGPNGAGHYVKMVHNGIEYGDMELISESYNLLRNVVGLSVEEIADVFKEWNHGELDSYLMEITADILTRKDDLGTDKPIVDVILDAAGNKGTGKWSSQSALELGVPQSLITESVYARYISAMKDERVAASKILPAPTVAKLTEDKKELIEKIRQALYFSKIMSYAQGFEQMRVASDQYDWSLNYGEIAKIWRAGCIIRARFLQKITDAFDKKADLNNLLLDDYFLDITKKYQGAVRDIAALAIQQGVPAPGLTAAITYFDSYRSEVLPANLIQAQRDYFGAHTYERTDREGIFHYTWYKEQ

SEQ ID NO: 26125 - protein, 187 aa, Aeromonas punctata
MSQSPTGNRAAATERAILAGGCFWGMEDLLRRARGVISTRVGYTGGEMPDPTYARHYGHAEAVEVTFDPSVLAYRSLLELFFQIHDPTTYEQQGSDVGPSYRSAIFYTTEVQKEVALTTIAEIEASGSWPGPVVSEINPEEPFWEAEPEHQEYLVRYPGGYSCHFVRPTWRLDRSDERPAVILDRKS

SEQ ID NO: 26126 - protein, 485 aa, Desulfitobacterium hafniense
MDNLDPVVKEQNDIVVKVQNDTKKKVYALIGAIILGILVWFLGEGLGPQGRMALALTMTAIVLWIFEVYPVEITAVLLSTFFVFTGSATPVEAFSGYGDAIVWFIFAALVFGTAVEQSGIGKRIACSLMRFSGTSFKSMMGIIVLVGALLSFLTPAGVERLLIIYPIAIGVAAVFVKGNVQGTNTGKLAMSITYLAGNTFGFGILTGIAVNILGAGIIKEMLGIEIFWSQWILWFGVPTVITTLIAIFVAWKLFPPEDYVLTAKKENANQDFMNLGPMTIVEKRALLYLVITLGLWATDRWHHLPSWGVAIFSAALFCAPGFGVISKEQLKKIQFPIVIFSGAAITIGTVLGKTGVAAWIGKVFLGSFIRPDMSTQLMGAITYLVGVVAHIPLVESKTAAAAFTPAVAAYFDSMQLPALGPTLMSIMSADTVAFFPYMMMPFLALMGLGYFTTKDSIKLLSSYTFVAIIVQVISCFTWYHWVGLL

SEQ ID NO: 26127 - protein, 442 aa, Arabidopsis thaliana
  misc_feature (402)..(402): Xaa can be any naturally occurring amino acid
MKSTPKLLLLLLFIINHHVDSGSIVKFLPGFEGPLPFELETGYIGIGEEEDVQLFYYFIKSERNPKEDPLLLWLSGGPGCSSITGLLFENGPLALKSKVYNGSVPSLVSTTYSWTKTANIIFLDQPIGAGFSYSRIPLIDTPSDTGEVKNIHEFLQKWLSKHPQFSSNPFYASGDSYSGMIVPALVQEISKGNYICCKPPINLQGYILGNPITYFEVDQNYRIPFSHGMALISDELYESIRRDCKGNYFNVDPRNTKCLKLVEEYHKCTDELNEFNILSPDCDTTSPDCFLYPYYLLGYWINDESVRDALHVNKSSIGKWERCTYQNRIPYNKDINNSIPYHMNNSISGYRSLIYSGDHDLVVPFLATQAWIKSLNYSIIHEWRPWMIKDQIAGYIIYFCVXTRTYSNKMTFATVKGSGHTAEYKPNETFIMFQRWISGHDL

SEQ ID NO: 26128 - protein, 462 aa, Synechococcus elongatus
MASARIVDLLSQGQPGQTVVVRGWIRTARQLKEFTFVEVNDGSCLKGIQVVLGQELADYEMLAKQLDTGAAIAVEGQLVASPAKGQRVELQAASVEIVGGADPEQYPLQKKRHSFEFLRTIAHLRPRTNSLGAVMRVRNAAATAIHDFFQERGFLWVHTPIITASDCEGAGELFTVTNLDLDKLGQSQQAPDFEQDFFGKRAYLTVSGQLEAEIMALAFSNVYTFGPTFRAENSNTSRHLAEFWMVEPEMAFCDLGGDMDLAEAFLKFVFQRVSDRCSEDLEFFNQRIDSEVLNRAETILNNDFERVSYTDAIALLEKADRSFDYPVAWGIDLQSEHERYLAEEYFRKPLIVYDYPREIKAFYMRLNDDQKTVAAMDVLAPGIGEIIGGSQREERLDVLKQRLAEANLPEENYWWYLDLRRYGSVPHAGFGLGFERLVQFITGMGNIRDVIPFPRTPQNAEF

SEQ ID NO: 26129 - protein, 676 aa, Triticum aestivum
MDRARNFIPGPNQELLDIKPIRSLAPMFPAPMGVNINQSSTPPLVCVTPVGQFPTGFGGGNLPAFGSFATFSATANGFSQAGTSANGAIDATPISAYKTRSSGATALNGDDEPYSGNQTSASGRKAKKRSAGLSADGSDGVKAKRPKPVYKNLVAGKELAFLPASPNNPREIVEAVHMTFEALRRRHLQMDETQDASRRADLKAGAIMMASNIRANVGKRVGTAPGVEIGDIFYPRMELCIIGLHAPSMGGIDYMSAKFGADEDSVAICIVAAGGYENEDDDTDTLVYSGSGGNSRNTEERHDQKLERGNLALERSMHRKNEIRVVRGFKDPAMVAGKIYIYDGLYKIQESWTERTKFGVNCFKYRLQREPGQRDGAAIWKMTQRWIQDPSTRGRVILRDLSSGIESIPVCLVNEVDHEKGPGQFTYTNQVKYLRPVSSMTPMQGCGCQSVCLPGDANCACGQHNGGDLPYSSSGVLVCRKPIVYECGEACHCTLNCRNRVSQKGIRFHFEVFRTANRGWGLRCWEPIRAGAFICEYTGEVIDELKVNLDDSEDDYIFQTVCPGEKTLKWNFGPELIGEQSTYVSAEEFQPLPIKISAKKMGNVSRFMNHSCSPNVFWQPVQYNHGDDKHPHIMFFALNHIAPMTELTYDYGVVGEETSHRAKTCLCGSLTCRGLF

SEQ ID NO: 26130 - protein, 349 aa, Magnaporthe grisea
MYEGFMANGTAAGGQLTTTTDVENFPGFPKGIGGQELMDAMREQSSRFETEIISETVAKVDLSSRPFKYCTEWSPEVMHTADTLVIATGASARRLGLPGEDKYWQNGISACAVCDGAVPIFRNKPLFVIGGGDSAAEEAMFLTKYGSHVTVLVRKDKLRASSIMAKRLLSHPKVTVKFNSVGVEVKGGEDGLMSHMVIKDVVTGKEETLEANGLFYAIGHDPATQLVKGQLETDEEGYIVTKPGTPLTSVEGVFACGDVQDKRYRQAITSAGSGCMAAMDAEKFLAEQEDVEPDREARIFYREGTPSGSAKLKLPSWQGLSLASNTLVLAMYGERDNAVRITLTFQKWA

SEQ ID NO: 26131 - protein, 258 aa, Unknown
  uncultured bacterium
QPNAMGGREVGGLASMLAAHMGFSDPECDAGQSFWKSPTIARKPGRKAVDMFRDVHDGRIKAIWVMATNPAVSMPDADYVREALNRCDFVVVSDIIAETDTTAFADVKLPALAWGEKDGTVTNSEQVISRQRPLFAPPGKAKADWWIVREVARRMGFGDAFSFDGPAAVFREYAEQTGFRNDGQRKLDISEWAGTSDSEYDDWVPKAWGGASPFAEGKFTSADGKARLAAVAPSAPAPVDRAFPLRLNTGRYRDQWHT

SEQ ID NO: 26132 - protein, 268 aa, Unknown
  uncultured bacterium
QPNAMGGREVGGLANMLAAHMDYSVENTATVSEFWNTKNLSQTPGLNAVDLFEAVADGRIKAIWIMGTNPVVSMPNADRVRAALQSCDTVIVSDCMADTDTTATANILLPATGWGEKSGTVTNSERRISRQRVLIHPVGQAKSDWWIISQVGQAMGFNDAFDYHSPRDIFIEHAQLSAFKNTGNRLFNISTLSHLSEQQYNQLEPIQWPVTPLKPKGTARLFEDRLFFTPSKKANFVVISPQLPQLHTPNNDFPLTLNTGRIRDQWHT

SEQ ID NO: 26133 - protein, 271 aa, Unknown
  uncultured bacterium
QPNAMGGREVGGLANTLAAHMDYDSPGARSRVADFWGTGAVADGPGYKAVDMFEAVHRGDIRVIWIMGTNPAVSLPDSARVREALARCPTVIVSDCVAHTDTTDLADILLPAAGWGEKDGTVTNSERRISRQRCFLPLPAEVKPDWWIMSSVAGKLGFGEAFNYKRPADIFREHAALSAHENNGERLFNLPGLANLSDASYEALIPVQWPVMEGAGVEAEGSTRLFSDGRFVTDNQRARFVAINTRLPAQQTSDDYPMVVNTGRIRDKWHT

SEQ ID NO: 26134 - protein, 144 aa, Triticum aestivum
MAPKAGKKPAEKKPAAAAEKPAEEVAEKAPAEKKPKAGKKLPKEAIGATDKKKKRSKKSIETYKIYIFKVLKQVHPDIGISSKAMGIMNSFINDIFEKLAQEASKLARYNKKPTITSREIQTAVRLVLPGELAKHAVSEGTKAV

SEQ ID NO: 26135 - protein, 270 aa, Unknown
  uncultured bacterium
QPNAMGGRKWAGWPIPWPLTWNDSPGARSRVADFWGTGAVADGPGYKAVDMFEAVHRGDIRVIWIMGTNPAVSLPDSARVREALARCPTVIVSDCVAHTDTTDLADILLPAAGWGEKDGTVTNSERRISRQRCFLPLPAEVKPDWWIMSSVAGKLGFGEAFNYKRPADIFREHAALSAHENNGERLFNLAGLANLSDAGYEALIPVQWPVMEGAGVEAEGSTRLFSDGRFVTDNQRARFVAINTRLPAQQTSDDYPMVVNTGRIRDQWHT

SEQ ID NO: 26136 - protein, 206 aa, Unknown
  uncultured bacterium
  misc_feature (132)..(132): Xaa can be any naturally occurring amino acid
QPNAMGGREVGGLANQFAARLNIEDPVHRDRVQRFWNSGPLPERAGLSAVDMFDAIADGRIKAVWIMATNPVVSLPNVDKVKHALQNCELVVVSDCVAHSDTLDVAHVKLPALGWSEKDGTVTNSERFISRXRSLLPPSGEAKPDWWIISEVAKRMGYIDAFSYDHPYQIFAEHAALSGFENGGSRDFDISMFEDIDEKSYDALKP

SEQ ID NO: 26137 - protein, 134 aa, Staphylococcus epidermidis
MVSLPAWGGGDNAKAALMTRGLAEISRLGEKLGADPMTFLGLGGIGDLIVTCTSTHSRNYTLGFKLGQGKTAEEALKEMKMVVEGIYTTKSVYHLAQQEGVEMPITNALYEVLFEDVPVSKSVRTLMERDKKAE

SEQ ID NO: 26138 - protein, 421 aa, Streptomyces coelicolor
MVDADQTFVIVGGGLAGAKAAETLRTEGFTGRVILVCDERDHPYERPPLSKGYLLGKEERDSVFVHEPAWYARHDIELHLGQTVVAIDRAAKTVHYGDDGTHVSYDKLLIATGAEPRRLDVPGTGLAGVHHLRRLAHAERLKGVLATLGRDNGHLVIAGAGWIGLEVAAAAREYGAEVTVIEPAPTPLHGVLGPELGAVFAELHESRGVRFRFGVKLTEIVGQDGVVLAARTDDGEEHPAHDVLAAIGAAPRTALAQAAGLEIADRAHGGGIVVDDHLRTSDPDIFAAGDVASFHHALFDTSLRVEHWANALNGGPAAARAMLGRGLAHDRVPYFFTDQYDLGMEYSGWAPAGSYDQVVIRGDAAKREFIAFWVKEGRVLAGMNVNVWDVTEPIQQLIRSKTRVDTEDLANPHVSLESLVA

SEQ ID NO: 26139 - protein, 446 aa, Synechococcus elongatus
MFYLVDRDRMQNSEPARLRDSVRDRHSTIVIGAGQAGLSMAYCLQKRGLQPLVLEKHRIGFAWDQQRWDSFCLVTPNWQCRLPDFPYDGAEPEGFMGRQAIVDYLHRFAKTCRAPIREGVTVQRLQQCDRGFQLLTNEGEYWAQQVVIATGAYHEPKRHPLAARLPESIVQIDARDYRNPEQLPPGAVLVVGSGQSGCQIAEDLFLAGRTVHLSVGSAPRSPRRYRGRDVVDWLDQMGYYDTPIDAHADPRSVRRKTNHYLTGRDGGREIDLRQRAKEGLLLHGRLFTLTSQAIQFEDNLATHLDAADAVYCRIRRSIDDFIAQHQLEAPEEPPYQPCWQPTESQTSTQLLVAEIAAVIWCTGYRSDFSWVEVPVFDGSGLPVHQRGVTPVPGLYFIGLPWLHTWGSGRFCGVGQDAEYLADQIQWRRDRRDASQERLECTALLGS

SEQ ID NO: 26140 - protein, 576 aa, Bordetella parapertussis
MDSNLMSSVSTSAIVGGENFADLFAESLKSQDMKSGEVISAEVVRVDHNFVVVNAGLKSEALIPLEEFLNDQGELEVQPGDFVSVAIDSLENGYGDTILSRDRAKRLSAWLQLEQALENGELVTGTITGKVKGGLTVMTNGIRAFLPGSLVDLRPVKDTTPYEGKTLEFKVIKLDRKRNNVVLSRRQVLEASMGEERQKLLETLHEGAVVKGVVKNITDYGAFVDLGGIDGLLHITDMAWRRVRHPSEVLQVGQEVEAKVLKFDQEKSRVSLGVKQLGEDPWVGLARRYPQGTRLFGKVTNLTDYGAFVEVEAGIEGLVHVSEMDWTNKNVDPRKVVTLGEEVEVMVLEIDEDRRRISLGMKQCRQNPWEEFATNFKRGDKVRGAIKSITDFGVFVGLPGGIDGLVHLSDLSWTESGEEAVRNFKKGDELEAVVLGIDTDKERISLGIKQLEGDPFNNFVATHDKGAVVPGTIKSVEPKGAVITLSVDVEGYLRASEISSGRVEDATTVLKAGENIEAMIVNIDRKARSIQLSIKARDNAETAETIQRMSEASASSGTTNLGALLKAKLDQQRNDG

SEQ ID NO: 26141 - protein, 1214 aa, Coprinopsis cinerea
MASRHSRDVRMHDPPHHLNGAATPSHPPAISPAVQPSPAAPPHNTSIIHKLNVANEQTWLLIGKYHFNFKWATSSPVSTRPGGRTNGRLGARTERVAGIARIKENYPKAIEYFQRVLALQEDNGEVWSALGHCYLMQDDLQKAYSAYQQALYLLPNPKDDPKLWYGIGILYDRYGSLDHAEEAFSSVLRMDKDFDKANEILFRLGIIYKQQGKYQESLECFDRILRNPPSPLAHADIWFQIGHVFEQQKDYHRAKDAYERVVMDNPSHAKVLQQLGWLYHQDGSAFQNQDLAIQYLTKSLEADPTDAQSWYLLGRAYMAGQKYNKAYEAYQQAVYRDGRNPTFWCSIGVLYFQINQYRDALDAYSRAIRINPYISEVWFDLGSLYESCNNQITDAIDAYARASELDPTNPAITQRLQLLRQAQANGTQLPAAPGPQDVHPTAYASAVVPPPGLNGPLSLGNNHPRHGLRTESRGPGGDVLPALAASGRNSPPFRGGPPPPVVIDDRHAPSHPPLAPMEVDRPPHSRDYPPSRDPHPRGPSGHQTIIHGNGPSQAPPVGDPRNGPPHPHADPFFNRSRGPRSRSISPAPHSARPRSPGHQNFTNYPPHRQAGGPGQPGPPVQRSPRFNHILDQGRPGDREGWDHERRPPPADQREWERERDRRPRHSGEFGAPPQPMYQQSPPVPTQRAHSPPHPSPRQARYQWDQKGPGGPPVPAHHPHGASPPPPPEQRRYDRDYPVESRAYPPSPGNTRNVLRQSHPHMADPSRRSESPHPSQSADAKDRRRRARDSRDFEPPQQLPPQQLPLQPPPVPSNASTPALQDPSSRKESKRRKNGTRRGEGSETPKPEQQQQPQRSNSFKVMPGYPEGGNGAGPSSFRSMQPPYSNDSDDRNVKLMQPPYSAKGPGSPEAERDRFSSKSSYGYKNAGSPEPISNGPPSSRSVQPSPTIATPRPVVRAIDEDYDNDGIDALMGLSQAQQYRAQPGSASSAEHPAQSPTISPGSRQGDPSPRPPPSHRNSVSSTRSHASPSSQAAQLKRPRSPGSDESDSKRSRTDPVRRRSSVSAGRHTPVPSTRPSPIPFRTQPQPPPSHSPETRQAHEYPPASPTHVPSVVLPPHPRPVGSGHATTHSGPVGGNGAPLALPPIATLSPQSSTAPSPAGERDRDDRMQVDGSRSASPQNRKGPPSTESGGRPASRTPPGTKNTPSPPAVEKKEQM

SEQ ID NO: 26142 - protein, 819 aa, Streptomyces coelicolor
MQNTGTRTPATTPTHCPYCALQCGMNLTPVEGGTVEVSERTDFPVNRGALCGKGRTAAAVLAPGARLTSPLVRSGDGALVPAGWDEALDRIAGNLERTRARYGADALGVFGGGGLTNEKAYALGKFARVVLGTSQIDYNGRFCMSSAAAAGTRAFGLDRGLPFPLEDVPRTGCVILVGSNPAETMPPSLRYFTELRENGGTLIVVDPRRTKTAEQADLHLAPRPGTDLALALGMLHLVVAEGRVDEAYVEERTSGWEEARAAAMAHWPEYVERITGVSVPELREAVRLFCAPEAAMVLTARGPEQQAKGTDTVGAWINLCLATGRAGRPLSGYGCLTGQGNGQGGREHGQKADQLPGYRKLTDPAARRHVAEVWGVDPDALPGPGRSAYELLDALGTDVRSLLVMGSNPVVSAPRAAHVEGRLRSLDFLAVCDVVLSETAELADVVLPVTQWAEETGTTTSLEGRVLLRRRAITPPDGVRGDLEVLHGLAGRLGVQKGFPTDPEEVFEELRRASAGGPADYSGIDYRRLAEENGVFWPCPAQPAADDTHTADPGTGTDTRTRTGTGSGSGSGSGRDMSTETGTGSGMYTDTGTASGMSTDTGSGSTDAGIGRDPRAATGTGSGMSTDTGRVTRTATGTGSGMSTDTGSDSDSDSSDAGAGLRAAPHPGTPRLFLDRFATDDGRARFAPVTHRPSAEEPDDEYPVLLTTGRVVSQYQSGAQTRRVAELNAAAPGPFVELHPRLAARLGAADGDPLAVVSRRGRAVAPARITTGIRPDTVFMPFHWPGEGRANTLTNPALDPTSRMPEFKVCAVRVETVTS

SEQ ID NO: 26143 - protein, 110 aa, Triticum aestivum
  misc_feature (76)..(76): Xaa can be any naturally occurring amino acid
MDSQFGALERGGSRQRRGPALARPNTAKRHMQQQRANAADKKVVIPNYFGIEAFFVLACLTVSLLILPLVLPPLPXPPSLLLFVPVCLLILLMVLAFMPNDVRSMATSYL

SEQ ID NO: 26144 - protein, 145 aa, Arabidopsis thaliana
  misc_feature (27)..(27): Xaa can be any naturally occurring amino acid
  misc_feature (45)..(45): Xaa can be any naturally occurring amino acid
  misc_feature (106)..(106): Xaa can be any naturally occurring amino acid
LIHGPWAMATVLGIFVGQAWNGVAWFXAGAQPNAIAPFSFGSLLXKRWVDFFNPDSQSVEWATPWSKTAENFANYTGDQGYPGGRFFDPLGLAGKNPAGVYEPDFXKLERLKLAKIKPSRLAMGAMLIFYFEAGQGKTPLGALGL

SEQ ID NO: 26145 - protein, 578 aa, Zea mays
MASSTAASPLTCHHLGSVGARPRLPSLSISLRRRSSSSSKPTSLSHSLPSKHSLAPPPAASASSRRGLTPVPASASAAAAPAPDPVPVPAPAPAPAPAPAAPPKKPALQGAAIKPLLASIATGVLIWLIPPPAGVPRNAWQLLAIFLSTIVGIITQPLPLGAVALLGLGAAVLSRTLTFAAAFSAFGDPIPWLIALAFFFARGFIKTGLGSRVAYAFVAAFGSSSLGLGYSLVFAEALLAPAIPSVSARAGGIFLPLVKSLCEACGSRAGDGTERRLGAWLMLTCFQTSVVSSAMFLTAMAANPLSANLTAATIGEGIGWTLWAKAAIVPGLLSLVLVPLILYVIYPPEVKASPDAPRLAKERLAKMGPMSKEETIMAGTLLLTVGLWIFGGMLNVDAVSAAILGLAVLLISGVVTWKECLAESVAWDTLTWFAALIAMAGYLNKFGLISWFSETVVKFVGGLGMSWQLSFGVLVLLYFYSHYFFASGAAHIGAMFTAFLSVASALGTPSLFAAMVLSFLSNLMGGTTHYGIGSAPVFYGAGYVPLAQWWGYGFVISVVNIIIWLGVGGFWWKIIGLW

SEQ ID NO: 26146 - protein, 172 aa, Glycine max
MQSLQQKASEWSGVSIADAFAIDEANLFHKLGLQTLVNLSTNFYNRVYDDEQEWFRSIFANSDKQNAIQNQIEFLVQRMGGPTLYSQRRGHPALIARHRPFPLTHEAANRWLHHMGQALDSTSAIDDDSKIKLINFFRHTAYFLVAGVEHKDQNFHVPCKDAALKQHPCKNF

SEQ ID NO: 26147 - protein, 487 aa, Pseudomonas aeruginosa
MTDLNTSQGQQLRRVLKPRHLNMIAIGGSIGTGLFVASGATVATAGPGGALLSYALIGLMVYFLMTSLGEMAAYMPVSGSFCTYGSRFVEDGFGFALGWNYWYNWAVTIAAELVAAQLVMSFWFPEVPGIYWSAIFLGIMFGLNVISARGFGESEFWFALIKVVTVVIFIGVGLATIFGIMHGVESPGFSNFTMGDAPFVGGFQAMVGVAMIAGFSFQGTELIGIAAGESENPRKNIPIAIRQVFWRILMFYILAIFVIGMLIPYTDPNLLKNDASDISVSPFTLLFERAGFAAAAGVMNAVILSAILSAGNSGMYASTRMLYNLALEGKAPRLFSRVSRSGVPRNALYATTLVGALCFLTSAFGDSTVYTWLLNTSGMCGFIAWLGIAISHYRFRKGYLAQGGRLEDLPYRAKLFPFGPLFAFALCMVITLGQNYQALVGERIDWIGLLATYISLPLFLAIWLGYRWKKRARFVRYHEMDVSPTNT

SEQ ID NO: 26148 - protein, 52 aa, Oryza sativa
  misc_feature (43)..(43): Xaa can be any naturally occurring amino acid
MIIHENGGQDNMEGENMNAQEGTTSPGYIGADARHPNLHKKIXIPQGGGGTG

SEQ ID NO: 26149 - protein, 487 aa, Desulfitobacterium hafniense
MRALEPLIFELSREGRTGVSLPSCDVPEIPLEDLIPQEFLRDKEPELPEVSEVDVVRHFTRLSSFNHGVDTGFYPLGSCTMKYNPKVNEKLARLPGFSQIHPYQPEELTQGALGLMVELQEELAEITGMDAFTLQPAAGAHGEMTGILIIKAYHDHRQDVKRRKVIVPDSAHGTNPATGAMAGYDIVQVPSNERGGVDIEALRQVANDEVAALMLTNPNTLGLFDENILEIAEIIHSVGGLIYYDGANANAIMGIARPGDMGFDVVHLNLHKTFSTPHGGGGPGSGPVGVKEFLAPYLPKPVAIRTPEGRYSWDEDRPLSIGRVRAFQANFGVLVKAYAYIRALGGEGLKAASQNAVLNANFLMSILKEHYHLPYDRVCMHEFIITPKNLKNYGIHTLDIAKRLLDYGYHPPTIYFPLIVEEAMMIEPTETESLETLEQFARVMIQIAEEVKQDAEMVKNAPHDTLVTRLDETGAARKPDLRWRKPQ

SEQ ID NO: 26150 - protein, 446 aa, Desulfitobacterium hafniense
MNYVPNTVDQQEQILTRIGVGSLEELFADIPESVRRQAQLKIREGLSELELVKYMGRLAAENKTVEEYTSYLGAGAYEHFIPSYVDQLLLRSEFYTAYTPYQPEISQGTLQAIYEFQTLVCELTGMDGANASMYDGASALAEAALMSCDATRRKKVLVPQTIHPEYREVLRTYLLPRGVEILEIPYQEGAVDSEALEKALNTEVAAVLIQSPNFFGMIEKAVEIGQMAHAKGGLLVMAVNPVSLGLLKSPGELGADIVVGEGQPFGNPLNFGGPYLGFLACREKYVRRMPGRIVGATKDKNGKKGYVLTLQAREQHIRREKAASNICSNEALCALAFTIHLSGLGKRGLKEMARLNLQKAHYGAEEIGKLPGMSLAFQGPFFHEFVIKTEVSPRKINEALLSHKIIGGLELSRFYPELDQHLLFCVTETKTKEDIDRLVAGMGEIK

SEQ ID NO: 26151 - protein, 380 aa, Lactobacillus plantarum
MAEQDLYKVLGVEKDASQDEIKKAYRKLSKKYHPDLNHEPGAEEKFKAVNEAYETLGDAQKRAQYDQFGSTGGQQGFGGAGGFGGQDFGGFGGGGGFEDIFSSFFGGGAGGSRRSNPTAPQQGRDLQYEMTLKFEDAIFGKKTTITYNREEQCETCGGSGAKPGTSPVTCSKCHGAGYIQVQTNTPLGRMMSQQVCDVCHGTGKEIKDKCATCGGSGHTEQSHSIKVTVPAGVEEGQQMRLQNQGEAGTNGGPYGDLFIIFRVEPSKDFERDGATIYFKLPIDFVQAALGDEVQVKTVHGDVKLKIPAGTQTGTTFRLRGKGAPRLRGNGNGDERVTVNIETPTHLNKGQKEALKTFAKASGKSVAGNGKSSLFDKLRGV

SEQ ID NO: 26152 - protein, 348 aa, Pseudomonas putida
MLSIAGIAKCGKNDRRCDQLQAWRRPNVFSRPCNDPGRPVVEIGGGPFYGDAHMQGRKAMLVLHGKQAMNEDVRSAVGDLRDSGWVLDVRVTWEAGDAQRLVAEALAAGYSHIVAGGGDGTLRDVAEAMGLAATQASLALLPLGTANDFAKAAGIPLEPASALALLNVAPQPIDLGQAGDQLFLNMATGGFGSQVTANTSEDLKKVLGAAAYLFTGLSRFSELQAASVELQGPGFHWQGDLLALGIGNGRQAGGGQVLCPEAMVNDGLLDVAILPAPQEVVGALRDLLGGDGLFVRARLPWVEIKSSQGLDINLDGEPLQAANLRFQARPAALHLHLPAGSPLLSHPG

SEQ ID NO: 26153 - protein, 113 aa, Populus trichocarpa
MAEVKLLGAWGSPFSCRVEMALKLKGVEYEYIEQDLANKSPLLLKYNPIHKKVPVLLHNGKTIAESLVILEYIDETWKSNPILPEDPYDKAMARFWAKFIDEKVRPLISSVFL

SEQ ID NO: 26154 - protein, 208 aa, Staphylococcus epidermidis
MRKITVFGMGSFGTALANVLAQNGHDVLMWGKNVENVDELNTHHMNKNYLKDAKLDSSIKATVDLNKAVQFSDIYLMALPTKAIREVSKDIDQLLTSKKTFIHVAKGIENDTFKRVSEMIEDSISSEHNGGIGVLSGPSHAEEVVIKQPTTVAASSKDNNVSKLIQDLFMNDYLRVYTNNDLVGVELGGALKNIIAIASGIVAGMGWG

SEQ ID NO: 26155 - protein, 128 aa, Alteromonadales bacterium
MRLLHTMLRVTNLEKSIAFYTHVLGMKELRRSENEEYRYTLAFIGYGDEKDTTVLELTYNWDQSSYSLGDAYGHIAIEFEDIYKACDDIKAAGGNISREPGPVKGGTTQIAFVKDPDGYAIELIQKKS

SEQ ID NO: 26156 - protein, 206 aa, Unknown
  uncultured bacterium
  misc_feature (115)..(115): Xaa can be any naturally occurring amino acid
QPNAMGGREVGGLANTLAAHMDYDSPSARDRVARFWETEAVADGPGMKAVDLFDAVERGDIKVLWIMATNPAVSLPETHRIRRALDQCPTVIVSDCVRNTDTASHADILLPAAGXGEKDGTVTNSERCISRQRRFLPLPGGARPDWWIVSAVARALGHQTGFDYECPADIFREHARLSGFENAGQRFFNTSGLADLTDEQYEAMEP

SEQ ID NO: 26157 - protein, 229 aa, Coprinopsis cinerea
MNGTLTDEQLRAVVQGPGDVEWRYEMRRECQEILPGLYLGPFVASKSLETLQSLGITHIVCIRDAKEAFSVKPRFPGQFHYMTLDVEDNEEQNLIRVFPGAKKFIDEAISAGGRVLVHCNGGISLSPSFVVMFVMQHYQLSWEDALHMVQNRRYCISPNGGFLTQIKEYEAIYRANIAVQSYPQNRPAVPRRKRSDDDDDEDDRPDDRSKRALVKSYSEEIDPNAMEIS

SEQ ID NO: 26158 - protein, 390 aa, Lactobacillus sakei
MQTNWWQNAVFYQVYPRSFQDSNGDGIGDIQGIIQRLDYLADLGVNAIWLSPVYQSPNVDNGYDISDYQAINPEYGSMVDMEQLIEAAKIRKIKIVMDLVVNHTSDQHPWFLEARKSKDNPYRDFYIWRDPATDGSVPNDLQSNFKGSAWAFDAVTGQYYLHFYAKEQPDLNWQNPKVREAVYQMMTWWLQKGIGGFRMDVIDLIGKEPDRKIKENGPQLHAYLQEMNARVLSQYDVVTVGETWGATPEIGQMYSNPNRHELSMIFQFEQINLDKQSGMTRWDLKPLIPAELHAVFSKWQLALDGVGWNSLFWSNHDLPRIVSRWGDDSQYREKSAQALAIYLHMLKGTPYIYQGEEIGMTNYPITSYHEIEDIESRRVYQQRQQQGYAI

SEQ ID NO: 26159 - protein, 206 aa, Unknown
  uncultured bacterium
QPNAMGGREVGGLANQLAAHMDFASEESIDRAKRFWKARNMASKDGLKAVDLFEAIEDGKVKAVWIMGTNPAVSLPNADQVVRALKKCPLVVVSDCMAQTDTVTLADICLPATGWSEKNGTVTNSERRISRQRSLLPPSGEAKPDWWIISEVAKRMGYIDAFSYDHPYQIFAEHAALSGFENGGSRDFDISMFEDIDEKSYDALKP

SEQ ID NO: 26160 - protein, 205 aa, Unknown
  uncultured bacterium
QPNAMGGREVGGLANMLAAHMDIDNSDHRERVQRFWQSPTIAEKPGLKAVDLFQQIKQGKVKAVWVMATNPVVSMPDKDDVAEALQSCELVVVSDCVASNDTLAYADVCLPASGWSEKNGTVTNSERRISRQRGLLPPAGEARHDWQIICDVAKHIGYAGFDYQTSCEIFNEHIALSGFENQGRRDFDLSGLGHLSLSQYDNLTP

SEQ ID NO: 26161 - protein, 205 aa, Unknown
  uncultured bacterium
PNAMGGREVGALANLLAAHMGFSCSEDIDRVRRFWEAPKIATKPGLAAVQMFDALADGQLKAIWVMATNPAVSLPNSDHVRRALASAELSIVSDCYLDTDTVGLSQVHLPALPWGEKDGTVTNSERRISRQRAFLSPLGDARPDWWIICRVAKALGFEHGFDFSHQAEIFDEHARLSAFENDGRRHLDLGGLVGLGRTAYDDLGP

SEQ ID NO: 26162 - protein, 904 aa, Nicotiana benthamiana
MAASVENRQFSHLEAGLSRSFKPRSDSPVRGCNFPSSHSTNFQKKPNSTIYLDYSSSEDDDDDDEKNEYLQMIKKGNSELEPSVHDTRDEGTADNWIERNFSMIRLTGKHPFNSEPPLNRLMHHGFITPVPLHYVRNHGPVPKGTWDDWTVEVTGLVKRPMKFTMDQLVNEFPSRELPVTLVCAGNRRKEQNMVKQTIGFNWGAAAVSTTIWRGVPLRALLRRCGVFSKNKGALNVCFEGADTLPGGGGSKYGTSIKKEFAMDPARDIIVAYMQNGEKLTPDHGFPVRMIIPGFIGGRMVKWIKRIIVTTQESDSYYHFKDNRVLPPHVDAELANTEAWWYKPEYIINELNINSVITTPCHEEILPINAWTTQRPYTLRGYSYSGGGKKVTRVEVTLDGGETWQVSTLDHPEKPTKYGKYWCWCFWSLEVEVLDLLSAKEIAVRAWDETLNTQPEKLIWNVMGMMNNCWFRVKMNVCKPHKGEIGIVFEHPTQPGNQSGGWMAKERHLEISAEAPPTLKKSISTPFMNTASKMYSMSEVRKHSSADSAWIIVHGHIYDATRFLKDHPGGTDSILINAGTDCTEEFDAIHSDKAKKLLEDFRIGELITTGYTSDSPGNSVHGSSSFSSFLAPIKELVPVQRSVALIPREKIPCKLIDKQSISHDVRKFRFALPSEDQVLGLPVGKHIFLCAVIDDKLCMRAYTPTSTIDEVGYFELVVKIYFKGIHPKFPNGGQMSQYLDSMPLGSFLNVKGPLGHIEYQGKGNFLVHGKQKFAKKLAMIAGGTGITPIYQVMQAILKDPEDDTEMYVVYANRTEDDILLKEELDSWAEKIPERVKVWYVVQDSIKEGWKYSLGFITEAILREHIPEPSHTTLALACGPPPMIQFAVNPNLEKMGYDIKDSLLVF

SEQ ID NO: 26163 - protein, 205 aa, Unknown
  uncultured bacterium
  misc_feature (99)..(99): Xaa can be any naturally occurring amino acid
QPNAMGGREVGGLANMLAAHMDIDNSDHRELVQRFWQSPTIAEKPGLKAVDLFQKIKQGKVKAVWIMATNPVVSMPDKDAVAEALQSCELVVVSDCVAXNDTLAYADVCLPASGWSEKNGTVTNSERRISRQRGLLPPAGEARHDWQIICDVAKHMGYAGFDYQTSCEIFNEHIALSGFENQGSRDFDLSGLGHLSLSQYDNLTP

SEQ ID NO: 26164 - protein, 320 aa, Bacillus subtilis
TKGGIRFHPNVTEKEVKALSIWMSLKCGIIDLPYGGGKGGIVCDPRDMSFRELERLSRGYVRAISQIVGPTKDVPAPDVFTNSQIMAWMMDEYSRIDEFNSPGFITGKPLVLGGSHGRESATAKGVTICIKEAAKKRGIDIKGARVVVQGFGNAGSYLAKFMHDAGAKVVGISDAYGGLYDPEGLDIDYLLDRRDSFGTVTKLFNDTITNQELLELDCDILVPAAIENQITEENAHNIRAKIVVEAANGPTTLEGTKILSDRDILLVPDVLASAGGVTVSYFEWVQNNQGFYWSEEEVEEKLEKMMVKSFNNIYEMANNR

SEQ ID NO: 26165 - protein, 381 aa, Mycobacterium avium
MARDYYGLLGVSRGASDAEIKRAYRKLARELHPDVNPDEAAQAKFKEISVAYEVLSDPEKRRIVDLGGDPLEGAAAAGGGFGGFGGLGDVFEAFFGGGFGGGTTSRGPIGRVRPGSDSLLRMRLDLEECATGVTKQVTVDTAVLCDRCHGKGTNGDSAPVPCDTCGGRGEVQTVQRSLLGQVMTSRPCPTCRGVGVVIPDPCHQCMGDGRVRARREISVKIPAGVGDGMRVRLAAQGEVGPGGGPAGDLYVEVHEQPHDVFVREGDDLHCTVSVPMVDAALGATVTVDAILDGVSEITIPPGTQPGSVITLRGHGMPHLRSGTRGDLHVHVEVVVPSRLDARDTELLREFKGRRGRDVPEVRSTHAGGGLFSRLRETFTGR

SEQ ID NO: 26166 - protein, 322 aa, Bacillus subtilis
TKGGIRFHPNVTEKEVKAVKALSIWMSLKCGIIDLPYGGGKGGIVCDPRDMSFRELERLSRGYVRAISQIVGPTKDVPAPDVFTNSQIMAWMMDEYSRIDEFNSPGFITGKPLVLGGSHGRESATAKGVTICIKEAAKKRGIDIKGARVVVQGFGNAGSYLAKFMHDAGAKVVGISDAYGGLYDPEGLDIDYLLDRRDSFGTVTKLFNDTITNQELLELDCDILVPAAIENQITEENAHNIRAKIVVEAANGPTTLEGTKILSDRDILLVPDVLASAGGVTVSYFEWVQNNQGFYWSEEEVEEKLEKMMVKSFNNIYEMANN

SEQ ID NO: 26167 - protein, 361 aa, Escherichia coli
MTCLSMLPIAQIVNKIVILFFYVCKFPTILPLSANNYGDLMGTTKHSKLLILGSGPAGYTAAVYAARANLQPVLITGMEKGGQLTTTTEVENWPGDPNDLTGPLLMERMHEHATKFETEIIFDHINKVDLQNRPFRLTGDSGEYTCDALIIATGASARYLGLPSEEAFKGRGVSACATCDGFFYRNQKVAVIGGGNTAVEEALYLSNIASEVHLIHRRDGFRAEKILIKRLMDKVENGNIILHTNRTLEEVTGDQMGVTGVRLRDTQNSDNIESLDVAGLFVAIGHSPNTAIFEGQLELENGYIKVQSGIHGNATQTSIPGVFAAGDVMDHIYRQAITSAGTGCMAALDAERYLDGLADAK

SEQ ID NO: 26168 - protein, 700 aa, Xanthomonas oryzae
MRAMCLALTSASLRAWRTLSSIGLRHALARARAARDACGARPVTPRCQQAGALTMCGLAGLLLASPRLHGEQLDALVRPMGAALRHRGPDDAGTWCDAQAGVALAHQRLSILDLSPLGHQPMRSADGRYVLAYNGEVYNFAQLRAALSALGHRFRGHSDTEVLLAAVVEWGLDETLTRCNGMFAIALWDERDNCLFLARDRVGKKPLYYGWAGDTLVFGSELKALWQHPDFDNGVDRNALTLLLRLGYIPAPACIHAHTFKLMPGRVLRMDAQAVAAGAAAHRADQAQQPFWNAREAMQRALAAPFTGSDAQAEEQLDSVLRDAVALRMVADVPVGVFLSGGTDSSIVTAMMQAQSAQPVHTFSIGFEGSHHDEAPLAREVATHLHTDHTELYVSGADALAVVPCLPDMFDEPFADASQVPTALVARLARGGVTVALSGDGGDELFFGYGRYQRALRNWRMHGLVPGPLRRLMAVAARRNGESSRTGGLAALVAEAGARGIGDIYRNRISRWRDPAAVVPGATEPDSFYSLADPLHGSGTPADAMMLADFAAYLPDDLLCKVDRTTMAVGLEARAPLLDWRVAEFAWSLPLSLKYRDGMSKYLLKRVLCRYLPDTMVYRGKRGFGAPVSAWLRGDLHGWADDLLAHGALQREGVFAADTVAGLWRDFNGGERKWHTHLWTVLMFQAWQAHWREQRAAITR

SEQ ID NO: 26169 - protein, 462 aa, Synechococcus elongatus
MASARIVDLLSQGQPGQTVVVRGWIRTARQLKEFTFVEVNDGSCLKGIQVVLGQELADYEMLAKQLDTGAAIAVEGQLVASPAKGQRVELQAASVEIVGGADPEQYPLQKKRHSFEFLRTIAHLRPRTNSLGAVMRVRNAAATAIHDFFQERGFLWVHTPIITASDCEGAGELFTVTNLDLDKLGQSQQAPDFEQDFFGKRAYLTVSGQLEAEIMGLGFSNVYTFGPTFRAENSNTSRHLAEFWMVEPETAFCDLGGDMDLAEAFLKFVFQRVSDRCSEDLEFFNQRIDSEVLNRAETILNNDFERVSYTDAIALLEKADRSFDYPVAWGIDLQSEHERYLAEEYFRKPLIVYDYPREIKALYMRLNDDQKTVAAMDVLAPGIGEIIGGSQREERLGVLKQRLAEANLPEENYWWYLDLWRYGSVPHAGFGLGFERLVQFITGMGNIRDVIPFPRTPQNAEF

SEQ ID NO: 26170 - protein, 948 aa, Unknown
  marine gamma proteobacterium HTCC2207
MLEFYEPQADYGTPKSTSTNMVTLSIDGVEVTVPEGTSVMRAAAESGVKIPRLCATDQLKSFGSCRVCLVEIEGRRGFPVSCTTNVEAGMEVKTQSDEIGKLRRNVMELYISDHPLDCLTCPTNGDCELQDTAGELGLRSVRYGFEGENHLVAEKDESNPYFTFDPSKCIVCSRCVRACEEVQGTFALTIDGRGFESKVSASQAEDFMDSECVSCGACVNACPTATLTEKSIIEAGKPEHSVTTTCAYCGVGCSFKAEMKGSQVVRMTPYKDGKANEGHACVKGRFAFGYATHKDRITVPMIRDSIDDPWREVSWEEAVTYTAKRFKAIQAQYGRTSIGAISSSRCTNEEVYLVQKMVRAGFGNNNVDTCARVCHSPTGFGLKTTLGESAGTQTFASVADADVVIVMGANPTEAHPVFGSRLKRRLREGAKLIVIDPRKIELVSSPHITADYHLPVRPGTNVTLLNALAHVVVNEGLEAREYIADRCDVAEFEKWVAFIGDERHSPENTETITGVSAADLRAAARLYATGGNGAIFYGLGVTEHSQGSTAVMGIANLAMLTGNIGRDGVGVNPLRGQNNVQGSCDMGSFPHELPGYRHISDKATRDLFEGEWGVTLDSEPGLRIPNMFDAALDGEFKGLYCQGEDIAQSDPNTQHVEAALRSIECLVVQDIFLNETAKFAHVFLPGASFLEKDGTFTNAERRISRVRKVMPPLSGKADWEGTMALANALGCKMEYSHPSDIMDEIARLTPTFNGVSYDRLEQLGSIQWPCNDSTPEGTPIMHVDQFVRGKGFFAMTEYVATTERANRKFPLLLTTGRILSQYNVGAQTRRTDNSEWHGEDLIEIHPHDAEERGINHGDWVGINSRVGDTVLRADVTDRVKPGVVYTTFHHPVSGANVITTDNSDWATNCPEYKVTAVQLSKVTQPSNWQARQKSFDKQQQGLLKDARH

SEQ ID NO: 26171 - protein, 410 aa, Streptomyces coelicolor
MTSKTRVVVIGAGLAGVTLARRLGELGTPALTLGDEEHRPYNRVLLAEVLAGRYGPEVIALPAPAGLLRGRVTGIDRAGRTVRCADGSVIAYDTLVLATGSNAVLPPLRGLFTPDHELPEGVHAFRTMDDCLGLSKAVRPGVRAVVIGGGLLGVSAARALAVRGAQVVLAQQSERLMERQLDPAASALVRRHLEGLGVEVHTECRVRDVRSVGGAVRSVEMGDGYALGADLVVLACGVRPRAGLAREAGLAVGKGVLVDDELRTSDPHIRAIGDCAQHADHVYGLAAPALEQAGVLAELLAEGGTATRHYTGTRALTRLTLTGADSPFAPLDLAAFGETDPRPGDDVVQLADATRGTYRKVVVRDDRLVGGVLVGELGTVGALARAWEGAEPLPSDGGPLLHLLTQDGGS

SEQ ID NO: 26172 - protein, 251 aa, Oryza sativa
MDPDAVKSTLSNLAFGNVMAAAARDYQKVGGGAGRAAGWISAPAGGIESRLVIGSGVDGRLIRAQSTRLSCAAPWIVEGRGNGENDLEIVAKEKAQAASASHDEVDLDELLDDPELEKLHAERIAALKKEVEKREVLKRQGHGEYREITEGDFLGEVTGSEKNAPFFVTKLGIKTLPCVILFKKGIAVDRLVGFQDLGSKDDFSTRALENILKMKGIIDEKKKDEDDEDDETDMSMNRRIRSSTAQDSDSE

SEQ ID NO: 26173 - protein, 1028 aa, Oryza sativa
MVPKCGYIRKAVAAARGGATATVDLDLSALPGGADAFDKAARYCYGANFEISVRNAAALLCAAAFLDMHPTDGGLARRVEEFLAKVGLRTLPGAVAVLRSCEGLLPAAEEIGVVQRSADAIALRICNEVLFPTRSPPDWWTAELAALSPASFHKVITALRCRRAEPEVLVAAATAYAELLLAEVLAADGHAADHSGMHRALVESVVAVLPSTDDAPLPAAFLCRLLHVAITICASAKTCRDLELRVAAVLDQATAGDLLTVALDSAGERVQNVDTVRRIITAFVERDSAASSGGANGRSRRASLSGAGALQGGGGAMQTVAKTVDEVAAEIATEESLPISKFVGLAGAVPKEARATHDCLYRAVDIYLKAHPALEEMEREKVCSVMDPLKLSYQGRLHASQNNRLPLQAVLSALYYDQLKLRSGDEGGGGWDAYGNGVMRSSAAGSARKQAKEEASLARENEALRSELARMRAYVSGMQQQSKGSSSSRGKKGSWLRTLSRLNPFKAGIWGKDTSGIVDGKTDAMNSVKSKRRSDQLRRTSPVLGRNSLSRRTPYTSGFSCVHRCSRHARRRLKLSGCGAQWDPRVGLILSIRAVKSTVALTTDVENGSAHECRAMGMCPIPPSWSAATPRLHLHHLLLLLALASDMEDAHHHHWTMVECSGTQLWASGRPFIIHGFNTYWLMSFAADQATRPRVTAAIAEAAEAGLNVCRTWAFSDGGYRALQTVPFHYDEDVFQALDFVVSEAKRHNMRLILSLCNNWEDYGGKAQYVRWGKEAGLDLTSEDDFFSDPTIKSYYKAFVEAVVTRINTVTNETYKDDPTILAWELINEPRCPSDPSGDTLQAWIEEMASYVKSIDPVHLLEIGIEGFYGLSTPELLPVNPDEYSGHAGTDFMRNHQAPGIDLASIHVYSDTWLPHSIKENHLQFVDKWMQQHIHDAANLLGMPIVVGEFGVSVKDGKFGNEFREDFMKTVYRIFLSSWKEGVIGGGCLLWQLFPEGAEHMDDGYAVIFAKSPSTLSLLANHLRCLEC

SEQ ID NO: 26174 - protein, 419 aa, Thermococcus profundus
MVEIDPFEMAVKQLERAAQYMDISEEALEWLKKPMRIVEVSVPIEMDDGSVKVFTGFRVQHNWARGPTKGGIRWHPAETLSTVKALATWMTWKVAVVDLPYGGGKGGIIVNPKELSEREQERLARAYIRAVYDVIGPWTDIPAPDVYTNPKIMGWMMDEYETIMRRKGPAFGVITGKPLSIGGSLGRGTATAQGAIFTIREAAKALGIDLKGKKIAVQGYGNAGYYTAKLAKEQLGMTVVAVSDSRGGIYNPDGLDPDEVLKWKREHGSVKDFPGATNITNEELLELEVDVLAPAAIEEVITEKNADNIKAKIVAEVANGPVTPEADDILREKGILQIPDFLCNAGGVTVSYFEWVQNINGYYWTEEEVREKLDKKMTKAFWEVYNTHKDKNIHMRDAAYVVAVSRVYQAMKDRGWVKK

SEQ ID NO: 26175 - protein, 242 aa, Unknown
  Synechococcus sp. RS9917
MLSGSSPSTSLSAEELLERFSSGSTRQRRSLIPTLESRASEIAALGSAALAAFDPAGDAWEAGWLLQVLQRHQPQVLPALLGTCDGWFQAPSSVGIDYGPLQRDLLAERFEDADRSTSAILRRLAGAEAERRGYVYFSEVPAMPGQDLVTLDRLWLAYSQGRFGFSVQARLLEGLNGRYDRLWPRIGWKLDGVWTRYPGAFDWSITAPEGHMPLINQLRGVRLMDAILNHPSLLARRSSSRR

SEQ ID NO: 26176 - protein, 150 aa, Glycine max
  misc_feature (101)..(101): Xaa can be any naturally occurring amino acid
  misc_feature (118)..(118): Xaa can be any naturally occurring amino acid
  misc_feature (129)..(129): Xaa can be any naturally occurring amino acid
  misc_feature (131)..(131): Xaa can be any naturally occurring amino acid
  misc_feature (136)..(136): Xaa can be any naturally occurring amino acid
  misc_feature (141)..(142): Xaa can be any naturally occurring amino acid
KLSGISEIIPEMEICDFDFEPCGYSMNAIHGSAFSTIHVTPEDGFSYASYEVMGLDATALSYGDLVKRVLRCFGPSEFSVAVTIFGGRGHAGTWGKALGAXVYDCNNMVEQELPVGGXLVYQSFCAAEXAXATLPXSVLHXXDGENVLLL

SEQ ID NO: 26177 - protein, 387 aa, Methanosarcina thermophila
MATTRDYYEILGLSRDATPEDIKKSYRKLALKYHPDRNKEPGAEEKFKEISEAYAVLSDPEKRAQYDRFGHAGINGQYTAEDIFRGADFSGFGDIFEMFFGGSRRGPRGPRRGSDLQYDLYITFEEAAFGVRKDIDVPRTERCSNCSGTGARPGTSPKRCPTCGGTGQIRTTRTGLGMQFVSTTTCSTCRGKGQVIESPCPVCSGTGRVRNTRKITVNVPAGADSGMSLRLSGEGDAGDPGAPPGDLYVVLHVMEHKIFKRVDYDVISEVPISFAQAALGTDIMVDTLYGKVKMNIPAGTPTHSVFKIKEKGIQHLHGNRRGDQLVRVVIKTPTNLSHEQKRNFFASLKALSSGKNPGGEKGRYDKFTEKSKKSKGFFEKVKDAFES

SEQ ID NO: 26178 - protein, 334 aa, Oryza sativa
MASQGVASMFALALLLGAFASIPQKAEAIGVCYGMSANNLPPASSVVGMYRSNGITSMRLYAPDQAALQSVGGTGISVVVGAPNDVLSNLAASPAAAASWVRNNIQAYPSVSFRYVAVGNEVAGGATSSLVPAMENVRGALVSAGLGHIKVTTSVSQALLAVYSPPSAAEFTGESQAFMAPVLSFLARTGAPLLANIYPYFSYTYSQGSVDVSYALFTAAGTVVQDGAYGYQNLFDTTLDAFYAAMAKHGGSGVSLVVSETGWPSAGGMSASPANARIYNQNLINHVGRGTPRHPGAIETYVFSMFNENQKDAGVEQNWGLFYPNMQHVYPISF

SEQ ID NO: 26179 - protein, 323 aa, Bacillus subtilis
TKGGIRFHPNVTEKEVKAVKALSIWMSLKCGIIDLPYGGGKGGIVCDPRDMSFRELERLSRGYVRAISQIVGPTKDVPAPDVFTNSQIMAWMMDEYSRIDEFNSPGFITGKPLVLGGSHGRESATAKGVTICIKEAAKKRGIDIKGARVVVQGFGNAGSYLAKFMHDAGAKVVGISDAYGGLYDPEGLDIDYLLDRRDSFGTVTKLFNDTITNQELLELDCDILVPAAIENQITEENAHNIRAKIVVEAANGPTTLEGTKILSDRDILLVPDVLASAGGVTVSYFEWVQNNQGFYWSEEEVEEKLEKMMVKSFNNIYEMANNR

SEQ ID NO: 26180 - protein, 517 aa, Sorghum bicolor
MQFSLASDANSGPHPIRRSCEGGGIDRLERLSIGGSKQEKALRNRCFGGRVAATTQCILTSDACPETLHFQTQSSRKSYADANHVSAIILGGGTGSQLFPLTSTRATPAVPVGGCYRLIDIPMSNCFNSGINKIFVMTQFNSTSLNRHIHRTYLGGEINFADGSVQVLADTQMPEEPDGWFQGTADSVRKFIWVLEDYYNHKSIEHIVILSGDQLYQMNYMELVQKHVEDNADITVSCAPVDESRASNNGLVKCDHTGRVLQFFEKPKGADLNSMRVDTNFLSYAIGDAQKYQYIASMGIYVFKKDALLDLLKSKYTQLHDFGSEILPRAVLEHNVQTCIFMGYWEDVGTIKSFFDANLALTEQPSKFDFYDPKTPFFTAPRYLPPTQLDKCKIKDASISDGCLLRECSIEHSVIGVCSRVSYGCELKDCVMMGADIYETEEEASKLLLAGEVPVGIGGNTKIRNCIIDINARIGKNVVITNSKGIQEADHPEEGYYIKSGIVVILKNATIKDGSVI

SEQ ID NO: 26181 - protein, 320 aa, Bacillus subtilis
TKGGIRFHPNVTEKEVKALSIWMSLKCGIIDLPYGGGKGGIVCDPRDMSFRELERLSRGYVRAISQIVGPTKDVPAPDVFTNSQIMAWMMDEYSRIDEFNSPGFITGKPLVLGGSHGRESATAKGVTICIKEAAKKKGIDIKGARVVVQGFGNAGSYLAKFMHDAGAKVVGISDAYGGLYDPEGLDIDYLLDRRDSFGTVTKLFNDTITNQELLELDCDILVPAAIENQITEENAHNIQAKIVVEAANGPTTLEGTKILSDRDILLVPDVLASAGGVTVSYFEWVQNNQGFYWSEEEVEEKLEKMMVKSFNNIYEMAKNR

SEQ ID NO: 26182 - protein, 871 aa, Streptomyces coelicolor
MTATPGNPPTIVLVGHGMVGQRFLEALAERGLTGTHRVVVLCEEPRPAYDRVQLTSYFSGKTPEDLSMTDPAFIAEHGIELRVGDPAETIDREARRVTARSGLVVEYDVLVLATGSYPFVPPVPGKDAEGCFVYRTIEDLLAIEAYARTRATTGAVVGGGLLGLEAAGALNGLGLTSHIVEFAPRLMPVQVDEGGGAALLRTIEEMGLSVHTGVGTQEITTGEDGAVTGMKLSDGSELATDLVVFSAGVRPRDQLARDCGLAVGERGGISVDERCRTVTDERVFAIGECALAADGRVYGLVAPGYEQAETAAATIAAQEASFTGADLSTKLKLLGVDVASFGDAHGTTEDCLDVVYSDSRAGLYKKLVVGRDGTLLGGILVGDAEAYGTLRAFTGSVPPVSPESLVLPAGAGAPAQLGPAALPDDAVICSCHNVTKGTIRGAVTEHSCTTVPEVKKCTRAGTGCGSCVKVLGQLVTAELEASGVEVDKGLCGCFAQTREELYEIVGALRITSYRELLDRHGREGARGGEGCEVCKPAVGSIIASLAPSIGASGYVLEGEQAALQDTNDHFLANLQRNGSYSVVPRIPGGEIAPEKLIVIGEIARDFGLYTKITGGQRIDMFGARVEQLPLIWARLVDAGFESGHAYGKSLRTVKSCVGQTWCRYGVQDSVRMAIDLELRYRGLRSPHKLKSAVSGCARECAEAQSKDFGVIATSNGWNLYVGGNGGATPRHADLLAQDLSDAELVRLIDRFLMFYIRTADKLERTSTWLERIPGGLDHVRDVVVHDSLGICDELESLMRAHVSHYRDEWAETVNDPEKLARFVSFVNAPDVPDPVVGFVPERDQIKPDLPLLDIGRRPASADDLLEGSTRR

SEQ ID NO: 26183 - protein, 888 aa, Solanum demissum
MTEKVDLVFNYGGKWVLSPQVVYIKKLDETWHGYDVDLLSYIDICSEFIEKYGFRAVKQLLVTGPTGRYYLLEDDSSIRTLQSALSSQFSVLQLFVVDEDEATVVIPNICDLNKPYPAVPVEVATDCESNEEDEDQNEPIPSYYNSDELEVFRKEKNREISDKLDRFLELEKGMCFKDLKEAKRIVSFYSIVRKVALKVEKSDSTRLRYLCDIGCPFECLISEDRKNQGFKIKTLNTKHSCGENVFKNRRATQEALAYYFKKKLQNNPKYSVNDMRQDLDDNFNLNVSYSKMKRVKRLVLEKLEGSYIDEFNKLEGYAQELRDSNPGTDVIINISRDALEQGKRRFLRMYVCIQALKNGWKGGKCKGILLVAMGQDSVKHFYPLAWAVVDRETSRTWKWFIELLRNSLDLANGEGVTFMSDMHKGLLDAVSQVFPKAHHRWCARHIEANWSKAWKGVQMRKLLWWSAWSTYEEEFHDQLKVMGAVSKQAAKDLVWYPAQNWCRAYFDTVCKNHSCENNFTESFNKWILEARAKPIIKMLENIRIKIMNRLQKLEEEGKNWKGDFSPYAMELYNDFNIIAQCCQVQSNGDQGYEVVEGEDRHVVNLNRKKCTCRTWDLTGILCPHAIKAYLHDKQEPLDQLSWWYSREAYMLVYMHKIQPVRGEKFWKVDPSHAMEPPEIHKLVGRPKLKRKREKDEARKREGVWSASRKGLKMTCGHCSATGHNQRRCPMLQRSKQPAQDVPVQREKIVADESEDEQHVAPSSAVADEDRGEHESEDEQTILRPKAISEARTRLQAKKIQIRPTGTRRIGFKGDDNGVSIPTNLPYSPRKLAWKGKETMTSNQLTAEKETRIGNLKAKKGKKSTTLDQLTVEKEKKIGKLKAKRGGKK

SEQ ID NO: 26184 - protein, 194 aa, Zea mays
MAAAGGGSREATVAAALAREPRRFFAGAAVRERAHPCRWRPEKFFEVEMKVRDYEIDQYGVVNNAVYASYCQHGRHELLESVGISADAVARSGESLALSELNLKYFAPLRSGDKFVVKVRLAGIKGVRMIFDHIITKLPNHELILEAKATAVCLNKDYYPTRIPRELLSKMQLFLSVDSRGSNEDVNNRNNSCN

SEQ ID NO: 26185 - protein, 188 aa, Brassica napus
MTIGGGHGDSEVLTVMEPPSQRNTETPSFQNATVPVDSSGRATVFRPFSLSSPHSRAFHLAWLSLFSCFFSTFSIPPLIPVISSDLRLSASAVSAAGTASFAGSIFSRLAMGPLCDLIGPRTSSAILSFLTAPAILSTAFVSSPTSFVLVRFFVGFSLANFVANQYWMSSMFSGNVVGLANGVSAGWA

SEQ ID NO: 26186 - protein, 568 aa, Rickettsia sibirica
MSIKLKQRFVPQLAAMNHEFAEDFSKMLETVDTSHIKEKTVVKGQVIEIKNDIIIVDVGLKNEGRIPKSEFLALPEVGDVVEVFIEKIEGRNGRTILSREKAVKEELWGQLEIMCSKGEFVDGTIFGRVKGGFTVDLSGVVAFLPGSQVDVRPIKDPTSIMNIKQPFKILSMDKKLGNIVVSRRAILEESRSEARDEMLSKIKEGMVLEGTVKNITDYGAFIDLGSVDGLLHLTDISWGRVNHPSEVLDFNQKVKVMVIKFDEKTKRISLGIKQLDSNPWEAIKEEFPVGKQMTGKVTNFADYGVFIELKDGLEGLVHSSEISWLKSNPNPRKTLTIGQEVDFVVLEVDTEKHRVSLSIKQCQENPLTKFAENNPVGTIIKAPIRNITDFGIFVALGNNMDGMIHEGDISWEDKGTDLLKSYKKGDEIECKVLAINIEKEQVSLGIKQLSPNPYQEISDEYKKGTIVKALITAVKDEGLEVLLNDKVAGFIKRTELSDEKDEQKPEMFQIDKEIEAKVVSIEKSTGRILLSVKAHKIAERQKALKEYGSSDNTTNMGDILANALEDKK

SEQ ID NO: 26187 - protein, 335 aa, Myxococcus xanthus
MRGSVIGSGSFGTALANVLAVNCEEVRLWGRESSVVEAINTQHENPTYLKGIPISERVRATNDLQEALVGSELVVLATPSHATREVVAKAQAYLPRHVPIVTVSKGIENGTLLTMTELLEDCLPEEFHPYLAVLSGPSFAKELARRMPTVVTIASHWDKVALRCQKALQTETFRSYTSTDVVGVQYGGALKNVIAIAAGMADGLGMGHNARAAIITRGLAEITRLAVRKGANPLTLSGLSGMGDLVLTCTGELSRNRHVGMELGKGRKLPDILADMKEVAEGVKTARSAHELELKTGVELPICHQVYLIAHEGKSARTAVVDLMTRQPKSELAGV

SEQ ID NO: 26188 - protein, 178 aa, Myxococcus xanthus
MTTVIRETKETQVRVELAPGKGVTNVDTGLKFFDHMLATFARYAGLDLSLHARGDLTHHVMEDVAITLGTAVQQVIPATAARFAERTIPMDDALVQACLDAGGRFYYQGPLKNRLYEHWMRSFSEHARVTLHLRVLRGKDSHHATEASFKALGLALRDAMVDSGSVFSMKGSVSLEVK

SEQ ID NO: 26189 - protein, 310 aa, Streptomyces coelicolor
MTGWSTGDIPDLDGRVAVVTGANGGLGYVIARELARKGATVVLACRSEERGSAAVRRLMGEVPAAAVEPARLDLGDLASVREFAYGLPYERVDLLVNNAGVMALPHGTTVDGFETQFGVNHLGHFALTGLLLPSLLAAPGARIVTVSSVLHALARVDPRDLNSVRRYGRWTAYARSKSANLLFTHELARRLAGREGASDVRAVAAHPGYAETGLHGAGPRAEGRRLAERLARLGSRVVAQSPEAGALPVLYAATAPGVPSDSFTGPSFAMWRGTPAPSWRASWTIDDAMGERLWAASERLTGVIYEALLP

SEQ ID NO: 26190 - protein, 544 aa, Bacillus clausii
MPKVASMIVKFIKEKGCKTVFGVPGKPVVPLILAMEESGVSFVLARHEGGAGFMATGYALQTGGLGVAIGTSGPGGTNMITAAAQAQAFHAPVLFITGHPPLSQSGMALGQDSSMFGTDLVALFKPVTKFSAKVESKGMLKRYLQHAEEQALTGAKGPVHLSVPLDILIEEVDEFTLSRLPVQDHIRSGNIQLAIKALNRAKRPLMLVGKGAHFSGAYKEVEQVAEKWSLPVVTTPGGKGTFVTDHPLSLGSLGLGGTEGAAAYVKDKPIDLLLVVGSKLSDMSTVGLTAGGMPSQVLHFDYQGLFVGKSLPADTLFVQGDAKINLQQLLLEAKEFPQRQQVDLREYRDRNRAPVDGCDRLSTAQTMGALREVLPADTVVYGDDGSHTFYAIKHFRTLVPGTFYFDDVFGAMGHAIGLSIGAKMAQPQRPIACFTGDGCLYMHGTEIATAVDQKTNVLFVVFNNGMLDMVDKGMKHNLGRTAGTRYEQEINAALFAESLGAKGFRCNTVAEVKEAVQKGNRFEGPVVVEVMVSKEETPPTLGRG

SEQ ID NO: 26191 - protein, 123 aa, Narcissus pseudonarcissus
QPMSVFWLVPQFFLVGAGEAFCYIGQLDFFLRECPKGMKTMSTGMFLSTLSLGFFLSSALVTIVHKVTGESGQGAWLPDDLNRGKLYDFYWLLAVLSAVNLVAFLVSARWYVYKENRMATDDG

SEQ ID NO: 26192 - protein, 209 aa, Synechococcus elongatus
MQLSDRPLTAPGTAPRQATVSRRTGETDVQVFLNLDGTGRCQADTGIPFLDHMFDQIASHGLIDLEITAKGDLHIDDHHTNEDVGITFGLALAEALGDRKGIVRFGHFVAPLDEALVQVALDFSGRPHLTYGLTLPTERVGTYETQLVREFFVAIANNAKLTLHLRQLDGINSHHIIEATFKAFARSLRMATEVDPRRAGQIPSSKGVL

SEQ ID NO: 26193 - protein, 845 aa, Glycine max
MMAVSSACKDGSKVALDNGKYVRYTPEQVEALERLYHECPKPSSLRRQQLIRECPILSNIEPKQIKVWFQNRRCREKQRKEASRLQAVNRKLTAMNKLLMEENDRLQKQVSHLVYENSFFRQQTHNNNATLATTDTNTSCESVVTSGQRNLTPQQHPPRDASPAGLLSIAEETLAEFLSKATGTAVEWVQMPGMKPGPDSIGIVAISHGCPGVAARACGLVGLEPTRVAEILKDRLSWFRDCRTVDVLNVMSTGNGGTIELLYMQLYAPTTLAPGRDFWLLRYTSLLEDGSFVVCERSLNNTQNGPAMPPVQHFVRADMLPSGYLIRPCEGGGSIIHIVDHMVLEPWSVPEVLRPLYESSMLLAQRTTMAALRHLRQISQEVSQPSVTGWGRRPAALRALSQRLSKGFNEAVNGFADDGWSMLESDGIDDVTLLVNSSPSKMMGVSLVYNNNGFPSVSSSVLCAKASMLLQNVPPAILLRFLREHRSEWADSSIDAYSAAAIKAGPCSLPGARSGGFGGQVILPLAHTIEHEEFMEVIKLENMGYYRDDMSIPGDVFLLQLCSGVDEHAVGTSAELVFAPIDASFSDDAPILPSGFRIIPLDSGTDAASPNRTLDLASALEVGTTANKAASDNSAHSGSTKSVMTIAFQFAFEVHLQENIATMARQYVRSIIASVQRVSLALSPSRFGSHNAFHLPPGTPEAQTLARWICNSYRFYLGVELLKCEGSESILKSLWHHSDAVLCCSLKALPVFTFANQAGLDMLETTLVALQDITLEKIFDDNGKKTLCTEFPQIMQQGFMCIQGGICLSSMGRPVSYERAVAWKVLNEEESAHCICFMFINWSFV

SEQ ID NO: 26194 - protein, 185 aa, Pseudomonas aeruginosa
MSVDLAHIRQVRAEADCLFNNDEVEAAIGRVAEAINRDLGETNPVVFCVMNGGLIFSGKLLPLLDFPLELSYLHATRYRNETSGGELFWKAKPEISFIDRDVLIIDDILDEGHTLSAIIDFCKHAGARAVHTAVLVDKEHERKARPDLKASFTGLYCADRYVFGYGMDYKGYWRNAAGIFAVKGL

SEQ ID NO: 26195 - protein, 304 aa, Thermotoga maritima
MKVVFLICNPAAGGGRAGKIWNRVEDLLKKHGIDHKFAFTERPGHAMEISKKAFKEGYRRIAAFGGDGTVNEMVNGIFLNGYDLREVVFGWIPFGSGKDWARTIGVPLEIEEAIKMLKDGKEFVQDLGVGEYEKASGEIEKRAFVNVAGLFFDGFVTYRTNLLKRKNRVSYFSRIFSSIIEYDPPTARIQIDEKVWEKRVFSMNVGICKYNGGGMNQLPHAVPDDGLLAVTVINDIGKLRILANLHRVFNGKLLEHPGVEGYQAKKVVVEFQRDEPVEFDGESFWAKKIFFSIIPGVIRVLVKK

SEQ ID NO: 26196 - protein, 374 aa, Prochlorococcus marinus
MADFYQILGVSRDADANTLKSAYRKLARQYHPDVNKDPGAEDKFKEIGKAYEALADPETRARYDQFGEAGIGGAAGMPDMGDMGGFGDLFETFFNGFGGQSSQGGRSQRRGPQQGDDLRYDLNIDFKDAIFGQQREINIPHLETCEVCRGTGAKKGTGPTTCTTCGGSGQVRRATRTPFGNFTQVAECPTCNGVGQIISDPCTSCGGNGVKQVRKKLRINIPAGVDSGTKLRVSGEGNVGLKGGPPGDLYVFIKVKNDSNLKREGINIYSEISVSYLQAILGDTVDIITVDGKVNLKIPSGTQPNSTLSLENKGVPRLGNPVARGNHQVLVKVKLPTRITEDERNLLEDLASKYTEQNSSSNSGLFSRLFGKDS

SEQ ID NO: 26197 - protein, 323 aa, Idiomarina baltica
MFKKFNAKSTADEVLSGVDLRGKRFLITGVSSGIGLETARSLAAHGASVVGTVRELQKGELTSAPIREAASQGNGNFELVQLDLASLQSVHACADNLLGNGQLFDAIIANAGVMATPFGRTVEGVEIQFGTNHLGHFALINRIEQLIADNGRLVVLSSQAHRAADVDLSDPNFEQQEYDPFVAYGRSKTANALFAVEFDKRHRHRGIRAASVMPGNSLTDLARHFSQEDLQGLFEFVGNARAEAGLPPSELKDVAQAAATSVWGAAVADKDEIGGRYLEDCTIAAVDDTPNPFVDGVRSYALDAKKAKELWTVSDELLAAACN

SEQ ID NO: 26198 - protein, 473 aa, Unknown
  Halobacterium sp. NRC-1
MEHYEQARYAPAEGETNEPLLSENDQTTVSVDPSLPDDLTRDTVELPSLEEPELARHYVRLSQQNYGVDSGPYPLGSCTMKYNPRFTEDAAALPAAAVHPDRSETALQGTLAVMHDLQDYLGRIGGMDAVTLQPPAGAAGEFTGILIAEAYHEATDGGHRNEVIVPDAAHGTNFASAALGGYDVIELPSGDDGRVDLDALEAALGENTAALMLTNPNTLGLFERDIEPIAEMVHDAGGLLYYDGANLNALLGRARPGDMGFDIMHFNVHKTFATPHGGGGPGAGPVGVTDELAGFLPDPHVRQSAGGDYELYTPPRSIGKVHGFQGNWPVLVKAFAYIDRLGDSGLADASAKAVLNANYLADQLDYEIPLGPFHHEFVASAGDQDAADVAKRMLDYGVHPPTTKWPELVAEALMTEPTETESKRTLDDLADAFNAVAGDDDAALADAPSRTTARRIDQTAAARNPRLSWHDLD

SEQ ID NO: 26199 - protein, 116 aa, Glycine max
  misc_feature (39)..(39): Xaa can be any naturally occurring amino acid
TLQVLLVGGGDGGILREISRHSSVEHIDICEIDKMVIDXIAFTNSVPEGTYDVIIVDAFQPMGPIAEVLADNCFLESVAKALRPGGVLSAPADSLWHKNFVVADTIANCKKIFKGS

SEQ ID NO: 26200 - protein, 441 aa, Unknown
  Halobacterium sp. NRC-1
MSGSPYASPSEADTDAMLDAVGVDRVDELFDIPPEVSFDGEFGIDAKSEQAALRGVRRRLSDNDDLTEFLGRGHYEHYVPSLVDSVSQRSEFITSYTQYQPEITQGFLQVLFEYQSLLVELTGLGVANCSMYDAATALAEAALLAKRVRAADGNRVLVPGFVRDSHVDVLRNYTSGSDVVVERYATDAGNVDLDALEAAMDADVVMVYAENPTTCGTVEEQLCAVGDLADSHDALFCLGSDPVAMSILQRPVDVGADVVVGDASVLGMPTSYGTGLGVFATRKEFLRQVPGRLVGASEDDAGTRAFTLTLQTREQHIRKERATSNICTNQAWVALRAAIHAAWLGADGLVDLAERMVELPRDLAARLDDVSGVTAPVHDDRHHIREFQARTEQPAPAVASALEAEGFGVHAVDDHTIQVCVTDANEHATDAFVAAVREVSE

SEQ ID NO: 26201 - protein, 999 aa, Candida albicans
MFTKSTIRTVLRSLATKANTSSENFAKVLNPKVSFDNLDVFARRHIGPTPKEVQKMLSSLGYNDLDEFLSNVVPEHILIKRKLSVQPEKGFTESEMLDHLHKLANKNKIKKSFIGKGYAGTLLPPVIQRNLLESPEWYTSYTPYQPEISQGRLNSLLNYQTMICSLTGMAMANASLLDEGTAAGEAMALSFHNSKDKKKIYVVDANLHPQTVDVIKSRAENIGVEIVEIPLATKQGVEELSRIADKVCGALVQYPDTNGEITDFTEIGNILHSNKALFAMATDLLALTVLKPPSEFGADIALGTSQRFGVPFGYGGPHAAFFATSSKYARKIPGRIVGVSKDRLGNPALRLALQTREQHIKREKATSNICTAQALLANISANYAVYHGPQGLKNIANRVYGFTTLLANEISKKHQLVNNKWFDTLTVKLNGVSSDEILAKALNEYDINMFRVDESTVSLQLDETVQKQDLINLVNVFTGQENYSPDELPAIPQELLRSDEILTNEVFNAHHSETAMLRYLHSLQRMDLSLADSMIPLGSCTMKLNATVEMQTLSIPGFNSIHPFAPIDQAQGYKELIDEFEKDLNDITGFDGTTSMPNSGAQGEYTGLSLIREYHRSRGEHDQRNICLIPVSAHGTNPASAAMCGLKVVPVKCLSNGSIDLEDLEAKAAKHAKNLCSIMITYPSTYGLFEPGVKKAIDIVHANGGLVYLDGANMNAQVGLTSPGDLGADVCHLNIHKTFALSHGGGGPGQAPVCVKEHLKPFLPKHHFVNTPHSTSESIKAVNSAPYGSASVIPVSYSYIKMLGAQALPYVSAIAMLNANYILTKLEPHYKILFVDRDASSESGTKHCAHEFILDLREFQKIGIEAIDVAKRLQDYGFHAPTMSFPVAGTLMIEPTESENLGELDRFIDSLISIRKEIEAYQNKEPLGQVLKNAPHSLEDIVSSEDWDARGYTREQAAYPLPFLKKNKCWPTVSRLNDTYGDLNLICTCPSVEEVAAES

SEQ ID NO: 26202 - protein, 411 aa, Arabidopsis thaliana
MNALAATNRNFKLASRLLGLDSKLEKSLLIPFREIKVECTIPKDDGTLASFVGFRVQHDNARGPMKGGIRYHPEVEPDEVNALAQLMTWKTAVAKIPYGGAKGGIGCDPSELSLSELERLTRVFTQKIHDLIGIHTDVPAPDMGTGPQTMAWILDEYSKFHGHSPAVVTGKPIDLGGSLGRDAATGRGVLFATEALLNEHGKTISGQRFAIQGFGNVGSWAAKLISDKGGKIVAVSDVTGAIKNNNGIDILSLLEHAEENRGIKGFDGADSIDPDSILVEDCDILVPAALGGVINRENANEIKAKFIIEGANHPTDPEADEILKKKGVMILPDIYANSGGVTVSYFEWVQNIQGFMWDEEKVNRELKTYMTRGFKDLKEMCQTHSCDLRMGAFTLGINRVAQATTIRGWGS

SEQ ID NO: 26203 - protein, 152 aa, Mannheimia succiniciproducens
METTFRHVAAQKHIALVAHDHCKEDLINWCQKNVHHLQNHQLYATGTTGHLIEKATELKINSLLSGPMGGDQQLGALIAENKIDVMIFFWDPMNAVPHDPDVKALLRIAAVWNIPHAMNIASADLLINSPLINREIELRIPDYQTYLQKRLK

SEQ ID NO: 26204 - protein, 112 aa, Brucella melitensis
MKKIEAIIKPFKLDEVKEALQEVGLQGITVIEAKGFGRQKGHTELYRGAEYVVDFLPKVKVEVIVADETVDSAIEAIRKAAQTGRIGDGKIFVSNIEEVIRIRTGESGVDAI

SEQ ID NO: 26205 - protein, 259 aa, Bacillus subtilis
MKWTISCLQFDISYGKPSENIKKAEFFIEKESKHADVLVLPELWTTGYDLANLDELADEDGRSAQSWLKKTAKKHGVHIVAGSVAVRKNSDVYNTMYIADKEGQIIKEYRKAHLFQLMDEHLYLSAGSEDGYFELDGVKSSGLICYDIRFPEWIRKHTTKGANVLFISAEWPLPRLDHWKSLLIARAIENQCFVAACNCTGSNPDNEFAGHSLIIDPWGRVLAEGGREEGIVRAEIDLQESAEVRESIPVFDDIRKDLY

SEQ ID NO: 26206 - protein, 258 aa, Xylella fastidiosa
MTQSRWRLDGRTALITGASTGIGLAVARELLGLGADVLLVARDADLLGRVRDELAEEFPERELHGLAADVADDVDRRAILDWVEDCSNGLHVLINNAGGNVTRAALEYTEDEWREIFEINLFSAFELCRYTQPLLACHASTAIVNIGSVSGLTHVRSGVPYGMSKAALHQMTRNLAVEWAEDGIRVNAVAPWYIRTRRTSEPLSDLYYYEQVIERTPMRRIGEPEEVAAAVAFLCLPASSYVTGECIAVDGGFMRYGF

SEQ ID NO: 26207 - protein, 568 aa, Oryza sativa
MDSTAGSGIAAPAAAAVCDLRMEPKIPEPFVWPNGDARPASAAELDMPVVDVGVLRDGDAEGLRRAAAQVAAACATHGFFQVSEHGVDAALGAALDGASDFFRLPLAEKRRARRVPGTVSGYTSAHADRFASKLPWKETLSFGFHDRAAAPVVADYFSSTLGPDFAPMGRVYQKYCEEMKELSLTIMELLELSLGVERGYYREFFADSSSIMRCNYYPPCPEPERTLGTGPHCDPTALTILLQDDVGGLEVLVDGEWRPVSPVPGAMVINIGDTFMVSEHGVDAALGRAALDGASDFFRLPLAEKRRARRVPGTVSGYTSAHADRFASKLPWKETLSFGFHDRAAAPVVADYFSSTLGPDFAPMGRVYQKYCEEMKELSLTIMELLELSLGVERGYYREFFADSSSIMRCNYYPPCPEPERTLGTGPHCDPTALTILLQDDVGGLEVLVDGEWRPVSPVPGAMVINIGDTFMALSNGRYKSCLHRAVVNQRRERRSLAFFLCPREDRVVRPPPSAATPQHYPDFTWADLMRFTQRHYRADTRTLDAFTRWLAPPAADAAATAQVEAAS

SEQ ID NO: 26208 - protein, 380 aa, Pisum sativum
MAIECITSSAKLMTQKSDKNENEESSKLVFDASFLKNQLNLPKRFIWPDDEKPCMNVPELDVPLIDFKNFLSGDPFAAMEASKTIGEACEKHGFFLVVNHGIDTKLIEHAHSYMNDFFEVPLSQKQRCQRKTGEHCGYASSFTGRFSSNLPWKETLSFQFSDEKNPSHIVKDYLSNTLGEDFQQFGEVYQEYCEAMSKLSLGIMELLGMSLGVGKECFRDFFEENKSIMRLNYYPPCQKPDLTLGTGPHCDPTSLTILHQDQVGGLQVFVDNEWHSIRPNFNAFVVNIGDTFMALSNGRYKSCLHRAVVNNKTTRKSLAFFLCPKGDKVVSPPSELVNDLTPRIYPDFTWPMLLEFTQKHYRADMRTLEAFTKWIQQKQN

SEQ ID NO: 26209 - protein, 112 aa, Vibrio angustum
MKKIEAIIKPFKLDDVREALAEVGITGMTVSEVKGFGRQKGHTELYRGAEYMVDFLPKVKIEIVVADEVAEQCIDTIVETAQTGKIGDGKIFMFDIERVVRIRTGEEDEDAI

SEQ ID NO: 26210 - protein, 513 aa, Solanum demissum
MAGLSLAAGGWTSNLIVFLINEFNMKSIAAAKVFNVVNGLTTIFPIVGGIIADSYLGCFSVIWISSLISALGILLLLLTVVIDALRPLACGDGSSLCTSPSTNQYVFLYVSLALASIGVGGTRFTVAPMGAYQFDKPKHQTMFFDWYIFIFYLCWALSTAFIVYVEDNISWAWGFGISMACNILGLAIFLAGKRFYRHVKEQGGSPFVNLARVVVAATQKWRAPLSDQTQHYYHDPSDKTTLVPTKFFKFLNCAAIITEGDTKPDGSICNPWRLCTVQQVEDLKSLIKLFPLWASGLLISTQLVMQLSLLTLQALKMDRHMGPHFEIPAAISIIDRILNPFLAKYTTFSLTPLQRVGIGHALTISCMAVSALVESRRLRVARSHHLQGQKDAIVPMSVFWLLPQLALNGIGEGFHFPGHIAFYYQEFPTSLKNTSTAMVSLFIGIAFYLGNVLIDVVQRETGWLPDNINDGRMDNVFWLCCTLGSVNFIYFLLVASFYKYKNMESKPNNVPSK

SEQ ID NO: 26211 - protein, 464 aa, Salmonella enterica
MKNASTASGASVSDAASKNEPTLQRGLQNRHIQLIALGGAIGTGLFLGIGPAIQMAGPAVLLGYGVAGIIAFLIMRQLGEMVVEEPVSGSFAHFAWKYWGPFAGFLSGWNYWVMFVLVGMAELTAAGIYMQYWLPDVPTWVWAAVFFIIINAVNLVNVRLYGETEFWFALIKVLAIIGMIGFGLWLLFSGHGGEHASIDNLWRYNGFFATGWHGLLLSLAVIMFSFGGLELIGITAAEARDPQKSIPKAVNQVVYRILLFYIGSLVVLLALYPWVEVKSNSSPFVMIFHNLDSNVVASALNFVILVASLSVYNSGVYSNSRMLFGLSVQGNAPKFLTRVSHRGVPVNSLMLSGAITSLVVLINYLLPQKAFSLLMALVVATLLLNWIMICLAHLRFRAAMRRKGRETQFKALFYPAGNYLCIAFLALILVLMCTMDDMRLSAILLPVWIVFLFIAFTVLRRKAH

SEQ ID NO: 26212 - protein, 531 aa, Solanum demissum
MAGLSLASGGWTSNLIVYLIDEFNMKSIKTAKVYNVINGCTTLFPIVGGILADSYLGSFSVIWFSSLISALGILLLLFTSAIDVLRPPPCDDGSSLCTSPSTHQYAVLYVALALASLGVAGTRFIIAPMGANQFDKPKHQAIFFNWYIFAFYMSFAISTTVIVYVEDNVSWSWGYGISMAFNILGLAMFLIGKRFYCDVKEQGGSPFVNLARVIVVAIQKWRVPLSEQTQHYYHDPSDTTTTLTITQIPTKSFKFLNCAAFITEGDTKPDGSISNPWRLCTVQQVEDLKSLIKLFPLWASGFLISTQLVIQASLLILQALKMDRHMGPHFEIPAGSMLVFILLFTCIAIFIIDRFLYPFLAKYTTFSLTPLQRIGIGHVITIISMAVSALVESRRLRIVRTHKLQGQNNDIVPMSVFWLVPQLALNGIGEGFHFPGHIAFYYQEFPTSLKSTSTAMVALFIGIAHYLGNTLIDLVQRLSGWLPDNINKGRTDNVFWLCCILGSANFMYYVVCASLYKYKNVDNKSNIAPSK

SEQ ID NO: 26213 - protein, 531 aa, Solanum demissum
MAGLSLASGGWTSNLIVYLIDEFNMKSIKAAKVYNVINGCTTLFPIVGGILADSYLGSFSVIWFSSLISALGILLLLLTSAIDVLRPPPCDDGSSLCTSPSTHQYAVLYVALALASLGVAGTRFTIAPMGANQFDKPKHQAIFFDWYIFAFYTSFAISTTAIVYVEDNVSWSWGYGISMAFNILGLAMFLIGKRFYRDVKEQGGSPFVNLARVIVIAIQKWRVPLSEQTQHYYHDPSDTTTTLTKTQIPTKSFKFLNCAAFITEGDTKPDGSISNPWRLCTVQQVEDLKSLIKLFPLWASGFLISTQLVIQTSLLILQALKMDRHMGPHFEIPAGSMSVFILLFTCIAIFIIDRFLYPFLAKHTTFSLTPLQRIGIGHVITIISMAVSALVESRRLRIVRTHKLQGQNNDIVPMSVFWLVPQLALNGIGEGFHFPGHIAFYYQEFPTSLKSTSTAMVALFIGIAYYLGNTLIDLVQRLSGWLPDNINKGRTDNVFWLCCILGSANFMYYVVCASLYKYKNVDNKSNIAPSK

SEQ ID NO: 26214 - protein, 475 aa, Triticum aestivum
MNTTEGKPGAAAVEEMAREAAAWCAMHGLVVGDRADPRSGTVPGVGLVHAPISLLPSRLPESFWSQACELAPLFNELVDRVSLDGDFLQDSLSKTRQVDDFTSRLLDIHRKMMDANKEENIRLGLHRSDYMLDSETNSLLQIELNTISVSFPGLCSIVTELHRTLINQYGNLLCLDAKRVPGNDASRQFAKALAKAWDEFNVDSAVVMMIVQPEERNMYDQYWIVKYLRESHGVTTIRKTLSEVEAEGQVLPDGTLVVNDRKVAVVYFRAGYTPNDYPSEAEWSARLLMEQSSAVKCPSISYHLVGTKKIQQELAKPNVLERFLENKEEIAKLRQCFAGLWSLDDEEVVKSAIENPDLFVLKPQREGGGNNIYGLDVREALIRLKKEGGDALSAYILMQRIFPKASLASLVRGGVCHEALTVSELGMYGAYLRNKDKVIINDKCGYLMRTKVSSSDEGGVAAGFAVLDSLYLTDK

SEQ ID NO: 26215 - protein, 462 aa, Crocosphaera watsonii
MTATISINPYLSGNFAPVNQETTENNLTVIGEIPRNLRGMFLRNGPNPQFLPIGQYHWFDGDGMIHGVHIENGKASYRNRFVQTRGYGLEKEANKPLWTGLLEPPQMDNPYGTSKNPANTALVYHAGRLLALWEGGEPHALTVPELNSLGSYNFDNKLVSPFTAHPKVDPVTGEMMFFGYSFAQPPYLQYGIISPQGELLRTVPIDIPVGVMMHDCAITENYTIFLDLPLTFRPERMYKGEPPLQFEHNTPSRFGITPRQGNNEDVRWFESDSCYIFHTLNAYEEGDEVVLIACRMNATTVLGEANEDVKDSDIPRLHQWRFNLTTGEVKEQPLCDLPSEFPRINEQYTGRKTRYGYSGKMAASSEPKFDGIIKHDFEKGNFEIHNFGSHRYGGEPIFAPNPSAVTDEQGWLLTFVYDEASKVSELVIIDAQDFTASPVAKIQIPQRVPYGFHGMWLNEVRS

SEQ ID NO: 26216 - protein, 377 aa, Triticum aestivum
MKRSPPPPPPQPSPSSSPACSLSPSPSSPSSSDSSSIAIPRKRARTQKAGSAKAKAAPKRAKKDASRSSKESDASANGAAAAGKRSSIYRGVTRHRWTGRFEAHLWDKNCFTSIQNKKKGRQVYLGAYDTEEAAARAYDLAALKYWGPETTLNFTVDEYAKERSEMEGVSREEYLAALRRRSSGFSRGVSKYRGVARHHHNGRWEARIGRVLGNKYLYLGTFDTQEEAARAYDLAAIEYRGANAVTNFDISRYLDQPQLLTQLEQGPQVVPALQEELQHDQQSDNAVQELNSGEAQKPGSVNEPIAVDDTDSAGDMGAPLVFDSGVEENLWSPCMDYELEPIFGRDNSNSMNLSEYFKRPHLREQHRVPVRRMSRHR

SEQ ID NO: 26217 - protein, 100 aa, Oryza sativa
MSSSRRSRTSSRLAAAPPPTDEQMAELISKLQAVLPTRGGEANAKASSAEVLQEACRYIRRLHREADALSERLAELLLLQPSDLAINGADVPDLIRSLLM

SEQ ID NO: 26218 - protein, 441 aa, Thermotoga maritima
MIGYQIYVRSFRDGNLDGVGDFRGLKNAVSYLKELGIDFVWLMPVFSSISFHGYDVVDFYSFKAEYGSEREFKEMIEAFHDSGIKVVLDLPIHHTGFLHTWFQKALKGDPHYRDYYVWANKETDLDERREWDGEKIWHPLEDGRFYRGLFGPFSPDLNYDNPQVFDEMKRLVLHLLDMGVDGFRFDAAKHMRDTIEQNVRFWKYFLSDLKGIFLAEIWAEARMVDEHGRIFGYMLNFDTSHCIKEAVWKENTRVLIESIERAVIGKDYLPVNFTSNHDMSRLASFEGGFSKEKIKLSISILFTLPGVPLVFYGDELGMKGVYQKPNTEVVLDPFPWNESMCVEGQTFWKWPAYNGPFSGISVEYQKRDPDSILSHTLGWTRFRKENQWIDRAKLEFLCKEDKFLVYRLYDDQHSLKVFHNLSGEEVVFEGVKMKPYKTEVV

SEQ ID NO: 26219 - protein, 308 aa, Streptococcus agalactiae
MSKIYNSITDLIGNTPIIQLHHIVPEGAAEVYVKLESFNPGSSVKDRIALAMIEDAEQKGILKAGDTIVEPTSGNTGIGLAWVGKAKGYNVIIVMPETMSIERRKIIQAYGAQLVLTPGSEGMKGAIAKAKEISAEQNAWLPLQFNNQANPEIHEKTTGREIIETFGEKGLDAFIAGVGTGGTITGVSRALKKVNPDVAIYAVEADESAILSGEQPGPHKIQGISAGFIPETLATDSYDHIIRVTSDDAIETGRIIGGLEGFLAGISASAAIYAAIEVAKQLGKGKKVLALLPDNGERYLSTSLYDFE

SEQ ID NO: 26220 - protein, 467 aa, Ustilago maydis
MSSNATTNSIPENVSAKTGLGSSATAPPYTIPISSRPPKQTYLQTTLFALVFNICIISVHLFQLLSWPLSLHPATKPIYHSHIAYTKLAFARILLIISQFFGPSQLIISIGDGKGGYLDPETFVHRNKQTGKIVSIDLPSRSIWMSNHQVYTDWLYLWCLAYYADLADSILIILKKSLKWIPFIGWGMQFYRFIFLARNWASDQAQLAKQLGEVASQNQNDAFSSASTDTAKKLLLLIFPEGTLVSSQTRPVSAKFAEKMGIKDMENLLLPRSTGLFFCLRTLAKEMHDLWLVDFSVGYPGVPPAGHGQDFYTLRSIFMQGVPPPAIHVHLTMTRITKPVAGDTSSNAVAVAQLATADIDAPPLGANIKPAESSEEERSAFETWLRQRWTNKDAEMHRFYTDGDFVQGEFTSLVKQGKQADPAQAHGKYVVLPVELRSLKEIGDAACWGISFIVLWSASKVYKAVFG

SEQ ID NO: 26221 - protein, 317 aa, Unknown
  Shewanella sp. ANA-3
MSQVRHSNLLILGSGPAGYTAAVYAARANLKPVMITGMQQGGQLTTTTEVENWPGDAEDLTGPALMERMQKHAEKFDTEILFDHINEVTLTERPFRLKGDNGEYTCDALIIATGASARYLGLESEEAFKGRGVSACATCDGFFYRNQKVAVIGGGNTAVEEALYLSNIAAEVHLIHRRDTFRSEKILIDRLMDKVANGNIILHLDQTMEEVVGDAMGVTGLKMKSTKDGAITDLAVAGVFVAIGHSPNTGIFEGQLEMNNGYLKVQSGLQGNATQTSIEGVFAAGDVMDQHYRQAITSAGTGCMAALDAERYLDAKK

SEQ ID NO: 26222 - protein, 744 aa, Moorella thermoacetica
MAELEEGIVSLFQDRKGTAVDRWVATTCGYCGTGCGLYLGIKDDRAVAVKADTEAAVNKGHLCLKGLYEWKTLHHPERAKVPLCRRGREMHPVTWEKALEETAERLRQALAAGGPEAVGIYHGGQLTLEEYYAIHKLAKGVLGTPNIDANTRLCMASTVSGYTRSFGVDAPPGCYEDLDVSRLVFIFGANPAEMHPQLWQRILRNRKLNGARIMVADPRLTLPARVADLRLRLRCGSNIPLLYGLINILIKEDMLDRDFIRRATAGFEDLARAAAAFPPERVADLTGVPAADIVAAARLFGRSPSAVTVFCQGVNQTSQAVDAVTLINSLHLITGKIGRPGSAPFSLTGQASALSMREIGGGGSLPGFRNPENPEHRRQVADYWGIPEERLPRRVNDINRMLELIDTGRLKVLWVIGTNPAVSLPDLGFSRRQLEKVFLIVQDIFYPMETAAFADIFLPGAGWGEKTGVVTNSERRLNLVRRAVAPPGEARDDLAIVSSVARYLGAGGLFAWQGPENAFRELRELTRGRPNDMTGVDYALLEHLGGVQWPCPEGGRGTPRLYTDGVFPTRAEEAQGYGEFNHPEGRARLWAVPYAPPPEVPDGEFPFWLNTGRIIEHYHTRTRTKRIPELQALVPGAYVEINPHDAARLKISEGEVVRVVSRRGWIEVPARLTDVVAPGEVFVPFHFGDLDPGEGGRQQAANHLTGRNVDPLSGQPLAKTGACRIERQEAGSMGQEGQGENCSG

SEQ ID NO: 26223 - protein, 356 aa, Triticum aestivum
MSTIYMSQLSTSFPLMEEDHHQDHHQGHFQAFTLPKDPPILFPFVISNSSPSDNSSLGYGSDQHLMQHHAMLDQPQHMIGGSSSVFSTPFPTVESIRDDMIERSYSYDPYDMEKLQATSGGSLKIGKWAAPAPAAKMRITRKTSDPGVKKPRKRAQAYEDHGHMGGMNQALGVIRTCSDCNTTKTPLWRSGPCGPKSLCNACGIRQRKARRAMMATGAAPATDVGAKAAAPGDAAVTVRPPKVKKEKRAVDVDRSLPFKKRCKVVQDHTATHDAASTTVEAAAEPPVVVPTTAPAAAPGSDLVDTIGANWSKSPTAAPAACFRPSPAPFAVPVPVQDEITDAAMLLMTLSCELVRS

SEQ ID NO: 26224 - protein, 481 aa, Pseudomonas aeruginosa
MNGLPMNLIWFRCDLRTTDNSALLAAADGRPCLALYLLSPAQWREHDDAPCKVDFWLRNLGELQRQLAALNIPLLVRDCGHWRQAPEVIGRLCRELGVGAVHVNQEYGVNEERRDQAVGQRLREQGVAFHSHLDQLFFAPGSVLTRTGGYFQVFSQFRKVCHERLYQALPGVRPRPQPQPPHALASDPLPDAVPAFPRPADSLRRLWPAGEEVAQERLRDFADQHLADYHERRDFPALPGTSQLSPYLAAGVLSPRQCLDAALVANRGEFSGGQQGAATWINELLWREFYKHILVGYPRVSRHRPFREETEALRWRQAPAELEAWQQGRTGIPIIDAAMRQLLATGWMHNRLRMVVAMFLSKNLLIDWREGERWFMRHLIDGDLAANNGGWQWSASTGTDAVPYFRLFNPLSQSERFDPRGEFIRHWLPELAGLERKAIHDPSSLGLFAGVDYPRPMVDLKASRERALAAFRNLPPRDGRA

SEQ ID NO: 26225 - protein, 181 aa, Bacillus licheniformis
MAEKRELATFAGGCFWCMVKPFDEQPGILKVESGYTGGHTENPTYEEVCSNTTGHREAVQITFDPRCLSYEKLLELYWQQIDPTDSGRQFTDRGESYRTAIFYHNDKQRKLAEESKKKLGESGIFKDPIATDILEAGPFYPAEEYHQDYHKKHPERYTQYRIGSGREGFLQQHWGRKHDEQ

SEQ ID NO: 26226 - protein, 473 aa, Moorella thermoacetica
MDSAITIIGLNHEGAGIGHLQDGRVIFVPGALPGEQVLVEVVSVKRNYARGRLVEVVEASPDRVLPPCPEAASCGGCDLQHLDYRAQLHWKRRLVIDALQRLGHLRDIPVLPVLGMANPWGYRNKVRLHVRRGRLGFYRPGSHELAPFSCCPLLPPGLLKAARAIVRLLPELPPGLQHVTLRQGLATGELLVVLEALPGWQGDRELAEKLAGRFPELVGVVSLAGGGRSRSGPKDFAGEPALECSGWVKTGGKEARRARYQEGFVPRRLGGRPFTLYGRDYLEERLGDLRFYISATTFFQVNSAQAEVLYNKAATFAGLQGGEEVLDAYCGSGAIALWLSRQAGRVEGVEVVPEAIVDARRNSILNNLANVHFRTGAAEAVLPRLAGKGYRPEVIILDPPRAGCDRRVLAAVATMEPRRVVYISCNPSTLARDLAHLREAGFKPGPVQPVDMFPHTHHVECCCFLVKERNNSR

SEQ ID NO: 26227 - protein, 194 aa, Bacillus cereus
MRESSQIRETTETKIKLSLQLDEGKNVSVQTGVGFFDHMLTLFARHGRFGLQVEAEGDVFVDAHHTVEDVGIVLGNCLKEALQSKEGINRYGSAYVPMDESLGFVAIDISGRSYIVFQGELANPKLGDFDTELTEEFFRAVAHAANITLHARILYGSNTHHKIEALFKAFGRALREAVERNANITGVNSTKGML

SEQ ID NO: 26228 - protein, 667 aa, Pyrococcus furiosus
MSIGVRMSVKVVCPYCGFGCNLLVDTITKKVRPYRGEPNRGKLCPKGLFALEHVYSKDRLRYPLKREGSDFKRISWERAISEIAEKIREIIENYGPSSIAFIASSKITNEENYLLQKIARLLGTNNIDNCARLCHESSVHALKLTLGAGIQTNPYSDLEKFKALMIWGYNPAETHPVVMQYIMNAKKNGAKIIVVDVRETTTMKFGDYKVIIRPGTDITLANAIMNVIIENRWYNKDFIEKRTVGFSEIRMGVKKYTPEYAEKITGVPARLIKEIAEAFAKAGSGAILWGMGVTQQIAGVENVLALINIALLLGYFGEKGGLYPMRGQNNVQGAAYMGTLSEFLPGYVPLSDSEFRKKVAKLWGVEDLPTERGLYLTEYWDAILNGDLKVLYIVGENPAISDANVLKVRKALTKLELLVVQDIFLTRTARYAHYVLPAAAFCEKEGSYMNSERRIQWSHKACEPLGESKPDWEILTMLANALGLRGFNYKRVEEITEEYFKLFPELENRSVEELKNSEGIVIPSPRLYTDRFLTPGGRARFISVEQIMPWEEPNGEYPLILTTVRLITHYNTGEMTMRSPSLTKMIGEPFVLISREDAQEYGIKEGDYVVVETRRGNLTLKAKISNIQRGVIAIPFHFEANVLTNDALNKAGTPELKFSAARIRKVS

SEQ ID NO: 26229 - protein, 267 aa, Lactobacillus plantarum
MAVISMKQLLEAGVHFGHQTRRWNPKMKPYIFTERNGIYIIDLQKTVKMIDSAYNFVKDAAADDGVILFVGTKKQAQDSIEEEATRAGQYYVNHRWLGGTLTNWNTIQTRIKRLKDLKKMEADGTFERLPKKEVSLLMKQRAKLEKFLGGIEDMPRIPDVIFIVDPRKEQIAVKEAQKLNIPIVAMVDTNTDPDDIDVIIPSNDDAIRAVRLITSKMADAVIEGRQGEDEDVTEDSFKDNKDAKKSVDSLEDIVEAVEGDNDAKSDK

SEQ ID NO: 26230 - protein, 416 aa, Vibrio angustum
MLKRDMNIADYDAELFAAIQEETARQEEHIELIASENYTSPRVMEAQGSQLTNKYAEGYPGKRYYGGCEFVDKAEQLAIDRACQLFGAEYANVQPHSGSQANNAVYMALLNAGDTVLGMSLAHGGHLTHGSPVNFSGKLYNVIPYGIDESGQIDYAEVEALALEHKPKMIIGGFSAYSQIVDWKRMREIADKVGAYFFVDMAHVAGLIAAGVYPNPVPHAHVVTTTTHKTLAGPRGGLILSNEGEDLYKKLNSAVFPGGQGGPLMHVIAAKAVAFKEAMEPEFKSYQARVVENAKVMVGEFLERGYKIVSGSTENHLFLVDLIDKGITGKEADAALGAANITVNKNSVPNDPRSPFVTSGIRIGTPSITRRGFTADDARQLAGWICDVLDNVDNEEVIAATKAKVLDICKRLPVYA

SEQ ID NO: 26231 - protein, 453 aa, Kluyveromyces lactis
MKWIYTFIAAVSATVTFHPENVEYSLSAKELDPASLGIDTVNQWSGYLDYQDKKHSFYWFFESRNDPANDPVILYLNGGPGCSSMDNLFFETGPASIGPDLKPIHNPYSWNNNASIIFLDQPVNVGFSYSEERVKTTNDAARDVYNFLDLFFTKFPNLTANAFHIAGESYAGHYIPRIAHEIVSVHKDDTKFNLSSIVIGNGLTDPLVQNQYFKPMACGEGGYPAILNPSKCRTMSVSNLACKGLTSLCSKTKLTPGRAYLLLHFCWKSLIQPAFDSAVNPCDIRGPCEDPESGLCWKTLGYIRSYLNQEFVQDALGTKVSSYNGCNTSVGSDFFLTGDNSRPFQQYVTELLDLNIPVLIYAGDTDYICNWLGNMAWTDALTWKDHISYETLPLNPWYSLNGSVQFGEVKNHGPFTFLRVFEAGHTVPYYQPLATMEMINRWISGDLSLGYSN

SEQ ID NO: 26232 - protein, 110 aa, Lolium perenne
MGRSPCCEKMGLKRGPWTAEEDKILVAHITSFGHGNWRALPKQAGLLRCGKSCRLRWINYLRPDIKRGNFSDEEEQSIIQLHQLLGNRWSAIAARLPGRTDNEIKNYWNT

SEQ ID NO: 26233 - protein, 391 aa, Pseudomonas putida
MRSLFTRFFQLEAASGLLLIAAAVLALIINNSPLSYLYSGLLDVPVAVQIGALNIAKPLLLWINDGLMALFFLLIGLEVKREVVDGHLSKPSQVILPATAAVGGMVVPALIYWFINRDNPAAVAGWAIPTATDIAFALGVLALLGKRVPVSLKLFLMTLAIIDDLGAIIVIALFYSGTLSSVSLLLAAACLVVLIAMNRLGVVKLGPYMVIGLILWVCVLKSGVHATLAGVALALCIPLRTRNAETSPLLALEHALHPWVAYAILPLFAFANAGVSLAGMTVESFTHPVPMGIAVGLLLGKTVGVFGLTWLAVKLRLAALPAGAGWGQILGVAILCGIGFTMSLFVGSLAFSPGSSEYAGMDRMGILTGSFFAAVIGYAVTAMASRKPRVG

SEQ ID NO: 26234 - protein, 236 aa, Ostreococcus tauri
MSAQFASTAVVGLRAPKTTKRSQRSVSVRASTQPMWFPGMDAPQHLKGELPGDYGFDPLNLGKEPKDLEWYVQAELQHGRWAMLGVAGAAAPEILTKMGISDLPNWHDAPNYQGYFTDATTLFWVQMLMMNWAEVRRWQDMRKPGSVNEDPAFSGNKLPSGIVGYPGGIFDPLGYAKGDLNKLKAKEIANGRLAMVAFAGIMVQYDHTGVGPVANLVAHMSDPAHNNVFQAKFIGF

SEQ ID NO: 26235 - protein, 99 aa, Unknown
  Synechococcus sp. RS9917
MASYKVTLINESEGLNKTIEVPDDQYILDAAEEQGIDLPYSCRAGACSTCAGKITAGTVDQSDQSFLDDDQIEAGFVLTCVAYPTSDCTIKTHAEEELY

SEQ ID NO: 26236 - protein, 408 aa, Arabidopsis thaliana
MATANPGRGGGRRGGGAMDDDKLVFETTDGIEPITSFNDMGIKEDVLRGVYEYGFEKPSAIQQRAVMPILQGRDVIAQAQSGTGKTSMIALSVCQVVDTSSREVQALILSPTRELATQTEKTIQAIGLHANIQAHACIGGNSVGEDIRKLEHGVHVVSGTPGRVCDMIKRRSLRTRAIKLLILDESDEMLSRGFKDQIYDVYRYLPPDLQVCLVSATLPHEILEMTSKFMTEPVKILVKRDELTLEGIKQFFVAVEKEEWKFDTLCDLYDTLTITQAVIFCNTKRKVDYLSEKMRSHNFTVSSMHGDMPQKERDAIMNEFRSGDSRVLITTDVWARGIDVQQVSLVINYDLPNNRELYIHRIGRSGRFGRKGVAINFVKSDDIKILRDIEQYYSTQIDEMPMNVADLI

SEQ ID NO: 26237 - protein, 723 aa, Geobacillus kaustophilus
MEQEKRVFSIDVAGRPLIIETGELAKQANGAALVRYGDTVVLSTATASREAKNVDFFPLTVNYEERLYAVGKIPGGFIKREGRPSEKAILVSRLIDRPIRPLFAEGFRNEVQVVSMVMSVDQDCAPEVAALIGSSVALTISDIPFEGPIAGVIVGRVDGQFVINPTVEQMEKSDLHLVVAGTKDAINMVEAGADEVPEEVILEAIMFGHEEVKRLIAFQEEIAAQVGKEKMEVVLYEPDPALEAEIRQLAEADIKRAVQVPEKLARDAAIEDVKAGVIAKYEAEEADEEKLKQVQEILHKLVKEEVRRLITVEKIRPDGRKVDEIRPLSSAVGVLPRTHGSGLFTRGQTQVLSVCTLGALGDVQILDGLDLEESKRFMHHYNFPPFSVGETGPMRGPGRREIGHGALGERALEPVVPSEREFPYTIRLVSEVLESNGSTSQASICASTLAMMDAGVPIKAPVAGIAMGLVKNDDHYTILTDIQGIEDHLGDMDFKVAGTRKGVTALQMDIKIKGLTREILEEALMQARKGRLEILDHMMQTLSEPRKELSKYAPKILIMHINPDKIREVIGPSGKQINKIIDETGVKIDIEQDGTIFISSVDEAANQKAKQIIEDIVREVEVGQVYLGKVKRIEKFGAFVELFNGKDGLVHISELAEGRVGKVEDVVSIGDEILVKVTEIDKQGRVNLSRKAVLRDARNIGGELPRESREKRGRRPERHRMKP

SEQ ID NO: 26238 - protein, 501 aa, Vitis vinifera
MAVPGGHRQRGRPRALIGEPVRPRVPLRRLLRVASVACGIQFGWALQLSLLTPYVQELGIPHAWSSIIWLCGPLSGLLVQPLVGHLSDRCNSRFGRRRPFIVAGATSIVVAVLIIGFSTDIGGLLGDGADRRPRAVATFVVGFWLLDVANNVTQGPCRALLADLTEKDHRRTRVANAYFSLFIAVGNVLGFATGSYSGWFRIFWFTSTSSCNADCANLKSAFLLDIIFIAITTYISITAAQELPLSSSSRSTHISEEMAESTHAQEAFLWELFGTLRYLSGSIWIILFVTALTWIGWFPFLLFDTDWMGREIYGGKPNEGQNYNTGVRMGALGLMLNSVVLGITSVLMEKLCRKWGAGFVWGLSNILMSLCFLLMLILSAVVKHMDFLGHDLPPSGVVIAALIVFSILGIPLAITYSVPYALISTRIESLGLGQGLSMGVLNLAIVIPQVIVSLGSGPWDQLFGGGNSPSLAVAAVAAFASGLVAILAIPRSSADKSRVHT

SEQ ID NO: 26239 - protein, 257 aa, Ostreococcus tauri
MFKSKAPTKQVAVKKAPVKTAVKKTARPVRKGPAPKAGDECLWRPGAVRPAWLDGSLPGDRGFDPFGLGKPAEYLQFDLDALDGSAARNPSGNVIGKLKKADSKPKARTIVPYDEAFDIMRFRECELLHSRWAMLGLVGAAAAEAATGITWADAGKIELEQPQYLGFPIQLTVTQLTIIEVLAMGYLEIARSAELDQNKRMYPGGAFDPLGYVAKADAQEEFRLKTAELKHGRLAMAGMLIISIEAATGRGTLPGSW

SEQ ID NO: 26240 - protein, 847 aa, Salmonella typhimurium
MSKVRLAIIGNGMVGHRFIEDLLDKSDASLFDITVFCEEPRKAYDRVHLSSYFSHHTAEELSLVREGFYEKHGVKVLVGERAITINRQEKVIHSSAGRTVYYDKLIMATGSYPWIPPIKGSETQDCFVYRTIEDLNAIEACARRSKRGAVVGGGLLGLEAAGALKNLGVETHVIEFAPMLMAEQLDQMGGEQLRRKIESMGVRVHTSKNTQEIVQQGNEARKTMRFADGSELEVDFIVFSTGIRPRDKLATQCGLAVAQRGGIVINDTCQTSDPDIYAIGECASWNNRVYGLVAPGYKMAQVAVDHILGSENAFEGADLSAKLKLLGVDVGGIGDAHGRTPGARSYVYLDESKEVYKRLIVSEDNKTLLGAVLVGDTSDYGNLLQLVLNAIELPENPDSLILPSHAGSGKPAIGVDKLPDSAQICSCFDVTKGDLIAAINKGCHTVAALKAETKAGTGCGGCIPLVTQVLNAELAKQGIEVNNNLCEHFAYSRQELFHLIRVEGIKTFEELLAKHGKGYGCEVCKPTVGSLLASCWNEYILKPQHTPLQDTNDNFLANIQKDGTYSVIPRSAGGEITPEGLVAVGRIAREFNLYTKITGSQRIGLFGAQKDDLPEIWRQLIEAGFETGHAYAKALRMAKTCVGSTWCRYGVGDSVGFGVELENRYKGIRTPHKMKFGVSGCTRECAEAQGKDVGIIATEKGWNLYVCGNGGMKPRHADLLAADLDRDTLIKYLDRFMMFYIRTADKLTRTAPWLDNLEGGIEYLKSVIIDDKLGLNEHLEEEMARLRAAVVCEWTETVNTPSAQVRFKHFINSDKRDPNVQVVPEREQHRPATPYERIPVTLVEENA

SEQ ID NO: 26241 - protein, 681 aa, Medicago truncatula
MYHKVHNGAIANHSRGEASNNAKQEKRKEKVEEDGEKKELTIEELEAKIYKDEMLLRKIKEERSKRDNTTSLEQRKRKTMARAQERILRYMLMMMEVCDARGFIYGVIPHEGKPMSGSSENLRGWWKDIVKFDKNGPAAIAKYEAENGIKTTNYEKLNGEPITLHSLNELSDTILGSLLSSLVPHCHPPQRSFPLEKGIPPPWWPTGKESWRKEMRFSEAPGLPPYRKPHDLKKVWKVYVLAAVIKHMSPNVHNIRNIVRQSRSLQDKLTMKETSIWGAIIDHEETIARKIHPEFFSSFDSRVEGSNYLLVEANDVDVVEGGEHNLAERKLSSSSSPSSSSLSSYEGTNKRKRKPGKRIGTHHNSFLNTHQHATPLDQHEFQQERNVRNNHHVTSTHIGSSSNINNKNLFQMVGVEVSTTHQNVAPLAQRAQAAVPVADQITHHTGNHYSFAAADYGFHNNAGNYSGRGEVDSDLMDIYNSGIQLNKNTNVMSMMIPTPGVNHNVHHQIYHASAQPEKNNMSTMIPNHGVNQSMHRQIYTGSVQQNKNTIMSTMVPTPGVNQNLHPQVYTSSVHQQQKSNTMMNTSMMSNSMPVMNMVATPVFNQNMQHQMDQNFYAQQGGADSYYNYKVRNAEVANVPMQANVSTTSFDPTFEHLKAFNSQFHVDAYNNSLASSSYDWNQ

SEQ ID NO: 26242 - protein, 146 aa, Brassica napus
RHERLAQRGESLILELLPEELRGSTIEIVPYFFDSFGNASRIDYGTGHETNFAAWLYCLARMGVIKEEDYHGVVARVFVKYLELMRKLQMVYCLEPAGSHGVWGLDDYHFLPFIFGSSQLVDHKYMKPKSIHNDDILENFSGEFMY

SEQ ID NO: 26243 - protein, 1189 aa, Cryptococcus neoformans
MMSTDKELYKLELLSLVSKVSQELFNHTKLQDKKLAEFVIALHEQSKTTEAFQKKLNEIGADFPEWFVKNLDRLIVTMHPKYKRKAAKMKASKQSGKSDDGQSVMEEQKQLQARKFPGLSMPDQDWKPAEKYVDERAAKEPHETLPESLSTSDTMAQLESIASRRNRPAAEDFLDGEPAAKKLRSATSSGHDGSSGRRGGYEGGSFRDSFRHGRPTVDERPVLYKIYNGTIANITDFGAFVTLDGVERKIDGNQRSNEGLIHVSNITNGRVNSPRDFLKRGQRVKVKVMAVSPKIGLSMKDVDQNTGDDLSPHLTVKTAEEAAVQQQRMSSYAASGSNSTPLLAVDERQRSSAKRLSSPERFEIKQLIASGAVSAADYPDLDEDFSTNVANHEIEEDIDVEVNEVEPAFLSGQTKVTLELSPVKIIKAPDGSLNRSALAGASLAKERRDLKRLEANEQADAETREINQPWLDPMANQNERQFASDIKGNLLGQKAAQMPAWKAANKVVSYGKITSMSIQEQRRSLPIYKLREQLVAAIRDNQILVVVGDTGSGKTTQMAQYLAEEGFLEKGRLGCTQPRKVAAVSVAKRVAEEVGCRLGAEVGYTIRFEDMTSPETKIKYMTDGMLLRELLVDPDCSKYSVIMLDEAHERTIATDVLFGLLKKACKRRPDLKLICTSATLDAAKFATYFWGCPIFTIPGRTYPVETLYTKEPEPDYLEASLITILQIHLMEPAGDVLLFLTGQEEIDTACEVLYERVKALGPQVPELLILPVYAALPSEMQSRIFEPAPPGARKVVIATNIAETSITIDGIYYVIDPGFAKQNAYDPKLGMDSLIVTPISQAQARQRAGRAGRTGPGKCYRLYTEVAYRNEMLPNPIPEIQRTNLASTILTLKAMGINDLISFDFMDPPPAATMLTALEQLYALGALDDEGLLTRIGRKMADFPLDPPLSKMLIKSVDYGCSEEALTIVAMLQAGGQVYYRPKDKQTQADAKKAKFHQPEGDLLTLLAVYNGWKNSKFSNPWCFENFIQTRAMKTAQDVRKQLIGIMDRYKHDLVSCGTNYNRVRMAICSGFFRNAAKKDPTEGYKTLVEGTPVSIHPSSALFQRPPEWCVYYELVLTAKEYMHQVTVIEPKWLSEVAPTFFRIADQNKISKRKASEKIEPLFDRFAADKDDWRLSKQKKAARSSQTFG

SEQ ID NO: 26244 - protein, 457 aa, Salmonella typhimurium
MDHLPIFCQLRDRDCLIVGGGDVAERKARLLLEAGARLTVNALTFIPQFTVWANEGMLTLVEGPFDETLLDSCWLAIAATDDDTVNQRVSDAAESRRIFCNVVDAPKAASFIMPSIIDRSPLMVAVSSGGTSPVLARLLREKLESLLPQHLGQVARYAGQLRARVKKQFATMGERRRFWEKFFVNDRLAQSLANADEKAVNATTERLFSEPLDHRGEVVLVGAGPGDAGLLTLKGLQQIQQADIVVYDRLVSDDIMNLVRRDADRVFVGKRAGYHCVPQEEINQILLREAQKGKRVVRLKGGDPFIFGRGGEELETLCHAGIPFSVVPGITAASGCSAYSGIPLTHRDYAQSVRLVTGHLKTGGELDWENLAAEKQTLVFYMGLNQAATIQEKLIAFGMQADMPVALVENGTSVKQRVVHGVLTQLGELAQQVESPALIIVGRVVALRDKLNWFSNH

SEQ ID NO: 26245 - protein, 383 aa, Oryza sativa
MVVMLLADICLSKPAGHMIAYTSSILFVLQQSIPDIYLFIRCPGHGNSSCTEQFAKSDEMIRAIAFRESSGRYDSSEKCMFCRLINNLDNAHEQIDTAIATALSESKPVYISVGCNLAGLSHPTFSREPVPLFISPRLSTKANLEYAVEAAADFLHKASILCEWVQHMDLPGPRWKKGKDGKDFSALAAANPMSVIVAELKASFISSKPVAVLSGPGGGAILGVEPEQAVILNRAAFGHAVEIAAAQKHWFQLSPEEVFYLCHVLNCIRVESHDKKQMSDKQLWNHFRSMSESFPEMYKAYSHLRLKNWVESRNQNYQKDSKQLKPPKVGIESKVIELERRYEGSKGFKRTKEGTERLENTEKRKKDSKILKSARKTQKSRVH

SEQ ID NO: 26246 - protein, 197 aa, Methanosarcina mazei
MVLGSKLLDNVKMHLCTCSAGLRPTPDMEAFLKMPMRELYVSLPIHMDDGSIKVFKGFRVQYNEALGPAKGGIRFHPDETMETIRALAALMTWKCALHRLPLGGAKGGIVCSPKELSHRELERLSRAYIRAVYQIIGPDRDIPAPDMYTNPQIMAWMMDEYSKLAGKMSSAQLQANPQVWEVLLAGLMQRLKVACMR

SEQ ID NO: 26247 - protein, 527 aa, Mycobacterium avium
MAFRPVSAAAASAGAILGGRTHPRAGGVSMARDHAHAALIIGAGFTGLGAAIRLAEAGVDDIVILERADRVGGTWRDTTYPGASCDVPSLLYSYSFVKNPTWSRTYSPAPEIYRHLEDMADRFDIRRRIRFGHEVSGLAFDEDAGVWTATTKNRKKFRARTVVLASGPLSDVSFPDIRGLDSYRGHKIHSARWDHDYDFAGKRVAVIGTGASAIQIIPELVKQAGFVKVFQRTPCWVLPRLDVATPPAVQALFAKVPAAQELARQALYWGHEASATALVWDTPLTSLVARLGKAHLRAQVKDPWLRRQLTPDFRPGCKRMLVSSDYYPALQRDNCKLIDWPIATLSPAGIRTSDGIEHHLDCIVFATGYDVHLTGPPFPVTGLGGRSLAAEWAGGAQAYKSINVHGYPNLFVMTGPNSGPGHNSLLVYIEGQLDYAVRGITTILNDDLRYLDVREEVQRRHNEAIQRRLTKTTWMSGCRSWYLTKDGFNGSMYPGFATQYLRQMSDFRYQDYQAVARRARTPAASSA

SEQ ID NO: 26248 - protein, 443 aa, Thermotoga maritima
MRYDVVVVGGGPAGLVAAFTTKRFFGDKKILVVKKTEKEMVPCGIPYIFHTLGSVENDYMGIEDRFKGAGIDLLIDEVVDGNPDEKKLFTKSGKEISYDKLIIATGSSPNIPKIPGVDLKGVFTVPKEADYLKLLHEKVKDANDVVIIGGGFIGVEVADEIKKSGKNVTLVEIMDSLLPVSFDPDFGELARKELESDNVKVLTGRKVTEILGTEKVEGVKLDSGETIPADVVVLATGYKPNSELARKLGLKVTELGFIETDEYMRTSKPDIFAAGDCVQHKDFLTGKPSRLMLASAAVFDARIAASNLYGLKVIRTNKGSLNAYSTVIGSKAFGSVGITERIAKEEGFEVVVGKAEAPDRHPGKFEDTSKLVVKLIFSEDSKILLGAQVCGGKSVGEIVNLISLGIQKGITANDLFTMQIGTHPLLTSAPTVYPLAKAAEMVL

SEQ ID NO: 26249 - protein, 155 aa, Unknown
  Rosa hybrid cultivar
VPFSLPVVSEVFKSSRAMRIPYTCPLVRIGPLVARYVQPEVVALRVPLLNLSNFQINDWPDVSAKSYAIMVLILPTDSTRKWRDHELELVDVVADQVAVALSHAAILEESMRASDQLVEQNGALDLARREAELAIHARNDFLAVLNHEMRTPMHA

SEQ ID NO: 26250 - protein, 321 aa, Robiginitalea biformata
MKIAVAQFEPRDADKSYNLSVITDLTRKAATAGAKVISFHEMCITAYTHTRNLDREALLNLAESVPDGPSTRQLIGLARTTGLTILAGLLEVDHGKVYNTYICVTGEGLVARYRKIHPFINPHIEPGAEYCVFDLMGWKCGILICYDNNIIENVRATSLLGAELIFAPHVTGCTPSAMPGRGYVAHELWENRDTHPDILRAEFQGPKGRGWLMRWLPARAYDNGVFYAFSNPIGYDGDHLKNGNAMILDPYGEILAETESFDAQIATAQLDRKKLELAGGTRYKRARKPSLYKNIIGRANRSRTIPHWMERETQTGSPNTQ

SEQ ID NO: 26251 - protein, 328 aa, Lotus japonicus
VAADLPVKRQREEEEEDQQNGLSQNDSSTPQGLSAVIPGWFSEISPMWPGEAHSLKVEKILFQGKSDYQNVMVFQSSTYGKVLVLDGVIQLTERDECAYQEMITHLPLCSIPNPKKVLVIGGGDGGVLREVSRHSSVEKIDICEIDKMVVDVSKEFFPDIAVGFEDPRVSLHIGDGVAFLKAAPEGSYDAVIVDSSDPIGPAQELFEKPFFSSVARALRPGGVVCTQAESIWLHMHIIEDIVANCRQIFKGSVNYAWTTVPTYPSGMIGFMLCSTEGPSVDFKHPVNPIDEDDSQQSARPLKFYNREIHSAAFCLPSFAKRAIGAKAN

SEQ ID NO: 26252 - protein, 361 aa, Lotus japonicus
MGDAAGRGLECQKTMDGKESNRNGLEKELPLCCLKAIASDPELDAKCHSTVVSGWFSAPQTCSGKSGKDAYFNNPMWPGEAHSIKVDKILYKEKSEYQEVLVFESSIYGKVLVLDGIVQLTEKDECAYQEMIAHLPLCSIASPETVLVVGGGDGGVLREVSRHSSVKRIDICEIDKMVIDVSRKFFPELAVGFDDPRVHLHVGDAVEFLRCTPEGKYDAIIVDSSDPVGPAQELVEKPFFETLAKALRPGGVLCNMAESMWLHTHLIQDMISVCRETFKGSVHYAWASVPTYPSGLIGFLLCSTEGPPVDFVNPINPIEKLEGADKHKRKLRFYNSEMHTAAFALPAFLKREVSLIRDPSA

SEQ ID NO: 26253 - protein, 137 aa, Photorhabdus luminescens
MRLLHTMIRVGDLQRSINFYTEVLGMRLLRTSENTEYKYSLAFVGYADESEGAVIELTYNWGVDHYEMGNAFGHIALGVDDVAATCESIHKAGGSITREAGPVKGGTTIIAFVEDPDGYKIELIENKNASNALGNSI

SEQ ID NO: 26254 - protein, 194 aa, Thermus thermophilus
MREATVERATAETWVWLRLGLDGPTGGKVDTGLPFLDHMLLQLQRHGRFLLEVEARGDLEVDVHHLVEDVGIALGMALKEALGDGVGLERYAEAFAPMDETLVLCVLDLSGRPHLEFRPEAWPVVGEAGGVNHYHLREFLRGLVNHGRLTLHLRLLSGREAHHVVEASFKALARALHKATRRTGEGVPSTKGVL

SEQ ID NO: 26255 - protein, 127 aa, Saccharophagus degradans
MRLLHTMLRVGDLDASLHFYTQVLGMKLLRKQDFPTGKFTLAFVGYGEESDTAVIELTHNWETSSYELGNGYGHIALGVNDVYATCETIRAAGGKIVREAGPMMHGTTVIAFVEDPDGYKIELIGCE

SEQ ID NO: 26256 - protein, 480 aa, Zea mays
MALTRIGLAGLAVMGQNLALNIAEKGFPISVYNRTTSKVDETVQRAKVEGNLPVFGFHDPASFVSSIQKPRVVIMLVKAGAPVDQTIATLAAHLDQGDCIVDGGNEWYENTERREKAMEERGLLYLGMGVSGGEEGARNGPSLMPGGSFEAYKYIEDILLKVAAQVPDSGPCVTYIGKGGSGNFVKMVHNGIEYGDMQLIAEAYDVLKSVGKLTNSELHQVFSEWNKGELLSFLIEITADIFGIKDDKGEGYLVDKVLDKTGMKGTGKWTVQQAAELSVAAPTIEASLDSRFLSGLKDERVEASKIFQGDYSTGLPVDKAQLIEDVRQALYASKICSYAQGMNIIKAKSSEKGWGLNLGELARIWKGGCIIRAIFLDRIKKAYDRNPNLANLLVDPEFAQEIIDRQAAWRRVVCLAINNGVSTPGMSASLAYFDSYRRDRLPANLVQAQRDYFGAHTYERVDMPGSFHTEWFKIARNSKI

SEQ ID NO: 26257 - protein, 462 aa, Xanthomonas campestris
MPLPTDSVAETAAPAAPALRHALKPRQLMMMGLGTAIGAGLFLGSGVGIHAAGPAVLISYLIAGALVIIVMNALGEMAAAKPASGAFSVYAADAMGPTAGATVGWLWWFQVVVVIAAEAVGAAGLLATVWPALPVPLLALLFMATFTAINLLGVRNFGEFEFWFAILKVLAIVVFLLIGVALLAGWLPGVASPGLSNFTQNGGFAPKGLAGIGSALLVVVFAFGGTEIVAVAAAETADPGRSLARTIRTVAWRILVFYIGSISVIVAVVPWTSAALSSPFAAVLDVARIPGAATAITLVAVVALLSALNANLYGASRMIFSLAQRGEAPRLLARTSGEQVPLVAVIASVLFGFAAAALELLYPNKVLPMLLNIVGATCLLVWTISLVSQLILRARADRAGLALPFRMRGYPFLTVLALVILGVIFVLLASSADTRAQFLSMVALTAVIAAVSEVARRLRARM

SEQ ID NO: 26258 - protein, 242 aa, Ostreococcus tauri
MWVDRGGDIGAHRRLKARATTTRASRRSVVVSAEAGAERPVWYPGKAPAPHLDGSLPGDFGFDPLSLSADPEMRKWMVQAELQHARWAMLGVAGAVAPELLTKIGVADLPNWVDAGTYQYWAPAGPLFFIQMAMFNWAEVRRWQDMKNPGSMNTDPLFGYNSNDTNTDVGYPGGLFDKLGYAKDPAKAKELKLKEIKNGRLAMVAFLGICAQYVQTGQGPVENLFSHIASPGSVGYFGSQGL

SEQ ID NO: 26259 - protein, 1428 aa, Aspergillus nidulans
MLAPRWLTTAIFVLTYIQKSGGDSQKQPVCLARDWREAVVPLKWPTCVETRWDRWPNGELTTTPTPASHNNLKSTSGSSSVSVSITVEPGPASSLADHELDTESPLDNVNFLSFEDWKKQNLARAGQSAENIGGNRRAGTAEKDRRRPLGINNALDSLGDDVEIELDFGGFGADASEAAKTATDWVTHVPSRGSGGAQVVPDGGRDTAEASGQGVPHAGGERSKDAGTTCKERFNYASFDCAATVLKTNPEAKGSSSVLIENKDSYMLNECRAQNKFLILELCDDILVDTVVLANYEFFSSIFHTFRVSVADRYPAKPEQWKELGIYAARNTREIQAFAVENPLIWARYLRIEFLTHYGNEFYCPLSLIRVHGTTMLEEYKHDGEVNRAEEELAGGVAEPALETETVTEDATKTEVPPPEAPSFHVVNSEIRPSKICPKFVTSVELALLGSVNPQTCGINDTSEESPATEGNKPVLSKTSSSPVIPSAGNAAKAASPEAGDYKASGSSGVNPPNTADTAASGAASSETDSHNATSDQDTRSTAASRDEQGVESIRTTTTQPPSANPTTQESFFKSVNKRLQMLETNSSLSLQYIEEQSRILRDAFNKVEKRQLSKTSTFLENLNVTVVNELKQLREQYDQAWRSVALEFEHQRIQYHQEIHSLSAQLGVLADEIVFQKRVAVIQSIVVLLCFGLVLFTRGAVGSYIDFPSVQNMVSRSYSLRPSSPILGFGSPPGSPGSTRPTSSYRTTPGHRRQVSQDSQDGSVSPTMYAPPTPTSDDSRLGPDERGTTSPSPEGARSLAEVAPPLLRSNSSPPDLNGENEGGCEKNHEDLDSDPECSGFETGGDDTLAESPVTVMMQQFQCPTTKETSITSLKMNSNPLTARSPNTHLAVSNEQDLKTASSTTDLMDYHRQKLQGKIENQDKQQASYVSPSDDIMSPCSKKLSDLKGKRFKNVEQDGKGDEFPLSLNPSSATGPRRPWIWYFPAPLPRLAASTPNNQKSNQQDQVEEFVEKECIPAEALFSAQLGTGEQRWKTNPAVMEELKTKAKKIGLWNMFLPKNHFSQGAGFSNLEYGLMAEYLGKSKVASEATNNAAPDTGNMEVLAKYGNDQQKAQWLTPLLEGKIRSAFLMTEPDIASSDATNIQLDIRREGNEYVLNGSKWWSSGAGDPRCQIYLVMGKTDPRNPDTYKQQSVLLVPASTPGITIHRMLSVYGYDDAPHGHGHISFKNVRVPLSAMVLGEGRGFEIIQGRLGPGRIHHAMRTIGAAERAIDWLIARINDDRKKPFGQPLSSHGVILEWLAKSRIEIDAARLIVLNAAIKIDQGNAKFALKEIAQAKVLVPQTALTVIDRAVQVYGAAGVSQDTPLASLWAMVRTLRIADGPDEVHLQQLGKRENKSRREEVTKRVAWQKEQSDRILTANGFSKLKSLL

SEQ ID NO: 26260 - protein, 310 aa, Staphylococcus epidermidis
MTEVDFDVAIIGAGPAGMTAAVYASRANLKTVMIERGMPGGQMANTEEVENFPGFEMITGPDLSTKMFEHAKKFGAEYQYGDIKSVEDKGDYKVINLGNKEITAHAVIISTGAEYKKIGVPGEQELGGRGVSYCAVCDGAFFKNKRLFVIGGGDSAVEEGTFLTKFADKVTIVHRRDELRAQNILQERAFKNDKVDFIWSHTLKTINEKDGKVGSVTLESTKDGAEQTYDADGVFIYIGMKPLTAPFKNLGITNDAGYIVTQDDMSTKVRGIFAAGDVRDKGLRQIVTATGDGSIAAQSAADYITELKDN

SEQ ID NO: 26261 - protein, 212 aa, Ostreococcus tauri
MIAQRSALSARSIATPKATRRSAVVAAAADRKMWYAPAHLDGSIAGDYGFDPLGLGTNPDRLKYYQEAELMNARWAMMAVAGIVGTEVAGIEPRWWEAGTEDYGFPPAALLAIQFPVMGYLENKRIQGWMATGSSGVNETFPFDPMGMGSKDANMKLKEIKNGRAAMIAFVGIVVQAIVYREGPVAALKDHISNPFGCNMATNIMNIPVNLA

SEQ ID NO: 26262 - protein, 536 aa, Petunia integrifolia
MGTCMSVQNASFLKRTRNRPVPIDQETCSKNTSRTSVPKSQKFSRPLNVVKDPSGDDINKRYEFGKELGRGEFGITYHCVDKVSGENVACKTIAKSKLRTEIDVEDVRREVVIMRHLPKHPNIVSYKEVYEDKEAVYLVMELCEGGELFDRIVARGHYTERAAARVTKTILEVVKVCHEHGVIHRDLKPENFLYANATENAQLKAIDFGLSIFFEPGQRFSEIVGSPYYMAPEVLRRNYGPEVDVWSAGVILYILLCGVPPFWAETEEGIAHAIVKGTIDFNRDPWPRVSEEAKDLVKGMLDPNPYNRLTVEEVLDHYWIQNAEKVSNICLGEGVRAKIKQFTLMNKFKKKVLRVVADNLPQDQVHGIKQMFYMMDTDKNGNLSFQELKDGLHLMGQAVADPEVQLLMDAADVDGNGMLNCEEFVTMAVHLKRLSNDDHLRKAFLHFDKNKSGYIEFEDLKDSLFDDHLGPKNDQVIHDIIFDADLDKDGRISYQDFKVMMSTGTDWKMGSRQYSKAMLNALSMRLFKDKSIQVKN

SEQ ID NO: 26263 - protein, 322 aa, Coprinopsis cinerea
MPGAIPSPRYLPTVIRESFPPAPKFTSEDVPDLTGKVIIVTGANAGMGKQTAKVLLSRNAKVYMAGRNEAKLSKAIEELKEATGKEGLPLILDLADLKSVKKAVEDFTSKEKELHVLFNNAGVMVPSLDDLTAQGYDSQFGTNVLGHFYLTKLLLPTLLATAKNPISCPEGKVRVVHTSSIASIMADGVNFETLKDGPERRKKGEWGLYHQSKLGNVILSNELARRYGDEGLVSTSVNPGAIKTDLLRHTKWWDKLMIKAVLHPVEYGALTQLYAGTSEDGLKFNGEYLIPWARLGEPNPVALDKKLGEELWKWLEEQVVDI

SEQ ID NO: 26264 - protein, 184 aa, Arabidopsis thaliana
MKRKGVDEFPFCVHLVSWEKENVSSEALEAARIACNKYMVKSAGKDAFHLRIRVHPFHVLRINKMLSCAGADRLQTGMRGAFGKALGTCARVAIGQVLLSVRCKDNHGVHAQEALRRAKFKFPGRQKIIVSRKWGFTKFNRAEYTKLRAMKRIVPDGVNAKFLSNHGPLANRQPGSAFISATSE

SEQ ID NO: 26265 - protein, 532 aa, Petunia integrifolia
MGNCCSRGQPNESNDHTESISTAKNGDGKVMQGGSVTPPKTPPPASPDPSSKPSKTSPIGPVLGRPMEDVRKTYSIGKELGRGQFGVTHLCTHKQSGEQFACKTIAKRKLVNKEDIEDVKREVQIMHHLTGQQNIVELKGAYEDKHSVHLVMELCAGGELFDRIIAKGHYTERAAATLLRTIVQIGHTCHSMGVIHRDLKPENFLLLNKDEDSPLKATDFGLSVFYKQGDVFKDIVGSAYYIAPEVLKRRYGPEVDIWSVGVMLYILLSGVPPFWAETEHGIFNAILRGHIDFSCDPWPAISHGAKDLVRKMLTIDPKQRLTAIQVLNHPWIKEDGDAPDTPLDNAVLSRLKQFRAMNNFKKVALRVIAGCLSEEEIMGLKQMFKSMDTDNSGAITLEELKTGLAKQGTKLSDYEIQQLMEAADADGNGTIDYEEFITATMHMNRMDKEEHLYTAFQYFDKDNSGYITVEELEQALREFGITDGKDIKDIVAEVDSNNDGRINYDEFVAMMKKGTPDTAANLKKRRESFDAK

SEQ ID NO: 26266 - protein, 216 aa, Silene latifolia
MRGVASPNSTVSTVSGKRSLCERDSTSAGAADDLDLERASSRGLSDDEDGGDNSRKKLRLTKDQSAILEDSFKEHNTLNPKQKLALAKRLGLGPRQVEVWFQNRRARTKLKQTEVDCEFLKRCCEQLTEENRRLQKEVQELRTLKLSPQFYMQMTPPTTLTMCPSCERVAAPPSGPVQPKPHPSLESRSSIRPVANNPWVTAAVPIRSFDAIHPRS

SEQ ID NO: 26267 - protein, 941 aa, Mycobacterium avium
MPDHTTFAARHIGPDPQAVAAMLDVIGVGSLDELAAKAVPAGIRDRLSADGIAPGLDRLPPPASETEALAELRGLAEANTVAVSMIGQGYYDTLTPPVLLRNILENPAWYTAYTPYQPEISQGRLEALLNFQTMVADLTGLEIANASMLDEGTAAAEAMTLMRRASRGKSNRLAVDADVFAQTAAIVATRARPLGIEIVTADLRDGLPDGDFFGVIAQLPGASGAITDWAALVAQAHERGALVALGADLLALTLITPPGEIGADVAFGTTQRFGVPMGFGGPHAGYLAVHANHARQLPGRLVGVSLDADGSPAYRLALQTREQHIRRDKATSNICTAQVLLAVMAAMYASYHGAEGLTAIARRVHGHAEAIAAALGTAVVHDRYFDTVLARVPGRADEVIAAAKARGINLWRVDDDHVSVACDEATTDEHVAAVLEAFGVAPAEPVASEIATRTAEFLTHPAFTQYRTETAMMRYLRTLADKDIALDRSMIPLGSCTMKLNAAAEMEPITWPEFARQHPFAPASDTPGLRRLIGDLENWLVAITGYDAVSLQPNAGSQGEYAGLLAIHDYHASRGEPHRDICLIPSSAHGTNAASAALAGMRVVVVGCHDNGDVDLDDLRAKVTEHRDRLSTLMITYPSTHGVYEHDIAEICAAVHDAGGQVYVDGANLNALVGLARPGKFGGDVSHLNLHKTFCIPHGGGGPGVGPVAVRSHLAPFLPGHPHAPELPQGHPVSSAPYGSASILPISWAYIRMMGADGLRAASLTAITSANYIARRLDEYFPVLYTGENGMVAHECILDLRPITKATGVTVDDVAKRLADYGFHAPTMSFPVAGTLMVEPTESETLTEVDAFCDAMIAIRGEIDRVGAGEWPVEDNPLRGAPHTAECLVTTDWDHPYSREQAAYPLGKDFRPKVWPPVRRIDGAYGDRNLVCSCPPVEAFA

SEQ ID NO: 26268 - protein, 417 aa, Unknown
  Microscilla sp. PRE1
MSQLDKTCVIIGASHAGVNCAFALRKEGWQGGIVLYDADPSLPYHRPPLSKAYLTSDAGIEKYLLKSAESYEKDNITLRLGIQVSAIDRTHKILTLNDGNTRSYDKLVIATGARPIIPPTKGIKTAKNLYPLRNAADVQNIRQALESNENKRVVIVGAGYIGLEIAASLKNRGAQVTVLEREDRVLARVTAPEMSAYFQQLHVSQGVEIVTNKNVVSIAPRNGFNTITCSDGTQYDADVIVMGVGIRVNLELAEDAGLNISNGICVNAAGQTNDEDIYAIGDCTLHYNPHYNRHIRLESVQNAVDQAKVTAAAICGKEVAYNAIPWFWSDQYDVKLQIVGLSSGYNELLIRREDDGRKFSSWYFKDDELLAVDAINNAKAYVIATKFIKERRKVDKIKLTDASVALSPLNLSAESHD

SEQ ID NO: 26269 - protein, 227 aa, Triticum aestivum
  misc_feature (180)..(180): Xaa can be any naturally occurring amino acid
  misc_feature (204)..(204): Xaa can be any naturally occurring amino acid
  misc_feature (226)..(226): Xaa can be any naturally occurring amino acid
MAAANAFTSASMSCGASLSGPVNVIAVCPRSVAAARTLSSSCLRPARCAAVRTAAPVAATAEGDERRFEQLAVPPELVDELVEEALVWCSQHGLVVGDKNHPRSGKAPGVGLLHAPFALLPMSFPKVYWEQALELAPLLNELVHRVSLDGDFLQQTLARTKEVDPFTRRLLDVTHSKMMXLNKKEDIQLGLTRSDYMVDGATRXLLQVELNTISRSSQGLACGVSXL

SEQ ID NO: 26270 - protein, 427 aa, Trichoderma atroviride
MAFLGGYEKKHKVTIVGSGNWGSTIAKIVAENTRANKDVFEEDVQMWVFEEDVTIAKDSKHYDESIGDAPQKLTHVINKYHENVKYLPGITLPSNIIANPSLVDAVQDSSILIFNLPHQFIRNVCNQIRGKILPFARGISCIKGVNVSDDGVSLFSEWIGDGLSIYVGALSGANIASEIAAEKWSETTIAYDPPPMDNSRAPTPRSQSPGLTMTVTEPPADMQHRDARGRKSKTKLTPVPAEYPPLDHACFHSLFHRPYFHVEMVSDVAGVSLGGALKNIVALAAGFVDGRGWGDNAKAAVMRIGLMEMVKFGKEFFGETVHTATFTESSAGVADLITSCSGGRNFRCARKAVEKGITVDEVEKQDLNGQKLQGTSTAFEVNSFLTARGLEKDYPLLTAVNAILLGKASVDDIPSLVSDTERKQPLP

SEQ ID NO: 26271 - protein, 258 aa, Ralstonia solanacearum
SVKNAAVNVPYGGAKGGIRVDPRKLSSGELERLTRRYTSEIGIIIGPNKDIPAPDVNTNAQIMAWMMDTYSMNEGSTATGVVTGKPIALGGSLGRREATGRGVFVVGSEAARNLGIDIKGARIVVQGFGNVGSVAAKLFHDAGAKVIAVQDHKGIVFNGAGLDVDALIQHVDHNGSVAGFKAETLSADDFWALECEFLIPAALEGQITGKNAPHIGAKIVVEGANGPTTPEADDILRERGILVCPDVIANAGGVTVSY

SEQ ID NO: 26272 - protein, 538 aa, Unknown
  marine gamma proteobacterium HTCC2207
MLTNEILKAVAGYTANMQKAVTFVLQTGEHSKRAELVAFLTDISKQSEHIQLEERDMDGLLRSPISFLMQADGVDTGIRFSGIPSGHEFNSLILAILHASGTPLKLDDSVKNIIAGVEENLHFEVFISLSCHNCPDVVQSLNQFALLNPNISTEMIDGGHYQALIKERDIQGVPSVYLNGELFANGKVDTAQLIDKLIQRAPSAAQDSSDQPALPLQDVTIIGGGPAGASAAIYSARKGLKVTLIADRIGGQLKDTMGIENFISVSKTTGPELSGALQSHMNEYEITFKEYLKVTKVEGGDIKSVTLSSGEKIFTKTVIIATGANWRELGVPGEKENVGNGVAYCPHCDGPFFKGKDVAVIGGGNSGIEAALDLAGMVKSVNVFEFMPDLKADQILIDKAVAKPNITIHKNVATKEISATNGKVSAIEYIDRATDTEHSLKLDGIFVQIGLIPNSGFLGDLVEKTRFGEIVINEKCQTSEAGIYACGDVTTVPYKQIIISMGEGSKASLSSFEYLLAEGDRLEEQFYSESADAIAIAS

SEQ ID NO: 26273 - protein, 511 aa, Lotus japonicus
MPGDPDNRHHHHPRSKNRPSTSSARPPPSRPPPARVPLRQLLRVASVASGIQFGWALQLSLLTPYVQQLGIPHQWASIIWLCGPVSGLFVQPLVGHLSDKCTSRFGRRRPFILAGAASIVVAVLIIGYAADIGWMLGDTESFRPAAITVFVIGFWILDVANNVTQGPCRALLADLTSKDNRRTRVANAYFSLFMAIGNILGYATGAYSGWYRIFTFTLSPACTISCANLKSAFFLDVAFIAVTTYVSITAAHEVPLNSSGAAHAGEGAGESGSTEEAFMWELFGTFKYFSSTVWIILSVTALNWTGWFPFILFDTDWMGREIYGADPNGGPNYDAGVRMGALGLMLNSVVLGVTSLLMEKLCRKRGAGFVWGISNILMAVCFLAMLVVTYVANTIGYVGKDLPPTGIVIAALIIFTILGFPLAITYSVPYALISKHTEPLGLGQGLSMGVLNLAIVIPQIVVSLGSGPWDQLFGGGNSAAFAVGAVAAIMSGLLAVLAIPRTGTQKPQIRV

SEQ ID NO: 26274 - protein, 541 aa, Neurospora crassa
MVLGFQFSFHSPPLNPVTKKAQRVPIFNPIDRHGRVFFFSWTGFMVAFWAWYTFPPLLTHTIKHSLHLTPAQVANSNIISLLATLLVRLISGWACDRYGPRLVFAFILLLGAIPIGLAPTITNVTGLYVIRFFIGILGGSFVPCQVWTTAWFDKNVVGTANAVAGGWGNAGGGVTYFVMPAVFDSLVRNWGMSDGKAWRVTFVVPLICLLVVGLALVLVCEDMPTGRWRDRNQGVEVPVVIDGVDLKSGSGAETPMTTTTKMDEEKGSKSVSDTESTTRPDVEKGEVVSAGPSNTTTIPSVTTILLSPQTLFHILTYACSFGSELAINSVLSSYFLSVAPSSLSQTSAANYAAIFGFLNFITRPLGGLASDYLFSFFGGSSPCSSPSSSSLSPSSPEAKPKALWARKLLITTCTLLTGTFLLLLGLLRPSSLGTAIGLVILAAIFIEAGNGANFGLIPFVHPERNGVVSGVTGAGGNLGGVAFALVFRFVGGHGMKGGYEKAIWIVGIINLVVAVVGVGIKPVPVAGMGSTKKEGGRRWFW

SEQ ID NO: 26275 - protein, 366 aa, Prochlorococcus marinus
MAFNQTEVVLGGIAHIPLVIGAFYVVKALFYRGQDGKLVPFSFSYRQAAQIKSSSTTTSTEKPDTKSPPAQKAIPINLYKPKAPFEGTVLENYSLVKEGAVGRVNHITFNLAGSDPHLSYVEGQSIGIIPAGTDANGKPHKLRLYSIASTRHGDNLEGKTVSLCVRQLQYELDGKTINGVCSSYLCDINPGAKTKITGPVGKEMLLPDDEEANVIMLATGTGIAPMRAYLRRMFEPTERSKNGWKFRGKAWLFMGAPYTANLLYDDDFERYLREFPDNFIYTKAISREQQNSKGGRMYIQDRVMEYSDQIFKMIENPKTHVYMCGLKGMEPGIDEAMTAAATAKGIDWSELRPQLKKAHRWHVETY

SEQ ID NO: 26276 - protein, 412 aa, Caulobacter crescentus
MSAEVNQNACVVIVGAGHAGGSVAAFLRQYGHEGRIVLIGDEPLLPYQRPPLSKAWLKGEADADSLSLKPAGWYADNNVMLRLGGVAERINRSDKTVALASGEVIPYDFLVLATGARARELPIPGADLAGVLALRTAADAELLKNALGPDKRLAVVGGGYVGLEAAASARALGSHAMVIERESRVLARVACETLSHFFQDYHGKHGVAFELNAGVAAFEGHDGHVTGVRFNDGRVVACDVALVGVGAVPNDELAKDAGLSTANGVVVDLEARTDDPSIFAIGDVTHRPLPLYDRQFRLESVPNALEQAKQAASAILGRPGPAPETPWFWSDQYDLKLQIAGLPFDADRQVVRGDVAAAKFAVFHLKGDLVQAVEAVNAPPEFMAGKQLIAKRTPVDANKLADPSVSMKEVAA

SEQ ID NO: 26277 - protein, 991 aa, Candida glabrata
MLHQDNCYGVAFRAIATADEELFKQTVRFYHSLGFSTIKDFNKFKHGENVVLASGTSDDSLREVWLESFKLSETDSLGFRVPQQEASNKAQSQGAFVKVRLVMHEPLKDVYSTAQTSHITYFSADLPAIAKEFGDKVTKVSDSVLQMNDPMGNQLSFTSFASPLDEKPTNMDAFLKPLEKEDDITASQSTDAVNQLKESLQSGSNLQKKKKIAVMTSGGDSPGMNAAVRAVVRTGIHYGCDVFAVYEGYEGLLRGGKYLKKMHWEDVRGWLSEGGTLIGTARSMEFKKREGRKRAAGNLISQGIDALVVCGGDGSLTGADLFRSEWPSLVEELVKDGTFTSEQVAPYRNLTIVGLVGSIDNDMAGTDSTIGAFSALERICEMVDYIDATAKSHSRAFVVEVMGRHCGWLALMAGIATGADYIFIPERAVPHGQWQDELKEVCQRHRNKGRRNNTIIVAEGALDDQLNPVTAEDVKDVLVDLGLDTKVTILGHVQRGGTAVAHDRWLATLQGVDAVKAVLEMTPETPSPLIGILENKIIRMPLVESVKLTKSVATAIENKDFDKAISMRDTEFIELYENFLSTTVKDDGSEMLPVTERLNIGIVHVGAPSAALNAATRAATLYCLSHGHKPYAIMNGFSGLIQTGEVQELSWIDVENWHNMGGSEIGTNRSVAAEDMGTIAYYFQKNKLDGLIILGGFEGFKSLKQLRDSREQYPIFNIPMVLLPCTISNNVPGTEYSLGVDTCLNALVNYTDDIKQSASATRRRVFVVEVQGGHSGYIASFTGLVTGAVSVYTPEDPISLKSIREDLSLLKENFRHDKGENRNGKLLVRNEQASSIYSTELIADIISESSKGRFGVRTAMPGHAQQGGAPSSKDRVIASRYAVKCIKFIEQWNKKNKATALDKDAKVLRFKFDKHGAKIPTVEHEDDSAAIICVNGSHISFKPIASLWENETNIELRKGHEVHWTEFNEISNILSGRLRLRAEVEASNNRV

SEQ ID NO: 26278 - protein, 621 aa, Coccidioides immitis
MAGQMGAVPVVRAMDHVKPAQGQIYLPDPEKDPSLLRGKGTDFTSSLFMKGGSIIPLPVDKNGPEQQTIEEILGPEELRLRKPFKAFKPDHPLYSGLRTGTTFKVAPHIDQGEMFDAVYSNLCAGGCIGIFPEGGSHDRPSLLPLKAGVAIIALGALARDPDCGLSIVPCGMNYFHPHKFRSRAVIEFGNPIQVHPDQVEVFKAGGESKHNAVGSLLGTIQAALAAVTQQAPDYETMMLIQATRRLYKPLRMKLPLPVVIELNRRLLQGYTQFKNEPRVLQLKKAVSDYNRQLRALGIKDHQAEWGDVKSRPRWLVFVTLIYRIGELFTLAVGTLPSLLLFWPVFVISKAISLKKQRKALAASVVKLQGRDVVATWKMLVAMGLAPALYTWYTVIVTIWLRYCRHEGYYCDVVPWWMNARLYIPDFIPLWIFYIFFFGLMIAVSFAGLRIGEIGIDVMKSLPPLFVALNPLSASSLAKLRAQRQAVAAQVVDVINMFGPEMFPNFESERLVDHGQIHSDAYLSQLKTVPLSESEYEGESRSRDSRSSSGSSGLPYDSFLKPFALLESNQDLGKLNRRIRDAMQERGRKRFTDEYLLDEDDESDDISTRGIRVPVADDKKTR

SEQ ID NO: 26279 - protein, 655 aa, Glycine max
  misc_feature (246)..(246): Xaa can be any naturally occurring amino acid
ATAVTLCLVLPERGSIDALDGGMIEMVLDPDLNKTGDIWHICIEDLPRSNVLYGYRIDGPRDWGKGHRFDSSIVLVDPYAKLVEVSSLGPDPPMKLSKFLGTYDFDSLPFDWGENYKLPNISEKDLVIYEMNVRAFTSDESSGLDSNIRGSYLGMIEKIPHLLELGINAVELLPVFEFDELEFQRRPNPRDHMINTWGYSTINFFAPMSRYASAGGGSVNASREFKQMVKSLHSAGIEVILDVVYXNHTNEADDAFPYTTSFRGIDNKVYYMLDNNGQLLNFSGCGNTLNCNHPVVMELILDSLRHWVTEYHVDGFRFDLASVLCRGIDGSPINAPPLIRAIAKDAVLSRCKIIAEPWDCGGLYLVGSFPNWDRWAEWNGKYRDDVRKFIKGDSGVKGSFATRVAGSSDLYRVNNRRPYHSINFVIAHDGFTLRDLVSYNFKHNKANGEGGKDGSNDNFSWNCGFEGETDDASIRALRSRQMKNFHLALMISQGTPMMLMGDEYGHTRYGNNNSYGHDTAINNFLWDQLDARKSDHFRFFSKVIKYRHAHEVFSRENFLNTNDITWHEDNWENPDSKFLAFTLHDRSGGDIYVAFNSHDYFVKVLLPTPPKKRNWFRVADTNLKSPDDFVLDGVPSVGNTYNIAPYSSILLEAKF

SEQ ID NO: 26280 - protein, 768 aa, Unknown
  Phalaenopsis sp. SM9108
MLAGVMIPARQVPSMIGRNSSALTLAQINILEGQQLPLQHQLAELTAQATTTAESDMMRAREDDFESKSGSDNIEGGSGDEHDPNQRPRKKRYHRHTQHQIQEMEAFFKECPHPDDKQRKALSKELGLEPLQVKFWFQNKRTQMKTQHDRQENSQLRAENDKLRNENLRYKEALSNASCPNCGGPATLGEMSFDEHHLRIENARLREEIDRISGIAAKYVGKPMNSYPLLSPTLPSRSSLDLGVGGFGLHSPTMGGDMFSPAELLRSVAGQPEVDKPMVIELAVAAMEELIRMAQLGEPLWTSSPGLDGGNEILNEEEYVQNFPRGIGPKPFGLKSEASRETAVVIMSHVNLVEILMDANQWSTMFSGIVSRGMTLEVLSTGVAGNYNGALQVMTAEFQVPSPLVPTRESYFVRYCKQHPDGTWAVVDVSLDSLRPSSLMMRCRRRPSGCLIQEMPNGYSKVIWVEHFEVDDRSVHSIYKPLVNSGIAFGAKRWVSTLDRQCERLASVMASSIPSGEIGVITTSEGRKSMLKLAERMVLSFCGGVSASTTHQWTTLSGSGAEDVRVMTRKSVDDPGRPPGIVLNAATSFWLPVSPKRVFDFLRDESSRSEWDILSNGGVVQEMAHIANGRDHGNCVSLLRVNSTNSNQSNMLILQESCTDPTGSYVIYAPVDVVAMNVVLNGGDPDYVALLPSGFAILPDGSNGVHGGGSGIGEVGSGGGSLLTVAFQILVDSIPTAKLSLGSVATVNSLIACTVERIKAAVTGESPQ

SEQ ID NO: 26281 - protein, 464 aa, Saccharophagus degradans
MSNETPKKFIPNEQNPMPRWEKKFNKILTPFERFVNRTTTGGLILMMAALIALALANSPLAHHYLHALHVPLGLNLGDWRIEKSLHHWVNDGLMALFFFVVGLELKREMLVGELAEIRKAVLPIVAAIGGMVIPAICYMSLNLNDETFRGWGIPMATDIAFALGVIALLASRVPKALITFLVALAIVDDLGAVVVIAVFYTQDLAWSFLIAGALLTCLLIFFNMIGIRKPSVYFFVGLILWFVFLKSGVHATLAGVITAFTIPAKPKFNTLTFSNRVQDILYKFRKGCEEDESILRNEHLSGLVQTLENGVVGVQTPLQRLEHSFHKPVAFFILPVFAIFNAGVTIDFGNAFQLFNHPITLGVVFGLLFGKFVGITGASWLAIRFGLCSLPNDTSMKHIIGASMLGSIGFTMSIFIAELAFVSQPEMIIQAKLGILLSSLVAGVAGYLWLHKLGGEKSRIGSSL

SEQ ID NO: 26282 - protein, 299 aa, Geobacillus thermoleovorans
MARTVNSITELIGDTPAVKLNRIVDEDSADVYLKLEFMNPGSSVKDRIALAMIEAAEKAGKLKPGDTIVEPTSGNTGIGLAMVAAAKGYKAVLVMPDTMSLERRNLLRAYGAELVLTPGAQGMRGAIRKAEELVREHAYFIPQHLKRANPEIHRLTTGKEIVEQMGDQLDAFVAGVGTGGTITGAGKVLREAYPNIKIYAVEPADSPVLSGGKPGPHKIQGIGAGFVPDILDTSIYDGVITVTTEEAFRGPRAAREEGILGGISSGAAIHAALKVAKELGKGKKVLAIIPSNGERYLST

SEQ ID NO: 26283 - protein, 463 aa, Arabidopsis thaliana
MRSDHYFSLRSPTEDFVGGYPSDEEWHGYINNNDRVLLKVISYSSPTSAGAECLDHDCSWVEQWIHRAGPREKIYFRPEEVKAAIITCGGLCPGLNDVIRHIVITLEIYGVKNIVGIPFGYRGFSDKDLTEMPLSRKVVQNIHLSGGSLLGVSRGGPSVSEIVDSMEERGINMLFVLGGNGTHAGANAIHNECRKRKIKVAVVGVPKTIDNDILHMDKTFGFDTAVEEAQRAINSAYIEAHSAYHGIGVVKLMGRNSGFIAMQASLASGQVDICLIPEVLLCYYFKFQNMIDELALRDPMHLKVPFNLHGPNGVLKHLKYLIETKGSAVICVAEGAGQNFLEKTNAKDASGNAVLGDFGVYIQQETKKYFKEISTPIDVKYIDPTYMIRAVRANASDGILCTVLGQNAVHGAFAGYSGITVGIINTHYAYLPITEVIAYPKSVDPNSRMWHRCLTSTGQPDFI

SEQ ID NO: 26284 - protein, 159 aa, Bacillus licheniformis
MSIYDISVKTIKGEDTTLRPYKGKVLLIVNTASKCGFTPQYQQLQDLYETYKDRGLEILGFPSNQFMNQEPGDEKSIEEFCSVNYGVTFPMFSKVNVKGDQIHPLFRHLTNKAKGMLGTKAVKWNFTKFLVDQTGENVVRFSPQTNPKEMEETIQKWLG

SEQ ID NO: 26285 - protein, 627 aa, Zea mays
MAPPPLSSWPWASLGQYKYVLLGPLVWKVLQEWREQAGLPLGSWWLHLLLLFAARGLTYQFWFSYGNMLFFTRRRRVVADGVDFRQIDAEWDWDNFLVLQTLIGATVVNSPLLPGLRQLCLWDPRGWAVALLLHVGFSEPVFYLAHRALHRAPLFARYHAAHHSSGVTQPLTAGFGTPLEVLLLTLVMGAPLAGAFLVGAGSIGLVYVHALAFDYLRAMGYSNVEVVSPRVFEAFPLLRYILYTPSYLSLHHRERCRNFCLFMPALDLAGGTLDERAWALQRAAYDGGPGGGALGTPEFVFLAHVVDMMSSMHVPFALRSLSSTPFANHFILLPFWPVAFGFMLLMWCCSKTFVVSFYYLRGHLHQTWSVPRYGFQYFLPAAKKGINQQIELAILRADRMGVKVLSLAALNKNEALNGGGTLFVNKHPDLRVRVVHGNTLTAAVILNEIPSNVREVFLTGATSKLGRAIALYLCRKKIRVLMFTVSSERFVKIQREAPPEYQQYLVQVTKYQAAQNCKTWIVGKWLSPREQRWAPSGTHFHQFVVPPIIGFRRDCTYGKLAAMRLPKDVQGLSSCEYTMERGVVHACHAGGVVHFLEGWGHHEVGAIDVDRIDVVWKAALKHGLAPV

SEQ ID NO: 26286 - protein, 160 aa, Alnus firma
MNTLEGRGFTEEQEAVVVKSWNAMKPNAGELGLKFFLKIFEIAPSAQKLFSFLRDSNVSLERNPKLKSHAMSVFLMTCESAVQLRKAGKVTVRESSLKKLGAVHFKHGVVDEHYEVTKFALLETIKEAVPEMWSPEMKIAWGEAYDQLVAAIKSAMKPSS

SEQ ID NO: 26287 - protein, 105 aa, Zea mays; identical to SEQ ID NO: 364

SEQ ID NO: 26288 - protein, 205 aa, Lycium barbarum
GAILDERVFHNDYVNLAHSIGAFLYDDLLAIVSLRYQRIHILQIRDSGDLVDVRAIGEFCREDDELFLNFNSQVLVNHVGNGFHHSMPELETSFMSGIKQRLLSFIFRGIWNEETDQTMRVQCLKKKFYFHFQDYIDLIIWKVQFLDRHHLLIKFGSVDGGVSRNADSHPSFFAVYNMETTEIVAFYQNSADELYFLFELFSDHF

SEQ ID NO: 26289 - protein, 886 aa, Aspergillus nidulans
MLTSKAYAGPLGLPSSQTPTASYHTTTQKSSTFSESQTGTVYTSPTKSEFSEADDGLDAVRSWDENQVISWLHSINCQQYEPLFRANNFNGNNLIECDQKILQEMGIKKIGDRVRIFVAIKQLRNKSVVNKKQKNLRQLAALEAAHQQASPDSARSYSARQQTSSAGHASRTGDYSYGRPTSRPGSPLRPHRYVANSPMDSGRKDYLSAGSGAGRNPGTPVERIGTHSRQNPSLDGMTMGSLLSNAPVIRVIYSGGQTKVLDIKHCKTPDEIILCVLKKLQLPEHQYRNYCFYVLDGLDPDPSNCRRLSDHELMEICEGFHRSERGRLILRKIHAGEPDAEEVHRAAQLALDESQQAHMNALSSSNARNQMKIQQLTGESWHNIRQPMSPVSSRHNTTPSDHEIRPPQVSERVSKLRSFFGARPPSEMIIHEISSYFPGHQREDIEKTMRMSVRRSQRLSRAASRLSVVSNTSYASSLRDAPPIPSIADTWLNNGTPPTRAARPLSVLSTRPGLPSTSYRDSIASSSLHPLQEESPVEPNRKSYVSFDSGSDDPNNSRHSLLDENASVAATDGGSFNERLSVLVAEDGEEEDDGLAEFLAGNNFVNWMKGSLIGEGSFGSVFLALHSITGELMAVKQVEIPSATKGTEFDKRKNSMVEALKHEIDLLQGLHHPNIVQYLGTTADDQYLNIFLEYVPGGSIATMLKQYNTFQEPLIKNFVRQILAGLSYLHSKDIIHRDIKGANVLVDNKGGIKISDFGISKRVEASTVLGSRASNGGGHIHRPSLQGSVYWMAPEVVRQTAHTKKADIWSLGCLVIEMFIGSHPFPDCSQLQAIFAIGSNKARPPAPEHASKDAVAFLDMTFQLDHEKRPDADELLKSPFLATTLT

SEQ ID NO: 26290 - protein, 241 aa, Chlamydomonas incerta
MALSMIAQRRAGAFSARQAPRAVRAQALTRPVWFPGNPAPAHLDGTLAGDYGFDPLFLGQEKETLRWYVQAELVHGRFAMLGAAGIILTSIGAKVGLGFPEWYDAGKVVVEKNNIDFPTLIVIQFYLMGWAETKRWYDFKNPGSQADGSFLGFTEEFKGLENGYPGGRFFDPMGLSRGDAAKYAEYKQKEVKNGRLAMIACLGFAAQYAATGKGPLDNLSDHLADPNHINFATNGVSIPIA

SEQ ID NO: 26291 - protein, 108 aa, Chlorobaculum thiosulfatiphilum
  misc_feature (24)..(24): Xaa can be any naturally occurring amino acid
  misc_feature (38)..(38): Xaa can be any naturally occurring amino acid
  misc_feature (58)..(58): Xaa can be any naturally occurring amino acid
  misc_feature (72)..(72): Xaa can be any naturally occurring amino acid
  misc_feature (81)..(81): Xaa can be any naturally occurring amino acid
AGKYFEATDKNFQTEILDSDKAVXVDFWASWCGPCMMXGPVIEQLADDYEGKAIIAKXNVDENPNIAGQYGXRSIPTMLIXKGGKVVDQMVGALPKNMIAKKIDEHIG

SEQ ID NO: 26292 - protein, 547 aa, Clostridium perfringens
MFCFQCQETAGCKGCTVRGVCGKTEDVAKIQDLLIFVTKGLATVANEGRKVGIVDKKINRMIIDNLFITITNANFDFKAIEKRVKDTLVAREELKERVQAKGGNPVGSDFKGCATWTATTSEEMMEKASQVGVLATENEDIRSLRELIMYGLKGLAAYMEHAMNLGHDKEEVHAFMAETLVKILDDSLSADELTALALETGKFGVDGMALLDEANTSTYGHPEITKVNIGVRNNPGILISGHDLKDLEMLLEQTEGTGVDVYTHGEMLPGHYYPKFKKYSHFAGNYGNAWWLQNKEFASFNGPILMTTNCITPVQDSYRGRIFTTGAVGYEGCIHITADENGHKDFSQIIELAKTCKAPTEIETGEIVGGFAHNQVLALADQVVDAVKSGAIRRFFVMAGCDGRAKSRDYYREFAEKLPKDTVILTAGCAKYKYNKLPLGDINGIPRVLDAGQCNDSYSLVVIALKLAEVFGTDSVNELPISYNIAWYEQKAVIVLLSLLHLGVKNIHLGPTLPAFLSPNVAKVLVENFGIGGITNVEDDMKMFLGE

SEQ ID NO: 26293 - protein, 165 aa, Populus alba
LTKKFINLIKHAEDGILDLNKAAETLEVQKRRIYDITNVLEGIGLIEKKLKNRIQWKGLDVSRPGEADDNNVATLQAEVENLTMEERRLDEQTREMQERLRDLSEDENNQKWLFVTEEDIKSLPGFQNETLIAIKAPHGTTLEVPDPDEAVDYPQRRYRILLRST

SEQ ID NO: 26294 - protein, 407 aa, Streptomyces ghanaensis
MGYIHTALKSAGFHHVIQVDTPALGLDSEGLRKLLADFEPDLVGVSTTTPGLPGAIEACEAAKSTGAKVILGGPHTEVYAHENLVHESIDYVGVGEGVTIMPELAEAMERGEEPEGIRGLVTRKHDGGAAPMVNLEEVGWPERAGLPMDRYYSIMAPRPFATMISSRGCPFKCSFCFKQAVDKKSMYRSPEDVVGEMTELKERWGVKEIMFYDDVFTLHRGRVREICGLIGETGLKVRWEAPTRVDLVPEPLLEAMAGAGCVRLRFGIEHGDSEILERMRKESDIQKIEKAVTSAHEAGIKGFGYFIVGWLGETREQFRRTVDLACRLPLDYASFYTATPLPGTPLHTESVAAGQIPPDYWDRFSCGASSTRGSGTWCRTRRSAPSGRTAPSSCAAPWSSRCCRTWR

SEQ ID NO: 26295 - protein, 380 aa, Brassica napus
MKLIQRISTAYIFRFTSHQNNPAKTLIPLSHFTRFFSSSPSRAAAAAMDAKEASATDLKRPREEDDNAAAAASMETENGDQTKEPACFSSVIPGWFSEMSPMWPGEAHSLKVEKVLFQGKSDYQDVIVFQSATYGKVLVLDGVIQLTERDECAYQEMITHLPLCSIPNPKKVLVIGGGDGGVLREVARHASVEQIDMCEIDKMVVDVSKQFFPNVAIGFEDPRVNLVIGDGVAYLKNAAEGSYDAVIVDSSDPIGPAKELFEKPFFQSVARALRPGGVVCTQAESLWLHMDIIEDIVSNCREIFKGSVNYAWTSVPTYPSGVIGFMLCSTEGPDVDFKHPVNPIDDSKSSGPLKFYNAEIHSAAFCLPSFAKKVIESKTN

SEQ ID NO: 26296 - protein, 407 aa, Nocardia farcinica
MSPREGTTAMSAPIVIVGAGLAGLRTAEELRRAGYEGDLVLLGDEARLPYDRPPLSKQFVRGETDDTTLRPAEFFTDKRIELRLGTTATGVDTATRRVLLADGSALAYDHLVIATGLRPRTLPGLPTPAGVHVLRDHADATALRDESASATAALVIGAGFIGCEVAASFRARGLDVVLVEPQPTPLASVLGEQVGGLVARMHRAEGVDLRCGTGVRTLLSDDRGRVRGALLSDGAEVRADLVVLGVGSRPAVEWLADSGIALAEQAAGGGVLADEVGRTSVERVWAVGDVAAWRHETGAQQRVEHWTNAGEQAKLVACALLGAEPPTAARVPYFWSDQYDVKIQALGTPSADDDVSVAADDGRKFLAYYSRAGALTAVVGAGMTAQVMKARAKVAAGAPVADLLATT

SEQ ID NO: 26297 - protein, 202 aa, Zea mays
NSRVDPRVRPRVRALELLGLRDNGAEDASPPSSSSSSSSSSSPDHQEIDVSLIITDYCMPGMTGYDLLKRVKGSSSLKDIPVVIMSSENVPARISRCLQDGAEEFFLKPVKPADMKKLKSHLLKRKQPKQKNKPQAQAVESPEQQLDPHPQPVHEPEEAAADRNGVNKRKAAAMEEGLTVVVTAPESTKPRRLSTSSLTVET

SEQ ID NO: 26298 - protein, 476 aa, Sinorhizobium meliloti
MSQAEIGLIGLGVMGSNLALNIAEKGNRIAVFNRTVDATRKFYAEAGALKDQIVPCETIEEFVAAIRPPRPIIIMIKAGDPVDQQMEALKPHLAKGDIMIDAGNANFRDTMRRFDALKDSGLTFIGMGVSGGEEGARHGPSIMVGGTEESYRRVEKVLTSIAAKYDSDPCVAWLGENGAGHFVKTIHNGIEYADMQMIAEIYGILRDGLKMTAQEIGEVFGAWNKGRLNSYLIEITEKVLKAADPLTGKPIVDMILDKAGQKGTGKWSVIEAQNMGVPATAIEAAVAARSISSAKEEREAAEKVLGLPPVGEIKVADRDGFIKDLENALLAAKIGAYAQGFAVMAAASKEFGWNLPMPTIAKIWRAGCIIRSQFLDEITTAFTKAPDAANLIVTPAFAAMVKESDGALRRVVSTAVLGGLPVPALASALGYFDSYRRGRGTANVIQAQRDFFGAHGFDRVDGADSHHGPWGSGLNA

SEQ ID NO: 26299 - protein, 352 aa, Hyparrhenia rufa
NIYDLKADEKTKSWKKLVNVAVSGAAGMISNHLLFKLASGEVFGQDQPIALKLLGSERSFTALEGVAMELEDSLYPLLREVSIGIDPYEVFQDADWALLIGAKPRGPGMERAALLDINGQIFADQGKALNAVASKNVKVLVVGNPCNTNALICLKNAPSIPAKNFHALTRLDENRAKCQLALKAGVFYDKVSNVTIWGNHSTTQVPDFLNAKIDGKPVKDVIKDTKWLEEEFTMTVQKRGGVLIQKWGRSSAASTAVSIADAIKSLVTPTPEGDWFSTGVYTTGNPYGIAEDIVFSMPCRSKGDGDYELATDVSLDDFLWEKIKKSEAELLAEKKCVAHLTGEGNAFCDLPV

SEQ ID NO: 26300 - protein, 1915 aa, Acetivibrio cellulolyticus
MKKVISMIVAIAMLVTMFSTVVNLGTASAATQDYDKALDYAIQFFDANKCGPDAASDNVFSWRGACHTSDKGPSGEDLTGGYHDAGDHVKFGLPQAYSAFMLGWALYEYGNVMDSTGNKTKILSTLKYFSDYLLKCHPSANIFYHQVGEGGPDHSYWGAPEKQTGTRSTKVVDSNTAGTDVAGEASAALAIMYLNYKDIDATYANKCLAASKTLLALAKSKIGAYNESEFYKSYCIYDDLAWASIWLYIAGGSTDSTLLADAEKYSVMDKLNGESPLKHVWTMCWDDVYLPAFIKLAQMTGKATYKDALAYSFNYWKSTVTTTPGGLKWLNNWGALRYASGEAALAFMYNNLVAKDATLVSTYKAQIDYALGTNPSNYSYVIGYGSTWPKSPHHRAANPDKSSNAKYTLTGALVGGPSNSDSYVDDVNQYQYSEVAIDYNSSFVLALASYLGTTMTSTTTPTKTATAPTPTKTTSTGTGFTVNVDSVNGNVGEQIVVPVSFANVPSNGVSTADMTITYDSSKLEYVSGAAGSIVTNPTVNFGINKEADGKLKVLFLDYTMSTGYISTNGVFANVTFKVLNSAPTTVGITGATFGDKNLGNISATINAGSINGGTISTPTKTTAVTPTKTTTIVPTPTKTTSTGTGFTVNVDSVNGNVGEQIVVPVSFANVPSNGISTADMTITYDSSKLEYVSGDAGSIVTNPTVNFGINKETDGKLKVLFLDYTMSTGYISTNGVFAKVTFKVLNAGGSSVGITGATFGDKNLGSVSATINAGSINGGSIPTPTKTTAVTPTKTTGVTPTKTPVIGTGFTVSVDSVNGNVGEQIVIPVSFANIPANGISTADMTITYDSSKLEYVSGVPGSIVTNPDVNFGINKETDGKLKVLFLDYTMSTGYISTSGVFTKVTFKVLSSGGSTVGITGATFGDKNLGNVSATINAGSINGGSISTPTKTPIVTPTKTATVPTPGKTAVSSNLKVEFFNAGTQAQSNSIYPKFRLTNTGSNAINLADVKLHYYFTVDGDKAQTFWCDWSPVGSSNVTGTFVKMNPTTTGADQYLEIAFSSAAGTLAANTSIEVQGRFAKSDWTNYNQADDYSFNSSATTYTSWDKVTAYSAEGLIWGIEPNGTVVTPTTVVTPTKTATATPTKTATATPTKTSTPNPNAMAVAVGAVQGGVGETVTVPVTMTKVPTTGVSTADFTVTYDATKLEYVSGAAGSIVTNPDVNFGINKEADGKIKVLFLDYTMATEYISKDGVFANLTFKIKSTAAAGTTAAVGIAGTATFGDSALKPITAVITDGKVEIIDGKAMKVVIANVSGNAGSEVVVPVSIEGVSANGVSAADFTITYDATKLDYVSGAAGSIVKNPDVNFGINKEADGKLKVLFLDYTMATEYISADGIFANLTFKIKSTAVNGDVAAISKSGTATFGDKNLGPISAVIKDGSVTVGNVTPTKTATATPTVTPTKTSTATATPTGTQTGFNLSIDTVEGNPGSSVVVPVKLSGISKNGISTADFTVTYDATKLEYISGDAGSIVTNPGVNFGINKESDGKLKVLFLDYTMSTGYISTDGVFANLNFNIKSSAAIGSKAEVSISGTPTFGDSTLTPVVAKVTNGAVNVVKKDDPNAFKVSIDTVKAATGTQVVVPVSFVNVPATGISTTDMTITYDATKLQYVSGDAGSIVTNPGVNFGINKEADGKLKVLFLDYTMTTQYISEDGVFANVTFKVIGTDGLAAVNAEDATFGDSSLSPVTASVVNGGVNIGIVSEGTTVSGYINPDFVTTSTTAPIVKAGFTVEIVGTTKSAVTDSNGYFEIKDVAAGTYTVKITKANYLTREIANVSVTADKELSTSASPILMWAGDMAIGGTQDGAINLEDILEICKAFNTSSTDAKYQVGLDLNRDGAISLEDVMIVAKHFNKVSSDY

SEQ ID NO: 26301 - protein, 91 aa, Datura ferox
RGSTIMAWELMNEPRCNADYSGKTVNGWVQEMASFVKSLDKKHLLEIGMEGFYGDSMPEKKQVNPGFQVGTDFISSHLIREIDFATIHGSA

SEQ ID NO: 26302 - protein, 521 aa, Salmonella enterica
MLDTNMKTQLRAYLEKLTKPVELIATLDDSAKSAEIKELLAEIAELSDKVTFKEDNTLPVRKPSFLITNPGSQQGPRFAGSPLGHEFTSLVLALLWTGGHPSKEAQSLLEQIRDIDGDFEFETYYSLSCHNCPDVVQALNLMAVLNPRIKHTAIDGGTFQNEITERNVMGVPAVFVNGKEFGQGRMTLTEIVAKVDTGAEKRAAEALNKRDAYDVLIVGSGPAGAAAAVYSARKGIRTGLMGERFGGQVLDTVDIENYISVPKTEGQKLAGALKAHVSDYDVDVIDSQSASKLVPAATEGGLHQIETASGAVLKARSIIIATGAKWRNMNVPGEDQYRTKGVTYCPHCDGPLFKGKRVAVIGGGNSGVEAAIDLAGIVEHVTLLEFAPEMKADQVLQDKVRSLKNVDIILNAQTTEVKGDGSKVVGLEYRDRVSGDIHSVALAGIFVQIGLLPNTHWLEGVLERNRMGEIIIDAKCETSVKGVFAAGDCTTVPYKQIIIATGEGAKASLSAFDYLIRTKIA

SEQ ID NO: 26303 - protein, 423 aa, Melinis repens
PAGSRLTTAPLAASAARLGSVQHLRPRRTLPTTVRCSVDAAKQVQDGAATVATEPPARHKTSRLPRYGVFCPSYDLTADDKTKSWKKLVTIAVSGAAGMIANHLLFQLASGEVFGQDQPIALKLLGSERSIQALEGVAMELEDSLYPLLREVSLGIDPYEVFEDADWALLIGAKPRGPGMERAALLDINGQIFADQGKALNAVASPNVKVIVVGNPCNTNALICIKNAPNIPAKNFHALTRLDENRAKCQLALKAGVFYDKVSNMTIWGNHSTTQVPDFLNAKIDGKPVKEVIKDTKWLEEEFTLTVQNRGGVLIQKWGRSSAASTSVSIVDAIKSLVTPTPEGDWFSSGVYTTGNPYGIAEDIVFSMPCRSKGDGDYELATDVLMDDFLWQRIKKSEAELLAEKKCVAHLTGEGIAFCNLTE

SEQ ID NO: 26304 - protein, 939 aa, Haemophilus somnus
MLINATQKEELRVALVDGQRLFDLDIENPGHEQKKANIYKGRITRVEPSLEAAFVDYGVERHGFLPLKEIAREYFPDDYVYQGRPNIRDILSEGQEVIVQVNKEERGNKGAALTTFVSLAGSYLVIMPNNPRAGGISRRIEGDERLELKEALSSLDVPEGVGLIVRTAGVGKSPEELQWDLKVLLHHWEAIKQASQSRPAPFLIHQESDVIVRAIRDYLRRDIGEILIDSPKVYEKAKAHIKLVRPDFINRVKLYQGEVPLFSHYQIESQIESAFRREVRLPSGGSIVIDATEALTAIDINSARSTRGGDIEETALNTNLEAADEIARQLRLRDLGGLIVIDFIDMTPVRHQREVENRMREAVRQDRARIQISRISRFGLLEMSRQRLSPSLGESSHHVCPRCQGTGKIRDNESLSLSILRLLEEEALKENTKQVHTIVPVQIASYLLNEKRKAIHSIEKRHNVDIVVAPNEAMETPHFSVFRVREGEEINELSYNLAKLHEMNDETYVVEDAFISRHLENSAATVESAVENAAVSLAIETPAPMPQERKQERESLLRRIIEGIKNLFADNSSKNKKNKNTRQNKNARHNRRNQDRRSSRRIRQEHEIKSDENNKLDTQHSHYTERYSKHAKKGVDDPQIQTKKAGELEIHTKDEETIETIQPRRQRRDLRKKVRVEENLVDTTNLGATEEHVENEKTTEPVTSLEQAVLQTENEKTHERQDNNYRHRRLPRHLRVNNQRRRRNVELKSAMPLFAAVASPELASGKVWVDVNVVNSKNNNFLSVDELLKQQYQQEEIEVVIPASEILMDTQSDDIKPLSNFVSQPANEAVEKKVQETLQRLTQEVVDESSTIERTEVDTNISVPEFVREYQFNGRLGTISAVMHTKAEMTLAKSSDEPMQPFSIVEWQDSRYYFYGRGAAGHHCAISHVYSEPANTKIE

SEQ ID NO: 26305 - protein, 425 aa, Thermotoga maritima
MRYVIVGSGPAGLNAIEAIREVDKEGEILLITAEKYVGYSRPLITYLLGRKVTEEKMYYRTEDYLREMRVDIKPATRVEKVIPEEKTVVTDSGEEIRYDKLLIATGGKPFVPNIEGLTGKKGVFTFTTWEDEEKVEKYIEENDVKEAVVLGGGLIGLKTTEALMELGVKVTIVELADRILSVTFDRKASEIITEALKKEGCSVITNDTVVKVNGDDTVSSVVLKSGKEIPTKLLVIAIGVKPNVEFLKDSGIEINRGIVVNEKMETNVEGVYAAGDCTEFYDLIDGQRKTIAIWPVAVAQGRVAGYNMAGKNVRYPGGIPMNSVELAGIPTISVGHSNVEDGGYEILTFEEGNTYKKMVLKDNRLVGAILVNDIDRAGIYTGLILQKLDVSSFKDRLLDENFGLVYLPKEFRKKMLEGEIKIWLE

SEQ ID NO: 26306 - protein, 553 aa, Unknown
  Brevibacterium sp. HCU
MPITQQLDHDAIVIGAGFSGLAILHHLREIGLDTQIVEATDGIGGTWWINRYPGVRTDSEFHYYSFSFSKEVRDEWTWTQRYPDGEEVCAYLNFIADRLDLRKDIQLNSRVNTARWNETEKYWDVIFEDGSSKRARFLISAMGALSQAIFPAIDGIDEFNGAKYHTAAWPADGVDFTGKKVGVIGVGASGIQIIPELAKLAGELFVFQRTPNYVVESNNDKVDAEWMQYVRDNYDEIFERASKHPFGVDMEYPTDSAVEVSEEERKRVFESKWEEGGFHFANECFTDLGTSPEASELASEFIRSKIREVVKDPATADLLCPKSYSFNGKRVPTGHGYYETFNRTNVHLLDARGTPITRISSKGIVHGDTEYELDAIVFATGFDAMTGTLTNIDIVGRDGVILRDKWAQDGLRTNIGLTVNGFPNFLMSLGPQTPYSNLVVPIQLGAQWMQRFLKFIQERGIEVFESSREAEEIWNAETIRGAESTVMSIEGPKAGAWFIGGNIPGKSREYQVYMGGGQVYQDWCREAEESDYATFLNADSIDGEKVRESAGMK

SEQ ID NO: 26307 - protein, 345 aa, Ostreococcus tauri
MFGECADASSGEGWDVFGCGASEYFCDPSVNYFDCDVDGFPGFGEDMEAFLGAKAREACSSESTDSEEMTLAIRAHPMYARLVEAYYECRKIGAHGDAAVALEREKDAMLYSVQVMSEEAYESSAMALDVASCDLDEFMRDCTHELETYVKELHSLYEDAKRCCKSLENRAHKVKTDVVHVDSSRRGEAAESKRHAPATEDELEAVSDDFDQILASEHQRRNHEERLRQDLKRKYASSITMLKTEFMRKRKKGKLPDTSTDILKKWWSDNIVWPYPSEDDKQVLIEMTKLDATQVNNWFINFRKRHWIRLFERGCTPKNEKEAATALAKAFNGSLEKAKDYARSL

SEQ ID NO: 26308 - protein, 129 aa, Burkholderia vietnamiensis
MRLLHTMLRVGDLDRSIKFYTELLGMKLLRRDDYPEGRFTLAFVGYEAESTGTVLELTHNWDTPSYDLGNGFGHLAVEVDDAYAACEKIKAQGGKVTREAGPMKHGTTVIAFVEDPDGYKIEFIQKKAH

SEQ ID NO: 26309 - protein, 485 aa, Moorella thermoacetica
MKTEPLLFELGAPGRQGYTLPECDVPGKVEDYLPEATRRRSDAALPELSEVEVVRHFTHLSTMNYGVDTGFYPLGSCTMKYNPKINEATANLPGFTGLHPLVPVEAAQGALELMYNLQEYLAEITGMDAITLQPAAGAHGEYTGLAVIAAYHQSRGDRERRQVLVPDSAHGTNPASAAMAGLEVVQIPSDEGGLVDLEALKAAVGPRTAALMLTNPNTLGLFESNIEAMAAIVHAAGGLLYYDGANLNAIMGLTRPGDMGFDVVHLNLHKTFSTPHGGGGPGSGPVGVKEHLAAFLPVPVVARREDGQYYLDYDRPQSIGQVRSFYGNFGVMVKAYTYIRSLGAPGLKRVSQQAVLNANYMLARLRPYFKVPFDRLCKHEFVIAPSQEVTDAGVHTLDIAKRLLDYGFHAPTIYFPLIVREAMMIEPTETEPRENLDAFCDALIAIAKEAVENPEALHQAPHNTPVRRLDEVGAARNPVLRWRGR

SEQ ID NO: 26310 - protein, 113 aa, Thermotoga maritima
MKLIIAVIQPHKLPDVKKALFDAQVYKMTVMNVLGCGQQKGYTETYRGEVEEVNLLKKVMLLIAVNEEFVEPTIEAIQKGARTGNIGDGKIFVLDLLDCIRIRTGERGREAIG

SEQ ID NO: 26311 - protein, 444 aa, Moorella thermoacetica
MTYIPTTAAEQQQMLAACGAHRMEELFSDVPASVRLGRELNLPRPMAEAEVWRHLEELAGKNKKLVSFLGAGAYEHYIPSVVGHLLARSEFYTAYTPYQPEISQGTLQAIFEFQSLICELTGLDVATASHYDGATAMAEAALVACNATRRQKILVSRSVNPQYRTVLSTYAKGQGVELAEVPLQDGRTDLEALEKLAGKDVAGVILQNPNFFGQIEAMAEATDLAHKARALGIAVVDPVSLGLLAAPGEYGADLAVGEGQSLGNPLNFGGPYLGFIAAREKLVRRLPGRIVGQTKDVDGKRAYVLTLQAREQHIRREKATSNICSNEALCALAATIYLAAMGREGLKEVASQCLLKAHYAQKKLAALPGVTPVFNGPFFHEFVLQTKLSPATVARRLAENGFAAGFDLGRFYPELKNALLFTVTEVRTREEIDALVAAMRGILA

SEQ ID NO: 26312 - protein, 301 aa, Robiginitalea biformata
MSEAATCEIDLPILRERDVRLWIRREDELFPGLSGNKYRKLKYNIREMQRGGHQTLLTFGGAFSNHIHAVAAAGRQFGFRAIGVIRGDELAVSPLNPTLADARDAGMHLHFVSRRDYARRQSPEYLQELLGQFGPAYLLPEGGTNPAAVRGCAEILGEADAGFDRVCCPVGTGGTLAGLAAAAVPGQQVRGYASLKASGLEASLRDWIPGKHWTLSGEFHFGGYARIDARLVRFINDFRTETGVPLDPVYTGKMLYGILEETRRGQFQPGTRILAIHTGGLQGIRGMNLKLGKKGLPLLQL

SEQ ID NO: 26313 - protein, 570 aa, Neisseria meningitidis
MAVYRKELYMSMENFAQLLEESFTLQEMNPGEVITAEVVAIDQNFVTVNAGLKSESLIDVAEFKNAQGEIEVKVGDFVTVTIESVENGFGETKLSREKAKRAADWIALEEAMENGDILSGIINGKVKGGLTVMISSIRAFLPGSLVDVRPVKDTSHFEGKEIEFKVIKLDKKRNNVVVSRRAVLEATLGEERKALLENLQEGSVIKGIVKNITDYGAFVDLGGIDGLLHITDLAWRRVKHPSEVLEVGQEVEAKVLKFDQEKQRVSLGMKQLGEDPWSGLTRRYPQGTRLFGKVSNLTDYGAFVEIEQGIEGLVHVSEMDWTNKNVHPSKVVQLGDEVEVMILEIDEGRRRISLGMKQCQANPWEEFAANHNKGDKISGAVKSITDFGVFVGLPGGIDGLVHLSDLSWTESGEEAVRKYKKGEEVEAVVLAIDVEKERISLGIKQLEGDPFGNFISVNDKGSLVKGSVKSVDAKGAVIALSDEVEGYLPASEFAADRVEDLTTKLKEGDEVEAVIVTVDRKNRSIKLSVKAKDAKESREALNSVNATANANAGTTSLGDLLKAKLSGEQE

SEQ ID NO: 26314 - protein, 193 aa, Cenarchaeum symbiosum
MRKNESQRETKETEVSVSVLLDGTGSTTVNTGQPFLDHLVSSLGKHAMFDIDLKASSRDGIVHHLVEDVAITLGGAIDKALGDRSGIMRFGHASVPLDESLSEAVVDLVKRPYHRIEMKIKRPEVEGIAKEDLEHFFDSLLRNLDCCIHLTVKYGNNDHHRVESAIKSLAVALRMAVSADPRREGPPSTKGSM

SEQ ID NO: 26315 - protein, 211 aa, Unknown
  Synechococcus sp. RS9917
MTRRHWLRGLALGLLLLLSLQGTPAVAASVQEAVFAGGCFWCLEHDLEELPGVLSAESGYSGGHVLRPTYQQVSGERTGHQEAVRVRFDPERISYATLLRHYWRNVDPLDGGGQFCDRGDSYRPVIFTEGAQQAAKAKASVAAAAKELKLPSDRLKVQVRSAVRFWPAETYHQNYAERHPLRYRYYRFSCGRDQRLDAVWGERARRGDSWR

SEQ ID NO: 26316 - protein, 72 aa, Methylococcus capsulatus
MSKEDHIEMEGKVIETLPNTTFRVQLDNGHVVIAHISGKMRKNYIRILTGDRVKVELTPYDLSKARITFRHR

SEQ ID NO: 26317 - protein, 279 aa, Pisum sativum
AYKLIIKTCGTTKLLLSIPPILKLADSISLNVRSVRYTRGSFIFPGAQSFPHRHFSEEVAVLDGFFGKLGSGSMAYILGGSDEAQNWHIYCASSDSVSPEGSVYTLEMCMTGLDREKASVFFKEQTGSAAEMTVNSGIRKILPNSEICDFDFEPCGYSMNSVEGPAVSTIHITPEDGFSYASFETAGYDLKAINLNEMVMRVLACFQPTEFSVAVHVDNASKSFEQGCLLDVKGYCCEEKSHQGLGMSGSVVYQKFLKTSYCGSPRSTLKCWKDEDEEE

SEQ ID NO: 26318 - protein, 163 aa, Unknown
  Shewanella sp. MR-4
MSHFRKFLAHLTTALLITALPISTVLLAGCAQSDPNTPSPSANASPTTLYQALGDDSGVSAIVDGLLARIARDPRIVHHFDETDIAIFRERLIEHLCAVTDGGCVYQGENMADSHKGLNITQADFDALVGHLIESMKEQHISTSTRNALLKRLAPMYSEVTYQ

SEQ ID NO: 26319 - protein, 295 aa, Unknown
  Anabaena
DVPVNLYRPNAPFIGKVISNEPLVKEGGIGIVQHIKFDLTGGNLKYIEGQSIGIIPPGVDKNGKPEKLRLYSIASTRHGDDVDDKTISLCVRQLEYKHPESGETVYGVCSTYLTHIEPGSEVKITGPVGKEMLLPDDPEANVIMLAGGTGIAPMRTYLWRMFKDAERAANPEYQFKGFSWLVFGVPTTPNILYKEELEEIQQKYPDNFRLTYAISREQKNPQGGRMYIQDRVAEHADQLWQLIKNQKTHTYICGLRGMEEGIDAALSAAAAKEGVTWSDYQKDLKKAGRWHVETY

SEQ ID NO: 26320 - protein, 156 aa, Vitis vinifera
YIAVGNEVSPVNGGTSRFAQFVLPAMRNIRAALASAGLQDRVKVSTAIDLTLLGNSYPPSQGAFRGDVRGYLDPIIRFLVDNKSPLLANIYPYFSYSGNPKDISLPYALFTANSVVVWDGQRGYQNLFDAMLDALYSALERAGGASLEVVISESGW

SEQ ID NO: 26321 - protein, 414 aa, Heteropogon contortus
PVGSGLAPAPLGIGAAGAAHRRSSAQLHRPRRALLATVRCDAAKDGVATAEAPTSNCFGVFCTTYDLKADDKTKSWKKLVNIAVSGAAGMISNHLLFKLASGEVFGQDQPIALKLLGSERSFTALEGVAMELEDSLYPLLREVSIGIDPYEVFQDVDWALLIGAKPRGPGMERAALLDINGQIFADQGKALDAVASKNVKVLVVGNPCNTNALICLKNAPSIPAKNFHALTRLDENRAKCQLALKAGVFYDKVSNVTIWGNHSATQVPDFLNAKIDGKPVKEVIKDTKWLEEEFTITVQKRGGALIQKWGRSSAASTAVSIADAIKSLVTPTPEGDWFSTGVYTTGNPYGIAEDIVFSMPCRSKGDGDYELATDVSMDDFLWERIKKSEAELLAEKKCVAHLTGEGNAYCDVPD

SEQ ID NO: 26322 - protein, 682 aa, Pisum sativum
MSSGGCSIVWFRRDLRVEDNPALAAGVRAGAVVGVFIWAPEEEGQYYPGRVSRWWLKNSLSQLDSSLRNLGTPLVTKRSTDSISSLLEVVKSTGATQIFFNHLYDPLSLVRDHRAKEILTAQGITVRSYNSDLLYEPWDVNDEHGQPFTTFDSFWERCLSMPYDPQAPLLPPKRIIPGDVSRCPSDTLVFEDELEKSSNALLARAWSPGWSNANKALTTFINGPLIEYSVNRRKADSATTSFLSPHLHFGEVSVKKVFHLVRIKQVFWANEGNKAGEESVNLFLKSIGLREYSRYISFNHPYSHERPLLGHLKFFPWVVDEGYFKAWRQGRTGYPLVDAGMRELWATGWLHDRIRVVVSSFFVKVLQLPWRWGMKYFWDTLLDADLESDALGWQYISGTLPDGREFDRIDNPQFEGYKCDPNGEYVRRWLPELARLPTEWIHHPWNAPESVLQAAGIELGSNYPLPIVEIDAATVRLEEALIQMWQLEAASRTAAENGTEEGLGDSTESAPIAFPQDIQMEERHEPVRNNPPHGTRRYQDQMVPSMTYSRVRVEDEETSSVRNSAGDSRAEVPTNANTQQNGREPMDQGMLQNVNRNTRQRRNNTTTTFWLRNAAEDSTAESSSSTRRERDGGVVPEWSPQASNFSDQFVDDENGIGATSPYLQRHPQTHQMMSWTRLPQTG

SEQ ID NO: 26323 - protein, 282 aa, Sieversia pentapetala
GLPPAMSANGHRVMTISPRYDQYKDAWDTEVTVKVRVGDKTETVRLFHCYKRGVDRVFVDHPLFLEKVWGKTASKIYGPVTGEDYKDNQLRFSLLCQAALEAPRVLNLNSNKYFSGPYGEDVVFIANDWHTALLPCYLKAIYQPKGIYKTAKVAFCIHNIAYQGRFSFADFSLLNLPDVFKSSFDFIDGYDKPIKGRKINWMKAGILESDTVLTVSPYYAKELVSSVEKGVELQNFIRKTKIRGIVNGMDVQEWNPLTDKYTDVKYDATTVTDAKPILKEAL

SEQ ID NO: 26324 - protein, 109 aa, Bryopsis maxima
SVNLSILKFLAFEQTFKNSLTGLPMGGGKGGSDFNPKGKSENEVMRFCQSFMTELSRHVGPNTDVPAGDIGVGAREVGFLFGQYKRLMNRFEGVLTGKALEFGGSEIRN

SEQ ID NO: 26325 - protein, 282 aa, Filipendula vulgaris
GLPPALAAYGHRVMTISPRYDQYKDAWDTEVTAQIQVGDKIETVRFFHCFKRGVDRIFVDHPMFLAKVWGKTASKIYGPMTGEDYQDNQLRFSLLCQAALEAPRILNLNSNKYFSGPYGEDVVFIANDWHTALVPCYLKAMYQSKGMYKSAKVAFCIHNIAYQGRFAFADYPKLNLPDGFKSSFDFIDGYDKPVKGRKINWMKAGILESNIVLTVSPYYAKELVSGVDKGVELDNILRITRVHGIVNGMDVQEWNPLTDKYMDVKYDATSVTDAKPILKEAL

SEQ ID NO: 26326 - protein, 275 aa, Oncostylus leiospermus
ATGHRVMTVSPRYDQFKDAWDTGVTVELQVGDKIETVRFFHCFKRGVDRVFVDHPLFLEKVWGKTASKIYGPVTGEDYKDNQLRFSLLCLAALEAPRVLNLNSNKYFSGPYGEDVTFIANDWHTALLPCYLKAKYQSKGIYMSAKVAFCIHNIAYQGRFTFADFSLLNLPDSFKSSFDFIDGYEKPVKGRKINWMKAGMLESNKVLTVSPYYAKELVSSIDKGVELDHIGRKVGVLGIVNGMDVQEWNPLTDKYTDVKYDATTVMDAKPILKEAL

SEQ ID NO: 26327 - protein, 775 aa, Salmonella typhimurium
MNDSFCRIIAGEIQANAGQVEAAVRLLDEGNTVPFIARYRKEITGGLDDTQLRNLETRLGYLRELEDRRQAILKSISEQGKLTDELAGAINATLSKTELEDLYLPYKPKRRTRGQIAIEAGLEPLADLLWNEPSHDPDVEAAKYIDGDKGVADTKAALDGARYILMERFAEDAALLAKVRDYLWKNAHLVATVVSGKEEEGAKFRDYFDHHEPIANVPSHRALAMFRGRNEGILQLSLNADPQFDEPPKESYCEQIIMDHLGLRLNNAPADSWRKGVVSWTWRIKVLMHLETELMGTVRERAEDEAINVFARNLHDLLMAAPAGLRATMGLDPGLRTGVKVAVVDGTGKLVATDTIYPHTGQAAKAATVIAALCEKYHVELVAIGNGTASRETERFYLDVQKQFPNVTAQKVIVSEAGASVYSASELAAQEFPDLDVSLRGAVSIARRLQDPLAELVKIDPKSIGVGQYQHDVSQTQLARKLDAVVEDCVNAVGVDLNTASVPLLTRVAGLTRMMAQNIVAWRDENGQFQNRQQLLKVSRLGPKAFEQCAGFLRINHGDNPLDASTVHPEAYPVVERILAATQQALKDLMGNSNELRHLKAADFTDDKFGVPTVSDIIKELEKPGRDPRPEFKTAQFADGVETMNDLLPGMILEGAVTNVTNFGAFVDIGVHQDGLVHISSLSTKFVDDPHTVVKAGDIVKVKVLEVDLQRKRIALTMRLDEQPGETAARRGGGADRAQGNRPASKAAKPRGRDAQPAGNSAMMDALAAAMGKKR

SEQ ID NO: 26328 - protein, 1722 aa, Oryza sativa
MAESGQSIASDVTALIGNTPLVYLNKVVDGCEAQIAAKLEIMEPCSSVKDRIGYSMITDAEEKGLITPGKSVLIEPTSGNTGIGLAFMAAAKGYKLILTMPASMSMERRIILKAFGAELVLTDPLLGMKGAIQKADELAAKMPNSYILQQFENPANPKIHYETTGPEIWKATAGKVDILVSGIGTGGTVTGTGKYLKEQNPEIKIYGVEPTESAILSGGRPGPHKIQGIGAGFVPGVLDVNLLDEVVQVSSDEAISMAKQLALKEGLLVGISSGAAAVAAIRVAQRPENKGKLVVVVFPSFGERYLSSVLFESIKREAENMGTPVNIIVGSHVWAEDPDDAWIDGEVVEIRGGDATIVSTDGKTIVASLASIYPKDTEAPPAGVDDMTKLAYLHEPGVLHNLACRYGINEIYTYTGNILIAVNPFRRLPHLYDVHMMEQYKGAAFGELSPHLFAIADACYRAMINEQGSQSILVSGESGAGKTETTKMLMRYLAFMGGRSGTEGRTVEQQVLESNPVLEAFGNAKTVKNNNSSRFGKFVEIQFDKYGKISGAAVRTYLLERSRVCQVSDPERNYHCFYMLCSAPPEDVKKFKVGDPRSFHYLNQTNCYEVANVDDAREYLETRNAMDVVGIGQEEQDAIFRVVAAILHLGNINFSKGQEIDSSKLRDEKSVYHLKIVAELLMCDEKALQDSLCERVIVTPDGNITKPLDPDSAALSRDALAKTVYSRLFDCFEQLCINLTNEKLQQHFNQHVFKMEQEDYTREEIDWSYVEFVDNQDVLDLIEKKPGGIIALLDEACMFPKSTHETFAQKMYQTYKAHKRFSKPKLARTAFTINHYAGDVTYQADQFLDKNKDYVVAEHQALLNSSRCPFVANLFPPLPEETSKQSKFSSIGTRFKQQLQALMETLSTTEPHYIRCVKPNAVLKPGIFENFNVLNQLRCGGVLEAIRISCAGYPTKRTFDEFIDRFGMLAAELVDSSDEKAACAAICDKMGLKGYQIGKTKVFLRAGQMAELDARRAEVLANAARLIQRRIKTHLTRKEFINLRKASIQSQKFWRARLARIFFEHMRRNAASIRIQKHARTHSARKSYLQMYESAIVIQTGLRAMAACNEHRFRRETKASIIIQEARETGALKEAKDKLEKRVEELTWRLDVEKHLRIDLEEAKGQEISNLKSVLQEMQEKLSEAHAAIEKEKEDAKLAIEQAPPKIVEVPVVDNAKVELLTRQNKELEDELVTFRTKAEDLEKRLLEVQKESDELSREILEKDSKLNQLQEMIERLETNLSSLESENQVLRQQSLLASADDDKSKQIESLESKIAILESENQLLRSKSSVAVQAVITPEVIQPSAMEEEVVVPPIKNLSKQKSLTDRQQENHDVLIKSLAEDRRFDNGRPAAACIVYKSLLHWHSFEAEKTNIFDRIIHTISTLKVLQNWLIGCRLHQLFSTYYKILLSLAVQQNARSSSLGSGISSGYSGMVGRPDTASKVEAKYSALRFKQQLTAYVEKIYGMIRDNLKKEINPFLIMCIQVPPMIIRKTFNQAFAFMNVQLFNSLLLRRECCSFSNGEFLKAGLQELEQWCSVTTEEYAGTSWDEFQHIRQAVGFLVLHQKTHKTLEEITDELCPVLSITQIYRIGTMFWDDKYGAQGLSQEVIGKMRTMATDDSITTPNSSFLLDDDSSIPISLDDIARLMLDIDLSDVEPTPLLRQNSQFHFLLQHHATQTDGIVC

SEQ ID NO: 26329 - protein, 423 aa, Pseudomonas fluorescens
MTESVLDYMTRLGRAAREASRVIGRASTAQKNRALLAAANALDAARAELAAANEQDLATGRANGLEPALLERLELTPARIDGMIVGLRQVAALPDPVGAIRDMSFRPSGIQVGKMRVPLGVIGIIYESRPNVTIDAASLCLKSGNATILRGGSEAIHSNRAIAACIQRGLAAAELPAAVVQVVETTDRAAVGALITMPEYVDVIVPRGGRGLIERISRDARVPVIKHLDGICHVYVSEHADLPKAQRIAFNAKTYRYGICGAMETLLVDQRVAKDFLPSMAKQFREKGVELRGCERTRAIIEAVAATEEDWSTEYLAPILSIRVVDGLDQAIEHINHFGSHHTDSIVSENLADTRQFVAQVDSASVMINTPTCFADGFEYGLGAEIGISTDKLHARGPVGLEGLTCEKYIVVGDGQLRGQATV

SEQ ID NO: 26330 - protein, 501 aa, Salmonella enterica
MSLSKDNIWKLLAPLVVMGVMLLIPVPDGMPPQAWHYFAVFVAMIVGMILEPIPATAISFIAVTICVIGSNYLLFDASELADPAFKASKQALKWGLAGFSSTTVWLVFGAFIFALGYEVTGLGRRIALFLVKFMGKRTLTLGYAIVIIDILLAPFTPSNTARTGGTVFPVIKNLPPLFKSFPNDPSARRIGGYLMWMMVISTSLSSSMFVTGAAPNVLGLEFVSKIAGVQISWLQWFLSFLPVGIILLIVAPWLSYVLYKPEVTHSAEVAAWAGGELKNMGRLSRKEWTLIGLVLLSLGLWVFGGKIINATAVGLLAVSLMLALHVVPWKDITRYNSAWNTLVNLATLVVMANGLTRSGFIDWFANTMSTHLEGFSPDATVIVLVLVLVLVLVLVLVLVLVFYFAHYLFASLSAHTATMLPVILAVGKGIPGVPMEQLCILLVLSIGIMGCLTPYATGPGVIIYGCGYVKSRDYWRLGAIFGVIYIAMLLLVGWPILAMWN

SEQ ID NO: 26331 - protein, 713 aa, Haemophilus somnus
MNPIVKQFKYGQHTVTLETGAIARQATAAVMASMDDTSVFVTVVAKKDVKEGQDFFPLTVNYQERTYAAGRIPGGFFKREGRPSEGETLIARLIDRPIRPLFPEGFFNEIQIIATVVSVNPQISPDLVAMIGASAALSLSGVPFNGPIGAARVGFINDQFVLNPTMNEQKQSRLDLVVAGTDKAVLMVESEADILTEEQMLAAVVFGHQQQQIVIEAIKEFAAEAGKPRWDWTAPEANTILIEKVKSIAENRLGDAYRITEKQARYEQIDLIKADVITQVTAEDETISEGKIIDIFTALESQIVRGRILRGEPRIDGRTVDTVRALDICTGVLPRTHGSAIFTRGETQALAVATLGTERDAQIIDELTGEKTDHFLFHYNFPPYSVGETGMIGSPKRREIGHGRLAKRGVAAVMPSLSEFPYVVRVVSEITESNGSSSMASVCGASLALMDAGVPIKAAVAGIAMGLVKEEDNFVVLSDILGDEDHLGDMDFKVAGTREGVTALQMDIKIEGITAEIMQIALNQAKSARMHILGVMEQAIPAPRADISDFAPRIYTMKIDPKKIKDVIGKGGATVRSLTEETGTSIDIDDDGTVKIAAVDKNAVQEVMSRIEDITAEVEVGVVYKGKVTRLADFGAFVALVGNKEGLVHISQIAEERVEKVSDYLAIGQEVIVKVLEIDRQGRIRLTMKELAKDQTKNEENLLQSEEGSPVQE

SEQ ID NO: 26332 - protein, 523 aa, Bacteroides thetaiotaomicron
MKGEREMLEPALKEQLKGIFAGLEADFTFDISVSASHESRAELLELLSDVAECSDHITCMVNEGSGLKFTIGKNGKPTEITFRAIPNGHEFTSLLLAILNLDGKGKNFPDEAVCNRVKALKGPIHLVTYVSLTCTNCPDVVQALNAMTTLNPSITHEMVDGALYQDEVDALKIQGVPSVFADGKLLHVGRGEFGELLAKLEAQYGIDETKVETEVKEYDVIVAGGGPAGVSAAIYSARKGLRVAIVAERVGGQVKETVGIENLISVPETTGSELADNLKTHLLRYPVDLLEQRKIEKVELAGKDKLVTTSVGEKFIAPALIIATGASWRKLNVPGENDYIGRGVAFCPHCDGPFYKGKQVAVVGGGNSGIEAAIDLAGICSKVTVFEFMDELKADNVLQERLKSLPNVEVFVSSQTTEVIGNGDKLTALRIKDRKTEEERLVELDGVFVQIGLSANSSVFRDIVETNRPGEIVIDAHCRTNVTGIYAAGDVSTVPYKQIIISMGEGAKAALSAFDDRVRGLIV

SEQ ID NO: 26333 - protein, 279 aa, Sinorhizobium meliloti
MTDMFAGLPELEPGSVWLVGAGPGDPGLLTLHAANALRQADVIVHDALVNGDCLKLAKASAALEFAGKRGGKPSPKQRDISLRLVELAREGKRVLRLKGGDPFVFGRGGEEALTLVEHRIPFRIVPGITAGIGGLAYAGIPVTHREVNHAVTFLTGHDSSGVVPDRINWEGIAKGSPVIVMYMAMKHIGQISANLMAAGRSPDEPVAFVCNAATPEQVVLETTLSSAEADVTASGLEPPAIVVVGEVVRLRASLDWLGALDGRALAPDPFSSRILRNPA

SEQ ID NO: 26334 - protein, 1878 aa, Trichodesmium erythraeum
MLIPSISQVINYHPLTATAETAVEDIIISMSSTGSSCVLITEKPSFSTSIKIVTPGDRSPGSPKGNHHSNSPDAKLQYLGPVIGIFTEGDLVQLASIGAPLSGFPIAQIMIRSIVTAQLSEIPDIFALFALFEKHKINHLPIVDNLERLIGLITGHSFLLNLNNIKKKGEKSILSRKKIKSQQKLSANQNNTVNKGLKSENNLLKNPNNQLLPQEITFDSSLELPGNFIPINHLEKTHESQVIQGSFSLSIKQITQLMSTHNVSYVLIIEATEKKYQNETDIYLNQESSNSQKSIKIIGTISSRDIVQLQALKIDFNKVKAGIVCNKSPIVIGSDVTLELAVDLINKKYCLLPLIVQNYIGKIDYFISPTKVIRQILLNKSLYQSLIRFYSYVEKTYLKLHQANKKLKQYTIEQNNLEKSQLAAPETTGITLKLDQDGIWDWNIETGEIFYSTLGEKMLGYTEHEISHKISFDEWLSRIHPEDRDKVNTAIQEHLTKKNTIYKIKYRIQGKDNNFIWIFDSGQTLWKSGKPVRMVGIFVDITKEKEAEIKQSFLVEKHIQIINNLSEIVWETDIHGNLIFLNQAWEKITGFKPKNSLGKNFLDYIHPEDINKLNFLTKNHPENTELAIIHNKLVADSYQLQLLTKTGGYCPVKMKSTLVFDRENKVTGIVSTLSNISEDIATQQQLQASQKAIKELYEVTTNADISFESKIVALLEMGCHRFGMDIGLLGQVLGELYKVIAAHLPENFLFGIAEGDIFTLEQTFDQEALQYDEPFVIESAKNSQWRHHPAHTVRHVESYIGTKILASGIVYGTLSFSSRLTKNKWSSIDIEVLKLMANYIGGELLREDERKALENKYQHFLLLKQITQEICSKLDTKEIFQTTVTQIGRAFKVSRCLIHSYVTEPDLHLPCMAEYLETNHESILGLDLIITSNYYTEKLLGEDRAIASPDVFSDPLLNSDVPMYQKLKVRSILAIRTSYQGKPNGIIHLHQCDYIRQWKQDEISLLEEVAFQVGLTLAKAQILESEVTHKEELEAENQALEKAREVAEVRNRAQGELLAMMSHKSQTNMNDVMMMTSLLLSMKLNPKQRDFVKTILARGDVVINMINNILDFTKIKSGEVELELSPLDIRGCVEDLLKSLDIIAKNKKLELAYLIDKNVPRIILTDDKKLVNILFNLLKNSINFTKTGEIVVYISAIKKSEKSQEYSQLEAISYEEISDFKGAGKITDNYEIQFAVKDTGAGIPLDQIDHLFKDFSQVSPATNREYDGLGLGLVISQRLSQMMGGQMWVVSQPLEIKNLSEEKKQISLLKIEDSRDINFPKNPINVYNSSSPESKVNIAGNPPHYFVKPELSGRGSIFYFTIQAKAIAMYSPEIVDGLLRGKKILVVESNIINQEEIKQQVKQWEMIPIVADSATKALSDLEQGKVFDLGIIAMDISDMDGLTLARKIRKLEAEQNSKQNKNDKSFLPLLMLNYIDTVDISRELQEAKVSLAGFLNIPIKQSQFYNVLLEVFGTRKEEEVNDKVPSLDMEDFQDLSEKNRDYTNIRILLAENNVVNQKVVIHLLEKIGYLADVAANKVEFLDALKRISYDVVLMDVQMNNGDGIGITNQICQRYSEEKRPWIIAMTANARSGDREKYLNAGMDDYMTKPVDQEKLVEVLNKFKRIRNQKLGSKTDLENAVRSHSSVIRSTLVKTNSSRQPVIQKPSFTNFQVESTSQSDEIISLKSTLPIVIPSNIEDVPETKEITMPGLDLLNDQQLAVDPKIIEKFCNLYYDEPDTPIILIQDYLTDGNKNINMIRNYINKGNFNALKTASQKFKTSSALLGAINFSKLCEELEKMALAVIESREDFDLEKATKIFLQSKNEWERVQKELSTKMNC

SEQ ID NO: 26335 - protein, 97 aa, Unknown
  Synechococcus sp. CC9311
MTSFNVQLITPQGEVSFHCPDDEYILDAAEQAGIDMSYSCRAGACSSCVGRLIQGTLDQSDQSFLDEAQIKDKYALLCVAYATSDLVVKTDCEEELW

SEQ ID NO: 26336 - protein, 655 aa, Ustilago maydis
MTPKRKGADARTSRMHDEDDKVLDPKLAEHADEDECETSKPRLAKRQKRSTHSLRSAVVAGGAKVDKQYGSSAYAKSGQGWHRSDFNPNARGRTDSKTPLNQLEEALNAHAPNKANDANDGKNVVYWMRMHDLRIHDNRALAHASSLAAARRKNGKGGHLIALFVITPADYSAHDRGARRIDFVLRTLASLKSQFDKLDIPFVVYTYSGEDRAQVGEKVFSLCEQCDASQLTANIEYEVDELWRDLAMLEAKDKKGVSFSLLHDCYVVPPGRIKTNDGRPYSVFSPWNRRWTESISKDMSLIEASEDPEANPKSIRSHPKLGALFELSKLGTGYGIPEELSGFECKDREYMAKLWPATDQAAHQVLDNFIKGKGGETALDRAANEPSTAEVGANAKDSRLARYAEGRNLLSENGTSRISPYLAAGVVSARECLRRTKQLTKGKLHVGRDSGVAMWNTEISFRDFYAHVLAAWPKVCMGHAFITKYEDVVWETDSSTLDAWKQGRTGYPIVDAAQRQCIQQGYIHNRGRMISAMFLTKHLLHDWRHGERHFSLNFIDQDFASNNGGWQWSASTGTDPQPYFRIFNPLSQSEKCDPHGDYIRHFVPELKNVKGNAIHDPFHRLSKAEFEKLGYPKPIVEHAQARQRALKRYKNPGDQ

SEQ ID NO: 26337 - protein, 206 aa, Unknown
  Malus x domestica
HGSDVAVKILMEQDFHAERFKEFLSEVTIMKRLRHPNIVLFMGAVTKPPNLSIVTEYLSRGSLYRLLHKAGAREALDERRRLSMAYDVAKGMNYLHRRKPPIVHRDLKSPNLLVDKKYTVKVCDFGLSRLKANTFLSSKSAAGTPEWMAPEVLRDEPSNEKSDIYSFGVILWELATMQQPWGNLNPAQVVAAVGFKNKRLEIPRDL

SEQ ID NO: 26338 - protein, 301 aa, Brassica napus
MMSVYGKAKQSTMKRNCRKKQRNYCPQQACKLSVLPDEIVMNCLAFVPRLDHGSLYLVSKLHRSLMLSPELYQARSLMGCTEHCIYLCLSIPSDPFARWFAFYPKAAAVNHPSPLVPIRPHLYQPPEASSVVAHGWGIYVIGGMIGRKRSSRVFFLDCRSHTWTNLPSMGFARASAAAGVVDGKIYVFGGCKKPNWVVEVFDPKTQTWDALSNQPPPPDDLNSLMHEIALIEEEKTEKIFGLNDKGDGLLYIPSQGIWKTGNSDTNQLRKGWHVIDNVIYSCVTGGGYCGVRQVIWSPWVG

SEQ ID NO: 26339 - protein, 382 aa, Geobacillus kaustophilus
MAKRDYYEILGVSKNATKDEIKKAYRKLSKQYHPDVNKAPDAAEKFKEIKEAYEVLSDDEKRARYDRFGHADPNETFGGGGFQGGGFDFGGFSGFGGFEDIFETFFGAGPRRRASGPRKGADVEYMMTLTFEEAAFGKETEIEIPREETCDTCQGSGAKPGTSPTSCPHCHGSGQVTSEQATPFGRIVNRRTCPVCGGTGRYIPEKCPTCGGTGRVKRRKKIHVKIPAGVDDGQQLRVAGQGEPGVNGGPPGDLYIIFRVEPHEFFKRDGDDIYCEVPLSFAQAALGDEIEVPTLHGHVKLKIPAGTQTGTRFRLKGKGVPNVRGYGQGDQHVIVRVVTPTKLTEKQKQLLREFERLGGDTMHDGPHGRFFEKVKKAFKGEA

SEQ ID NO: 26340 - protein, 472 aa, Hordeum vulgare
MALLLLALVVVGVVASSLLLRWNEVRYGNGRRKHGDACLPPGTMGWPLFGETTEFLKQGPSFMKQRRLRYGRLFRTHILGCPTVVCMDPELNRRMLLQGEAGGRVPGYPQSMLDILGRNNIAAVHGPLHRVMRGAMLGLVRPAALRQSLLPKMDAFMRHHLAGWAGTVVDVQAKTKEMALLSALRQIAGITAGPLSDALQTELYTLVLGTISLPINLPGTSYYQGFQARTKLVSMLEQMIAERRSSGEAHDDMLDALLRSGDDGTREKISDEQIIDLLIALIYSGYETMSTTSMMAVKYLSEHPRALQELRREHLDIRKGKLPEEAIGYDDFKSMSFTRAVIFETLRLATVVNGLLRKTTQDVEMNGYVIPKGWRIYVYTREINYDPFMYPDPMTFNPWRWLEKNMESHPHFMLFGGGSRMCPGKEVGTAEIATFLHRFVTQYRWEEEGKNTILKFPRVEAPNGLHIRVQDY

SEQ ID NO: 26341 - protein, 410 aa, Buchnera aphidicola
MRRMLINAIEIKKLRIALIDGQQLYDLNVENIDKKQRKSNIYKGKIVRIEPSLEAAFVDYGEKKNGFLPLKEISRNYFPNNCSNYRHLHIKNILKEGQECIVQIDKEERGTKGALLTTFISLAGNYLVLMPNCPHLEGISRKIEGIDRFHLKKIISMLMVPENMGIIIRTSGVGRSIETLQLDLNFRVKNWYTIKKSAEINTAPCLIHKESNIVIRTLRDYLKKDIQEIIVDNPEILELARDYMFNMNCSYFEKKIKLYTGSDPLFSYYKIESQINALLRRIVKLPSGGSIIIDYTEALTAIDINSSQSTKGVNIEETAFNTNYEAVREIARQLRLRDLGGLIVIDFIDMSVLKHQKMIELHLHQVLQKDRARVQVGSISQFGLLEMSRQCLGSPLKKINHNYLFEMQKC

SEQ ID NO: 26342 - protein, 740 aa, Arabidopsis thaliana
MASVYIPVQNSEEEVRVVLDQLPRDASDILDILKAEQAPLDLWLIIAREYFKQGKIEQFRQILEEGSSSDIDEYYADVKYERIAILNALGAYYSYLGKTETKNREKEEQFISATRYYNKASRIDMHEPSTWVGKGQLLLAKGEIDNALQAFKIVLDTAPDNVPALLGQASVEFNRGRFSESLQLYKRALQVFPGCPAAVRLGIGLCRYKLGQLDKARQAFDRVLQLDPDNVEALVALGIMDLQANDSIGMRKGMDRMQQAFEIYPYCASALNYLANHFFFTGQHFLVEQLTETALAVTTHGPTKSHSFYNLARSYHSKGDFEKAGMYYMAAIKETNNNPHEFVFPYFGLGQVQLKLGELKGSVFNFEKVLEVYPDNCETLKALGHLYTQLGQNEKALEYMRKATKLDPRDAQAFVGLGELLISSDTGAALDAFKMARTLMKKGGQEVPIEVLNDIGALHFEREEFESALENFKEALGDGIWISFLDEKENLEQTGVSVLGYKDTGIFHRLIESGHSVDVPWNKVTTLFNLARLLEQIHKTEAATFMYRLILFKYPGYIDAYLRLAASAKAQNNLPLAIELVNEALKVDDKNPNALSLLGELELKNDDWVKAKETFRAANDATDGKDSYAILSLGNWNYFAAMRNEKRNPKLEATHLEKAKELYTKVLTQHNSNMYAANGSGIVLAEKGQFDIAKDVFTQVQEAASGSVFLQMPDVWVNLAHVYFAQGNFALTVKMVCHFI

SEQ ID NO: 26343 - protein, 158 aa, Rhodopirellula baltica
MAIDAISFRSAIRSGPDCRKGTFFARSIGLLESPARDFWFVPSMKLIIAIVQPSKLDAIKEALTRVEVHRLTVVDCQGFGRQRGQTGSMRGRDYGVSLLRKVQLQIGVNEEFVQPTIDAILEGGRSGESGEIGDGKIFVLPMDDCVRIRTGERGGEAI

SEQ ID NO: 26344 - protein, 569 aa, Desulfovibrio vulgaris
MPKHVVVIGAVALGPKAACRFKRLDPEAHVTMIDQASRISYGGCGIPYYVSGEVSNIESLQATPYNVVRDPEFFRINKDVEALVETRAHAIDRAAHTVEIENLRTGERRTLKYDKLVLALGSKANRPPVEGMDLAGVTPVTNLDEAEFVQHAISAGEVSKAVIVGGGFIGLEMAVSLADMWGIDTTVVELADQIMPGFTSKSLSQMLRHDLEKNDVVVHTGEKVVRLEGENGKVARVITDKRTLDADLVILAAGVSPNTQLARDAGLELDPRGAIIVDTRMRTSDPDIFAGGDCVTIPNLVTGKPGFFPLGSMANRQGRVIGTNLADGDATFPGAVGSWAVKLFEGSASGAGLTVEGALREGYDAVNVHVEQFDRAHFYPEKTIMTLQLVVDRPTRRVLGIQGFSTLGDALTARINAVATMLASKPTVEDISNAEVVYSPPFASAMDIVNVAGNVADNVLAGRCRLVGTEEFVQLWEGRKDADICFVDTRLAANAVPLVEKYGDEWINIPEEELAARIDEIPRDKTVMLVCNTGLRSFESQLILDRLGLTNTKSVAGGMVAIHKIGGDI

SEQ ID NO: 26345 - protein, 172 aa, Brassica napus
MQAMSDEVVEVTVVEKAAEANGEKSARRRTRRKDAAEGGDGLMKWERFLPKISLRVLLVEADDSTRQIVSALLRKCSYRVAAVADGLKAWEMLKGKPESVDLILTEVDLPSISGYALLTLIMEHDTCKNIPVIMMSTQDSVNTVYKCMLKGAADYLVKPLRRNELRNLWQHV

SEQ ID NO: 26346 - protein, 334 aa, Schizosaccharomyces pombe
SSTITCDGKSLNTLPTPKQEDVEFGVPLQPEDTQDLQRKLKPRHMQMIAIGGCVGTGLFVGSGNALADGGPASILIAFAVIGTYVLFTTSALAELSAIYPVSGSFYTYFSKFIDPAWGFAVGIQYWLSFAVTVPLELTVAPLIINFWNASGPVSIWISVFYVIIIAINIWGTEGYGEVEFFLSIMKVISVIGFVILSIIIAAGGVPTDDRGVIGVSYWKQPLVFNNGFKGLCAVSVIAIFSLSGTELVGLAASEAKNPQKTVPAAVKQIFWRIFLFYIVALFMLTLVVPSDLPGLRTSDNSNVLISPFVIAIQLANIRALPSIMNVVILLSTLS

SEQ ID NO: 26347 - protein, 472 aa, Lactococcus lactis
MAQANFGVVGMAVMGKNLALNVESRGYTVAIYNRTTSKTEEVYKEHQDKNLVLTKTLEEFVGSLEKPRRIMLMVQAGAATDATIKSLLPLLDKGDILIDGGNTHFPDTMRRNAELADSGINFIGTGVSGGEKGALLGPSMMPGGQKEAYDLVAPIFEQIAAKAPQDGKPCVAYMGANGAGHYVKMVHNGIEYGDMQLIAESYDLLKRVLGLSNAEIQAIFEEWNEGELDSYLIEITKEVLKRKDDEGEGYIVDKILDKAGNKGTGKWTSESALDLGVPLPLITESVFARYISTYKDERVKASKVLSGPAVNFSGDKKEVIEKIRKALYFSKIMSYAQGFAQLRKASEEFDWDLPYGTIAQIWRAGCIIRAEFLQNITDAFDKDSELENLLLDDYFVDITKRYQEAVRDVVSLAVQAGIPIPTFTSAISYYDSYRSENLPANLIQAQRDYFGAHTYERTDKAGIFHYDWYTED

SEQ ID NO: 26348 - protein, 482 aa, Oryza sativa
  misc_feature (288)..(288): Xaa can be any naturally occurring amino acid
  misc_feature (294)..(294): Xaa can be any naturally occurring amino acid
MAVTRIGLAGLAVMGQNLALNIAEKGFPISVYNRTTSKVDETVQRAKVEGNLPVYGFHDPASFVNSIQKPRVVIMLVKAGAPVDQTIATLAAHLEQGDCIIDGGNEWYENTERREKAMEERGLLYLGMGVSGGEEGARNGPSLMPGGSFEAYKYIEDILLKVAAQVPDSGPCVTYIGKGGSGNFVKMVHNGIEYGDMQLISEAYDVLKSVGKLTNSELQQVFSEWNKGELLSFLIEITADIFSIKDDQGSGHLVDKVLDKTGMKGTGKWTVQQAAELSVAAPTIEASXLDSRFXLSGLKDERVEAAKVFQGDFSSNLPVDKAQLIEDVRQALYASKICSYAQGMNIIKAKSMEKGWSLNLGELARIWKGGCIIRAIFLDRIKKAYDRNSDLANLLVDPEFAQEIMDRQAAWRRVVCLAINNGVSTPGMSASLAYFDSYRRDRLPANLVQAQRDYFGAHTYERVDMPGSFHTEWFKIARAAKM

SEQ ID NO: 26349 - protein, 441 aa, Chlamydia trachomatis
MAGRRTKEEQINRKRSHFYRDNVGVIVLCGGEGKRLSPLTCWRCKPTVSFGGRYKLIDVPISHAFASGFSKIFVIGQYLTYTLQQHLFKTYFYHGVMQDQIHLLVPERRDGSQVWYQGTADAIRQNLLYLQDSRVEYFLILSGDQLYNMDFRSIVDYAIDAQADMVIASQPVSDKDVSRFGVLKVDDESKLIDFYEKPQSEEILKHFRLSNTAMKKFGLDPQHGNFLGSMGIYLFRKDCLFQLLLEETGDDFGKELIHRQMHRGKTVAYLYDGYWTDIGTIESYYEANMALTQRPSHNIRGFNCYDDGGIIYSKNNHLPGAIISDSRISSSLLCEGAMIESGQVSNSVVGVRGVIGQGSVFDRSIMMGSDSYGSESFPLGIGKNCEIHKTIIDENCCIGNGVRLQNLQGHKDYDSPDGKLVVRDGIIIVPRGTQIPDNYVF

SEQ ID NO: 26350 - protein, 174 aa, Unknown
  Dehalococcoides sp. CBDB1
MNEIAVFGGGCFWCMEAVFSSLSGVTKVEPGYAGGNLPNPTYQQVCAGDTGHAEVIRLEFDAALISYTALLDIFFQMHDPSTLNRQGEDLGSQYRSVIFYTTPSQKAQAEKTIKTLDENGAFAKRIVTEVLPLTEFYPAEDYHHNYYAFNSSQPYCRFVIQPKLAKLKEHLPKL

SEQ ID NO: 26351 - protein, 394 aa, Saccharomyces cerevisiae
  misc_feature (26)..(26): Xaa can be any naturally occurring amino acid
  misc_feature (53)..(53): Xaa can be any naturally occurring amino acid
  misc_feature (94)..(94): Xaa can be any naturally occurring amino acid
  misc_feature (110)..(110): Xaa can be any naturally occurring amino acid
  misc_feature (116)..(116): Xaa can be any naturally occurring amino acid
  misc_feature (165)..(165): Xaa can be any naturally occurring amino acid
  misc_feature (174)..(174): Xaa can be any naturally occurring amino acid
  misc_feature (203)..(203): Xaa can be any naturally occurring amino acid
  misc_feature (215)..(215): Xaa can be any naturally occurring amino acid
  misc_feature (302)..(302): Xaa can be any naturally occurring amino acid
  misc_feature (371)..(371): Xaa can be any naturally occurring amino acid
SEGITDIEESQIQTNYDKVVYKFDDXELDENLLRGVFGYGFEEPSAIQQRAIXPIIEGHDVLAQAQSGTGKTGTFSIAALQRIDTSVKAPQALXLAPTRELALQIQKVVXALAFHXDIKVHACIGGTSFVEDAEGLRDAQIVVGTPGRVFDNIQRRRFRTDKIKXFILDEADEXLSSGFKEQIYQIFTLLPPTTQVVLLSATXPNDVLEVTTKFXRNPVRILVKKDELTLEGIKQFYVNVEEEEYKYECLTDLYDSISVTQAVIFCNTRRKVEELTTKLRNDKFTVSAIYSDLPQQERDTIXKEFRSGSSRILISTDLLARGIDVQQVSLVINYDLPANKENYIHRIGRGGRFGRKGVAINFVTNEDVGAXRELEKFYSTQIEELPSDIATLLN

SEQ ID NO: 26352 - protein, 507 aa, Solenostemon scutellarioides
MTSLLAHPLLPPPRRRPLPPLLPPPVSHPAGPRPGRWWRNLYDVKPVRFRCFAEWAQLFGPTFSVWFGSTLNVIVSSSELAKEVLKEKDGQLADPPRSRSAVKLSRDGKDLIWADYGPHYVKVRKVCTVVLFSPKRLELLRPIREDEITVMVESIYQDSAASGKSVVIKKYLASMAFHNITRLVFGKRFVNSEGEVDKQGQEFKAIAINGLKLGASLAVSEHIPWLRWMFPLDEDAFTQHGVRMERLTREIMQEHTLARQKTGGAKQHFFDALLTLKDEYDLSEDTIIALLWDMIAAGMDTPAISVEWAMAELVRNPRVQEKVQEELDRVIGHERIMTELDIPNLPYLQCVVKESLRLHPPTPVMLPHRSNADVKIGGYDIPKGSNVHVNVWAIARDPKSWKVPLEFRPERFLEEDVDIKGHDFRLLRFGAGRRVCPGAQLGIDLATSMIGHLLHHFRWTPPTGVRAEDIDMGENPGTVTYMRTPVEAVPTPRLPANLYKRVAVVDI

SEQ ID NO: 26353 - protein, 417 aa, Unknown
  Shewanella sp. MR-4
MLKKDMNIADYDPELFNAIQNETLRQEEHIELIASENYTSPRVMQAQGSQLTNKYAEGYPGKRYYGGCEYVDVVETLAIERAKQLFGATYANVQPHSGSQANSAVYMALLKPGDTVLGMNLAHGGHLTHGSPVNFSGRLYNIIPYGIDESGKIDYDEMERLAVEHKPKMMIGGFSAYSGIVDWARMREIADKIGAYLFVDMAHVAGLIAAGVYPNPVPHAHVVTSTTHKTLAGPRGGIILSAADDEDLYKKLNSAVFPGGQGGPLMHVIAGKAVAFKEALEPEFKAYQQQVVKNAKAMVEVFLERGYKIVSGGTDNHLMLVDLIGRDLTGKEADAALGSANITVNKNSVPNDPRSPFVTSGVRIGTPAITRRGFKEAEAKELTGWICDILDDAHNPAVIERVKGQVLALCARFPVYG

SEQ ID NO: 26354 - protein, 413 aa, Vibrio angustum
MGQAAQQAAFELATTATAIKNNALAIIADELESNKDIILAANKQDIDAALESGMSDALVDRLLLNESRLAGIANDVRNVINLNDPVGAELDSRVLENGMRLSRRRVPLGVVGVIYEARPNVTIDIAALCLKTGNASILRGGRETFHSNMALVKVIQVALEKAGLPAASVQYIEQPDRELVSQLLKLDQYVDMIIPRGGAGLHKMCKENSTIPVIIGGFGISHIYVDESADLTRSLDVVENAKVQRPSACNALDTLLVNEKVAEAFLSRLVERMNKAKVELIADEAAYNLLEGKAASLRKIVEGDFDTEWLSYTLGIKVVNDVDEAIFHMRKHNASHSDSILTNNLQSAERFVNAAGSAAVYVNASTRFTDGAQFGLGAEVAVSTQKLHARGPMGLEELTSYKWVGVADYLSRA

SEQ ID NO: 26355 - protein, 456 aa, Streptomyces antibioticus
MSTRRPYQGAFTPVDQEVTAFDLPVTGRIPAELRGRYLRNGPNPLRLDDPRAHLFLGEGMVHGVRLRDGRAEWYRNRWVRSAAVARSLGEKPRRGTRFAGAEFAPNTHVIGHAGRTLALVENGFRPYELTEELETVGPCDFRGTLQAGYVAHPKLDPHTGELHAVSYATRWEFVQYSVISPTGMVTRTVNIPAPHRPVMHDFALTASYVVLYDLPVVNSLVAAAAGAPMVYDWQENRGARLGLLPRNGTEVRWFDISPCWVFHTLNAYEDGDRVVVDVIRYPRMFTGLRLDGNSTPTMDRWVIDTVSGRVTETRLDDRAQEFPGVNPAVVSGPHRYGYAAVVPDMHTYFGPDDDLDDLPDQAYSDALIKHDFSAGSSSVRPLGRGHYTGEPVFVATASPAAEDDGYLLAYVHDPDRGASDLVILSAQDFTGEPVATVHLPARVPLGLHGSWIADPA

SEQ ID NO: 26356 - protein, 624 aa, Arabidopsis thaliana
MDDMNLIQQAQRHQLVVSNLGEEIDLEIGPGEDDAAFANNSLIGGPPREPSTGEHDETKHMVLVSDLPSEDQDISKGTPAKRKKKVVKRWREEWADTYKWAYVDMKDGTARIFCSICREYGRKHRRNPYGNEGSRNMQMSALEEHNNSLLHKEALRLQTASKDKIVVDKPIYVKTVMSKSAGSIVEGALKRDPNEIEFVQSVQESVHALERVIAKNSHYVNIMERLLEPERMIVFRVPWIDDRGETHVNRGFRVQFNQALGPCRGGIRFHPSMNLSIAKFLGFQQTLKNALSPYKLGGASGGSDFDPKGKSDNEIMRFCQSFMNEMYRYMGPDKDLPSEEVGVGTREMGYLFGQYRRLAGQFQGSFTGPRIYWAASSLRTEASGYGVVYFARLILADMNKEIKGLRCVVSGCGKIAMHVVEKLIACGAHPVTVSDSKGYLVDDDGFDYMKLAFLRDIKSQQRSLRDYSKTYARAKYFDELKPWNERCDVAFPCASQNEVDQADAINLVNAGCRLLVEGSNMPCTAEAVDVFRKANVLIAPAIAAGAGGVAAGEIEVLRESNSMQWSAEDFESRLQEALKQTYEKALKAANDFGYQKESPEALLHGATIAAFLNIAQAMTDQGCV

SEQ ID NO: 26357 - protein, 710 aa, Streptococcus pyogenes
MSKQTFTTTFAGKPLVVEVGQVAKQANGATVVRYGDSTVLTAAVMSKKMATGDFFPLQVNYEEKMYAAGKFPGGFMKREGRPSTDATLTARLIDRPIRPMFAEGFRNEVQVINTVLSYDENASAPMAAMFGSSLALSISDIPFNGPIAGVQVGYIDGEFIINPDKEQMEASLLELTVAGSKEAINMVESGAKELSEDIMLEALLKGHQAIQELIAFQEQIVAVVGKEKAEVELLQVDADLQADIVAKYNAQLQKAVQVEEKKAREAATEAVKEMVKAEYEERYAEDENLATIMRDVAEILEQMEHAEVRRLITEDKIRPDGRKIDEIRPLDAVVDFLPKVHGSGLFTRGQTQALSVLTLAPMGETQIIDGLAPEYKKRFLHHYNFPQYSVGETGRYGAAGRREIGHGALGERALEQVLPSLEEFPYAIRLVAEVLESNGSSSQASICAGTLALMAGGVPIKAPVAGIAMGLISDGINYTVLTDIQGLEDHFGDMDFKVAGTREGITALQMDIKIAGITPQILEEALAQAKKARFEILDVIEATIAEPRPELAPTAPKIDTIKIDVDKIKVVIGKGGETIDKIIAETGVKIDIDDEGNVSIYSSDQAAIDRTKEIIAGLVREAKVGEVYHAKVVRIEKFGAFVNLFDKTDALVHISEIAWTRTTNVSDVLEVGEDVDVKVIKIDEKGRVDASMKALIPRPPKPEKKEEKHD

SEQ ID NO: 26358 - protein, 356 aa, Novosphingobium aromaticivorans
MNAPTHTNTRYLENAWYVAALSSEVQGQALFHRKILDISVMIYRLSDGSPTALRDRCPHRFAPLHMGKREGDEISCFYHALRFNSVGTCTHNPHGNGNIPDGANVRAFPLLERHGFIWIWMGEQTADPDLLPDFSPLEDSGPNAVGYTYMHMDANFELIVDNVMDLSHIDHVHGEIISTRGKLSPKIPKIRSTSRSISSRWEWEQQPAMLILAPFLPAPDAEARQYFDITWTPPANIQLSVGAVQGELSFDEAVMQYDLHTATPETQFTTHYFFATRRNHDTDNAEYNAMKIKAMHDTFEAEDGPIITGVQREMGDTDFFDLNPVLMSNDVGPVRVRKLLRKLIEEERADDYHKSE

SEQ ID NO: 26359 - protein, 413 aa, Listeria monocytogenes
MVYLQKQDKEVFDAIKLELGRQRANIELIASENFVSEQVMEAMGSVLTNKYAEGYPGKRYYGGCEFVDIVEDLARDRAKKLFGAEYANVQPHSGAQANMAVYHTVLEPGDTVLGMNLSHGGHLTHGSPVNFSGILYNFVEYGVREDTKEIDYDIVREAALKHKPKMIVAGASAYPRKIDFAKFREIADEVGAYLMVDMAHIAGLVAAGLHQNPVPYADFTTTTTHKTLRGPRGGMILAKAEWEQKLNKSIFPGIQGGPLMHVIAAKAVAFGEALQPEFTTYCEQIIRNSKKLAETLQANDVAVLTGGSDNHLLLIDLKPLGLTGKAAEKVLDEVGITVNKNTIPFETESPFVTSGIRVGVAAVTTRGFDEVAIEKVGVLISEVLHNLENEEVLADVKARVATLTNEYPLYPSL

SEQ ID NO: 26360 - protein, 334 aa, Chlamydophila abortus
MKEKIAYLGMGIWGFCLASLLAHKGYRVVGWARNPELVAQLQTEHRHPQAPDMPIHPNLSFTTDMVEAVDGASMIVEAVSSAGIRPVSKQLKTITDLKVPFVITSKGIEQHTGLLLSEIVVEIFGSQASRYLGYLSGPSIAREVLKGCPCSVVISAYDPDTLKKIHHAFLTPKFRVYPNSDLKGVALGGALKNIIAIACGISDGFQFGDNAKSGLVTRGLHEIRKFATIMDCRPDTLYGLAGLGDLCTTCFSSLSRNTRFGKLIAQGFTLEQAKAEIGMVVEGAYTALSAYQIAKHHKIDMPITTGIYRVLYENLDIKEGIAALLQRNTKEEYL

SEQ ID NO: 26361 - protein, 351 aa, Novosphingobium aromaticivorans
MTNTRPNFVRNCWYVAGWDYEFTAGKPHPRTFLAEPVVFYRKGDGTLVAMADRCVHRLAPLSLGRLEGDDIRCMYHGMRFTADGKCVEIPGQDMIPSSACIQTYPVVEKGSWAWIWMGDPHLADAALLPDARGLDDPVWVLKSGQLDYAAPHELINDNLLDLSHLAYVHVASFGATPGWITQQPRTTQIERGVRVERWVESAPPLPPLPSLAAYESVDMWASYEFLIPGVFLMYTSLHPPGTAKGSNHAAPAGDVLFSNFTCQAVTPLTAGSSRYFFSWGPGSQFGGEEIAQQMIDVAMAAFLEDKLIIEAQARIIAMSPGEKIMPNAADRTVTIFQRMMERMKHPASTSS

SEQ ID NO: 26362 - protein, 313 aa, Arabidopsis thaliana
MMVDENVETKASTLVASVDHGFGSGSGHDHHGLSASVPLLGVNWKKRRMPRQRRSSSSFNLLSFPPPMPPISHVPTPLPARKIDPRKLRFLFQKELKNSDVSSLRRMILPKKAAEAHLPALECKEGIPIRMEDLDGFHVWTFKYRYWPNNNSRMYVLENTGDFVNAHGLQLGDFIMVYQDLYSNNYVIQARKASEEEEVDVINLEEDDVYTNLTRIENTVVNDLLLQDFNHHNNNNNNNSNSNSNKCSYYYPVIDDVTTNTESFVYDTTALTSNDTPLDFLGGHTTTTNNYYSKFGTFDGLGSVENISLDDFY

SEQ ID NO: 26363 - protein, 258 aa, Ralstonia solanacearum
SVKNAAVNVPYGGAKGGVRVDPRKLSSGELERLTRRYTSEIGIIIGPNKDIPAPDVNTNAQIMAWMMDTYSMNEGATATGVVTGKPIALGGSLGRREATGRGVFVVGSEAARNLGIDVKGARIVVQGFGNVGSVAAKLFQDAGAKVIAVQDHKGIVFNSAGLDVDALIQHVDHNGSVDGFKAETLSADDFWALECEFLIPAALEGQITGKNAPQIKAKIVVEGANGPTTPEADDILRDRGILVCPDVIANAGGVTVSY

SEQ ID NO: 26364 - protein, 410 aa, Mycobacterium avium
MASATGFVIIGGGLAAAKAVDALRDNNFDGRIIVFADEEHLPYERPPLSKEFLAGKKSLTDFTVQNSDWYRDNDVDLRLNTRVCALDAAGHTVGLADGTTVAYDKLLLATGSAARRPPIPGSDCAGVHYLRTYEDAVALNSFLGEGKSLAVVGAGWIGLEVAAAARQRGVEVTVVEAARQPLTAALGETVGEVFATLHREHRVDLRLETQVREITRADGSATGLRTTDGSAIPADAVLVAVGAQPNIELAEAAGLSLADGGVLVDASLRTSDPDIYAVGDIAAAEHPLLRTRIRTEHWANALKQPAIAVAGMLSRPGEYDELPYFFTDQYDLGMEYVGHAPRFERVVFRGDVAAREFVAFWLDADDRVLAGMNVNIWDVLDDVKALIRSRAPIDADRLGDPGAPLGELLG

SEQ ID NO: 26365 - protein, 155 aa, Escherichia coli
MYIMELTTRTLPSRKHIALVAHDHCKQMLMSWVERHQPLLEQHVLYATGTTGNLISRATGMNVNAMLSGPMGGDQQVGALISEGKIDVLIFFWDPLNAVPHDPDVKALLRLATVWNIPVATNVATADFIIQSPHFNDAVDILIPDYQRYLADRLK

SEQ ID NO: 26366 - protein, 794 aa, Callitropsis nootkatensis
MDSGSVQNVGEVVKAEANGIIEGQDANRGIEVKVKVEEMVRDLNDESPEECNEMIGMNSEDADFLGKAEDLIPPSPGGAEWTDYECTSADDLLDAARIFDCVNLPSLGELQYNLEPPPAPQHTSPPVAASVPPASSSLGSSTSSSSASVSSPSSSSWLNMKSEEAIDRHCHSASTHSIDQDSATSTSYQNFMVMPFQEPTETQENNMSKDYSYSDLGHAEKIDVLEELQNLDLLDGSDMWDPFSAGALDGFAPADNNIPSEELPMVFFEWLKSNRDSISPEDLRSIKLKRSTIELAAKQLGGGKKAMLHLLKLILAWVQNNHLQRKRKLSQQNHKFNGCRPSYFVDQYNQCYNGGGVMDQGFEPQNCYVQVGMPTDPSMFAALNNNTFNPPPAPPMDTIHHPAKYRKVPVEGCGGFSSSNECQPMFQGFDGGAPWTNMNCVLPYENYRFPPPTSQSQLDYMNYRSSAPAVSTKEARKNRMARQRRSMAHHHHHHHQNRHWPPSTSPLSRQSSEQVNINIMQYQQQRQTYLQTDRRQVNGWKPEKNLKFLLQKVLKQSDVGNLGRIVLPKKEAETHLPELEARDGISIAMEDIVTSRVWNMRYRFWPNNKSRMYLLENTGDFVRSNGLQEGDFIVLYSDTKTGKYMIRGVKVPRSDTSAAAATKCTNGSDGGDAKQFIKMGKSYLASTSQSVAVTFADSMADASSSSVSDATVHSCPDSDPFLRDMVTHSFTTKPTNASQNDHPPSASTNLESLSSLESGDLTIEEILDLVDSPDLVAEPAKSGSNSDDIAESKD

SEQ ID NO: 26367 - protein, 684 aa, Ustilago maydis
MSKHVRVLYWFRTDLRLHDSPALQAALDLKPAALFPVWCWDPNYVYKHRVGVNRFRFLLESMIALSKNITSTQSNSQLLVVRGEPTELLPELWKRWSITHLVFEKDPSAYGRRRDQLILEAAEKSNVKVVAVQGHHLYDPEQVVNKNKGKPTMSMSTLQKIVADMGDVPKPIDAPEDLPLPTLKDSKSKSLQDTLPELARSLEGLPYYTGKGREGPESIDLNSTELGGQRDKKVSCYDTVQGEASELFSAPTLASLGMDASKVKDTIKGGEPIALEKLANICKDAKYVATFAKPKTSPGQSAEDPSTTLLSPYLKFGCLSVRKLWWDAEEAKNRYKGGSKTGPPENLNGQLLFRDMYACAEYAIGDAFGRVRGNEVCRYMDWYLPTHYDENGEVVLPRPAGDAVSEARLSAYKLGQTGFPWIDALMRQLRLEGWMHHLGRHSVAAFLTRGQCWISWERGAEIFDEYLIDWDPCSNPGNWMWLSCSAFFTQYFRLYGLATFPAKYDKTGALVRKYCPELAKFPDKYIYEPFNAPKEVQQKAGCIIGKDYPLPMLDEKEAKAENMARMKICYQANLYGTSKEVLEGKADEMLRKKHGFKDAPKEFDWNNRPGAKIPKWARAPHGEEHTTKGAPGHEDGPPLTKEEGESGDDSDDVVYKQEDEQKEERTSKKRKAAAKVEGTSKKKE

SEQ ID NO: 26368 - protein, 428 aa, Rhodopseudomonas palustris
MTEEAAAQQTPVPGMTGPRRAAVGFIFITIALDMLSLGMILPILPKLIESFSDDNTANAARIYGLFGTAWALMQLFASPILGGLSDRFGRRPVILLSNLGLGLDYVLMALAPSLWWLFVGRVISGITSASISTSFAYIADVTPAEKRAAVFGMVGAAFGLGFTFGPAIGGLLGGVDPRLPFWVAAALSLANTLYGLFVLPESLPRDRRSPFRWKSANPIGAVRLLSSNARLAALAVVEFCAEVAHVALPATFVLYTGYRYAWDQTTIGLALAFVGVCTTIVQGGLVGPAVKLLGERNAQIIGYGGGALGFLIYALAPSGTLFWIGIPVMTLWGIAGPATSGMMTRLVSPSQQGQLQGATTSVKSVAELIGPFLFTMIFAYFIDAGAPLQLPGAPFLLAGALLVVSVVIVAFASPAADSKQAPQAAPES

SEQ ID NO: 26369 - protein, 481 aa, Geobacter metallireducens
MQLIYEKSVPGRRGVRLPASDVPAAPELPAALRRKEPAALPEASELDVVRHFTGLSRRNFSVDTNFYPLGSCTMKYNAKVLEEAARLFAPYHPMVPLLPHGSSFSQGCLGLAYELGAALAEITGMDEVTTQPLAGAHGEMTGIMLIAAYHEAKGNKKKYVVVPDSSHGTNPASATMVGYEIITVPTAPYGDMDLDRFREVMTDEVAAVMMTCPNTLGLFNPHIQEICDIAHDHDALMYYDGANLNAILGKVRPGDVGFDVIHLNLHKTFGTPHGGGGPGSGPVGVKKQLVPFLPSPRIVKYDDGCYGVDAPAHGSIGRTSGFFGNFGVMAKAFAYITMVGREGLIQVSEQAVLNANYVMHRLKDVYDLPYDQTCMHECVFSAARQVKSGVHAIDIAKFLIDRGYHPPTVYFPLIVKEAIMIEPTETESKETLDAFIAVMREAAELAESDPAAFAEMPRTMPVTRLDETKAAREQNVCYFGC

SEQ ID NO: 26370 - protein, 466 aa, Buchnera aphidicola
MKTVSIFDIYLNKIKLNSKINIQGWVRNRRRSKLGLLFIDLYDGSCLYTMQVVVKDILSNYDSEISKLSVGCSINVFGVLISSIGTKQKYEIQAKVVKVIGIINNPGSYPISSKYHTMKHLRNVPHLRSRTNFFGAVSRVRNYLFNALHEFLFKNGYYWIPSPIITGLNSEGAGDMFKVSILDLNNIPKNKNGKINFKKDFFGKEAFLTVSGQLTLETYACSLSKVYSFGPIFRAENSNTRRHLSEFWMLEVETAFSNLCDIIKFSENMLKYAIGIILDKCVIDINFFRENVDEKIFCRLKDFSSKQFFQIEYKEAINILIKSNRFDHKVMFIGMELSSDHERFLVEEYFKFPLVITNYPKSLKAFYMRVNDDNKTVSAMDVLVPGVGEIIGGSEREERLNVLDRRFFELNLNKEDYWWYRDLRKYGTIPHSGFGLGFERLLSYILGIKNIRDVCPFPRTAYKADF

SEQ ID NO: 26371 - protein, 448 aa, Geobacter metallireducens
MSTASYCPNTPEEVREMLAAMGAASIDDLFQPIPPGLRARSFDLPAGMSEFEMLRRFEHLAGKNAQHLAHFVGGGYYDHLIPAVVDHLSGRAEFYTAYTPYQPECSQGTLQALFEYQTAICRLTGMEVSNASLYDGGTALAEAAMMALRITGRNRLVIDGAVNPFHREVVRTYLANLDVELVEIGPKLGMEDDLRLRAAIDDATAAVLVQNPNFFGSVSDFRKLAADAHAAGALLVVSAYPVALGLIESPGAMGADVVVGDGQSLGNPLSFGGPSFGFIASRKEYIRNLPGRIIGETVDKKGQRGFVLTLQAREQHIKRHKATSNICSNQSLCALRGLIFLSSLGAQGFAELARLNYDKAEYAKKVLGSLSGVEVMNGGATFNEFTVCLPTIAEEVVTALLRKGVAAGVPLSPYYPEMERCMVVTVTEKRTREEIDTLARHLEGILCS

SEQ ID NO: 26372 - protein, 368 aa, Unknown
  Gerbera hybrid cv. 'Terra Regina'
MGRAPCCEKVGLKRGRWTAEEDDILTNYIKTHGEGSWRSLPKNAGLLRCGKSCRLRWINYLRSDIKRGNISKEDEDVITKLHASLGNRWSLIAAHLPGRTDNEIKNYWNSHLSRKIIPSRRLLNTPATPVPAKLSSHPLNKRKGRTSRSAMKINKTHKSSSRDIGANNREVDGAIDTTPLAPSIEKESNVYMEPCAASHEYSDDGQKRERHDNEAEVVDDVGMFCFNEIMDGGALTDPHGVLSLAEKETEKDLALMNVVTSEEERQNVSEPISIIGGEEVNKTGSCATSTSTDSCNVGDHDNILSGPWDWKWNFDVEEGMLGLGVEDEDNILSWPWESTTTTDSGNGDTDFVGEDLEKQNAMVAWLLS

SEQ ID NO: 26373 - protein, 150 aa, Glycine max
  misc_feature (130)..(130): Xaa can be any naturally occurring amino acid
MAPKAEKKPAAKKPAEEEPAAEKTTAGKKPKAEKRVPAGKSAGKEGGEGKRGKKKGKKSVETYKIYIFKVLKQVHPDIGISSKAMSIMNSFINDIFEKLAGEAAKLARYNKKPTITSREIQTSVRLVLPXELAKHAVSEGTKGVTKFTSS

SEQ ID NO: 26374 - protein, 163 aa, Triticum aestivum
TKGYIMQQTMFRVKDPKVSLDFYSRVMGMSLLKRLDFAEMKFSLYFLGYEDLSAAPADPVQRTGWTFGQKATIELTHNWGTESDPEFKGYHNGNSDPRGFGHIGVTVDDVYKACERFERLGVEFVKKPDDGKMKGIAFIKDPDGYWIEIFDLKRIGEVTATAS

SEQ ID NO: 26375 - protein, 999 aa, Candida albicans
MFTKSTIRTVLRSLATKANTSSENFAKVLNPKVSFDNLDVFARRHIGPTPKEVQKMLSSLGYNDLDEFLSNVVPEHILIKRKLSVQPEKGFTESEMLDHLHKLANKNKIKKSFIGKGYAGTLLPPVIQRNLLESPEWYTSYTPYQPEISQGRLNSLLNYQTMICSLTGMAMANASLLDEGTAAGEAMALSFHNSKDKKKIYVVDANLHPQTVDVIKSRAENIGVEIVEIPLATKQGVEELSRIADKVCGALVQYPDTNGEITDFTEIGNILHSNKALFAMATDLLALTVLKPPSEFGADIALGTSQRFGVPFGYGGPHAAFFATSSKYARKIPGRIVGVSKDRLGNPALRLALQTREQHIKREKATSNICTAQALLANISANYAVYHGPQGLKNIANRVYGFTTLLANEISKKHQLVNNKWFDTLTVKLNGVSSDEILAKALNEYDINMFRVDESTVSLQLDETVQKQDLINLVNVFTGQENYSPDELPAIPQELLRSDEILTNEVFNAHHSETAMLRYLHSLQRMDLSLADSMIPLGSCTMKLNATVEMQTLSIPGFNSIHPFAPIDQAQGYKELIDEFEKDLNDITGFDGTTSMPNSGAQGEYTGLSLIREYHRSRGEHDQRNICLIPVSAHGTNPASAAMCGLKVVPVKCLSNGSIDLEDLEAKAAKHAKNLCSIMITYPSTYGLFEPGVKKAIDIVHANGGLVYLDGANMNAQVGLTSPGDLGADVCHLNIHKTFALSHGGGGPGQAPVCVKEHLKPFLPKHHFVNTPHSTSESIKAVNSAPYGSASVIPVSYSYIKMLGAQALPYVSAIAMLNANYILTKLEPHYKILFVDRDASSESGTKHCAHEFILDLREFQKIGIEAIDVAKRLQDYGFHAPTMSFPVAGTLMIEPTESENLRELDRFIDSLISIRKEIEAYQNKEPLGQVLKNAPHSLEDIVSSEDWDARGYTREQAAYPLPFLKKNKCWPTVSRLNDTYGDLNLICTCPSVEEVAAES

SEQ ID NO: 26376 - protein, 287 aa, Methanosarcina barkeri
MKVACIQMDVLHCRKQENLEKALHMALKAVRKGAELIVLPEVFSTGFCYEHFDHAAETLPSPLLENLACFSEANDCIIMGSVIEKVALEETSDSGTPADSENSTLSNSSNSPFYYNLGFCFESGTLAGSYRKTHPFKTENNYFSKGDSIEPISLKKQNLKIGFEICYDLRFPEVARKLSLAGSDLLVTTAAFPNPRSEHWNILAKARAIENQIPHIACNRIGSAPDCSYFGNSMIIDAWGEVKADAGNKECLIVHDLDLSRKNEVRKMIPVFENQRIELYSEDLKII

SEQ ID NO: 26377 - protein, 447 aa, Desulfovibrio vulgaris
MPAMHRLDWTNAWTGRLEGQQEAPFALRHADIAHRFATELSAGRLPFVDMPYAEDLIASLEALTPRLRRFRHMVLLGIGGSALGARALQKAFHPSQDRPGHTGPCLWIADNIDADTLEAWFATLPARETIVVAVSKSGGTIETVAQYLLAREWLRGHLGESWRENMLLVTDVAHGFMRQEADTHGLVSLPVPDHLGGRYSVLSAVGLVPAAFLGMDWRALLDGALSVGRPLRDGGLPADHPAWRLALWNRSLMAHGYTQIIFFAYIPLWATFGPWFAQLWAESLGKEGKGSMPLPATGVTDQHSLQQMFLDGPRDKGCLFLTCPTLPAGRAFPLQLPDQWAFLKGAHFGDLLHAEALGTRMALASCDVPTVALEMADTGPEAAGRMMALLELATLFTGWLLDINPLDQPAVELGKRLANAKLGAPGYEAEGSALAGFLAREGERQEF

SEQ ID NO: 26378 - protein, 266 aa, Unknown
  Gerbera hybrid cv. 'Terra Regina'
MGRTPCCSKVGLHRGAWAIEEDKLLTDYIQTHGEGQWRALPSNAGLLRCGKSCRLRWMNYLRPGIKRGTFTSDENDVIIRLQSLHGNRWSLIAAELPGRTDNEIKNHWNSHLRRKSAENADTHHGKVSKNNKKAKKKRKSDDRRAETTTPEKSKKVKLPDSSVSSSSSCVSLSKNDSSDNGIMSSTGASSSCTIDLEDADFDFSWSDWTPLLEVEGTTSINGEQDKGFLMDGCDLLMSKEDESLRLEKLYYEYLDLLDHEDGDGNN

SEQ ID NO: 26379 - protein, 113 aa, Zea mays
MKYLHSMVRVRDLDASLRFYCEGLGLREVRRKEVPEGKFTLIFLAADESPEAEVELTWNWGSTEDYGSARNFGHLAFRVEDIYATCARLQSMGYTIHRPPRDGHMAFVRSPDL

SEQ ID NO: 26380 - protein, 478 aa, Bacillus subtilis
MASEKDAGKQSAVKLVPLLITVAVGLIIWFIPAPSGLEPKAWHLFAIFVATIIGFISKPLPMGAIAIFALAVTALTGTLSIEDTLSGFGNKTIWLIVIAFFISRGFIKTGLGARISYVFVQKFGKKTLGLSYSLLFSDLILSPAIPSNTARAGGIIFPIIRSLSETFGSSPANGTERKIGAFLLKTGFQGNLITSAMFLTAMAANPLIAKLAHDVAGVDLTWTSWAIAAIVPGLVSLIITPLVIYKLYPPEIKETPDAAKIATEKLKEMGPFKKSELSMVIVFLLVLVLWIFGGSFNIDATTTALIGLAVLLLSQVLTWDDIKKEQGAWDTLTWFAALVMLANFLNELGMVSWFSNAMKSSVSGFSWIVAFIILIVVYYYSHYFFASATAHISAMYSAFLAVVVAAGAPPLLAALSLAFISNLFGSTTHYGSGAAPVFFGAGYIPQGKWWSIGFILSIVHIIVWLVIGGLWWKVLGIW

SEQ ID NO: 26381 - protein, 680 aa, Unknown
  Synechococcus sp. RS9917
MGSAITEQGVNFSLAAPGAYRVELLLYARADAPQPERIIDLGLEHRSGDYWHVEVEGLQAGCCYGYRVFGPLEPGGHGFRPAKVLLDPCARAIAGWEVYRREAATGASPNTDCCLKAVVCERDSFDFQAHPRPHHSWNRSVIYELHVGGFTRRGDSGVAPDRRGTLRGVIDKLPYLKDLGVTAIELLPIQAFDPQDAPAGRDNVWGYSPLSWFAPHHGYIEGDDPLQARAQVRELVAACHDNGLEVLLDVVYNHTTEGNRHGPTLSWRGCGDRLYYHQNSKGDYLDVSGCGNSIAANRPLTRQLILESIRCWAIELGVDGFRFDLGIALSRGEGLQPLDHPPLFEAIEADPLLSDLKLVSEPWDCGGLYRLSDFPAQRIGAWNGRFRDDLRSFWKGDDNSTWKLGQRLRGSPDLNGGRPLALGRSVNFITAHDGFTLMDLVSFNGKHNLANGEDNRDGENHNSSWNHGVEGPSTDHAVLALRRRQQRNLITSLLLSRGVPMLLMGDEVGRSQGGNNNSWCQDSPLSWMIWGDDHCDRHLQGYVRRLLRLRQQLADLINPQQPIGEMPQRRSSDPDQLWRQWHGVELGKPDWASWSHCLAVSLQRGSRGAVLWAGFNSYFKAMHFDLPQPTSPWHRLIDTALPPGDDLPQQPEVWTPAGVPLEARSMVVMVSREMLGSLRL

SEQ ID NO: 26382 - protein, 340 aa, Oenococcus oeni
MIKQTRKIAILGAGSWGTALASTFSMNGNQVILWGKNQSDIDDINQNHQNRRFLQEAFLDKNLKATTDLKDAVKDAEIVLFVVPTSAVRQVAGKLASILPSLKNEIIFGHAIKGIEVDSNKRVSQMISEEIPSIKEDDLFFISGPSHAESVVKRAITLVAVASSNQARAAIIQAALSNSFFRVYTNSDLCGSEYAAALKNVLAIAGGIIKGLKMTDNTQAALVTRGLSEMRRLGVALGGKSETFNGLAGLGDLIVTAMSTNSRNFRAGLGLASGKDLKQVQKEMGMVIEGVKTAKAVDQLSRKNNISMPISESVYKILYENAKIDDVVADLMNRPLISEE

SEQ ID NO: 26383 - protein, 808 aa, Unknown
  Sulfitobacter sp. EE-36
MKQKLVVIGAGMASGRVLEHLLEQDRDAYDITLFNAEARGNYNRIMLSPVLSGEKTYADIVTHDAGWYAENDITCRFGEKVLEIDRAAKTVTGENGTVSYDKLVLGTGSNPFMIPLPGHDLEGVIAYRDLEDTERMMGLGEGSKCVVIGGGLLGLEAAAGMAARGVDVTVVHIMGHLMERQLDEAAGYLLRRALTDKGITVKCAANSKEILGENGKVRALLLDDGTELPCDLLVMAVGIRPNVALGQGAGLAVGKGIHVDDQMVTSDADVLAVGECVEHNGALFGLVAPLYDQAKVAAQTLLGQSSTFVPKELSTKLKVTGCDLFSAGDFADGEGREDIVFRDPARGVYRRLVIKNNVVIGAVMYGDTADSNWFFGLIRDKTDIADMRDTLIFGPAYQGGTPLDPLAAVAALPRDAEICGCNGICKGQIEDAIAAGVSDLGAIKATTKASASCGTCTGLVEQVLAVTLGDDFVLPAAASICGCTDMTHEDVRRMIKSQRLTSMPAVWQECGWKTPDGCHVCRPALNFYLLADWPLEYRDDPQSRFINERKHANIQKDGTYSVVPRMWGGITTPDELRAIADAADKYMVPTVKVTGGQRIDLLGVKSEDLPDIWADLNAAGMVSGHAYSKGLRTVKTCVGTDHCRFGTQDSTGLGIQLEKELWGAWTPHKLKLGVSGCPRNCAEATCKDIGVICVDSGYQISIGGAAGMDVRETELLIQVPTEQEAINVIKAVTQLYRENAKYLDRIYKWMAKVGLDWIKERVAAEGDALVDRFELSQTIYRKDPWAEHVTQQAERYKPLATLSLEAAE

SEQ ID NO: 26384 - protein, 364 aa, Zea mays
MATGPEHVAAAVEETPEKKAASTTELPAPSGWTKKVAPTRGGRFEVIFVSPTGEEVKSKRQLTQYLKAHPGGPASSEFDWGTSDTPRRSARLSEKVKATESPEGEKTPKRGRSSSKRGKKEEKEDTEAANEAGEDGASEEGKGTDVEMKDAENAEDEKKEVPNADAAEKTEEGEDKKEEAPAVDAAEKTEEGEDKREEEAPAVDAAEKTGEKEVAPAVDATEETEKSTEGQAQPNYVAAPESEYKGDGKPGESEAAPLAFVDETAPHVIIGEEKKEENTENENSQAAESAVPSLASLEGEKKENGGAPEQPALPVAETKADAPPAEAEKGAENSGQPNTGSQEPKAANCDEGQIQPGASAVRCT

SEQ ID NO: 26385 - protein, 222 aa, Pseudomonas putida
MVLRSEILVNKNVMPTAEQALPGRETPMSLPEFHYVFEGTPLLGPFFEGAIDFAIFGLGCFWGAERRFWQREGVVSTVVGYAGGFTPHPTYEEVCSGLTGHTEVVLVVFDKDKVSYRELLAMFWELHNPTQGMRQGNDVGTQYRSAIYCTSPEQLEQAEASRDAFQAELSKAGFGEITTEIDQAPTVYFAEAYHQQYLAKNPQGYCGIGGTGVCLPPSLQGN

SEQ ID NO: 26386 - protein, 313 aa, Oenococcus oeni
MTQKYDVVIIGAGPAGMTTATYASRANLSVMMINKGIYGGQMNDTAEVENYPAFDSILGPDLAEKMYASSTRFGAEYTFGEVQNVIDHGKTKTIVTDDEQYEAKVVIVASGATHRHIGVPGEDKYSGRGVSYCAVCDGAFFKNEQIVVIGGGDSAVEEASYLANLAKDVTIVHRRDQLRASRIAQKRAFDTDNIDFSWNKRTEEIIGDDEKVTGVKVLDKISNQESVIKTNGVFIYVGIDPNTQGLENLGILDEKGWVLTDDNMQTKVPGIYAVGDVRKDSIRQIAAAVGDGAVAGKILFDYIQSLSDTEIEA

SEQ ID NO: 26387 - protein, 887 aa, Arabidopsis thaliana
MAKSSADDEELRRACEAAIEGTKQSIVMSIRVAKSRGVWGKSGKLGRQMAKPRVLALSVKSKGPRKKAFLRVMKYSSGGVLEPAKMYKLKHLSKVEVITNDPSGCTFTLGFDNLRSQSVAPPQWTMRNTDDRNRLLVCILNICKDVLGRLPKVVGIDIVEMALWAKDNTPVVTTQRSTEDGEPVAESVTESDLKVTVEKELVSQAEEEDMEALLGTYVMGIGEAEAFSERLKRELQALEAANVHAILESEPLVDEVLNGLEAATNIVDDMDEWLGIFNIKLRHMREDIESIETRNNKLEMQSVNNKALIEELDKVIERLRVPSEYAASLTGGSFDEADMLQNIEACEWLAKALRGLEVPNLDPIYANMRAVKEKRAELEKLKATFVRRASEFLRNYFASLVDFMVSDKSYFSQRGQLKRPDHADLRYKCRTYARLLQHLKGLDKNCLGPLRKAYCSSLNLLLRREAREFANELRASTKVSRNPTVWLEGSTGSSQNANTDTSAVSDAYAKMLTIFIPLLVDESSFFAHFMCFEVPALAPPGGAGNDKKSQSNNDDGNDDDDLGIMDIDETDKKPGKNSPDLTALNESLQDLLDGIQEDFYAVVDWAYKIDPLRCISMHGITERYLSGQKADAAGFVRLLLGDLESRVSMQFSRFVDEACHQIERNERNVRQMGVLPYIPRFAALATRMEQYIQGQSRDLVDQAYTKFVSIMFVTLEKIAQQDPKYADILLLENYAAFQNSLYDLANVVPTLAKFYHQASEAYEQACTRHISMIIYYQFERLFQFAKKIEDFMYTITPEEIPFQLGLSKVELRKMLKSSLSGVDKSIAAMYKKLQKNLASEELLPSLWDKCKKEFLDKYESFVQLVAKVYPSENVPGVTEMRGLLASM

SEQ ID NO: 26388 - protein, 828 aa, Vibrio angustum
MKMTRRAFVKANAAASAAAVAGITLPASATNLIVSSDETKIKWDKAPCRFCGTGCSVLVGTQNGRVVATQGDPKAPVNKGLNCIKGYFLSKIMYGKDRLQTPMLRMKNGQYDKEGEFTSVSWDTAFDVMAEKWKLALKKQGPSGVGMFGSGQWTVMEGYAASKMMKAGFRSNNIDPNARHCMASAVVGFMRTFGIDEPMGCYDDLEHADVFVLWGSNMAEMHPILWTRITDRRLSHPHVKVNVLSTYQHRSFELADNGMIFEPQTDLAIANFIANYIIQNDAVNWDFVNKHTHFKRAQTDIGYGLRDDNPLQQQAANPNSGDIFPMNFEEYKASVADYTVEKASEMSGVAPEKLIQLAKYYADPKLKVMSLWTMGMNQHTRGVWMQSLVYNLHLLTGKIATPGNSPFSLTGQPSACGTAREVGTFAHRLPADMVVANPKHREIAEKIWKLPEGTIPPKPGYHAVLQDRMLKDGKLNAYWVMCNNNMQAGPNINEERLPGYRNPENFIVCSDPYPTVTAQASDLILPTAMWVEKEGAYGNAERRTQAWYQQVEAPGEAKSDLWQIMEFSKRFKVEEVWGEELINKMPQYRGKTMYDILFRNGQVDKFPLSEAQALNDDAKAQGFYVQKGLFEEYASFGRGHGHDLAPYDTYHQVRGLRWPVVDGKETLWRFKEGSDPYAKKGTDWDFYGKPDGKAWIISAPYEAPPEVPDSEYDMWLCTGRVLEHWHTGTMTRRVPELYKAVPDALCYLHPDDAKKRGLRRGDEVNVASRRGEVRCRIETRGRNRPPEGLIFIPFFDARILVNKLILDATDPLSKQTDFKKCPVKISKV

SEQ ID NO: 26389 - protein, 691 aa, Unknown
  Synechococcus sp. RS9917
MIECGDTSVLVTATRSSGREGIDFLPLICDYEERLYAAGRIPGSFMRREGRPPERATLISRLIDRPMRPLFPNWLRDDLQIVATCMSLDERVPADVLAVTGASMATLLAGIPFHGPMAAVRVGLLGDDFVLNPSYREIERGDLDLVVAGTPEGVVMVEAGANQLPEQDVIEAIDFGYEAVCELIKAQQEILKQAGIEQVIPPAPEPDATLPSYLEKQCSKSIGEVLKHFEQSKAERDAKLDAIRASTAETIQGLKEDDPVRQAVSANSKALPATFKALTKKLMRQQILKDGKRVDGRGLDEVRPISAAAGVLPKRVHGSGLFQRGLTQVLSTATLGTPSDAQEMDDLNPSTEKTYLHHYNFPPYSVGETKPMRSPGRREIGHGALAERAILPVLPAKDTFPYVVRVVSEVLSSNGSTSMGSVCGSTLALMDAGVPLKSPVSGAAMGLIKEGDEVRILTDIQGIEDFLGDMDFKVAGTDKGITALQMDMKITGLAVSTVAEAVNQARPARLHILEKMMQAIDTPREGLSPHAPRLLSFRIDPELIGTVIGPGGRTIKGITERTNTKIDIEDSGIVTIASHDGAAADEAQKIIEGLTRKVNEGEVFSGAITRIIPIGAFVEILPGKEGMIHISQLSEARVEKVEDVVKVGDEVTVRVREIDNRGRINLTLRGVPQNGEDAEPEPAPTPVAPLT

SEQ ID NO: 26390 - protein, 842 aa, Unknown
  Sulfitobacter sp. EE-36
MLAAADGTIKGDPDHPANFGRLCSKGAALGETIDLDGRLLHPQINGVRADWDAALDMVAQRFSDAIAQHGPESVAFYASGQMLIEDYYVANKLMKGFIGAANIDTNSRLCMASSVAGHKRAFGTDTVPGTYEDLEQADLVVLVGSNLAWCHPVLHQRIAAAKQARPHMRIVNVDPRRTATTDLADVHLRIAPDGDVALFNGLLAYLAETGKLDTAYTENHVNGLDAALAAAQASDPADSGLNARELVDFYALWANTPKVVTAYSQGVNQSVCGTDKVNAILNCHLATGRIGNPGMGPFSLTGQPNAMGGREVGGLANMLANHLEIGDEAHRSVVQSFWQSPTICTKPGLKAVDLFEACADGQIKALWVISTNPAVSLPDADGVAAAIANVPFVVTSDIMEKTDTNALADVLLPATGWGEKDGTVTNSERRISRQRAFLPAPGDARPDWKIISDVAKRMGFSGAFSYGSSADVFAEYVALDQAASAFPRDLDLSIFADADYAKMVPTQWPRNGARFFANGQYYHPDGKAQMVAVTSPVSLNSRFTLNTGRNRDQWHTMTRTGKSARLGAHLAEPYVEMNPVDAAALGALPGALIALQNSRGRVLMRALITPRVAQGALFAPMHWTRQRSTAGTVNSVMTPLTDPISGQPALKASAVTAEVFKAKWYGFLASIVEPAPRTTYAAVARTNTGWQAELGGSKSPEDWEAEARLLTGQAEGDLSLQSDVATGGVRIAITQGGRITGLLFVSPNPVVVSRSAIISLIGTDTSALAALAGRNASDRPDPGATVCACFDVGRNTLLAAIAGGASTVAALGDATCAGTNCGSCKPELAALLDQTLQRMAAE

SEQ ID NO: 26391 - protein, 887 aa, Arabidopsis thaliana
MAKSSADDEELRRACEAAIEGTKQSIVMSIRVAKSRGVWGKSGKLGRQMAKPRVLALSVKSKGPRKKAILRVMKYSSGGVLEPAKMYDLKHLSKVEVITSDPSGCTFTLGFDNLRSQSVAPPQWTMRNTDDRNRLLVCILNICKDVLGRLPKVVGIDIVEMALWAKDNTPVVTTQRSTEDGEPVAESVTESALKVTVEKELVSQAEEEDMEALLGTYVIGIGEAEAFSERLKRELQALEAANVHAILESEPLVDEVLNGLEAATNIVDDMDEWLGIFNIKLRHMREDIESIEIRNNKLEMQSVNNKALIEELDKVIERLRVPSEYAASLTGGSFDEADMLQNIEACEWLAKALRGLEVPNLDPIYANMRAVKEKRAELEKLKATFVRRASEFLRDYFASLVDFKFSDKSYFSQLKRPDHADLRYKCRTYARLMQHLKGLNKNCLGPLRKAYCSSLNLLLRREAREFAKELRASTKVSRNPTVWLEGSTGSSQNANTDTSAVSDAYAKMLTIFIPLLVDESSFFAHFMCFEVPALAPPGGAGNDKKSQSNNDDGNDNDDLGIMDIDEADKKPGKNSPDLTALNESLQDLLDGIQEDFYAVVDWAYKIDPLRSISMHGITERYLSGQKADAAGFVRLLLGDLESRISMQFSHFVDEACHQIEKNERNVRQMGVLPYIPRFAALATRMEQYIQGQSRNLVDQAYTKFVSILFVTLEKIAQQDPKYADILLLENYAAFQTCLFDLANVVPTLAKFYDQAMEAYEQACTRHISMIIYYQFERLFLFDKKIKDLMYTITPEEIPFQLGLSKVELRKMLKSSLSGVDKSIAAMYKKLQKNLASEELLPSLWDKCKKEFLDKYESFVQLVAKVYPSENVPGVTEMRGLLASIFII

SEQ ID NO: 26392 - protein, 1835 aa, Arabidopsis thaliana
MVRDIVDDPLDEDDIALVKTYGLVPYSAPIKKVEKEIKELTEKINDLCGIKESDTGLAPLSKQMMQEGQPLQVGYVSCFRYIPIDLLMDIFSRVPAKSIARFRCVSKLWESILCRPDFKELFMTMSSIRPPLLLFTFQDDDGNLFFFSSPHPQIPCNENTSLVPTRYHVQHTTDSFSEIGSPLCGFICRRGKRNLDTMVICNPVTGESVSLPKVELKSINTETRPYLGYDPVRKQLKVLCIKSDDIPNTCDEHQVLTLENGNHLWRTIQCKPHYPKSDGICIDGILYYTAGFDMRARVSMVVCFDVRSEKFSFINIHVFMLMNDSCTLINYKGKLGALQFTCLSPKRLRFWVLVNAEKNIWTKCIYALPPLWNNLVQHTELAIVGMTDGGEVVLSQYCLIYAFYIYYFNLESKSLTRVQIQDVEMFKLDKCLSYILLFQGLTMTEDSTHFLLKGGYFKSSLPLKLASLIFVSSPPRSSEDVEAELARVSRWLTVATSIDSELIDDGGSRSIVRMATAVHVMGLGPAVRYGSSGLRDWWLRSRVVGGGCARNRRIRDSLVERISVLFPKNLSQSQQFPVTPRSPSCTFLLSLSGSEVSSRNRVRLLQDRRREPFFSRYLFLRIKYYHQCLIHTVKDFIAKTGDPTGTGTGGDSIYYDEIHAELKHSNTGTVAMASFGENLNASQFYITLCDDLDCLDGKYTITSGFETLTCIAKASVDAKNRPNKDIRIRHTYILTDPFDDPPQLAKMIPDASPKGKPKVEVTDDMQPREDWDIRDAEFDFLELNEAFAEMAANPVEVAINSMIIRDIMEDPENEGPHNMRSDFEPLLSVLRLRDYETGDIIEFDSTEASEEALSDITEFGSTEASEAHFEEPYSARIKKVEKEINELAEKICNLGIKESDTGLAPPNQWDLVSDKQMMQEEQPLLVATCTQIISPNTEDAKYVVDIKKIGKYVVGLGDKASPTDIEAGMRVGVDQKKYQIQIPLPPKIDPSVTMMTVEEKPDATYSDIGGCKEQIEKIREVVELPMLHPEKFVRLGIDPPKGVLCYGPPGSGKTLVARAVANRTGACFIRVVGSELVQKYIGEGARMVRELFQMARSKKACILFFDEIDAIGGARFDDGVGSDNEVQRTMLEILYQLDGFDARGNIKVLMATNRPDILDPALLRPGRLDRKVEFCLPDLEGRTQIFKIHTRTMSCERDIRFELLAGLCPNSTGADIRSVCIEAGMYAIGARRKSVTEKDFLDAVNKVVKVLSVVIWVDGSGLISGNDCVTSSMVKVSSSTTSSSSSSSPDEESDLQNLLEESDSQIDQFRISDEAAEQRPTFDVESLRSRLRRSFKLNLTKKQSIFIFLPIVIILIYLSTDFSNYFSVKVPNSAFRSNTLTGRVHESDLQALYLLRKQESDLFSIWNHTVSNLSTIDDVKSAVFRQISLNRQIQNALLSPHKTGNVDIGGSSDGYFAGGSCRKVDQKLNGRKTIQWKPRPDKFLFAICLSGQMSNHLICLEKHMFFAALLKRVLVIPSHRFDYHYSRIIDIDRINTCLGRTVVVSFEEFWKKDKNRKKHHHVHINRFICYFSKPEPCYVDKEHITKLKALGITVGGKLDTPWEEDIARPSNKTAEEVEANFRSDDDVIAIGDVFYANVEREWVMQPGGPVAHKCRTLIEPNRLILLTAQRFIQTFLGKNYIALHFRRHGFLKFCNAKNPSCFFPIPQAASCITRLIEKVEAPVLYLSTDAAESETGLLQSLLILNGKTVPLVKRPARDSAEKWDALLYRHGLEGDSQVEAMLDKTICALSSVFIGASGSTFTEDILRLRKDWGTASECDEYLCANEQPNFIADHE

SEQ ID NO: 26393 - protein, 112 aa, Methylobacillus flagellatus
MKLVSAIIKPFKLDEVREALSSIGVQGITVTEVKGFGRQKGHTELYRGAEYVVDFLPKIKLEVAVADELLDQVVEVIEKSASTGKIGDGKIFVFDLEQVYRIRTGETGADAL

SEQ ID NO: 26394 - protein, 472 aa, Unknown
  Sulfitobacter sp. EE-36
MKTFPMFLQMAGRRVVIMGGGEQAAQKVRLILKTEATVEIWAATFDAELSDLAASGRVTLHDGTITPNSFSDTALAFIATGCPGADMALHVLAKEAGAVVNVVDQPQLCDAITPSIVDRDPVVVAIGTEGTAPVLARQIKTKVEEMLEPRLGDLAALVGRLRGKASARLDPRARRDLWRWVFNDSPRWMFAAGAERAAAKRIKTAIETGDFGTAAGGSVSLVGAGPGAKDLITLRGVQRLQEADVIYYDRLLDPEILELARRDAERIYVGKAPGCHSWPQEKITQTLVMAAKRGQRVVRLKCGDPGVFGRSTEEVDALKASGIAFEIIPGVTAACAAAASIGESLTDRGKIDTVVLTTGHRQDGYAVPEPIKDIRPGTCVALYMAVGAAPQIVDHLKTAHPGVQFDLQIAAKAQRKDQKILRCSLQDLEATLSVNKIAGEAMLFIRWPREAHQADMPLVQSAVGRVVSMVQD

SEQ ID NO: 26395 - protein, 535 aa, Aspergillus nidulans
MSSKTTPTVPPVALDSITQHIGNTPLVRLNKLPQNLGINATVYAKLEYFNAGGSVKDRIALRMIEEAERSGRIKPGDTLIEPTSGNTGIGLALVAAVKGYKTIITLPEKMSAEKVSVLRALNATIIRTPNEAAYDSPESHIGVAKRLEKELPNAHILDQYGNENNPLAHELGTAQEIWSQTKGQIKAIVAGAGTGGTITGLSRGLKKHNSNVQVIAADPQGSILALPAALNEEHANEPYKVEGIGYDFIPQVLDQHAVDKWYKTDDKESFQYARRLIAEEGLLVGGSSGSAIAALVKAARDNMFKEGDVVVVILPDSIRSYLTKIQFADDDWLAANDLLPSLPTEVILQSSNKQTQGQDDAFAGSKVSSLRLKPVTTVHSNVPCETAIEVMRDKGFDQLPVLAPSGRKLVGLVTLGNVLSRLTHNRATGRSPVADVMFDFRTISEVVTDPRDMGLASLEPNQNGRDAPKPQTRSRKFVEITMDTSLSVLNRFFEWNSAAIVTERDEGGTLRPVAVVTKVDLLTWMLHHKKNGASE

SEQ ID NO: 26396 - protein, 184 aa, Cryptococcus neoformans
MMNLDEEVRLWTTNAEREKTENLATLYSIIVSLEYLERAYVRDSVSGKEYAPACLKLLAQYKSLMKLVADDIGGVEAFMKRFKMDHPAALHRLTVGVPATVEHSAEAEDGGAEKGKWCSLLIITEQSFITFMDALKLNLKAKDQLHPFLTELMSGYSRFKGSQEWEGRGKILHWYVLVSCYVPS

SEQ ID NO: 26397 - protein, 92 aa, Arabidopsis thaliana
  misc_feature (2)..(2): Xaa can be any naturally occurring amino acid
  misc_feature (5)..(5): Xaa can be any naturally occurring amino acid
  misc_feature (7)..(7): Xaa can be any naturally occurring amino acid
  misc_feature (52)..(52): Xaa can be any naturally occurring amino acid
  misc_feature (62)..(62): Xaa can be any naturally occurring amino acid
  misc_feature (74)..(74): Xaa can be any naturally occurring amino acid
  misc_feature (81)..(82): Xaa can be any naturally occurring amino acid
  misc_feature (91)..(91): Xaa can be any naturally occurring amino acid
SXATXVXSPAQATMVAPLNGLKSSAAFPATRKANNDITSITSNGGRVNCMQXWPPIGKKKFXTLSYLPDLYRFXNWLRKFXXLIRNKWDPXF

SEQ ID NO: 26398 - protein, 332 aa, Coprinopsis cinerea
MSEFRPSLMHFFNSFKESLFLGNPRWTPAEIPCLKDKVIIVTGGNSGIGYDTVKALLEHEATVYIVSRNESKALPVIDELEKETGKRALYIQAELSDLSSVKRAAEQFLSKEDRLDILYNNAGIVYPFATTPEGNDLIFETNVTGHFYFTTLLLPLLLSTAKTAAPGTVRIINVSSSAHRLVPATNPLKLDAIQEGPLRDQVLRMYGYGFSKFCSNLYTNELARRYKDTNIVVMSVHPGCFHTSMTDHMPQTLANRMINKIIFIYSPDYKAYTQLWAGTAPEAGKLHGKYITPWNSVGNPRAETQDEGLMTELWTYLEGRVKAHELKQVEGA

SEQ ID NO: 26399 - protein, 349 aa, Chlamydophila abortus
MHLLEKFKAQRVSLLSRELISCCDPAIASSDAGHVYQLLFNTTGSNLSYKVGDSLGVFPKNPVHVVEKILECLSYSPKQLVQSRESSQISLYDFLRCHTNINKVPPKLKSFFPDLEETMTFYDAIQKYQPHIPVELFVESVLPLLPRFYSIASAPHPHENQIELLVRLVNYSGEYEQRYGVCSFFLCRELELGKSCHVFVQPTKHFTLAEHVQNQPIVMIGSGTGIAPYKAFVQQRIYNNDSGMNILFFGERFEKANFYYQDFWKKAVENELLKLFLAFSRDGDRKLYVQDLLKQHADLVLKAYQKGAYFFVCGSKVLGNEVKKTLEDILGKNKLSQLKEEHRYVADVY

SEQ ID NO: 26400 - protein, 251 aa, Coprinopsis cinerea
MSETKPAGKHLRAMLRETWFLGKPHWSPKDMPSLKGKVVVVTGGNSGLGLDTVKALLEHDAKVYILSRNEQKALPVIDQLEKDTKKRPLFIKTELSDLNSVKRAAEEFLSKENRLDILYNNAGIILPFAVTPEGYDLVFETNVTGHFYLTSLLLPLLLSTAKTAPKGEVRIINISSTAHHTVPAVNPLRLEAVKDGPLRRQWLKKIDYGFSKFVMNLYTSELAKRYKDSNIVAIAVHPGKTSILIHIPNDD

SEQ ID NO: 26401 - protein, 172 aa, Glycine max
MSRLMEPLVVGRVIGEVVDIFSPSVKMNVTYSTKQVANGHELMPSTIMAKPRVEIGGDDMRTAYTLIMTDPDAPSPSDPCLREHLHWMVTDIPGTTDVSFGKEIVGYESPKPVIGIHRYVFILFKQRGRQTVRPPSSRDHFNTRRFSEENGLGLPVAAVYFNAQRETAARRR

SEQ ID NO: 26402 - protein, 137 aa, Zea mays
CPLRVRAVSVIRCILMNKILVCAGADRLQTGVRGAYGKPYDTDARVDIGQVLLSVRTRDSNRAVVIEALRRSRYKFAGRQKIIISKRHGFTNMMRSEYQQAKADNRILKDGCYLQYINNHGPLEKNLRLQARIAAQK

SEQ ID NO: 26403 - protein, 93 aa, Pseudotsuga menziesii
SGAHTLGRCHKERSGFEGAWTSNPLIFDNSYFKELLSGEKEGLLQLPSDKALLEDPVFRSYVEKYAADEDAFFADYAEAHLKLSELGFAEEYQ

SEQ ID NO: 26404 - protein, 276 aa, Shewanella oneidensis
MEILSLPGQSAKGKVWLVGAGPGDVELLTLKAWRILKSADAVLYDALVSQDILDLIPKDAEKIAVGKRAGKHSAAQDDINQLLVTKAYTRKNVVRLKGGDPFIFGRGGEELQTLVDAGVEFEVVPGITAASGTAAYTGIPLTHRDYAQGVTFITGHCQLESRPMDWQGYANPNNTLVVYMGILNAGVIRAGLINAGRSPQTPVAIVSKATTQSQQRFIGQLDSLEQLAADPKLQMPALMIIGEVVGLSETLNWFQPKAEGSQSLEALNAPKVAVKI

SEQ ID NO: 26405 - protein, 441 aa, Unknown
  Frankia sp. CcI3
MAVRGSRGPVPGDGGPPLVGYTLRYLHDPAQHWRQRYDRYGPVSWERTFGLRVVSLLGPDATGLALRNHEQAFANGPGQQRIAGPFFRRGLSMLDFDEHRHHRRILAGAFAPDRLRGYLAGMNPSIERGVAGWRPGARFQVYPAVKQLTLELATRIFMGERLGPEADRFNAALFACIRAPGAVVRVPAPGLRWSRGLAGRRYLEEFLRLRVPAKRAGSGTDMFSRLCHAEAEDGSRLSDDDVVNHMILMMVAAHDTSTITMTSMSYYLARHPEWQQRCREESLALGTPAVDHADLDRLPSLALVMKEALRLVTPVPILLRATVKDIDVLGVTVPAGTVAALALAFTHQMPEYWPSPERFDPERFADHRREDKVHPYAWQPFGGGPHTCIGLHFAGQQVKAILHQMLLRYRWSLAPGYRISLDRFPLPVPRDGLPVQLEKIT

SEQ ID NO: 26406 - protein, 258 aa, Ralstonia solanacearum
SVKNAAVNVPYGGAKGGVRVDPRKLSSGELERLTRRYTSEIGIIIGPNKDIPAPDVNTNAQIMAWMMDTYSMNEGATATGVVTGKPIALGGSLGRREATGRGVFVVGSEAARNLGIDVKGARIVVQGFGNVGSVAAKLFQDAGAKVIAVQDHKGIVFNGAGLDVDALIQHVDHNGSVDGFKAETLSADDFWALECEFLIPAALEGQITGKNAPHIRAKIVVEGANGPTTPEADDILRDRGILVCPDVIANAGGVTVSY

SEQ ID NO: 26407 - protein, 106 aa, Triticum aestivum
  misc_feature (10)..(10): Xaa can be any naturally occurring amino acid
  misc_feature (52)..(52): Xaa can be any naturally occurring amino acid
  misc_feature (55)..(55): Xaa can be any naturally occurring amino acid
  misc_feature (78)..(78): Xaa can be any naturally occurring amino acid
GSRMQDPVQXLVQLNVAPDGRPPRYDARGDVLPALIACHRTFPVTHQCLQRXLTXHAASCEITAAINPDTMILMMIFXSLTAYVLVTGNEMTSLPQSVHACSHAAS

SEQ ID NO: 26408 - protein, 137 aa, Salmonella enterica
MSEALKILNNIRTLRAQARECTLETLEEMLEKLEVVVNERREEESAAAAEVEERTRKLQQYREMLIADGIDPNELLNSMAAAKSGTKAKRAARPAKYSYVDENGETKTWTGQGRTPAVIKKAMEEQGKQLEDFLIKE

SEQ ID NO: 26409 - protein, 271 aa, Oryza sativa
MAAAAETSAKVGAPRRWSLQGKTALVTGGTRGIGRAVVEELAALGATVHTCSRKEEELSERLKEWEARGFRVTTSVCDLSVRDQRERLLRQVADLFGGKLDILVNNVGTNIRKPTTEFSAEEYSFMMATNLESAYHLCQLSHPLLKASGSGSIVFISSVCGLVAVFSGSLYAMTKGAINQLTKNLACEWARDNIRSNSIAPWYIRTSLTEGLLANKDFEGAVVSRTPLRRVGEPEEVSSLVAFLCMPGSSYITGQTISVDGGMTINGLYPS

SEQ ID NO: 26410 - protein, 319 aa, Kineococcus radiotolerans
MPQQDTTPWTPDAMGRQEGRTVLVTGANSGLGLQVATEFARRGADVLLACRNAERGRAAVAELTAAVRDSGVEPTVEVIPLDVADLASVRRAAGDVLHRRSGIDVLVNNAGVMAPPFGRTVDGFETQVGTNHLGHFAFTGLLLPALLTGGGARVVSVASVAHKFGRLNRQNYQSERSYQKWLAYGQSKLSNLLFAFELQRRAAAVGAGIVSTAAHPGLSDTNLWKNTPLAPGRVGAPLGTALSRAVGQPPAQGAWPLLRAATDPAVVGGEYFGPGGRKEWRGFPVQVQANAAAYDTADAAWLWARSVEWTGVDFRELHA

SEQ ID NO: 26411 - protein, 134 aa, Proteus vulgaris
MSESLKILNNIRTLRAQARETSLETLEEMLEKLEVVVNERREEEQAMQAEIEERQQKLQKYRELLIADGIDPTDLLEAAGASKTGRAKRAARPAKYSYVDDNGETKTWTGQGRTLAVIKRAIEEEGKSLEDFLI

SEQ ID NO: 26412 - protein, 357 aa, Unknown
  Chrysanthemum x morifolium
MDDNSLHENRFVRDEDERPKVPYNKFSSEIPVISLKGIDDVEESSGGIKSRRAEICEKIIKACEDWGIFQVVDHGVDTKMLSEMTRLAREFFEMPAEEKLRFDMTGGKKGGFIVSSHLQGEAVQDWREIVTYFSYPIKARDYSRWPDKPKEWRAVTEKYSEDLMGLGCKLLEVLSEAMGLEKEALKDACVDMDQKVVLNYYPKCPQPDLTLGLKRHTDPGTITLLLQDQVGGLQATRDGGKTWITVEPIEGAFVVNLGDHGHYLSNGRFKNADHQAVVNSNTSRLSIATFQNPAPNAIVYPLIVNEGEKSIMEEAITFMDMYKKKMSTDLELARLKKLAKAKQQDLEKAKPIESILA

SEQ ID NO: 26413 - protein, 93 aa, Pseudotsuga menziesii
SGAHTLGRCHKERSGFEGAWTSNPLIFDNSYFKELLSGEREGLLQLPSDKALLEDPVFRSYVEKYAADEDAFFADYAEAHLKLSELGFAEEYQ

SEQ ID NO: 26414 - protein, 135 aa, Serratia marcescens
MSERLKILNNIRTLRAQARECTLETLEEMLEKLEVVVNERREEDSQAQAEIEERTRKLQQYREMLIADGIDPNELLQTMAANKAAGKAKRARRPAKYQYKDENGELKTWTGQGRTPAVIKKAIEEQGKSLDDFLL

SEQ ID NO: 26415 - protein, 693 aa, Buchnera aphidicola
MLNPIVRKFQYGQHIVTLETGIMARQATAAVLTSMDDTTVFVTVVGQKKLQTEQKFFPMTVNYQERTYAAGRIPGGFFRREGRPSENEILIARLIDRPIRPLFPKRFFNEVQIIATVVSLNPQVNPDIVAIIGASAALSISGMPFLGPIGAARIGYINNQYILNPNVNEIKSSSLDLIISGTEESVLMVEAEANMLTEEQIINAINYGHEQQKIVIKNIEHFAKKVKIPVWEQCLYPVNDDLEKRIIEISEQEIVKAYNIFDKVIRLDVLDKIKSKAIEIIISEYSGIDEFEITSIISNIERKIVRNRVLKNRIRIDGRNKDEIRTLDVRTGVLPRVHGSALFTRGETQSLVSVTLGTSRDAQNLDELLGDKTDNFLFHYNFPPYAVGEIGMVGSPKRREIGHGKLAKRSILAVMPKLDLFPYTIRIVSEITESNGSSSMASVCGASLALMDAGVPISNAIAGIAMGLIKEGDDFVVLTDILGDEDHLGDMDFKISGSKKGITALQMDIKVKGITNEIMKLALYQAKNARIHILNIMKKSLNVPRKDISIFAPRIHTIKINPEKIKDVIGKGGSVIRMLTEETGTTIEIEDDGTVKISAVMQEKAKCAIQRIKEITAEVEVGSVYTGKVTRIVDFGAFVSIGIGKEGLVHISQIAHKRVDKVSDHLRLHQEIFVKVLEVDRQGRLRLSIKGAK

SEQ ID NO: 26416 - protein, 436 aa, Geobacter sulfurreducens
MNYVIIGNSVAAVGAIRGIRSIDQQGNITVISRERHNAYGRPLISYLLGGLVSEKRMAYLPEDFYEKNRVNLLLNSEVTGIDTAARQVRIAGGDTIGYDRLLVATGGDPFIPPIEGMADKDRIFTFTTWDDAAKLKGIASDIGRVVVIGGGLIGLKAAEGLHLIGKQITIVELADRILSAAFDRPAGRVVAKKMKANGIDVITEDTVVRIEGEGAEITGVTLRSGDFIPCDTIIVAIGVRPACGFLKGSGVEVNRGIVVDDRMETSVEGIYAAGDVAEAKDFFSGVKNPMPIWPDAYIQGDIAGVSMAGGTKAYEGGLAMNSIELFKVSTISMGITNPAEPKEYEILTYQDLENYQYRKIVIKDGLLAGAVLVGAVDRAGIFSGLIREKIAVVPFKDQLLAPDFGFANLPKDIRTALFAPAGKVTETGRPAVAVGH

SEQ ID NO: 26417 - protein, 348 aa, Magnaporthe grisea
MLKGTIIVTGANGGLGSAIANKLLLEAQYAEYHMIFTVRNVEKANVLQEVINSHRGKGLSSSNDVVPLDLTSLASGRKLADDINARVAAGSIPPIRALVLNAGWQEWTTESFTKDGFEMAFQSNYLTHWLLTVKLLQSMDKNKGRIVVLGSWSHDPDHPGNNYQGFYKGEQWRQLHPNTEAVAKGTFSKPESLPAGGHGFRRYGAAKLCQIMMVYELQARLDADPALSKIAVLGVDPGAMPTPLTRRANPFFVLVGRAIFPILIFLSGLFSKNPEFRSSKKSAKDVMAAALSEDEPYGHSPKAVYYNGDEISTSSAESRDKRKGLELWRSSVEYTGLTEGETCLRNWR

SEQ ID NO: 26418 - protein, 454 aa, Robiginitalea biformata
MRKAGQYFYICPGRHHCGNGWLHRRGFRKSRVPAPIADHSKSRIMLMKELLERYENKPPEIVFQWKDPETEAEGWAVINSLRGGAAGGGTRMREGLDQNEVLSLAKTMEVKFTVSGPPIGGAKSGINFNPDDPRKKGVLERWYRAVSPLLKNYYGTGGDLNVDEIHEVIPITEDAGVWHPQEGVFNGHFRPTEADKINRIGQLRMGVIKVLETDTYSPDTSRKYTVADMITGFGVAEAVRHFYDIHGESVVGKRAVVQGFGNVGGAAAFYLSKMGARVVGIIDRAGGVIKEEGFSFEEIRALFGKKKGNALVAEDLIPSAEMDRRIWSLPCEIFAPCAASRLVTREQISTLIDSGLEVISCGANVPFADREIFFGPIMEFTDQRVSLIPDFVSNCGMARVFAYFMEGRVSMEDADIFNDTSGTIRNAILNIFNQNPTRRNFSRTAFEIALKQLV

SEQ ID NO: 26419 - protein, 311 aa, Magnaporthe grisea
MASQKFDPDSDIPSLSGKVILVTGGNIGLGQESILQLAKHDPKRIYLAARSEEKARKAMEAIEQKIGAAKSSVITFLPLDLGSFDSVRKAADTVKSQTDELHILLNNAGIMMTPAAKTKDGYEEQFGVNHMGHALLTRLLLPLLEKTAKSGADVRIVNLSSSGEMLAATDCFKDMSRYKTTMEDVQTVKRYGAAKLANVYHAQMLAQKYPSIKAVSLHPGVVKTNLMSRMKESWPILGPIVSSIISNVFCTSVADGVRNQLWAAVSNDVVSGEFYHPVGLLGKGSPATKKVKEAENLWEWTEKELDAYLNK

SEQ ID NO: 26420 - protein, 112 aa, Desulfovibrio desulfuricans
MKKVEIIIRPFKLDEVKESLTELDIKGMTVSEVKGFGRQRGHKEVYRGAEYQVDFMPKAKIEVVVEDDQVQSVVETVMKAARTGKVGDGKIFIIPVDDVVRIRTGETGTGAV

SEQ ID NO: 26421 - protein, 259 aa, Picea abies
DLECDALGWQYISGCLPDGREMDRIDNPQFEGYKFDPAGEYVRRWLPELARLPTEWIHHPWDAPRAVLQAAGVELGSNYPLPIVEISTAKERLQEGLSEMWQRETDARASLENGTEEGLGESLENANASLPDQMDVDREPVRNNTHLAARSQDDQLVPSISNAVQRAYVGYTLSQAASSSPSEQAEVPSNTDSGIASAASSQQFLGQSTWSMTRGLIEDLPNVTNDYAQMQVLDEQNESHSTADSSSILRGRDDMSSGG

SEQ ID NO: 26422 - protein, 85 aa, Setaria barbata
ECQKVGAPPEVSARLTAMAQELEARQRTALGGLGAATEPELDQFMEAYHEMLVKFREELTRPLQEAMEFMRRVESQLNSFSISGR

SEQ ID NO: 26423 - protein, 85 aa, Setaria palmifolia
ECQKVGAPPEVSARLTAMAQELEARQRTALSGLGAATEPELDQFMEAYHEMLVKFREELTRPLQEAMEFMRRVESQLNSLSISGR

SEQ ID NO: 26424 - protein, 853 aa, Arabidopsis lyrata
MRVVVPNCHHFYIFFVVLILIRSVFSSYVHTLSSTESLTISSKQTIVSPGEVFELGFFNPAATSRDGDRWYLGIWFKTNLERTYVWVANRDNPLYNSTGTLKISDTNLVLLDQFDTLVWSTNLTGVLRSPVVAELLSNGNLVLKDSKTNDKDGILWQSFDYPTDTLLPQMKMGWDVKKGLNRFLRSWKSQYDPSSGDFSYKLETRGFPEFFLLWRNSRVFRSGPWDGLRFSGIPEMQQWEYMVSNFTENREEVAYTFQITNHNIYSRFTMSSTGALKRFRWISSSEEWNQLWNKPNDHCDMYKRCGPYSYCDMNTSPICNCIGGFKPRNLHEWTLRNGSIGCVRKTRLNCGGDGFLCLRKMKLPDSSAAIVDRTIDLGECKKRCLNDCNCTAYASTDIQNGGLGCVIWIEELLDIRNYASGGQDLYVRLADVDIGDERNIRGKIIGLAVGASVILFLSSIMFCVWRRKQKLLRATEAPIVYPTINQGLLMNRLEISSGRHLSEDNQTEDLELPLVEFEAVVMATENFSNSNKLGEGGFGVVYKGRLLDGQEIAVKRLSTTSIQGICEFRNEVKLISKLQHINLVRLFGCCVDENEKMLIYEYLENLSLDSHLFNKSLSCKLNWQMRFDITNGIARGLLYLHQDSRFRIIHRDLKASNVLLDKDMTPKISDFGMARIFGRDETEANTRKVVGTYGYMSPEYAMDGIFSVKSDVFSFGVLVLEIVSGKKNRGFYNSNQDNNLLGYAWRNWKEGKGLEILDPFIVDSSSSPSAFRPHEVLRCIQIGLLCVQERAEDRPVMSSVVVMLRSETETIPQPKPPGYCVGRSPFETDSSTHEQRDESCTVNQITISAIDPR

SEQ ID NO: 26425 - protein, 566 aa, Buchnera aphidicola
MTESFAQLFEESLKNIKTRPGSIIQGTVVAITKDTILVDAKLKSESKIPIDQFKNSQGELEVKVGDQIDVALDAIEDGFGETLLSREKAKRHEAWLTLEQAYKDSKTVVGLINGKVKGGFTVELEDIRAFLPGSLVDIRPVRETMHLEGKELEFKVIKLDQKRNNVVVSRRAVIESEYNAERNLLLETLQEGLIVSGIVKNLTDYGAFVDLGGVDGLLHITDMAWKRVKHPSEIVNIGDEVKIKILKFDREKIRVSLGLKQLSDDPWTKISERYPEKTKITGRVTNLTDYGCFVEIEEGVEGLVHVSEMDWTNKNIHPSKMVQVNSVVKVMILDIDEERRRISLGLKQCKNNPWMEFSKKYNKGSHVVGKIKSITDFGIFIGLEGSIDGLVHLSDISWNISGEESVKKYKKGEEVLAVVLQVDPDRERISLGIKQLQEDPFAKYVSSHKKGSLVSGTIKKIDNNVIVVSLSEHIDGLIKFLNISDEIMNVHDNKPWNKAKIGEIVEVKLNSIDKKERIIYLSILEKQELKISNDIKKNNSHKQEIDKDKNFSNAMTEAFKAAKNVD

SEQ ID NO: 26426 - protein, 635 aa, Aspergillus nidulans
MAATDRAVNETSPLVGARTTDDADVDSMTFVNGSGNEAPHDMPETKTSWYLFILTLSIGGLQVVWSVELSSGSPYLLSLGMSKALLAFVWIAGPITGTLVQPYIGIRSDNCRISWGKRKPFMIVGGAVTIATLLGLAWVKEFVGGFLVLFGGDPKSEGANIVIGIVATMMMWCLDFAINTVQAGIRCFIVDNAPAHQQESANAWASRMTGVGNIIGYIFGYINLPKLFPYLGNTRFQILCALASISLAVTLLISCSYIQERDPRLDGPPPSGSMGVVGFFKQVFKSIKHLPPQAAKVCEVQIAAWIAWFPFLFYATTYIGQLYVNPIFEKNPGLSDSDIDKAWEDATRVGTLALLIYALVSFVANITLPIFVVPTYKPVLSSDSSEVDIRQEAEPCLRVERQSSSDIEVGLVAELHPEVLRDKARGSAESKSWSSKLQIPGLTLRRTWLLSQILFALCMFSTFFITSVTAATVVVGLIGIPWALSLWAPFALISAEVATLEEQRRSRRQRSELTTFDEQMSPQIDRDAADDNDDDDDDDDNDDNDAETGSSRSPKTPGDENSAQAGIVLGLHNVAVSAPQVLSSLICSAIFRASQKPRGEPYDESVGWVLRFGGCAALLAAWLTSRLSEGTPRKR

SEQ ID NO: 26427 - protein, 457 aa, Lactococcus lactis
MYTVGDYLLDRLHELGIEEIFGVPGDYNLQFLDQIISRKDMKWVGNANELNASYMADGYARTKKAAAFLTTFGVGELSAVNGLAGSYAENLPVVEIVGSPTSKVQNEGKFVHHTLADGDFKHFMKMHEPVTAARTLLTAENATVEIDRVLSALLKERKPVYINLPVDVAAAKAEKPSLPLKKENPTSNTSDQEILNKIQESLKNAKKPIVITGHEIISFGLEKTVTQFISKTKLPITTLNFGKSSVDETLPSFLGIYNGKLSEPNLKEFVESADFILMLGVKLTDSSTGAFTHHLNENKMISLNINEGKIFNERIQNFDFESLISSLLDLSGIEYKGKYIDKKQEDFVPSNALLSQDRLWQAVENLTQSNETIVAEQGTSFFGASSIFLKPKSHFIGQPLWGSIGYTFPAALGSQIADKESRHLLFIGDGSLQLTVQERKLQVQVSQPSSSHMNSYS

SEQ ID NO: 26428 - protein, 166 aa, Vanilla planifolia
GNPCNTNALICLKNAPNIPAKNFHALTRLDENRAKCQLALKAGVFYDKVSNVTIWGNHSTTQVPDFLNAKINGIPVKEVITDRKWLEQEFTERVQKRGGVLIQKWGRSSAASTAVSIVDAIRSLVTPTANDDWFSSGVYTNGNPYGIAEDIVFSMPCRSKGDGDYE

SEQ ID NO: 26429 - protein, 387 aa, Zea mays
MIPSVRISPGYAAFSGSSLRLKLHSIPSISSLKPSKYVVSSLKPLYLAPLDGPHTSELKSWRQPLEFRCAASAADDKESKTQVVPVQLEGAQRLKISIYFATWWALNVIFNIYNKKVLNAFPYPWLTSTLSLACGSAMMLFSWATRLVEAPKTDLDFWKVLFPVAVAHTIGHVAATVSMSKVAVSFTHIIKSAEPAFTVLVSKFLLGETFPVPVYLSLLPIIGGCALAAVTELNFNMVGFMGAMISNLAFVFRNIFSKRGMKGKSVSGMNYYACLSIMSLVILTPFAIAMEGPQMWAAGWQKAVAEVGPNVVWWIAAQSVFYHLYNQVSYMSLDQISPLTFSIGNTMKRISVIVSSIIIFRTPVRPVNALGAAIAILGTFLYFQAKA

SEQ ID NO: 26430 - protein, 332 aa, Vigna angularis
MVVLSQPALNQFLLLKPCKSTPLFTGIPVVDFTHPDAKNLIVEACRDYGFFKLVNHGVPLELVANLENEALRFFKKSQSEKDRAGPPDPFGYGSKGIGPNGDVGWVEYLLLNTNPEVISPKSLSIFRESPHHFRAVVENYITAVKNMCYAVLELMAEGLGIAQRNTLSRLLKDEKSDSCFRMNHYPPCPEVPALNRNLVGFGEHTDPQIISVLRSNSTSGLQICLADGTWVSVPPDQTSFFINVGDALQVMTNGRFKSVKHRVLADTTKSRLSMIYFGGPALSEKIAPLPSVMVKGEESLYKEFTWWEYKKAAYTSRLADNRLAPFEKSATD

SEQ ID NO: 26431 - protein, 344 aa, Solanum lycopersicum
MASKLSNFNFFTLILYGVLTLVTPDFTGAQTGVCYGRLGNGLPSPADVVSLCNRNNIRRMRIYEPDQLTLQALRGSNIEVMLGVPNTDLENVGASQDNANTWIQNNVKNYDNVKFRYIAVGNEVSPFNENSKYVPVLFNAVRNIQTAISGAGLGDQIKVSTAIETGLTTDTSPPSNGRFKDEVLRFIEPIINFLVTNRAPLLVNLYPYFAVVDNPVIKLEYALFTSPEVVVNDNGRGYKNLFDAILDATYSALEKAGGSSLQIVVSESGWPSAGAGQLTSIDNARTYNNNLIQHVKGGSPKRPSGPIETYIFVLFDEDQKNPEIEKHFGLYSANMQPKYQISFN

SEQ ID NO: 26432 - protein, 322 aa, Vibrio angustum
MSKIYEDNSLTIGNTPLVRLNRVSNGKVLAKVEARNPSFSVKCRIGANMIWDAEKKGLLKEGVELVEPTSGNTGVALAFVAAARGYKLTLTMPESMSLERRKLLKALGANLVLTEAPKGMKGAIDKAEEIVNSDPSKYLLLQQFNNPANPEIHEKTTGPEIWDATDGEVDVFVSGVGTGGTLTGVSRFIKQQKGKAITTIAVEPLESPVITQTLNGDTVQPAPHKIQGIGAGFIPGNLDLSLIDEVQKVSSDDAIEMARRLMDEEGILAGISSGAAVVAANNIAARPEFADKNIVVILPSSGERYLSTALFAGIFTEKETQQ

SEQ ID NO: 26433 - protein, 327 aa, Vigna angularis
MASLSKTTTEQYSYIKNRMASTFASTIPIVDLSKPDAKTLIVNACEEFGFFKVINHGVPMEAISRLETEALKFFSLPLNEKEKAGPPNPFGYGSKRIGHNGDVGWVEYLLLNNNQEHDFSLYGKNHEKFRCLLNSYMCSVRKMACDILELMAEGLKIQQKNVFSKLLRDKESDSVFRVNHYPACPELAVNGENMIGFGEHTDPQIISLLRSNNTSGLQIYLRDGSWISVPPDHNSFFINVGDSLQVMTNGRFRSVRHRVLANGFKSRLSMIYFGGPPLSEKIVPLPSLMKGKESLYKEFTWFEYKNSTYGSRLADNRLGHFERIAAS

SEQ ID NO: 26434 - protein, 343 aa, Solanum lycopersicum
MACTKLHFPITATTLLVILILATLDFTGAQTGVCYGRNGNGLPSPADVVALCNRNNIRRMRIYDPHQPTLQALRGSNIELILGVQILTFRISASSQANANRWVKHVRNYGNVKFRYIAVGNEVSPLNGNAQYVPFVINAMRNIQNAISGAGLGNQIKVSTAIETELTTDTYPPSRGKFKDNVRGYVDPIIRFLVANRSPLLVNIYPYFAIANNQAIKLDYALFTSPGVVVNDNGREYRNLFDALLDATYSALEKAGGSSLDIVVSESGWPSAGAGQLTSIDNARTYNNNLIRHVKRGSPKRPSKPIEAYIFALFNENLKSPEIEKHFGLFTPNRQPKYPISFN

SEQ ID NO: 26435 - protein, 258 aa, Ralstonia solanacearum
SVKNAAVNVPYGGAKGGVRVDPRKLSSGELERLTRRYTSEIGIIIGPNKDIPAPDVNTNAQIMAWMMDTYSMNEGATATGVVTGKPIALGGSLGRREATGRGVFVVGSEAARNLGIDVKGARIVVQGFGNVGSVAAKLFQDAGAKVIAVQDHKGIVFNGAGLDVDALIQHVEHNGSVDGFTAETLSADDFWALECEFLIPAALEGQITGKNAPQIRAKIVVEGANGPTTPEADDILRDRGILVCPDVIANAGGVTVSY

SEQ ID NO: 26436 - protein, 715 aa, Geobacillus kaustophilus
MTMTNELLRYFRAKEKERASETAAATQCPFCSVQCTLQLVEERIVERRRYKAVPTDNPTSNGRLCLKGMNAHQHALHPERLLFPLAKVDGRFVRVSWEEALSLIVERIISIQKEDGVDAFAVYGGGSLTNEEAYLLGKFARVALKTRHIDYNGRFCMSAAAAAMNDAFGLDRGLTNPLSDIPLAQTIILAGTNVAECQPTLMPYFYEAKKNGAFIIVVDPRETKTAALADLHLPLKPGTDTALAVGIGKVLLDEGYIDEAFVCERTVGFTEWKQHIEAVKMDEIARVTDVPAEKIRLAARKYGEAADAIVLTARGLEQQADGYAAVRHWMNVVLATGKIGRPGSGFGSITGQGNGQGGREHGQKADQLPGYRSIEHPEHRRYIANIWGISPDELPRKGVSAYEMMQKIGAGEITGLLVMGSNPVVSSPNAAFVAKALQKLKFLVVADMFLSETAELADLVLPVSSYLEDEGTVTNVEGRVCFRPAARKRPGEVKHDWEILCAIAHKLGKGRYFSFTSAEEIFNELRLASRGGKADYYGVTYERLRRERVYWPCPDAHHPGTPRLFTERFAHPDGKARFAVLPFRPEKEETDEWYPLYLTTGRVLAHYLSGTQTRRSPALSARQPEAVVEIHPRTAKRYGIGPGMLVRIETRRGAAVVRSRYNDQIREDTIFVPFHWSGLQQINNVTSDELDPHCRMPAFKRCAARVRPVVDLGRN

SEQ ID NO: 26437 - protein, 258 aa, Ralstonia solanacearum
SVKNAAVNVPYGGAKGGVRVDPRKLSSGELERLTRRYTSEIGIIIGPNKDIPAPDVNTNAQIMAWMMDTYSMNEGATATGVVTGKPIALGGSLGRREATGRGVFVVGSEAARNLGIDVKGARIVVQGFGNVGSVAAKLFQDAGAKVIAVQDHKGIVFNGAGLDVDALIQHVEHNGSVDGFKAETLSADDFWALECEFLIPAALEGQITGKNAPHIRAKIVVEGANGPTTPEADDILRDRGILVCPDVIANAGGVTVSY

SEQ ID NO: 26438 - protein, 808 aa, Geobacillus kaustophilus
MKRKLVLIGNGMAGVRCIEEILKLDREAFEITIFGSEPHPNYNRILLSKVLQGDTRLDDITLNSWEWYERNGIRLFVGETVTEVDIKRRLVRTDRGRVVEYDELIFATGSNPFILPVPGADLPGVTAFRDIQDCERMIEYAKTYKKAAVIGGGLLGLEAARGLLHLGMDVDVIHIFDYLMERQLDPTASKLLQRELEKQGMNFLLRKETAELFGNGRVEGVRFKDGTSIAADLVVMAVGIRPNVELARKSGIEVNRGIVVNDYLETSVPHIYAVGECAEHRGVVYGLVAPLYEQGKVLAQAICGRKGKPYEGSVVSTQLKVSGVDVFSAGEFMDVEGTESIKLYDEARSVYKKVVVREGKIVGAVLFGDTSEGRKLFDMIQRGDSLEALSLSLLAPASSGGKGSLVAAMADTDVVCGCNGVTKGAICQAIAEHGLKTVAEVRDYTNASRSCGGCKGLVAELLEHMLGEEANRYAVKETICGCTDLSREEVLEAIEQRRLMTVKEVMSVLGWKNEEGCSKCRPALNYYLGMLYPGEYDEEAESLFVNERLHANIQADGTYSVVPRIYGGVTTAEQLRNIADVAEKYNVPMIKITGGQRIDLLGVKKEDLPRIWADLGMPSGYAYAKALRTVKTCVGKQFCRFGTQDSTGLGIRMEQTFERLKTPHKVKMAVSACPRNCAESGIKDVGVVGVEGGWEIYVGGNGGTHLRAADLLCTVKTEDEVIEMTGAFLQYYRESAHYLERTSKWVERVGLEHIREVLFDVETRRALLERLHKALSATKDPWREIVENERLQQLLFRDIGDKEPVPVE

SEQ ID NO: 26439 - protein, 615 aa, Glycine max
MASLSGICSSSPTLKKFPNQSPSLTDPLRKDHVSFPARLADRTLSLAPLRAVAREVSDGALAAAVKKGLEKDPRALWRRYVGWLYQHKELGIYLDVSRVGFSDEFVKEMEPRFQAAFRAMEELEKGAIANPDESRMVGHYWLRDPKRAPNSFLKTQIENTLDAVCKFANDVVSGKIKPPSSPEGRFTQILSVGIGGSALGPQFVAEALAPDNPPLKIRFVDNTDPAGIDHQIAQLGPELASTLVIVISKSGGTPETRNGLLEVQKAFREAGLDFPKQGVAITQENSLLDNTARIEGWLARFPMFDWVGGRTSEMSAVGLLPAALQGIDIREMLAGASLMDEANRSTVLRNNPAALLALCWYWATDGVGSKDMVILPYKDSLLLFSRYLQQLVMESLGKEFDLDGNRVNQGISVYGNKGSTDQHAYIQQLREGVHNFFVTFIEVLRDRPPGHDWELEPGVTCGDYLFGMLQGTRSALYANNRESITVTVQEVTPRTVGALIALYERAVGIYASLVNINAYHQPGVEAGKKAAGEVLALQKRVLAVLNEASCKEPVEPLTLEEVADRCHAPEDIEMIYKIIAHMAANDRALIVEGSCGSPRSIKVFLGECNIDGLYA

SEQ ID NO: 26440 - protein, 480 aa, Streptomyces antibioticus
MAAPRTPNTARKVLGRLSLPERTFVADALRTETVGGVLLLVATVTALVWANIPALQHSYEAVSHFHFGPSALGLNLSVAHWAADGLLAVFFFVAGIELKRELVAGDLRDPRAAVLPVVAALCGMAVPALVYTLTNLTGHGSTQGWAVPTATDIAFALAVLAVIGTSLPSALRAFLLTLAVVDDLFAILIIAIFFTERINFAALGGAVAGLAVFWLLLRKGVRGWYVYVPLAVVVWALMYNSGVHATIAGVAMGLMLRCTTREGEEHSPGEHIEHLVRPLSAGLAVPLFALFSAGVVVSGGALGDVFTEPETLGVVLGLVVGKTLGIFGSTWLTARFTHAELSEDLEWADIFAVASLAGIGFTVSLLIGELAFAGDTLLTDEVKAAVLTGSLIAALCATVLLKIRNARYRGLCEDEERDEDRDGIPDVYEQDDPAYHLRMADIFERKAAEHRRIAAEKAAAARHGGAEVPGGAGEEDGRPA

SEQ ID NO: 26441 - protein, 168 aa, Zea mays
MAASSTATSVHDFIVKDASGKDVDLSTYKGKVLLIVNVASQCGLTNSNYTELAQLYEKYKDQGFEILAFPCNQFGGQEPGTNEEIVQFACTRFKAEYPIFDKVDVNGNNAAPIYKFLKSSKGGLFGDSIKWNFSKFLVDKEGRVVDRYAPTTSPLSIEKDIKKLLGSS

SEQ ID NO: 26442 - protein, 258 aa, Ralstonia solanacearum
SVKNAAVNVPYGGAKGGVRVDPRKLSSGELERLTRRYTSEIGIIIGPNKDIPAPDVNTNAQIMAWMMDTYSMNEGATATGVVTGKPIALGGSLGRREATGRGVFVVGSEAARNLGIDVKGARIVVQGFGNVGSVAAKLFQDAGAKVIAVQDHKGIVFNGAGLDVDALIQHVEHNGSVDGFKAETLSADDFWALECEFLIPAALEGQITGKNAPQIRAKIVVEGANGPTTPEADDILRDRGILVCPDVIANAGGVTVSY

SEQ ID NO: 26443 - protein, 212 aa, Vibrio cholerae
MLDKQTMVTAHNALPGRTTAMSIDDTHFVNGSSLTAAPQSGQQQILIGMGCFWGAERLFWQLDGVISTSVGYSGGFTPNPTYEEVCSGKTGHTEVVRVIFDPERLPLTELLRAFWERHDPTQGMRQGNDRGTQYRSAIYTFSEDQREIAEASKAAYQALLTAQHRPSITTEILPAGAYYFAETYHQQYLAKNPNGYCGLGGTGVCFPPHSTL

SEQ ID NO: 26444 - protein, 210 aa, Buchnera aphidicola
MSKKRSSSSNRWLNEHFKDKYVKQVHKNKSDIRSRAWFKLDDIQSSNNFLKVGMTVVDLGSSPGSWSGYAVKRVGKKGRVIACDMRPMLPIKDVVFFQGNIKNKCFFNFIETYLCHKKVHVIISDMAPNMTGHYFIDHIQAILLSKLALKMSIKVLSKGGSLLVKSFYGQEFNSFIQDVHVTFSKVKICKPNSSRARSREVYILASGRKM

SEQ ID NO: 26445 - protein, 323 aa, Arabidopsis thaliana
MEFGFSIGSCFKAPNPPVLISASPNKINFTLRRRNKRFLLRVSAVSYKEFAESALEETRKRIVLEPSHLQYSSMTGLDGKTELQMLAFKSSKIRLLRSMAIENETMQVFDFAGFMEPEYDTPIFCANFFTSTNVNIVVLDLNPLHQLTDQTDYQDKYYNKIMSIYHKYAETFPWGGKLTGESIKFFSPLVMWTRFSSSKEKHKALFSAFLEYYQAWLEMTIQVREEMEPSHVRANCEAQHKYLTWRAQKDPGHGLLKRLVGEAKAKELLRDFLFNGVDELGTKTFIDYFPEYQTEDGTVSDKRSIIGKSYETRPWDLTGQFIG

SEQ ID NO: 26446 - protein, 148 aa, Triticum aestivum
MGRRPARCYRQIKGKPYPKSRYCRGVPDPKIRIYDVGMKKKGVDEFPFCVHLVSWEKENVSSEALEAARIACNKYMVKSAGKDAFHLRIRVHPFHVLRINKMLSCAGADRLQTGMRGAFGKALGTCARVAIGQVLLSVRCKDNHGAHA

SEQ ID NO: 26447 - protein, 433 aa, Unknown
  symbiont bacterium of Paederus fuscipes
MNQKFRLCIIGGGPLGIGLGRELSEGAIDYDLYEAESDLGGVWNREGKCGRVYPSLHLISPKFNTQVPDYPMPDHYPVYPNHKMMLAYMRSYARDFGVYEHAIFNTSVTRLEPDGEGWEVELSSGERKRYEVVAVCNGAQRVARFPDPPHPGTFQGKVLHSMDYKSPDLVRDKRVLVVGAGNSGCDIAVDASHHAEQVYHSTRRGYHYFPKFIDGKPTPQWMLQLGNKFETKEQTLAYMQQVFKVAGFDGMDYGLKKPDHPLDGAHPIMNSQILYHIGHGDILPKDNIEYFEGNTVFFIDGTKADVDLIIYATGYDRDFPFIDHALLEWKDGLPDLFIHIVPRNLDNIFFFGFVNAAAGLGDGLRLQGQFVRSYVRALQQKSKGYFKFIQTKQNDNPDLGQDYFLDSHRHRWEVDFWKFIKCARRYREMLDEI

SEQ ID NO: 26448 - protein, 52 aa, Geobacter metallireducens
MQSWRCTICQYIYDPAAGDPENGIAPGTPFEDLPDSWVCPLCGAGKEMFEEV

SEQ ID NO: 26449 - protein, 543 aa, Rhodopseudomonas palustris
MPTLATALLDALKDHGAREIFGIPGDFVLPFFKVIEESGTLPYFTMSHEPAVGFAADAASRYRGSIGVAVVTYGAGAFNLVNSIAGAYAERSPVVVIAGAPGARERTSGYLLHHQVRTVDSQLAVFKEVTCDQAVLSDPATAPAEIARVLRSALELSLPVYIEFPRDMVDAKVDPVPKLPRREADIGARDECAEEILDRIARAKSPVMVVDVEIRRYGVEQQVAALARKLGLPVVTTFMGRGLLEGDDDVVAGTYLGAAGDPDLSALVEGADLVLMFGVILSDTNFALSSNMTDPRRTVLATGREVQIGHHVYRDLPLADLIAGLDAHASQHPPRPRNVGKGMAYPRGLTLDASPIAPSDIATAINDLFDRHGKMPMTADIGDCLFTAMEIDNTALAAPGYYAGMGFGVPAGVGVAATGLRPLVLVGDGAFQMTGWELGNCKRYGLDPIVVLFNNCSWEMLRVFQPESKFNDLDDWHFADIAHSIGGFGERVTTRAELAAALQRAVERRGVFSLIEVMLPRGVTSHTLARFVTGFKAARERMK

SEQ ID NO: 26450 - protein, 340 aa, Musa acuminata
MATKASLSIKGFALLVSVLVAVPTRVQSIGVCYGMLGNNLPPPSEVVSLYKSNNIARMRLYDPNQAALQALRNSNIQVLLDVPRSDVQSLASNPSAAGDWIRRNVVAYWPSVSFRYIAVGNELIPGSDLAQYILPAMRNIYNALSSAGLQNQIKVSTAVDTGVLGTSYPPSAGAFSSAAQAYLSPIVQFLASNGAPLLVNVYPYFSYTGNPGQISLPYALFTASGVVVQDGRFSYQNLFDAIVDAVFAALERVGGANVAVVVSESGWPSAGGGAEASTSNARTYNQNLIRHVGGGTPRRPGKEIEAYIFEMFNENQKAGGIEQNFGLFYPNKQPVYQISF

SEQ ID NO: 26451 - protein, 335 aa, Mycoplasma mobile
MNKTNKISIIGSGAMATAMAKVLYDSGNTNIFIYGIDEKELEDLKIGKNAKYFSTDIKLPSFNTTKDLKIALDKTDYIVLAIPSIFIQATFLEILKLLNSKVLVISVSKGFYPNSFLSIHEGLSKDSKSNEFVRGVVTVTGPSFAEEIIKEQLTTICAVDSNIKNAQEVQKLFSNKYFKLYVQSDVIGAEVGASFKNVLAIFSGIANQQGYGINTLASILSRGLKEMKLYNDKVGGKLSTLLGLTGVGDLILTATSPLSRNFSFGKEFVINKSKALETVKTVEGLKALENIYRSNKKYGLDLPIISSLYELIFENISLEEFKEKIWNRTLKSEFE

SEQ ID NO: 26452 - protein, 865 aa, Anaerobranca gottschalkii [sequence omitted]

SEQ ID NO: 26453 - protein, 376 aa, Desulfovibrio vulgaris
MSQRDYYEVLGVARDASEDDIKRAYRKLALQYHPDRNPDDPEAEQKFKEAAEAYDVLRDGEKRARYDRFGHAGVGNGGGFGQGFSSNEDIFAHFSDIFGDLFGFAGAAGGRSRGPRPQAGSDLRYNLTISFRQAAKGDEVTLRLPKSVPCDECGGSGAAPGTRPETCRHCGGAGQIRQSQGFFQIAMPCPVCRGEGTVITSPCPKCKGSGQTQQVKELSVRIPAGVDTGNRLRLRGEGEPGIHGGPAGDLYVVISVEDDKTFRRQGQDLVVTREISFVQASLGDRIDVPTLDDDITLDIPAGTQSGEVFRLVDKGLPYLGHGHTGDLLVEIRVVTPTRLTKKQEELLREFALLDEEKPLEKVKKMARKIGKAMGMD

SEQ ID NO: 26454 - protein, 158 aa, Saccharomyces cerevisiae [sequence omitted]

SEQ ID NO: 26455 - protein, 836 aa, Geobacter metallireducens
MKAVIMAGGFGTRIQPLTSSIPKPMIPLLNRPIMLHIVELLKKYEITDLVMLLYHQPAVIKNFFRDGTDFGVKITYVTPLQDMGTAGAVKCAEKFLDERFLVISGDLLTDFNLQKIIDSHEDNKALATITLTSVKDPLQFGVVITDKEKRITQFLEKPGWGEVISDTINTGIYVFEPEIFAHIPEEENYDFSQDLFPKLLEQQKPLFGYTAKGYWRDIGNTDSYREAHHDIFKGKVNVKIDEAKQDLVGKDLRLGSDVNLDEHVTLEGTVVVGDNSQVFESAHIKDTVIGRNCTIEPGVRLNRCVIWDNVYVKKGAKLNDGVLCSNVRVGHGVVMEEGVIVADDTSIGEEAYIKRDVKIWPRKVIEAGATVTGNLIWGEKWKKSLFEGAMVKGLTNMELTPEFVAKLGCAYGTMLPKGSHIISGRDSYRSCRMLKRSFIGGLLSAGINVRDLTMVPMPVLRYKLRTFGEVGGIYFRQAIDDPASTEIVFLDGDGLDFSSSMGKNVERIFFKENFRRAHHTEPGALSEIPQQVTDFYREGFLHTIGKSPLQKKQFKVVIDFNHSSASQLLPGILTQMGCEVISLNAYVDEERGIQAVAERQQSLAQLSKIVATLEASAGFWLDPGTEGVIVVDETGKVYEGAELLPLMVGLALRSGEKGLFAVPVSAPSAIERMVQERGSAVTRTKSADRAMIEATLSSEVVLAGTMDGRFAFPKFQSAFDGMFAIAKTIELVAKGGLSISRVAAEIPQRVFLQTRVPCVWDMKGGIMRKMSEDSLDKEASFIDGIKVHFGEDWALVLPDQYLPYVHIVAEARDAKTAQKLLDEYKKKVEGWKRELQ

SEQ ID NO: 26456 - protein, 207 aa, Desulfovibrio desulfuricans
MKKYRDHYFLKAKRENYPARSVYKLKEIDKRFGILKQGMRVLDLGAAPGSWSLGAAEKIGPSGRVLAADIQTTETVFPPNVTFMQEDVFERSAEFEQALSETGPFDVVISDMAPKTTGHKFTDQARSSNLCFEALAVASLHLVEGGSFVVKIFMGPDVEAYVKQMRTLFTAVKSFKPKSSRSESKETFYIGLGFKGLPEFSEQEGED

SEQ ID NO: 26457 - protein, 170 aa, Magnaporthe grisea
MLMPKADRKAIHEYLFREGVLVAAKDYNLAEHPDIPNVKNLFVIKACQSLNSRGLIKTRFSWQYYYYTLTPEGLDYLREWLHLPAEIVPATHIKQQRSHAPPRGMMGGEGERERRPFGRGRGGDRGDRGDREGGYRRRDAGEGKEGGAPGEFQPQFRGGFGRGRGGAPPS

SEQ ID NO: 26458 - protein, 324 aa, Aquifex aeolicus
MHEIFYTGCGKVGNTLATHLDRKGHEVLLYDINEEVVKKINEGIHPYVEGIRFKNVKATTDLNQINEFKNLICALPVQVIPKVITKVNLKGKNFISASKGIIHENLKRISQLVKEIEPKLKFFVLSGPSFAEEVSKGLPTAIVLAYEDKEEAMKLQDALDSENFNVYLNDDITGVELGGALKNVIAIAVGLSDGMGYGYNARSAIITRGLHEMANVGEKFGARRETFFGLSGAGDLILTSTSDLSRNRTFGKLLGQGYSVEEALKKINQTVEGVKTAEALYEIIKRENIFAPICEGVYRIIKGEDPKKVYPHFLSNHLREEFQR

SEQ ID NO: 26459 - protein, 139 aa, Zea mays
  misc_feature (47)..(47): Xaa can be any naturally occurring amino acid
  misc_feature (59)..(59): Xaa can be any naturally occurring amino acid
  misc_feature (72)..(72): Xaa can be any naturally occurring amino acid
  misc_feature (103)..(103): Xaa can be any naturally occurring amino acid
MVTSTTAAAVLSPPCVDELRLVPSPRERVEFRAERPQRSPLQGLELXPSLAISLSTGVXFFLGRFIFFNFHXENEVNHENDQNENTDFDVVYKRNKEFSSLLXHNDLGSFNIAYVLGWGSLFHIVVYDMLVTSSIDTSP

SEQ ID NO: 26460 - protein, 98 aa, Synechococcus sp.
ASYKVTLVNESEGLNKTIEVPDDQYILDAAEEQGIDLPYSCRAGACSTCAGKLTSGTVDQSDQSFLDDDQIEAGFVLTCVAYPTSDCTIKTHTEEELY

SEQ ID NO: 26461 - protein, 849 aa, Brassica oleracea
MKGVRNIYHHSYSSFLLVFVVTILFHPALSIYINTLSSTESLTISSNRTLVSPGDVFELGFFETNSRWYLGMWYKKLPYRTYIWVANRDNPLSNSTGTLKISGSNLVILGHSNKSVWSTNLTRGNERSPVVAELLANGNFVMRDSNNNDASKFSWQSFDYPTDTLLPEMKLGYNLKKGLNRFLVSWRSSDDPSSGDYSYKLEPRRLPEFYLLQGDVREHRSGPWNGIRFSGILEDQKLSYMVYNFTENSEEVAYTFRMTNNSFYSRLTLSSTGYFERLTWAPSSVIWNVFWSSPANPQCDMYRMCGPYSYCDVNTSPSCNCIQGFDPRNLQQWALRISLRGCKRRTLLSCNGDGFTRMKNMKLPETTMAIVDRSIGLKECEKRCLSDCNCTAFANADIRNGGTGCVIWTGNLADMRNYVADGQDLYVRLAVADLVKKSNANGKIISLIVGVSVLLLLIMFCLWKRKQNREKSSAASIANRQRNQNLPMNGIVLSSKRQLSGENKIEELELPLIELEAIVKATENFSNSNKIGQGGFGIVYKGILLDGQEIAVKRLSKTSVQGVDEFMNEVTLIARLQHVNLVQILGCCIDADEKMLIYEYLENLSLDSYLFGKTRRSKLNWKERFDITNGVARGLLYLHQDSRFRIIHRDLKVSNILLDRNMVPKISDFGMARIFARDETEANTMKVVGTYGYMSPEYAMGGIFSEKSDVFSFGVMVLEIITGKRNRGFYEDNLLSYAWRNWKGGRALEIVDPVIVNSFSPLSSTFQLQEVLKCIQIGLLCVQELAENRPTMSSVVWMLGNEATEIPQPKSPGCVKRSPYELDPSSSRQRDDDESWTVNQYTCSVIDAR

SEQ ID NO: 26462 - protein, 338 aa, Streptococcus agalactiae
MTKQKIAVLGPGSWGTALAQVLNDNGHEVRLWGNVVEQIEEINTNHTNQRYFKDITLDSKIKAYTNLEEAINNVDSILFVVPTKVTRLVAKQVANLLKHKVVLMHASKGLEPGTHERLSTILEEEISEQYRSDIVVVSGPSHAEEAIVRDITLITAASKDIEAAKYVQKLFSNHYFRLYTNTDVVGVETAGALKNIIAVGAGALHGLGYGDNAKAAIITRGLAEITRLGVQLGADPLTFSGLSGVGDLIVTGTSVHSRNWRAGDALGRGEKLEDIEKNMGMVIEGISTTKVAYEIAQNLNVYMPITEAIYKSIYEGANIKDSILDMMSNEFRSENEWH

SEQ ID NO: 26463 - protein, 151 aa, Triticum aestivum
  misc_feature (49)..(49): Xaa can be any naturally occurring amino acid
MAGMGEMSMRPRPGPPMHRGPPPMARPRPEPIDREKTCPLLLRVFTKVXGGHHLNEEFSERGKEPKDEVQIYTWKDATLRELTDLVKEVALPARKRNARLSFAFVYPDKNGRFVVKQVGSTFSYGHGRGDDAKSLGDLGFQIGDYLSVSIM

SEQ ID NO: 26464 - protein, 282 aa, Unknown
  Rhodococcus sp. RHA1
MTALPDDRMLPTGYRVVSRSVETRDSVTVTLAPAAPPAMPLAQFTPGQFMMLYAHGVGEVAISVSGDPSATDGTLVHTIRNVGAVSRALHDAPRGTIIGVRGPFGRGWTMPTGPDRDLVIVAGGVGLAPLRPVVLAALAARDKFRRLVLVVGARTPADILYRAELGTWQARTDLTVEVTIDQPIAGWTGGVGFVTESLHRVDLDPGRTTALLCGPEPMMRFCARALTDRRVRPDDIQVSVERNMQCGIGACGHCQLGELLLCRDGPVVDYATAEPLLRVPEL

SEQ ID NO: 26465 - protein, 374 aa, Triticum aestivum
  misc_feature (199)..(199): Xaa can be any naturally occurring amino acid
MAAPEAPTCYVGIARQSAAFRLMKQMGWEEGEGLGKDKQGIKGHVRVKQKQDTLGVGVDNPQNKWAYDTTQFDDILKKLKVQSTTPVKEIEDVSSSPDSTPKKDKPAKDEVAKVTRPQGRYKKRERGKSVRGYSAVDLEGILVRKKENDCEVDQEVQPSCMEEPDITIGQGAVSQAEDVNWWGHKFGYVSGGFLGAKSXRIKKIISNVRQMFGEDDQENLYNLVQDKATSGKQGLGIKDLPMKVGGQRWKGNKTSLGDSDEENSTQSELSEVEEDEDEEVSASDAKVNEVHVKTIKEVCVDAKPKTKFKKLCKKILRQAPSQSMKLKELKEAVEEQSTILSDFSCRREALSFLKRKLQGSKKFNLEGKRVHLVS

SEQ ID NO: 26466 - protein, 376 aa, Unknown
  Frankia sp. CcI3
MPEIHIKNQKPRLEPPADPVPKELAASWYVALASGELRGQPKAFQLFGRDVVAWREASGRPAVAGRYCPHQGASLALGAVVDGCLRCPFHGWRFDSSGACVEVPRSQRIPTTARLDSYPTIERFGYIWVWYGTRTPLFELPGFPALEEEQEHYLGFRYTDWTAGHPRQLLENAFDYFHFQTLHSLPLDRAEFRVLSDPEQAADNGPPIDREAYLGGWMEGVVTPGHPLRRPRHWLVAAGATFFTGDAFQLLIDGWPGGQRYTGYVGGREIFKYLMGITPTANGSTIQHAWTGVRRSDRRWRTWLNVAMLIGQSRAGTLQDMPIYDYTQAHVGTARMFYDTNLIRFRRYYRSWVDRVAEGQGEPQPAMARIPGAGAS

SEQ ID NO: 26467 - protein, 299 aa, Vibrio cholerae
MPATDQLRIKIMAQDAVTPLRKTPRLAVVEGSGYVRAARSQLQAGEVALVGAGPGDPELLTVKALSYLQQADVVLYDYLVSDEIMALIPSETILVCVGKRAGHHSVPQEKTNQLLVDFARQGYRVVRIKGGDPFMFGRGGEELEVLFEAGVKFQVVPGITAAAGATAYAGIPLTHRDYAQSALFVTGHLKAQAEDLDWSTLARGKQTLVIYMGLSNAAAIAEQLQLHGRQASTPVAIIERGTQVNQQVLIGTLQTLPSLASQAQSPALIVVGEVVALAAKLHWFGEQGATQQLDAAQSA

SEQ ID NO: 26468 - protein, 356 aa, Unknown
  Frankia sp. CcI3
MTGSIVTGDLVTAETEPPQPGLAAGWYIALPSEELGKRRGQPLTLFGRELVAWRDGTGRPVIMRRHCPHLGASLAFGKVVDGTLRCPFHHWHFDAAGACTHVPGTDRLPRRVARRSYPTDERYGYVWVWYGNPEPSYPVPAVPALAEGREAYLGYQFSHVTTASPRRVLENAFDCAHFGTLHRVRSGGGLKINILTEPSATAENGPPIGGDASIAAAMETDILDLPPTVRALGIRARKFTLLIDGWPGGQRLTFLLDGHVLAKELLGITPTSDGRTVLQGWSLIRRTGNRALDHLIRLAYRAQHEWGTREDLRIYRHASDVDGTVPVTADHGVLKFRKHYQRWVDAALPDDRACMS

SEQ ID NO: 26469 - protein, 307 aa, Geobacillus kaustophilus
MRVAKSIHELIGHTPVVEITRFPLPEGVRLFAKLEYFNPGGSIKDRLGQELLREAFASGKLKEGGTIIEPTAGNTGIGLALAAIGKNVNIIFCVPEKFSIEKQQLMKALGAQIVHTPTEEGMEGAIRKAEELARTIPGAYCPQQFQNPANPRTYYKTLGPELWDDLDGQIDIFVAGAGSGGTFMGTATFLKEKNPAIKTVIVEPEGSILGGGKPGPHRTEGIGMEFLPPFMDPDYFDAIYTIADDDAFRRVSELARQEGLLVGSSSGAAFHAALMEAEKAKPGTNIVVIFPDGSERYLSKHIYEGGR

SEQ ID NO: 26470 - protein, 294 aa, Saccharomyces cerevisiae
TTPLVHVASVEKGRSYEDFQKVYNAIALKLREDDEYDNYIGYGPVLVRLAWHTSGTWDKHDNTGGSYGGTYRFKKEFNDPSNAGLQNGFKFLEPIHKEFPWISSGDLFSLGGVTAVQEMQGPKIPWRCGRVDTPEDTTPDNGRLPDADKDADYVRTFFQRLNMNDREVVALMGAHTLGKTHLKNSGYEGPWTANPNVFDNSFYLNLLNEDWKLEKNDANNEQWDSKSGYMMLPTDYSLIQDPKYLSIVKEYANDQDKFFKDFSKAFEKLLENGITFPKDAPSPFIFKTLEEQGL

SEQ ID NO: 26471 - protein, 85 aa, Panicum bulbosum
ECQKVGAPPEVSARLTAMTQELEARQRTALSGLGAATEPELDQFMEAYHEMLVKFREELTRPLQEAMEFMRRVESQLNSLSISGR

SEQ ID NO: 26472 - protein, 395 aa, Saccharomyces cerevisiae
MSEGITDIEESQIQTNYDKVVYKFDDMELDENLLRGVFGYGFEEPSAIQQRAIMPIIEGHDVLAQAQSGTGKTGTFSIAALQRIDTSVKAPQALMLAPTRELALQIQKVVMALAFHMDIKVHACIGGTSFVEDAEGLRDAQIVVGTPGRVFDNIQRRRFRTDKIKMFILDEADEMLSSGFKEQIYQIFTLLPPTTQVVLLSATMPNDVLEVTTKFMRNPVRILVKKDELTLEGIKQFYVNVEEEEYKYECLTDLYDSISVTQAVIFCNTRRKVEELTTKLRNDKFTVSAIYSDLPQQERDTIMKEFRSGSSRILISTDLLARGIDVQQVSLVINYDLPANKENYIHRIGRGGRFGRKGVAINFVTNEDVGAMRELEKFYSTQIEELPSDIATLLN

SEQ ID NO: 26473 - protein, 85 aa, Setaria poiretiana
ECQKVGAPPEVSARLTAMAQELEARQRTALSGLGAATEPELDQFMEAHHEMLVKFREELTRPLQEAMEFMRRVESQLNSLSISGR

SEQ ID NO: 26474 - protein, 142 aa, Unknown
  Silicibacter sp. TM1040
MPLKYLHTMVRVKDLEKSMAFYALLGLKETRRYDSEAGRFSLIFMAPPGQEEAPVELTWNWDGDDELPSDSRHFGHLAYEVDNIYETCQHLMDNGVVINRPPRDGRMAFVRSPDNISIELLQAGDALPPAEPWSSMENTGHW

SEQ ID NO: 26475 - protein, 340 aa, Solanum tuberosum
MEVISTHTNGSTITITTNGHHNNGKSDHRNGGTIHDNGNKLLLGNSNSIKPGWFSEFSALWPGEAFSVKIEKLLFQGKSDYQDVMLFESATYGKVLTLDGAIQHTENGGFPYTEMIVHLPLGSIPTPKKVLIIGGGIGFTLFEVLRYSTIEKIDIVEIDDVVVDVSRKFFPYLAANFNDPRVTLVLGDGAAFVKAAQAGYYDAIIVDSSDPIGPAKDLFERPFFEAVAKALRPGGVICTQAESIWLHMHIIKQIIANCRLVFKGSVNYAWTTVPTYPTGVIGYMLCSTEGPEVDFKNPVNPIDKDTTHVKSKLEPLKFYNTDIHKAAFILPSFARSLIES

SEQ ID NO: 26476 - protein, 555 aa, Desulfovibrio desulfuricans
MNLTEALLHALKERGAKEVYGIPGDFALPYFKIIESTGILPLVTLSHEPAVGFAADASARFRGGLGVAAVTYGAGALNMVNAIAQAYAEKSPVVVISGAPGTHEGGHGLLLHHQAKHLDSQYRMYKEVTCDQAVLDDPATAPETIARVLQSCIEHSRPVYLEIPRDLPAAPCAPVPAFAASGTDADAVDACARDVLQRVQSAALPMMMVGVEVRRYGIEDKVALLAERLGVPVVTSFMGRGLLASASCLEGTYLGMAGDETLSEAVESSDGLLLLGVIMSDTNFGVSGSQLDRRRVMHAEDRQVRVGYHVYHDIPLGALVDRLLALLDDGQEADMALSGCGGSSDDRALQGAGLAVNPRGFMADAADITPTDIAALLNDFFASHGAMPVASDIGDCLFTMLSVDAIPMVAPGYYASMGFGVPAGMGLQITTKERSLILVGDGAFQMTGMELGNCTRLGIDPIVLVFNNSSWEMLHVFQPETAYSNLGEWDFAAVADGLGGRGHRAATRAELARALTQAHAERGRFQLIDARLAPHSLSPTLARFVEGVRRFSSGQ

SEQ ID NO: 26477 - protein, 120 aa, Debaryomyces hansenii
MLIPTEDRKKIHQYLFQEGVVVAKKDFDAPKHDEIDTKNLFVIKALQSLTSKGFVKTQFSWQYYYYTLTDEGVEFLRNELNIPEGILPLTRLKGAPAERPQRASRGPRRDGDSYRRRARD

SEQ ID NO: 26478 - protein, 451 aa, Gibberella zeae
MSHLPHEPEFEQAYGELASALENSSLFNEHPEYRTALAVAAIPERVIQFRIVWEDDKGNLQVNRGYRVQFNSALGPYKGGLRFHPSVNLSILKFLGFEQIFKNALTGLSMGGGKGGADFDPKGKSDAEIRRFCQSFMTELSKHIGAETDVPAGDIGVGGREIGYLFGAYRKLRNRWEGVLTGKGLSWGGSLIRPEATGYGLVYYVDYMLKHANRGSFEGKRVALSGSGNVAQYAALKIIELGGSVVSLSDSKGALVAKEGSSFTPEQIHNIAALKIKHQSLTAFEHQDKFTWIEGARPWVHVGKVDIALPSATQNEVSKEEAQALLEAGAFIVAEGSNMGCTADAIDVFEAHRKENGAQALWYAPGKASNCGGVAVSGLEMAQNSQRIQWSEKEVDDRLKAIMKDAFVAGLETAQKYVEAKEGELPSLVAGSNIAGFIKVAEAMHNQGDWY

SEQ ID NO: 26479 - protein, 763 aa, Methanosarcina barkeri
MTDSKTTIKLKVAEADQRDVGKGIVRIGESFREKLGLEPFDVIEIKGGKSTSALIGRPYPSDSGLEIIRMDGFIRTNAKTSIGEYVAICKADWKEAKSVIFAPVARGMQIYAPSETLKAVFMNRTVSKGDFISTTSLRKSRESETFGKGVMFEDFFQDFFGQGFEPSFGLGEIKLQVVSTSPSGIVKITDLTQVELLSEATEVIPEQNIPTVMYEDLGGLKEAIGKVREMIELPLNHPELFDRLGIDAPKGVLLHGPPGTGKTLLAKAVANESDAYFISINGPEIMSKYYGESERAIREIFEDAEKNAPAIIFLDEIDSIAPKRAEVTGEVERRVVAQLLSLMDGLKARKNVIVIGSTNRPEALDVALRRPGRFDREIELRVPDTDGRLEIFQIHTRGMPLAENVNLMDFAQITYGFVGADIAALCREAAMSALRRVLPKINLNEPEIPAEILDSLQVIREDFENALKDVQPSAIREILIEVPTVGWDDVGGLEEVKRLLKEVVEWPLKNPESYRDIGVEAPKGVLLYGPPGTGKTLLAKAIAHESDANFITAKGSDLLSKWYGESEKRIAEVFTRARQVAPSIIFLDELDSLAPIRGASISEPQVTARILNQLLSEMDGLEELRAVVVIGATNRPDVIDPALIRPGRFDELILVPIPDEGARREIFKVHTEKMELAEDIDIEKLVSITDQYTGADIAAVCKKAGRLALREDIHAKNVKQRHFLKAITETGPSVTPDTMKYYEAIKGELRTRKSKEIENPSYI

SEQ ID NO: 26480 - protein, 373 aa, Unknown
  Dehalococcoides sp. CBDB1
MNENCYKRVVIKLGTSLLTGGTGKLDHERMADLCRQIAELTRLGTEIVIVSSGAIAAGRSKMGIRHIPKDVPFKQVLAAIGQSQLMNYYDQLFSPHGLTVAQGLLTKSDLSDRSGYLNARNTLLALMELGIITIVNENDVVAIDEIQQAKFGDNDNLSAMVANLIEADLLLILTNIRGLYTSDPTLHPEATLITEVKEITEELEQLAAGSSNKLGTGGMVTKLEAARLATSSGVTAIIADGHIPDIILKLANGENEGTRFIPSLHKPDSRQRWMMSGLCTRGSICVDDGAAKALRENQKSLLAAGVQQAEGKFGRGDIVKLTDSHGKRLGYGITNYSSDDISKIKGLHSQELNAVLGGNQGPEVIHRNNLVVI

SEQ ID NO: 26481 - protein, 642 aa, Zea mays
MMGGGLLVDQSVVFPGVHNFVDLLQQNGDKNLGFGSLMPQTSSGDQCVMGEGDLVDPPPDSFPDAGEDDSDDDVEDIEELERRMWRDRMKLKRLRELQQTRGKDSLASGAGLADGSSKPRQSQEQARRKKMSRAQDGILKYMLKMMEVCRAQGFVYGIIPEKGKPVSGASDNLRAWWKEKVRFDRNGPAAIAKYQADNAVPGAENELASGAASPHSLQELQDTTLGSLLSALMQHCEPPQRRYPLEKGVPPPWWPTGDEEWWPELGIPKDQGPPPYKKPHDLKKAWKVSVLTAVIKHMSPDIEKIRRLVRQSKCLQDKMTAKEISTWLAVVKQEEELYQKLNPGARPPASTGGIASAISFNTSSSEYDVDIIDECKGDEAGNQRTAVTDPTAFNLGAAILSDKFLVPTPMKEETADVEFIQKRNAPAAAEPELMLNNRLYTCNNVQCPRSDYSYGFLDRNARNSHQYTCKHKDPTPQSTENKPPSAPPQPQAFQPAFSQPNQALNSLDFSLPMDGQRSIAELMNMYDNNFVPNKNPSSDSVAVMERPNAMPQQRIQMDEGFFVQGNGAFDDVNNSMMQQQQQQAPVQQQQQFFIRDDTPFVSQMGDIAASAPEFRFGPGFNMSSGVDYPGAAQRNDGTNWFY

SEQ ID NO: 26482 - protein, 317 aa, Unknown
  Synechocystis sp. PCC 6803
MSFANADTPPQVVVLGAGAWGSSLAYVLNNNDIPTQVWSRRSPQSLESMVAGADVIVSAVSIKGVPSVAARLEAMDLQRRTILVTATKGLDPETMTTPSQIWQAALPSQPIAVLSGPNLSKEIDQGLPAATVVASSDQAAAEEIQTIFAADNFRVYTNNDPLGTELGGTLKNVMAIAVGVCEGLGLGTNAKSALITRALPEITRVGLHFGAQPDTFWGLAGLGDLLATCSSMLSRNYRVGYGLSKGQSLEEILANLGGTAEGVNTTDVLIKIANREKIAVPITRQVYRLLHGKITPPQAVEALMERELKAEFEDFDL

SEQ ID NO: 26483 - protein, 424 aa, Zea mays
  misc_feature (379)..(379): Xaa can be any naturally occurring amino acid
MALAVRTPRFQPRPASISAPTTPASTSLAAGNARPRPCAGAAVRASPFTEATSSSRYRRDAWSYAADGSSNSASPSSAAAAAAGRRDDEIALQLPELRRLLDVLRASRGRGAEEGGGPGEVALVGTGPGDPELLTLKAVRAIEAADLVLYDRLVSNDVLDLVGEGARLLYVGKTAGYHSRTQEEIHELLLSFAEAGANVVRLKGGDPLVFGRGGEEMDFLQQQGIKVEVIPGITSASGIAAELGIPLTHRGVATSVRFLTGHSRNGGTDPLYVAGNAADPDTTLVVYMGLSTLPSLAPKLMKHGLPPDTPAVAVERGTTPQQRTVFASLKDLVDEVKSADLVSPTLIIIGKVVSLSPFWVESSEHDALKVQSSYANEAXDDNRFSWFLVTGQYLRNARSQIWEHRFDLVYTETSQEAWILNGGW

SEQ ID NO: 26484 - protein, 147 aa, Sesbania rostrata
GFTDKQEALVNASYEAFKKNLPGHSVLFYSFILEKEPAAKGLFSFLKDSDGVPQNNPSLQAHAEKVFGLVHDAAAQLRATGVVVLADASLGSVHVQKGVTDPHFVVVKEALLKTLKEAAGATWSDEVSIAWEVAYDGLAAAIKKAMS

SEQ ID NO: 26485 - protein, 170 aa, Triticum aestivum
  misc_feature (126)..(126): Xaa can be any naturally occurring amino acid
  misc_feature (145)..(145): Xaa can be any naturally occurring amino acid
MAFSEAQEELVLRSWKAMKPDSESIALKFFLRIFEIAPAAKPMFPFLRDAGEDAPLESHPKLKAHAVTVFVMACESATQLRKTGDVKVREATLRRLGATHVRAGVADAHFEVVKTALLDTIEGAVXPEMWTLEMNAAWEEAYDQXLAAAIKEEMKLAAAGLMWHAWSLLS

SEQ ID NO: 26486 - protein, 1646 aa, Aspergillus nidulans
MLGRCGRQASRLLPRPVTARPPSLQWQRMVSSSRDGQQSLLTAPLEQADPSVYNILQKEKKRQQHFINLIPSENFTSQAVLDALGSVMQNKYSEGYPGARYYGGNEHIDEAERLCQQRALETFRLSPEEWGVNVQPLSGSPANLYAISALLNTHDRLMGLDLPHGGHLSHGYQTPTKKISFISKYFETLPYRLDESTGLIDYESLEKQALLYRPKLIIAGTSAYSRLIDYPRMRQIADNAGAYLMSDMAHISGLVAAGVIPSPFAHSDVVTTTTHKSLRGPRGAMIFYRKGIRRTDKKGNQEMYDLEGPINASVFPGHQGGPHNHTITALAVALQQAQSTEFKTYQETVLANAKSLAERLGGSTSSGGLGYNIVSGGTDNHLVLVDLKNRGVDGARVERVLELCGVASNKNTVPGDRSALKPGGLRLGTPAMTTRGFQPEDFRRVADIVDRAVTITQKLDKSAKESAASKGVKNPNTVKAFLEYVGNGEEISEIVQLRQEVEDWAVNPNGVFYIQLSYKQPMPRPDSYLGNNARQSRLDSNSRLLQIPPQSHRVSFSTLQQHPFSQYISLSSTKMKVSQIYVYPIKSLRGVPLSSAQVTRTGFEYDRRFMLLKVIPSESEDAKGEKTLKNMHIPHFPEMSLFQTELLEPGSGDNARIRVTYHPSDSESAGQVNGTGYGKEEEALHIPLNPDTRGLEQLAVVMHRSPTKGYNMGPKYNEWFSERFGYDVVLAYLGDGNGRAVLGTFAPGKHVAHKDQRQGMNLGYVAALLAVIGVLYIALTVLTPSPPGFAFVAAGFLGRRDRVGVMVAVAALLPAFLVLKRQSTKDERITFADTAPYMVVSETSVANVTDRLEGEEMDMRKFRANIVVSGAKTAFEEDFWAELVIGDAQVRLLLTANCVRCRSLDVDYETGKMGTGESGKVLKKLMADRRVDTGAKYSPVFGRYAFLEGQSDLKMVRVGDEVIVARNMKERAIYVKVRHKISHQLRHKLRLCKKSWLHHLNFVSPPHACSLLLSLNPGLIFTLCCARLGIAMDQVRRKDTTKGPPLRILSLDGGGVRGYSMLILLQELMHRIYVEIEGKPPRRDQIPKPCDYFDLIAGTGTGGLIALMLGRLRLDLETCKDVYVRMTRRVFETDKTFAGIPFRSTLFKASKLEEAIRECVREHTIYETEGNDSTSPTSPTYAPFSPNFSTTSIPQRSGSRASQSTTHSSINNRSSAFINGLRWGNPDALLYDNRENRTKTAVTAVYRGTPKNGNSVLLRSYDSRKEPAPEQHCTIWQAGRATSATGLAFKPIQIGQHYFIDEGAGTYNPAPEVLDEAAVNEWPGREIGVFISVGTGKRPPDTNNRQHEWWEDFFGDALGTFAEARRRLIAKIEGCEDIHHAMLREHLPKRGVNKDNYYRLNVEVGVGEFGMNEWHRLADISTNTRRYLSRPDVKKMIHDASVKFAKIERMHRRLEAHTAAGHDPVNSSLTEDDHSSLAPSPRLSVTSPTSQTGPPPPPANTFELPAELPGDFTPYQPNDDKLPMHPTPQDAIRPPPGRTSGSDLHLSSNEPSRPSSQAYSPPRLSFEHTGPPPVPPKTPIPYPDTAELGGNPMPMPNQSLGLHPAHATTAPVSAAGRPAPPYPVDEPPPVVNKLRKPSYQVRDYSV

SEQ ID NO: 26487 - protein, 173 aa, Lolium perenne
MSRSVEPLIVGRVIGEVLDPFNPCVKMVATYNSNKLVFNGHELYPSAVVSKPRVEVQGGDLRSLFTLVMTDPDVPGPSDPYLREHLHWIVSNIPGTTDASFGGEVMSYESPKPNIGIHRFIFVLFKQKRRQTVSVPSFRDHFNTRQFAVDNDLGLPVAAVYFNCQRETAARRR

SEQ ID NO: 26488 - protein, 856 aa, Brassica oleracea
MKGVQNIYHHSYTFSFLLVFLVLILFHPALSIYVNTLSSSESLTISSNRTLVSHGGVFELGFFKPLGRSRWYLGIWYKKVSQKTYAWVANRDSPLSNSIGTLKISGNNLVLLGQSNNTVWSTNLTRENVRSPVIAELLPNGNFVMRYSSNKDSSGFLWQSFDFPTDTLLPEMKLGYDFKTGRNRFLTSWRSYDDPSSGKFTYELDIQRGLPEFILINRFLNQRVVMQRSGPWNGIEFNGIPEVQGLNYMVYNYTENSEEIAYTFHMTNQSIYSRLTVTDYALNRYTRIPPSWGWSMFWSLPTDVCDSLYFCGSYSYCDLNTSPYCNCIRGFVPKNRQRWDLRDGSHGCVRRTQMSCSGDGFLRLNNMKLPDTKTATVDRTTDVKKCEEKCLSDCNCTSFATADVRNGGLGCVFWTGDLVEIRKQAVVGQDLYVRLNAADLASGEKRDRTKKIIGWSIGVTVMLILSVIVFCFWRRRQKQAKADATPIVGNQVLMNEVVLPRKKINFSGEDEVENLELSLEFEAVVTATEHFSDFNKVGKGGFGVVYKGRLVDGQEIAVKRLSEMSAQGTDEFMNEVRLIAKLQHNNLVRLLGCCVYEGEKILIYEYLENLSLDSHLFDETRSCMLNWQMRFDIINGIARGLLYLHQDSRFRIIHRDLKASNVLLDKDMTPKISDFGMARIFGRDETEADTRKVVGTYGYMSPEYAMNGTFSMKSDVFSFGVLLLEIISGKRNKGFCDSDSNLNLLGCVWRNWKEGQGLEIVDRVIIDSSSPTFRPREILRCLQIGLLCVQERVEDRPMMSSVVLMLGSETALIPQPKQPGYCVSQSSLETYSSWSKLRDDENWTVNQITMSIIDAR

SEQ ID NO: 26489 - protein, 139 aa, Arabidopsis thaliana
MGLMRSMLPNAKQIFKSQSMRNKNGSSSPSTTTTTSGLVPKGHVAMAIRLSRVINSKQSQKQQSRVPKGHVAVYVGEEMESKKRFVVPISYLNHPSFQGLLSRAEEEFGFNHPIGGLTIPCREETFVGLLNSYGCIVST

SEQ ID NO: 26490 - protein, 167 aa, Citrus sinensis
MASQSKTSVHDFSVKDAKGQDVDLSIYKGKLLLIVNVASQCGLTNSNYTELSQLYDKYKNQGLEILAFPCNQFGAQEPGDNEQIQEFACTRFKAEFPIFDKVDVNGDNAAPLYKHLKSSKGGLFGDSIKWNFSKFLVDKEGNVVERYAPTTSPLSIEKDIKKLLETA

SEQ ID NO: 26491 - protein, 574 aa, Shewanella oneidensis
MHESQLTTSAAKPSRLGWFDDVLLLGIMAVLAGCGLIYEYLLSHYAGRILGALEAAIYTMIGLMIVSMGLGAFAARKIKDAFTGFVVLELTVALCGSLAILITAAVIGFGQQLPMLIASTLGLPPDQLPEGGMIGTLQKLSEYLPYFWGVLLGLMIGMEIPLIARVRQSLSDEHLLHNAGTIYGADYIGAGIGAAIWVGFMLAIDIQLAAALTASFNLLAGFVFIWRFWQKIQRPKLLLAAHLVVTGVLLLLAIQGPSWEQQFNNLLYKDKVVYAKATRFQQLTFTERLRGNGLSPVYALYINGRLQFSSSDEHIYHAFLVHPTLAASARHNKVLIIGGGDGLGLKQVLRWEPEQVTLLDLDAALVQLFKSPDPDMPERLSQALLSLNGNAFNDPRVTVIHDDAFNGVDKLIAKGDKYDAIIVDLPDPSHPDLNKLYSDYFYRKLKELISNDGALTVQSTSPYHAQKAFISVAKTLALAGFDVKQYHHNVPSFGEWGWSIATLDGKDAQHRLAQLTKLPIADDWLTLGLVKGAFEFPANFYQDATNIKPNELGSLQLYHYHQQAWSETQGLDLF

SEQ ID NO: 26492 - protein, 490 aa, Bradyrhizobium japonicum
MAASSQAPEAKGFRWKLIAPLVVWLAIYLWPVPSGLNVNQWHYFAVFAAVITGLILESMPVGAVGLIGLTVAGVGGYIDPDPTKSLRWMLAGFAESTVWLIVGAFVFSIGYRKSQLGRRIALVLVQKLGSNTLGLGYAVAMSDFLLAPATPSNTARSGGIVYPIISNIPRIYGSEPGPTAGRIGTYVMWTAFAATAVTSSLFFTALAPNAAALAIAKKTVGVEVSWGQWFIGFAPLGILLMILVPLLSYPVCRPEVKRSPEIAEWAAKELSEMGPMSRNEWIMLALIVLAMFLWIAGSSPDINVPLLGSNFVNATTVVFIVISLMLVTGVIEFADIVSEKSAWEVFFYFTSLLTLASGLNEIGFIKWFATEYAKPLAGLSPSTAMILLVALFFWIHYFFSSITSHAAAVLPVVLAVGSGIPGLPVTTLAMLCMYSLGLMGVISPYATGPAPMYFGSGYIGKGQFWGFGLIFGLLYFAGLLLIVLPWLQVR

SEQ ID NO: 26493 - protein, 322 aa, Streptomyces coelicolor
MSDVRNVIIIGSGPAGYTAALYTARRSLKPLVFEGAVTAGGALMNTTEVENFPGFQDGIMGPELMDNMRAQADGFGAELIPDDVVAVDLSGEIKTVTDTAGTVHRAKAVIVTTGSQHRKLGLPNEDALSGRGVSWCATCDGFFFKDQDIAVIGGGDTAMEEATFLSRFAKSVTIVHRRDTLRASKAMQERAFADPKISFVWDSEVAEVQGDQKLAGLKLRNVKTGELSDLPVTGLFIAIGHDPRTELFKGQLDLDPEGYLKVDAPSTRTNLTGVFGAGDVVDHTYRQAITAAGTGCSAAVDAEPFLAALSDEDKAEPEKTAV

SEQ ID NO: 26494 - protein, 93 aa, Pseudotsuga menziesii
SGAHTLGRCHKERSGFEGAWTSNPLIFDNSYFKELLSGEKEGLLQLPSDKALLEDPVFRSYVEKYAADEDAFFADYAEAHLKLSELGFAEGYQ

SEQ ID NO: 26495 - protein, 500 aa, Geobacter metallireducens
MANELVINTSSHETRIALIENGTIAELYIERSREKGIVGNIYKGKVVRVLPGMQAAFVDIGLEKAAFLYVADVFDAMEEFDSFMDRNGEDGEGEQQVLQPLHPIEELLQEGQEILVQVSKEPIGTKGARITSHISLPGRHLVYMPTVDHVGISRRIEEEPERERLKEIVERMKPQNGGFIVRTAAEGKSEEDLVSDMNYLTKLWDEVVKRNDKGHAPSLIHADLDVTQKVIRDILTEDVSRIVVDSKTEHDKIVQFISTFMPKMKYSMELYDDEEPIFDHFGLEVEISRALGRKVWLKSGGYIIIEQTEALTAIDVNTGRFVGKHNLEDTILKTNLEAVKEIAYQLRLRNIGGIIIIDFIDMEKEVNREKVFTALEEAMKADKSKTNILKISELGLVEMTRKRVRESIGRMMCEPCPYCEGRGYVKSKTTVCHEIFRELRREMLDIRGTKATLTVHPQVADLLYDEERRGLEELEKKFKKRITVRAKPGFHQEQFEIAIS

SEQ ID NO: 26496 - protein, 119 aa, Arabidopsis thaliana
MLSCAGADRLQTGMRGAFGKALGTCARVAIGQVLLSVRCKDAHGHHAQEALRRAKFKFPGRQKIIVSRKWGFTKFNRADFTKLRQEKRVVPDGVNAKFLSCHGPLANRQPGSAFLPAHY

SEQ ID NO: 26497 - protein, 307 aa, Saccharomyces cerevisiae
MTSKLKRVAVAQLCSSADLTKNLKVVKELISEAIQKKADVVFLPEASDYLSQNPLHSRYLAQKSPKFIRQLQSSITDLVRDNSRNIDVSIGVHLPPSEQDLLEGNDRVRNVLLYIDHEGKILQEYQKLHLFDVDVPNGPILKESKSVQPGKAIPDIIESPLGKLGSAICYDIRFPEFSLKLRSMGAEILCFPSAFTIKTGEAHWELLGRARAVDTQCYVLMPGQVGMHDLSDPEWEKQSHMSALEKSSRRESWGHSMVIDPWGKIIAHADPSTVGPQLILADLDRELLQEIRNKMPLWNQRRDDLFH

SEQ ID NO: 26498 - protein, 424 aa, Unknown
  Dehalococcoides sp. CBDB1
MEKALLEIEEKARLARAASRPLSYASSAQKDAALKNIARCLLDNEPAILEANLKDQNEAKASGMLPAMLDRLIIDQSRLEGIAKDTFAIAALPDPVGEIFDMNTMPNGLIIGKKRVPLGVIAAIYESRPNVTVDIASLCLKAGNAVILRGGKETIHSNTILAKLIRQAVEQAGLPKEAVQFIENTDRNLVNHLLKLSDQIDLVIPRGGAGLISYVKQNSFIPVVAGGIGVVHVYVDADAKVTDAVNIAYNSKVQRPTVCNAMDTLLVHKDIAPVFLPAVAAEWSKAGVEIRADEAALKILENTFGCKLIPATPDDWGKEFLALIAAVKVVDSLDEALSHIARYGSGHTESIVTQNYTSSQRFLNEVDAAAVMVNASTRFTDGSQFGLGAELGISTQKMHARGPMGLKEITSYKWIVYGSGQIRG

SEQ ID NO: 26499 - protein, 316 aa, Arabidopsis lyrata
SKEVAPDNEFEKRIRPEVIPANEIGVTFADIGSLDETKESLQELVMLPLRRPDLFKGGLLKPCRGILLFGPPGTGKTMMAKAIANEAGASFINVSMSTITSKWFGEDEKNVRALFTLAAKVSPTIIFVDEVDSMLGQRTRVGEHEAMRKIKNEFMTHWDGLMSNAGDRILVLAATNRPFDLDEAIIRRFERRIMVGLPSVESREKILRTLLSKEKTENLDFHELAQMTDGYSGSDLKNFCTTAAYRPVRELIKQECLKDQERKKKEEAEKSSEEGSETKEEVSEERVITLRPLSMEDMKVAKSQVAASFAAEGAGM

SEQ ID NO: 26500 - protein, 462 aa, Mannheimia succiniciproducens
MQTLTILLIRGKLMSSTVSSLEDFLSLVAQRDGNQPEFLQAVREVFTSIWPFLEANPQYRSQALLERLVEPERAFQFRVAWTDDKGQVQVNRAFRVQFSSAIGPYKGGMRFHPSVNLSILKFLGFEQIFKNALTTLPMGGGKGGSDFDPKGKSDAEVMRFCQALVAELYRHIGPDTDVPAGDIGVGGREVGYLAGYMKKLSNQAACVFTGRGLSFGGSLIRPEATGYGLVYFAQAMLAEKGDSFQGKTVSVSGSGNVAQYAIEKALQLGAKVVTCSDSAGYVYDEAGFTTEKLAALLDIKNVKRGRVKDYAEQFGLQYFPGERPWGVKVDIALPCATQNELELTDAQKLIANGVQLVAEGANMPTTIEATEALQAAGVLFAPGKAANAGGVATSGLEMAQSSQRLFWSAEEVDQKLHNIMLDIHANCKKYGTDANGNINYVAGANIAGFVKVADAMLAQGVY

SEQ ID NO: 26501 - protein, 102 aa, Chlamydia trachomatis
MVQVVSQENFADSIASGLVLIDFFAEWCGPCKMLTPVLEALAAELPHVTILKVDIDSSPRPAEQYSVSSIPTLILFKDGKEVERSVGLKDKDSLIKLISKHQ

SEQ ID NO: 26502 - protein, 357 aa, Unknown
  Marinobacter sp. ELB17
MFEKTAAPAQGNASNVPARHDVAVLGGGSFGTAMVKVLAENGHRVHFWMRDQAQADSIRETGRNERYMPGIALAGDIEPTTDLPGAVASAEIVFVAIPSKAFRDVIHQHAGRFRDGQIVVSLTKGIEAQGFKLMSEILQDEIPQCRIGVLSGPNLAAEIVNRDLTATVIASEDPEVRACVQNLLGCEYFRVYANVDMYGVELAGALKNIYAIVAGLGSALEMGENAKAMLITRGMAEMSRFAVSLGANPMTFLGLAGVGDLIVTCTSAKSRNFRIGYAIGKGKPLDEAAAELGQVAEGIYTLKLVREKSEAMGIQMPLVHGLHEILYGNASVKAVISGLMTAAQNSDVEFILPRTIV

SEQ ID NO: 26503 - protein, 305 aa, Oceanobacillus iheyensis
MKKARIIYNPTSGREAIKRALPNILEKLEVAGFETSTHATTCEGDATEAAKIAVERRYDLVIAAGGDGTINEVINGLAEQEHRPQLGIIPAGTTNDFARALHIPRDIDKAVDVIIEGNRMKLDIGRVNDDHYFINIAGGGKLTELTYEVPSKLKTLLGQLAYYIKGIEMLPFLKATRVKIEYDDQVLEDDIMLFLISNTNSVGGFEKLAPDAKLNDGYFDLLILKKTNLAEFIQIATLALRGDHFKSKNIIYTQAKHIKVSNEEKMQLNIDGEYGGLLPGEFLNLRQHIEFYVPKEFIKAQEDLD

SEQ ID NO: 26504 - protein, 466 aa, Bacillus subtilis
MNQQKKQAPVELKVGQTFPLTIKRLGINGEGVGYFKKKVVFVPGALPGEEVVVQATKVQPKFSEGRIKKIRKASEHRVAPPCPVYEQCGGCQLQHLAYSQQLREKRDIVIQSLERHTKFKVENMEIKETIGMDNPWNYRNKSQFQIGRSQSGSIIAGLYGLDSHDIVPIKDCIVQHPATNKTTGIVRRILEDFNVSVYNERKRKGDVRTIVTRVGFETGEVQVVLVTAKETLPHKEEIVKAIQKRLPEVKSIIQNVNGAKTSVIFGEKTKQLAGKTVIQEVLGDVSFELSARAFFQLNPEQTVKLYDEVKKAAQLTGKEKVVDAYCGVGTIGMWVADGAKEVRGMDVIKESIDDAKKNAKKHGMANATYVTGTAEHWLPKWTKEGFRPDVVIVDPPRTGCDSTFLDTIKKVKPKRFVYVSCNPSTLAKDLQTLSKDYRVDYIQPVDMFPQTAHVEAVARLVLKSSN

SEQ ID NO: 26505 - protein, 538 aa, Hordeum vulgare
MAFEVVAAQLARLSDALATSDHASVVSINLFVALLCACIVLGHLLEENRWLNESITALIIGLCTGVVILMTTKGKSSHVLVFSEDLFFIYLLPPIIFNAGFQVKKKQFFRNFMTITLFGAVGTMISFFTISLAAIAIFSKMNIGTLDVSDFLAIGAIFSATDSVCTLQVLNQDETPFLYSLVFGEGVVNDATSVVLFNALQNFDPNQIDAIVILKFLGNFCYLFVSSTFLGVFSGLLSAYIIKKLYIGRHSTDREVALMMLMAYLSYMLAELLDLSGILTVFFCGIVMSHYTWHNVTESSRVTTKHAFATLSFIAETFLFLYVGMDALDIEKWKFASDSPGKSIGISSILLGLVLVGRAAFVFPLSFLSNLTKKTELEKISWRQQIVIWWAGLMRGAVSIALAYNKFTRSGHTQLHGNAIMITSTITVVLFSTMLFGILTKPLIRFLLPASSNGDPSEPSSPKSLHSPLLTSMLGSDMEAPLPIVRPSSLRMLITKPTHTIHYYWRKFDDALMRPMFGGRGFVPYSPGSPTDPNVIVA

SEQ ID NO: 26506 - protein, 72 aa, Oenococcus oeni
MAGNDVIEIEGVIKETKPNANFIVELENGARIQAGVSGKIRKNYIRILVGDRVTVEMSPYDLTKGRITYRHK

SEQ ID NO: 26507 - protein, 347 aa, Glycine max
  misc_feature (282)..(282): Xaa can be any naturally occurring amino acid
MSSSIRPSLSSFMLPSLASCNPSQKLSLFRLGSGIRQFHKFGLKASRFLRHDDKCMRVMAFGNMSTAATQENVLDWVKHDKRRMLHVVYRVGDLDKSIKFYRECLGMKLLRKRDMQEQKYTNAFLGYGPEDAHFVVELTYSYGIEKYDIGDGFGHFGIAIDDISRIVELVRAKGGKITREPSPVKGGNTTIAYIEDPDGYQFELLERVPSPEPLCKVMLRVGDLDRSIKFYEKAFGMELLRTQDDPESKSTIGILGYGPEEKNTVLELTYNYGVPDYDKGVXSDYDRRAIDTDDVYKTAEAIKLAGGKITREPGPIPVMKTKITSCVDPDGWKTVFVDNVDFRRELE

SEQ ID NO: 26508 - protein, 346 aa, Bdellovibrio bacteriovorus
MYSGFLKNVWYVGIPSAELAVNKATARKILGEPIVFYRDSKGKVSAMRDICPHRGIPLSYGRVVNDQIECPYHGWKFDGTGMCTEIPSLCPDQELNPNKIKVRSYPVHEAQGLIWVFVGDKDYDVSKAPAIPVMKAFPADVKPNLTYVVNFPCHVDHAVIGLMDPAHGPYVHKSWFWRSEKTMLEKKKKFAPVNYGFQMVRHQPSKNSKAYKILGGTPTTEITFTLPCVRVEHIEVGPRNFYSYTALTPVDENNTRVTQLAYWDIPWLTLLKPAIHQFSKKFLGQDMDAVTKQQDGLRYDPSLMLIKDADTQAKWYYALKTEYHDHLEGKREFNHPVKETELRWRS

SEQ ID NO: 26509 - protein, 538 aa, Unknown
  Rhodococcus sp. RHA1
MSTAAPAVTEVLDVLVVGAGFAGLYQLENLRSRGYSVKVVEAGEGLGGIWHWNRYPGARVDSEGPIYQFTRPDLWDEFAFSELYPGGDELRRYFKYVDAKLDLSKDIYYNTRIISAEFDDTANTWTVTAENGSSFVCKYFVLCTGFAAKPIFPKLPGMDSFTGINHHTGLWPEGGIEFAGKRIAIIGTGASGVQVAQEASKKAAQLTVFQRTPVQALPMRQRQLTDEDNAKIKFDLADRFSRRSASFSGFDFDFIPKSALGVSDEERITTYERLWECGFEFWLGTYQDVFVDDDANDTAYEFWRDRTRARIKDPVIAEKLAPTKKAYPFGVKRPSLEQTYYDIFNQDNVRVVDLHEDPIETITPTGLKTTSEQHEFDIIVYATGFDAVTGGLTAMDIRGTDGTLLRDKWSNGVRANLGVATAGFPNLLFLYGPLSPSGFCNGPSCAEIQGDLIVNTIDYMRDNGLNRIESEADADAAWSDHVAELTAEALYDKADSWYMGANVPGKPRQLLNYPGGLPLYLAKWDETVCAGYKGFTLS

SEQ ID NO: 26510 - protein, 556 aa, Vibrio cholerae
MTESFAQLFEEFLNETQFQQGTIVKGTVVAIENGYVLVDAGLKSESAIPAEQFKNAAGELEVQVGSQVDVALDAVEDGFGETQLSREKAKRHEAWIVLEKAYEEAATVIGIINGKVKGGFTVELNGIRAFLPGSLVDVRPIRDTAHLENKELEFKVIKLDQKRNNVVVSRRAVIESESSVERDELLETLQEGTEVKGIVKNLTDYGAFVDLGGVDGLLHITDMAWKRVKHPSEIVNVGDEILVKVLKFDRDRTRVSLGLKQLGEDPWVAIAKRYPEGHKLSGRVTNLTDYGCFVEIEEGVEGLVHVSEMDWTNKNIHPSKVVNVGDEVEVMVLDIDEERRRISLGLKQCKANPWQSFAEAQAKGDKVTGKIKSITDFGIFIGLEGGIDGLVHLSDISWNVPGEEAVREFKKGDEISAVVLAVDAERERISLGIKQMENDPFNAYVSDNKKGALVNGTVTAVDAKGATIELEDGVEGYIRASEVSRDRIEDASLILNVGDKVEAKFTGVDRKNRVINLSIKAKDEAEEQEVMATLNKQDEAAFGNAMADAFKAAKGE

SEQ ID NO: 26511 - protein, 644 aa, Oryza sativa
MMGGGLVMDQGMMFPGVHNFVDLLQQNGGDKNLGFGALVPQTSSGEQCVMGEGDLVDPPPESFPDAGEDDSDDDVEDIEELERRMWRDRMKLKRLKELQLSRGKDPAGGVVGDPSKPRQSQEQARRKKMSRAQDGILKYMLKMMEVCRAQGFVYGIIPEKGKPVSGASDNLRGWWKEKVRFDRNGPAAIAKYQADNAVPGFESELASGTGSPHSLQELQDTTLGSLLSALMQHCDPPQRRYPLEKGVPPPWWPTGDEEWWPELGIPKDQGPPPYKKPHDLKKAWKVSVLTAVIKHMSPDIEKIRRLVRQSKCLQDKMTAKEISTWLAVVKQEEELYLKLNPGARPPAPTGGITSAISFNASSSEYDVDVVDDCKGDEAGNQKAVVVADPTAFNLGAAMLNDKFLMPASMKEEATDVEFIQKRSASGAEPELMLNNRVYTCHNVQCPHSDYGYGFLDRNARNSHQYTCKYNDPLQQSTENKPSPPAIFPATYNTPNQALNNLDFGLPMDGQRSITELMNMYDNNFVANKNLSNDNATIMERPNAVNPRIQIEEGFFGQGSGIGGSNGGVFEDVNGMMQQPQQTTPAQQQFFIRDDTPFGNQMGDINGASEFRFGSGFNMSGAVEYPGAMQGQQKNDGASEFEELE

SEQ ID NO: 26512 - protein, 91 aa, Pseudotsuga menziesii
SGAHTLGRCHKERSGFEGAWTSNPLIFDNSYFKELLSGEKEGLLQLPSDKALLEDPVFRSYVEKYAADEDAFFADYAEAHLKLSELGFAEE

SEQ ID NO: 26513 - protein, 593 aa, Pinus sylvestris
MCGILAVFGCLDASQAKRVRVLELSRRLRHRGPDWSGLYQSGHSFLAHQRLAIVDPASGDQPLYNEDRQIVVTVNGEIYNHEKLREQLKSHKFRTGSDCEIVAHLYEDYGEEFVNMLDGMFSFVLLDTRDQSFIAARDAFGITPLYIGWGFDGSVWFASEMKALHDDCESFESFPPGHIYSSKQGGLRRWYNPPWYSENVIPSSPYDPLVLRRAFEKAVIKRLMTDVPFGVLLSGGLDSSLVAAVASRYLAATKAGKQWGDKLHSFCVGLKGSPDLKAAKEVAEYLGTVHHEFHFTVQDGIDAIEDVIYHVETYDVTTIRASTPMFLMSRKIKSLGVKMVLSGEGSDEIFGGYLYFHKAPNKEEFHQETCRKIKALHMYDCLRANKSTSAWGVEARVPFLDKEFVNVAMDIDPERKMVKPDIGRIEKWVLRRAFDDEQNPYLPKHILYRQKGQFSDGVGYSWIDGLKSHAAEHVTDTMLRNAKYIFPHNTPTTKEAYYYRMIFERFYPQNAARLTVPGGPSVACSTAKAVEWDAAWAHNLDPSGRAALGVHASAYQECNAGANDGTGNGNVNTFSKMPGREASVDAREVLIKG

SEQ ID NO: 26514 - protein, 418 aa, Geobacter metallireducens
MTIAEQIRTIAADARQAAIAMAKLPTTAKNDLLMAMAMALISNTPHLIDENRKDLEAGEKKGLSSAMLDRLMLDEARIKAMADGLREVAGLPDPVGEVTRMWKRPNNLMVGKMRIPLGVIGIIYEARPNVTADAAALCLKAGNSVILRGGSEAIHSNLAIARILGEEMERAGIPKAALSVIPFPEREGVLEMLKQEEFIDLIIPRGGESLIRFVVEHSKIPVIKHYKGVCHVFVDASADFDMAERIVVNAKVQRPGVCNALETLLIHKDVAEAFIPRIAATLTDLKVELRGDDCVRQFAPQAKKATEEDWQAEYLELILAVRVVDGLNEAIDHINAYGSLHTEAIVTRDYHNSQRFIREVNSSTVLVNASTRFADGNQLGLGAEIGISTTKLHSFGPMGLEDLTTTKFIVYGDGQVRQ

SEQ ID NO: 26515 - protein, 481 aa, Desulfovibrio desulfuricans
MKTVFSQSVPGRMACVPPEAEEHAADFIPKNLLRTRRPALPELSELDVVRHFTRLSRLNYSVDSNFYPLGSCTMKYNPKFTEPLAALPGFTELHPLMAQIKSAGLYTQGALEVMYETERLLCEINGMHAFTLHPMAGAHGELTGVMLIAAYHRDKGNKKTKIICPDSAHGTNPASAALGGYEVVNVESKDGIVDPEALEAVLDNDVAAVMMTCPNTLGLFEKHLPRIVEKLRSVDALLYYDGANLNAIMGKMRVGDVGFDVVHLNLHKTFGTPHGGGGPGSGPVGVSERLEPYLPVSRVDRLRDGRLFLNYDYPKSIGYMAPFYGNFGVYIKALAYIMRLGREGIPKAAELAVLNANYLRKKLEQYITIPYNRICMHEFVASACDKAECGVRALDIAKGLLDKGYHAPTIYFPLIVKECLMFEPTETESKETLDTFVDDLAAILKEGEQNPEALHQAPLTTPVRRLDETLAARSMVLTDDA

SEQ ID NO: 26516 - protein, 153 aa, Pseudoalteromonas tunicata
MKTIQQALPAKKTIALVAHDGKKHALELWCSKHLNILSQHTLYGTGTTGHLIEKRTGLPVHKLLSGPLGGDQQLGALIAEHEIHLLIFFWDPLASQPHDPDVKALLRLAAVWNIPVACNESSADMLLSSPLMNSQMPREMPDYQGYLAQRLTI

SEQ ID NO: 26517 - protein, 443 aa, Desulfovibrio desulfuricans
MPYTPHTPEEIRQMLDVIGVKSIDDLFAEIPPEMQPRSFDIPEGMSEMEVCARIQRMAAKNRIDLVSYLGAGFYDHHIPKAVDNLVSRGEFYTAYTPYQPEASQGTLQAIFEYQTAVCRLMEMEVANASVYDGGSAIFEAMMMAARATRRSKLVIDEALSPIYRTMLASYTSNLNMELVTVAHNEGRSDKQALMDAVDDKCAAVVVQNPNFFGAVDDFTELFTHARSCNALGVISVYPVMQSVLKTPGEMGADIAVADGQSLGMPLSFGGPYLGIMTCTKKLARQIPGRIAGRTKDVDGKTGYVLTLQAREQHIRRAKATSNICSNQALCALRAIIHMCLTGPEGLVRTAELSMERAHYAADRLTALPGVSLLHDAPFCNEFALRLPVSAYDVVDRLVNHGVVPGFPLGGYYAGMDDVLLVACTEKHSFEQIGIMAELVGGML

SEQ ID NO: 26518 - protein, 562 aa, Zea mays
MALSASPAQEELLQPAGRPLRKQLAAAARSINWSYALFWSISSTQRPRVLTWTDGFYNGEVKTRKISHSVELTADQLLMQRSEQLRELYEALRSGECDRRGARPVGSLSPEDLGDTEWYYVICMTYAFLPGQGLPGRSSASNEHVWLCNAHLAGSKDFPRALLAKSASIQTIVCIPLMGGVLELGTTDKVPEDPDLVSRATVAFWEPQCPTYSKEPSSNPSAYETGEAAYIVVLEDLDHNAMDMETVTAAAGRHGTGQELGEVESPSNASLEHITKGIDEFYSLCEEMDVQPLEDAWIMDGSNFEVPSSALPVDGSSAPADGSRATSFVVWTRSSHSCSGEAAVPVIEEPQKLLKKALAGGGAWANTNCGGGGTTVTAQENGAKNHVMSERKRREKLNEMFLVLKSLVPSIHKVDKASILAETIAYLKELQRRVQELESRRQGGSGCVSKKVCVGSNSKRKSPEFAGGAKEHPWVLPMDGTSNVTVTVSDTNVLLEVQCRWEKLLMTRVFDAIKSLHLDALSVQASAPDGFMRLKIGAQFAGSGAVVPGMISQSLRKAIGKR

SEQ ID NO: 26519 - protein, 409 aa, Burkholderia mallei
MLASSTIAFTLCFAVWMMFAILGIPLKKTLGLNDTEFGLIAAMPVLTGSLIRVPLGIWTDRYGGRIVFFILMLVTVVPIWLISYATELWQFLLLGLFVGLAGGSFSVGTPYVARWFPKARQGLAMGVFGAGNSGAAVNKFVAPALIAAAGTWTIVPRVYAVAMLAMALLFWLFSATDPAHRSTNATSLRAQLRVLKNPRVWRYSQYYSVVFGGYVGLSLWLTQYYVGEYGFGIQSAAFLAACFSLPGGVLRAIGGWLSDRYGAYRTTWWVMWVCWVMFFLLSYPPTDFTIRAAHGPLGFHLSLTPVAFTALLFAVGIAMAVGKASVFKFIADEFPNDIGAVSGVVGLAGGLAGFALPILFGALVDLTGVRSTCFMLLYGAVSVSLVWMYFSFRAERAAHDQRVLATRSA

SEQ ID NO: 26520 - protein, 311 aa, Helicobacter pylori
MIDCAIIGGGPAGLSAGLYATRGGVKNAVLFEKGMPGGQITGSSEIENYPGVKEVVSGLDFMQPWQEQCFRFGLKHEMTAIQRVSKKGSHFVILAEDGKTFEAKSVIIATGGSPKRTGIKGESEYWGKGVSTCATCDGFFYKNKEVAVLGGGDTAVEEAIYLANICKKVYLIHRRDGFRCAPITLEHAKNNSKIEFLTPYVVEEIKGDASGVSSLSIKNTATNEKRELVVPGLFIFVGYDVNNAVLKQEDNSMLCECDEYGSIVVDFSMKTNVQGLFAAGDIRIFAPKQVVCAASDGATAALSVISYLEHH

SEQ ID NO: 26521 - protein, 1110 aa, Desulfovibrio desulfuricans
MSIMIEPAGLDPQWYRDAIIYELHIKSFHDSDGDGMGDMAGLIEKLDYLQDLGVTALWLLPFYPSPLRDDGYDIADYMSINPDYGSMADFRKLLREAHSRGLRVITELVLNHTSDQHAWFRRARRAPAGSEERDFYVWSDTSDRYKDARIIFKDFEPSNWSWDPVARAYYWHRFYHHQPDLNYENPAVHKAMFRVIDFWLDMGVDGVRLDAVPYLYEEEGTNCENLPRTHDFLKALRSHIDSRFQGRMLLAEANQWPEDAARYFGDGDSCHMAFHFPLMPRMFMAIEMEDRHPVIDIMEQTPELPDGCQWAIFLRNHDELTLEMVTDEERDYMYRMYARDPRARINLGIRRRLAPLLGNDRRRVELLNVLLFTMPGTPVLYYGDEIGMGDNYYLGDRDGVRTPMQWSADRNAGFSRSNPQRLFLPVVIDPEYHYEAVNVETQQSNKSSLLWWMKRIIAMRRRYTAFSRGGISFLRPENSRVLAYMRSSGEEHVLVVTNLSRHAQAASLDLSGWEGYRPVEVFSNTRFPAVRQPAYTITLNPYGYYIFHMRREEAAEALTGLFSPPMLMPVSGARFLDVEVREALQRRVLPGYLTRRGLLGTSAVQLREAVILEAVPVGGKGAPSWLLIVEARYQERQPEWFGMLVSLLAGEPARQTVREAPVHLMCTFGEDAPEAVLVESFDASCRCGALLQLVSRTQTVKGRHGELAVAPAGGTRGRVRAACAEDAPALWKPHIHATSVVCGESVLFKVYRRMDEGVNPDVELLRFLTEEAGYPHVPAYMGVVEYRRSRTSSMAVAMLHEYVQAQGDAQEMCRDMVRRFFDRVLAARGEMDIRPRLYARSPVEAAGRPLPQEYRELMGDMDFAGMQLLGRRVGELHRALAFSSEDSAFAPEPFSTLYQRSVYQGMQSRVKQVLTRLERSLALLPESARDDAARVLELREEALRRMRGFLTRKLDCLKIRVHGNLHLGNVLRSGREYVIVNFEGRPDKSLSERRLKRSPLRDVADLVRSVHYTVLTVLMHESVLRPEDRAFLEPWADLWRIEASGAFMTTYLEAVGGSRLVPENEQGVQVLLEAFLLEKAFMELDAELKAPSGMVGLPLAAIITLLGAEG

SEQ ID NO: 26522 - protein, 260 aa, Methanosarcina barkeri
MELDEVIITRAIFDEYSKTFLDYTEVDVALIGGGPANLVAARYLAEAGAKVAIYEQKLSLGGGMWAGGMMFPRIVVQEEACRILDDFGIRYKEYQPGYYVANSVESVGKLISGATSAGAEVFNLVSFEDVMIRENDRVTGIVVNWGPVTVQRLHVDPLMIRTKLVIDGTGHEAVVCNTILRKIPNAKIGNLGKLGEKPMWSEVGEQLVVDATKEIYPGLIVAGMAANAATCSPRMGPVFGGMLLSGEKAAKLALEKLKEL

SEQ ID NO: 26523 - protein, 91 aa, Arabidopsis thaliana
  misc_feature (52)..(52): Xaa can be any naturally occurring amino acid
  misc_feature (72)..(72): Xaa can be any naturally occurring amino acid
MASSMLSSATIVASLDHATMVAPFSGLKSSAVFTVIRRANNDITSITINGGXVNFMHVWPPTGNNKFETLSXLPDLTDSELAMEVDYLIRD

SEQ ID NO: 26524 - protein, 250 aa, Unknown
  Silicibacter sp. TM1040
MCPGVVAFAGSGPGDVDLLTLKVLKALGEADVILFDRLVSKDIMALAHEGALLEDVGKEGFGPSMAQEEICARLVHHAKRGLKVLRLKSGDPTIFGRLDEELSACEAADVDTQILPGITAASAAVAAIGQSLTQRGRNTSVRFLTGHDMKGFADHDWAQLARRGEVAAVYMGKKSARFVQGRMLMHGADLTTPVTVVENASRADQRVLATTLEHLPADLAAAHFSGPALTFLGLAPRQAAALTDIQMELA

SEQ ID NO: 26525 - protein, 210 aa, Pseudomonas putida
MEPFSPNDFAELVMVERKASVERNTLETQVKCSINLDGSGKARFDIGVPFLEHMLDQIARHGLIDLDIECKGDTHIDDHHTVEDVGITLGMAFAQAIGDKKGIFRYGHAYVALDEALSRVVIDFSGRPGLQMHVPYTRASVGGFDVDLFQEFFQGFVNHALVTLHIDNLRGHNTHHQIETVFKAFGRALRMAITLDERMAGQMPSTKGCL

SEQ ID NO: 26526 - protein, 153 aa, Zea mays
MSAKAPLGVAPVEEGAGTPGQQAVLGQMVEDAAVWCAVHGLVIGDRANQRSGTVPGVGLVHAPFSLLPARFPASFFNQACELAPIFNELVDRVSLDGEFLQAALSRQVLNSIHWILLVNSRLSFSNFRTKQVDEFTSRLLEIHDKMMSINKKE

SEQ ID NO: 26527 - protein, 432 aa, Glycine max
MAQILAPSTQWQMRISKSSPNASPITSNMWSSLLWKQNKKVSPTSSAKFRVMAIKSDNSIINRLEGLLNLDITPFTDKIIAEYIWIGGTGIDVRSKSRTISKPVEHPSELPKWNYDGSSTGQAPGDDSEVILYPQAIFKDPFRGGNNILVICDSYTPQGEPIPTNKRHRAAEIFSNPKVQAEVPWYGIEQEYTLLQTNVKWPLGWPVGGYPGPQGPYYCSAGADKSFGRDISDAHYKACLYAGINISGTNGEVMPGQWEYQVGPSVGIEAGDHIWASRYILERITEQAGVVLSLDPKPIEGDWNGAGCHTNYSTKSMREDGGFEVIKKAILNLSLRHKDHISAYGEGNERRLTGKHETASINTFSWGVANRGCSIRVGRDTEKNGKGYLEDRRPASNMDPYVVTSLLAETTLLWEPTLEAEALAAQKLALKV

SEQ ID NO: 26528 - protein, 265 aa, Unknown
  Rosa hybrid cultivar
LVQFGAFIVLCGATHLINLWTFSVHSRTVAIVMATAKVFTAAVSCATALMLVHIIPDLLSVKTRELFLKNKAAELDREMGLIRTQEETGRHVRMLTHEIRSTLDRHTILKTTLVELGRILTLEECALWMPTRTGLELQLSYTLHQQNPVGYTVPIHLPVINQVFNNNGTVKISPNSPVARLRPIAGKHIPGEVVAVRVPLLHLSNFQINDWPELSTKRYALMVLMLPSDSARQWHVHELELVEVVADQVAVALSHAAILEESMRA

SEQ ID NO: 26529 - protein, 474 aa, Streptomyces cattleya
MRVLLVWPRNERALLSDRLSCCEPLPLEYLAGALRGAHDVTIHDLRVDTSLEEYAATHEAPDLIGVAIPYTTSVRVSRDVTHQARRLWPGTPIVLGGHHPTVSAEWLTGFAADWIVAGEGGGPLAHLAAELEAGRTPAPVRGLAPYDARTGLERDRRPKPSALDDLPMPDRTRLAHHRGRYFHSIYRPVALIRFTAGCPYTCKFCSLWRMTDRRYLVKDIDRVLAEIADIDGDNLYVVDDEAFIQPVRMLELADAIDKAGFRKKFHMYVRTDTALRRPDVIARWAEIGLDSVLVGAESMTDEELTGYRKGTDPGQTRRALDLFHGNGVKVRANFIVQPDWSEADFARLGRTVDELQVDMPSFSVLTPLPGTDLYDEAKLGLISDNPELFDCYHSLFRTRLPLERFYGELADLLAGASARTAPGVTGESDPSVFYYSDDDAFDQMLRELRRGADWSHPRESWSPTREPETVAGTG

SEQ ID NO: 26530 - protein, 142 aa, Listeria monocytogenes
MSIEVGNKLQGKVTGITNFGAFVELEGGKTGLVHISEVADNYVKDINDILTVGDEVTVKVMNIGDDGKIGLSIRKAVDRPDRPEKSYDRKPKYNKKPAGNYVKPAESFEDIMSKFLKDSDERLTTIKRQTESKRGGRGAKRG

SEQ ID NO: 26531 - protein, 564 aa, Xanthomonas oryzae
MCSIFGIFGLQPGDDLQALRRQALECSQRQRHRGPDWSGVYVDAGAILVHERLAIVDPAGGSQPLLSEDGQLALAVNGEIYNHRELKAELLQPYAFQTGSDCEVINALYREDVPALYLNRLNGIFAFALWDKTEGRVIIARDPIGVVPLYWGHDREGRLRVASELKSLVDDCADAAQFPPGHWYDSATGALSRYYERAWREYAEVEGVQVQLQELREAFERAVHRQLMTDVPYGVLLSGGLDSSLVAAVAARYARHRVEENDTTEAWWPRLHSFAIGLKGSPDLAAAEVAAAALGTVHHGFEYTFEEGLDALPDVIRHIETYDVTTIRASTPMFLLARRIKAMGVKMVLSGEGSDEIFGGYLYFHKAPNAREFHEELVRKLDALNNYDCLRANKSMMAWGVEPRVPFLDREFLDVAMRMDASFKMIDKTSSGAARMEKGVLREAFAGYLPESILWRQKEQFSDGVGYGWIDGLKAHAAANVSERELAAADRRYPVNPPQTKEAYFYRTLFEQFFPGQSAAETVPGGKSIACSSPTAIAWDASFAAMADPSGRAIAGVHAQAMDS

SEQ ID NO: 26532 - protein, 648 aa, Listeria monocytogenes
MDDTEKRVHKYIEKHDLIRSDDKLLVAVSGGPDSLALLHFLWNSNLVPKEAISVAHLNHQLRENAAKEQRVVETFCERQGIPFYIEEVDIKSRAQSLQKGLEETARIVRYDFFEKVMAEKNINKLVLAHHADDQIETILMRLVRGSASIGWSGIQPKRELKGGQAIRPFLPITKAEIIDYAQKHELAYEIDESNTSQEYTRNRYRAQLLPFLKQENPAVYSHFERFSEETSEDFQFLEALASDLLKKNLIKNGKQTTLLLSSFKNEANPLQRRAIHLLLRYLYNEDASFITVNHIYQIIQMIQSDNPSSSIDLPNKLIANRAYDKLHFQFGEREAPSEFYHQLELNDRIELDNKASIRLKLKSSVVQTNGLNGMLLDAEEITLPLIVRNRVNGDRMTMKGQAGSKKLKDIFIDAKIPRQERDKLPVITDYTGKILWVPGVKKSAYDREFSRSKKQYIIRYTRNIGGNESMHNDIQKVLISEDELQEKIRELGRELTTEYEGRNPLVVGVLKGATPFMTDLLKRVDTYLEMDFMDVSSYGNGTVSSGEVKIIKDLNASVEGRDVLVIEDIIDSGRTLSYLVDLIKYRKAKSVKLVTLLDKPAGRNVEIEADYVGFVVPNEFVVGYGLDYAERYRNLPYIGILKPEIYSE

SEQ ID NO: 26533 - protein, 335 aa, Pseudomonas putida
MLPKVCIIGAGCSGFTTAKALADRGIPFDCFDMSDQIGGNWVFKNKNGRSACYQSLHIDTSKYRMQFEDLPIPSHFPDYPHHSQVLEYFNAYVDRFGLRKRITFNTEVTKAELMPDKTWRVTLSNGETRSYGALVVANGHHWDQYIPSFPGTFDGPSFHSHRYIDPFEPVDMRGKRILVVGMGNSAMDIASELSQKPIAKRLVVAARRGVWIFPKYINGKVPDKGHAFVDAPLPDPRAGEAHDHPCRRAHEGLRASRARASSCGCAPFGVRRVPDAGRMWRCCREAEYRGTARYQGQVRGRFCRNPTYKPSAFSASLKAHMLEPRPGKSTETGRF

SEQ ID NO: 26534 - protein, 308 aa, Listeria monocytogenes
MTIANSITDLIGKTPIVKLNRLPEAGSADVYVKLEFQNPGGSVKDRIANAMIESAEKSGALKPGDTIIEPTSGNTGIGLAMVAAAKGYQAIFVMPETMSLERRKLLQAYGAKLVLTPGPDGMKGAIAKAEELAKENNYFVPQQFHNPANPAVHEETTGPEIVEAFGKDGLDAFIAGVGTGGTVTGVGHVLKKNYPDVKIYALEPEESPVLSGGSPSPHKIQGIGAGFVPDTLDTKVYDGILKVSSEDALETAREVAKKEGILVGISSGATIKAALDLAKELGAGKKVLAIVASNGERYLSTPLYNFED

SEQ ID NO: 26535 - protein, 545 aa, Azospirillum brasilense
MKLAEALLRALKDRGAQAMFGIPGDFALPFFKVAEETQILPLHTLSHEPAVGFAADAAARYSSTLGVAAVTYGAGAFNMVNAVAGAYAEKSPVVVISGAPGTTEGNAGLLLDHQGRTLDTQFQVFKEITVAQARLDDPAKAPAEIARVLGAARSLSRPVYLEIPRNMVNAEVEPVGDDPAWPVDRDALAACADEVLAAMRSATSPVLMVCVRSAATGLEAKVADVAHGLGVPVVTTFMGRGLLADAPTPPLGTYIGVAGDAEITRLVEESDGLFLLGAILSDTNFAVSQRKIDLRKTIHAFDRAVTLGYHTYADIPLDGLVDALLERLPPSDRTTRGKEPHAYPTGLQADDGPIAPMDIARAVNDRVRAGQEPLLIAADMGDCLFTAMDMIDRGLMAPGYYAGMGFGVPAGIGAQCVSGGKRILTVVGDGAFQMTGWELGNCRRLGIDPIVILFNNASWEIVRTFQPESAFNDLDDWRFAEMAAGMGGDGVRVRTRAELKAALDKAFATRGRFQLIEAMIPRGVLSDTLARFVQGQKRLHAAPRE

SEQ ID NO: 26536 - protein, 389 aa, Arabidopsis thaliana
MVIAAAVIVPLGLLFFISGLAVNLFQAVCYVLIRPLSKNTYRKINRVVAETLWLELVWIVDWWAGVKIQVFADNETFNRMGKEHALVVCNHRSDIDWLVGWILAQRSGCLGSALAVMKKSSKFLPVIGWSMWFSEYLFLERNWAKDESTLKSGLQRLSDFPRPFWLALFVEGTRFTEAKLKAAQEYAASSELPIPRNVLIPRTKSFVSAVSNMRSFVPAIYDMTVTIPKTSPPPTMLRLFKGQPSVVHVHIKCHSMKDLPESDDAIAQWCRDQFVAKDALLDKHIAADTFPGQQEQNIGRPIKSLAVVLSWACVLTLGAIKFLHWAQLFSSWKGITISALGLGIITLCMQILIRSSQSERSTPAKVVPAKPKDNHHPESSSQTETEKEK

SEQ ID NO: 26537 - protein, 434 aa, Arabidopsis thaliana
MEEVSPAIAGPFRPFSETQMDFTRIRLGKGYCNNQYSNQDSENGDLMVSLPETSSCSVSGSHGSESRKVLISRINSPNLNMKESAAADIVVVDISAGDEINGSDITSEKKMISRTESRSLFEFKSVPLYGFTSICGRRPEMEDAVSTIPRFLQSSSGSMLDGRFDPQSAAHFFGVYDGHGGSQVANYCRERMHLALAEEIAKEKPMLCDGDTWLEKWKKALFNSFLRVDSEIESVAPETVGSTSVVAVVFPSHIFVANCGDSRAVLCRGKTALPLSVDHKPDREDEAARIEAAGGKVIQWNGARVFGVLAMSRSIGDRYLKPSIIPDPEVTAVKRVKEDDCLILASDGVWDVMTDEEACEMARKRILLWHKKNAVAGDASLLADERRKEGKDPAAMSAAEYLSKLAIQRGSKDNISVVVVDLKPRRKLKSKPLN

SEQ ID NO: 26538 - protein, 628 aa, Glycine max
SARDAVYHGPEGLKTIAQRVHGLAGVFAQGLKKLGTVEVQDHPFFDTVKIKTANAHAIADAARKNEINLRVVDGNTITVAFDETTTLEDVDNLFKVFSDGKPVSFTAASLAPEVQTAVPSGLTRNSPYLTHPIFNTYHTEHEVLRYIHRLQSKDLSLCHSMIPLGSCTMKLNATTEMMPVTWPSFANIHPFAPIEQAQGYQEMFENLGKLLCTITGFDSFSLQPNAGAAGEYAGLMVIRAYHLARGDHHRNVCIIPVSAHGTNPASAAMCAMKIVSVGTDAKGNINIEELRKAAETHKDNLAALMVTYPSTHGVYEEGIDEICKVIHDNGGQVYMDGANMNAQVGLTSPGWIGADVCHLNLHKTFCIPHGGGGPGMGPIGVKKHLAPFLPSHPVVSTGGIPAPGKSQPLGTISAAPWGSALILPISYSYIAMMGSKGLTEASKTAILNANYMAKRLENHYPVLFRGVNGTVAHEFIVDLRGFKNTAGIEPEDVAKRLMDYGFHSPTMSFPVPGTLMIEPTESESKSELDRFCDALISIRQEIAEIEKGKADINNNVLKCAPHPPPVLMGDAWTKPYSREYAAFPASWLRVSKFWPSTGRIDNVYGDRNLVCTLLPTSQAVEEQAAATA

SEQ ID NO: 26539 - protein, 431 aa, Oryza sativa
MVGKRVAVVVGGSVAGLACAHAVAEAGWEAVVVEKAAAPGAGSGTGAGLGLDAQSMETLARWIPGRLDAATLPLAVDLNRATDGETKAGRTLTRDEGFGFRAAHWGDLHRRLHEALPAGVTVLWGHQFVSFEMAPEGDGDGGVVVTARVLRTGETVEVAGDLLVAADGCTSAIRRRFLPELKLRYSGYCAWRGVFDFSGKEGCTTMVDIRRAYPELGNCLYFDLAYKTHAVLYELPKNRLNWLWYINGDEPELMGSSVTMKVNEATVSEMKEEAERVWCPELARLIGETAEPFVNVIYDAEPLPGLSWAGGRVALVGDAAHPTTPHGLRSTNMSILDARVLGCCLARWGGDGNAEPTSTPRRALAEYEAARRPVVAAQVLHARRLGRLKQGLGMGSAGDGEGFDARTATEEEISQLRQSSMPYFSGAPTIE

SEQ ID NO: 26540 - protein, 907 aa, Desulfovibrio desulfuricans
MKSSPPAHTGLQRGRLLFLLPALALAAFIVCLISFVYISQRQTLEARQLRIMAQAERQASAISHLIGEIKLDAALLFRQQDFIDFSDSTPKSVQPGQTHPAGREAVRRLLTDFIASKALSGERLYNRIVLFSSTGRMLMDTSANKEPVHLPAGIARALASDVDYPLVFSLTPEIKELTFAVPLVTDSTRAGYAVVFCNTRAVTSFLESLWDLNDAYILLLQGQSGIALHRAEQISPEWIRQASRLEPGLLYTLSSEGEPEMLQHGAATSRETGIRHHVDNSPFDLLLVFSGPSIGGAVSPNVTLVAVALLAAIIAVSFYHVFRSTMRAREHKARAEAAAASEKRILQQNALLNAEIEERIKAEHALREAKELAEEADKAKGEFLANISHEFRTPMNAIIGMSEVILKTELSAPQRNHLTVLNKAAHSLLDLLNTILDFSRYESGKATLALSPFMLHAPFTQVHEMFLSAAAAKGLPLQLELAPDMPRAVEGDEGKIRQILVNLVSNALKFTDTGNITITCKAFPAPSGRADICFSVSDTGIGIEKEKHSAIFDSFTQADGSYTRTYGGTGLGLSICKLLADMMGGSITVRSAPRQGSTFTVCLPLKAVPEERVFPAAENPAVRPSKAASPLSVLVAEDNEFNREVIREILGLSGHSSTLVQNGEQALQALSTQDFDVVLLDIQMPVMDGVQTAQKIRSGACGNRNAGIPIIALTAHSMEGDKKRFLQAGMTEYLAKPVTPDHLNHVLGKYAPLPAAAPTGQSSAAHGFQPAAGKGSTAQADAEIPPPDLSLALSMLNGKQKVLTVMLGTFVRTMPDRIAALHDALQKKDIQALAEQGHALKSTLHSIGSLPGRSVAEQLENAGRSGNTEAAVTLAPRLIHVLEFMTEHLRRQIDSSQSHHQPSSGGR

SEQ ID NO: 26541 - protein, 470 aa, Yersinia pestis
MDYFPIFCQLQHKACLLVGGGEIAERKARLLLDAGALVTVNACEFTPQFHHWADQGQLSLISGEFVPELLADKWLVIAATDQLSVNALVYQSANQQRIFCNVVDDPKRTSFIMPSIIDRSPIMIAVSSGGKAPVLARLLREKLEALLPQHLGQLAGNLRQRVKQHFTVMTERRRFWEKLLTHDRLAQSLANNDHVQADQHVEQLFSAPLTDRGEVVLVGAGPGDAGLLTLKGLQQIQQADVVVYDRLVSDEVMNLVRRDAERIFVGKQSGHHCVPQEQINQILLQQAQSGKRVVRLKGGDPFIFGRGGEELEELAGYGIPFSVVPGITAASGCSAYSGIPLTHRDHAQSVRLVTGHAKKEGQLDWANLAAEKQTLVFYMGLSQAGEIQQQLIQHGMPATTQVALVENGTSRHQRVVSGELSQLALLSQQVSSPSLIIVGSVVSLREKLNWFSSRHHDDQPKVTECVAHVG

SEQ ID NO: 26542 - protein, 690 aa, Sorghum bicolor
MSASSSSLCGGDPAMRSVVWFRRDLRVEDNPALAAAARAGGEVVPAYVWSPEEEGPYYPGRVSRWWISQSLKRLDASLRRLGAGKLVTRRSADAVVALLQLVRDTGATHVYFNHLYDPISLVRDHRLKEMLAAEGIVVQSFNADLLYEPWEVVDDEGQPFTMFTAFWNRCLSMQYDPPAPLLPPKKINSGDLSMCPSEDLIFEDDSERGSNALLARAWTPGWQNADKALTAFLNGPLADYSVNRKKADSASTSLLSPHLHFGELSVRKVFHLVRMKQLVWSNEGNHAAEESCTLFLRSIGLREYSRYLSFNHPSSHERPLLAHLRFFPWVVNESYFKIWRQGRTGYPLVDAGMRELWATGWLHDRIRVVVSSFFVKVLQLPWRWGMKYFWDTLLDADLESDALGWQYITGSLPDSRELDRIDNPQFEGYKFDPHGEYVRRWIPELVRLPTEWIHHPWDAPVSVLQAAGIELGSNYPLPIVELDAAKARLQEALSEMWQLEAASRATMNNGMEEGLGDSSEVPFPEELQMEVDRATANVVMTVRRREDQMVPTMTSSLNRAETEVSADLGNSEDTRAQVPFHAHFHPRVEREDMIQNTEGPALRINGTHQHNIFQQPQNHRREALAPSVSEASSSWTGREGAVVPVWSPPAASGHSETFAADEADVSSRSYLDRHPRSYRLMNWSQLSQSL

SEQ ID NO: 26543 - protein, 806 aa, Geobacter metallireducens
MAKKMLINVMHPEEARVAIVEDGKLDNLDIEIAGSEQTRGNVYKGVVVRVEPGLQAAFVDIGAKRLGFLQMGEIHPSFWQWRDDVPPENRNRRPRIQEVIRRGQELIVQVEKGERDMKGAALTTYMSFPGRYMVLMPGSDSAGISRKVESDADRKKLKEKLSQMEIPEGIGYIVRTEALGKTKTELNKDLQNLLTLYKSIQEKAAALKAPALIHQEMNVVIRTIRDYFTAEIDEVLVDSKEVYKEARDFFKQTMPKYEKLVKLHTEKRPIFSRYQIEEQIDLIYEKKVPLKSGGYLIIEPTEALVSIDVNSGKTTGEKGVEDTAYKTNLEAAEEAARQLRLRDLGGLIVLDFIDMRDRKHNATVEKTLKAALKEDKARVEVGRISQFGMLEMSRQRIKQTLEQGSTLECPHCSGRGKVKSVESMALSFLRKVHAAAAKGTVAEVHGGLPLEVAYYLLNRKKRELARIEDDYDIVVTVKGRTSFLMNELELETVKREKPAHIEHPAEAAEAPEKKPETVMEAAEAVEPEETALQEGGEGKKRKRRRSRKKGKGEETPAVSLAEEPLQEEEVVGEPEAGEEPEEIEEGVEAAPGEEAKKKRRRRRRRGKKPRAGEAGEVPAAEVTAEIVTPEPAVEPSAPIDAESAAEAEEPAEPAAEEAKKKRRRRKRRSGKREEEGLAAEEAATPQETAPVAPEPAPASAVEPAPEEPKPKKTRAPRTKRAAVAASEPAEPQTVEAVSAEPAPTEAAPAKPVRKRAPRKKAVAEEEAIAPEAHAPEPTPEAEAPKRKRAPRKKKETPEAPPENDTP

SEQ ID NO: 26544 - protein, 761 aa, Ostreococcus tauri
  misc_feature (1)..(1): Xaa can be any naturally occurring amino acid
XASGDGRRRLLRGGFGQTLDTIFGSGILAMCAGGSDGSELWWSTGGQFARLHAYDMFIQGQREIARPRLNEDAAGVGIRCLTGSSAGAPTLNAPIVTMSSSTSNDSVLLWAGLRNGVVMAWDCDLGKLLSTDIVLASRDKAVTAIAPIDATRAWVGCEDGTIVEVHAPATKPDSSWSYSGKCFKTRDVFPADAHERPSFGEPRENSKGVRCMIHNANEGSDGFMFIACERDLFLEIWDIADATCVRVEALDDLGAVVSLMQHPTVRDLIVSVHETGAVQLWGGDKCAVKTGDRVMTITPGFKQVEKWSLAPFSKYFGKTVIGAVPVENVLVIGHASGKLTIWSLPGAQELHDTTLHSETLASSPASASVTVRWGKRVAHESGLVHLTKIDGGGSLGVVTVGRFGSIMYWPLAQLESGLGKGRKPRPMLGTPSKMNEDRLKPKTPESGTLSDTARIAYEHIKLVQKIGEGSFGRVYKAKWNHIDVAVKFIGPSDIDVTASGLGRSLEELEKEVSIMTKLRHPNIVLLLGVVMSPRPAIVQEFCVRGSLYTVLQRHAKSGAPELTWRLRLQMALGAAAGMLYLHECTPTVLHRDLKSANLMVDRYYRVKVGDFNLSRAEIVASSESAEFSGNLHSPSWMAPEVLCDSQYSKASDVYSFAVVMWEIQSLQTPWKDLHIYQIVTAVPDGERLDPTATHGVVFHEAKAYQDLMMQAWQQDPAVRPCFEQLVEEVTTLLSAEIARDPQLKKDAKIQFFQRERFHQTA

SEQ ID NO: 26545 - protein, 141 aa, Oryza sativa
METTGGGGSPKEAVVPSAASGDTTLGRHLAHRLVQVGVSDVFAVPGDLNLTILNHLIAEPGLHIVGCCNELNAGYAADGYARARGVGAYAVTFTVRGQLLHGCRRRSHRFLNQVTGDEARKQAPPLGIRSARARLRRCCRW

SEQ ID NO: 26546 - protein, 490 aa, Staphylococcus aureus
MTSKSSPLIFERSREGRYAYSLPISDIKTNSVESLLDDKFIRKNKAEFPEVAELDLVRHYTELSNKNFGVDNGFYPLGSCTMKYNPKINEKVARIPGFSESHPLQDEDQVQGSLEIIYSLQEELKEITGMDEVTLQPAAGAHGEWTALMIFKAYHENNGEGHRDEVIVPDSAHGTNPASASFAGFKSVTVKSNERGEVDIDDLKRVVNENTAAIMLTNPNTLGIFEKNIMEIREIVHNAGGLLYYDGANLNAIMDKVRPGDMGFDAVHLNLHKTFTGPHGGGGPGSGPVGVVKELASYLPKPMVIKDGDKFKYDNDIKNSIGRVKPFYGNFGIYLRAYTYIRTMGATGLKEVSEAAVLNANYIKARLSEHFEIPYKQYCKHEFVLSGVRQKEFGVRTLDMAKRLLDFGVHPPTIYFPLNVEEGMMIEPTETESKETLDYFIDTLISIAEEAKNDPDKVLEAPYTTVIDRLDEATAARKPILKFENLKQEK

SEQ ID NO: 26547 - protein, 848 aa, Yersinia pestis
MSKIKIAIIGNGMVGHRFIEDLLDKADKDQFDITVFCEEPRIAYDRVHLSSYFSHHTAEELSLVREGFYEKQGVKVLVGERAITINRAEKVIHSNSGRSLYYDKLVMATGSYPWIPPIKGSEGQDCFVYRTIEDLNAIEACTRRSKRGAVIGGGLLGLEAAGALKSLGVETHVIEFAPVLMAEQLDPMGGDQLRQKIERMGVRVHTGKNTQEIVHSGQNSRKTMLFADGTQLEVDFIVFSTGIRPQDKLANQCGLATARRGGIAINDYCQTSDPDVYAIGECASWQERTFGLVAPGYKMAQVAADHLLGRENAFLGADMSAKLKLLGVDVGGIGDAHGRTEGARSYVYLDESKEIYKRLVVSADNKTLLGAVLVGDTTDYGNLLQLALNNITLPENPDSLILPAHAGNKPTIGVDSLPDSAQICSCFDVTKGDIIRAIGQGCQTVAALKSATKAGTGCGGCIPLVTQVLNAELSKQGIEVNNHLCEHFAYSRQELYHLIRVEGIKTFTELREKYGKGYGCEVCKPTVGSLLASCWNEYVLEPQHTPLQDTNDNFLGNIQKDGTYSIIPRSPGGEITPDGLLVVGQIAKEYNLYTKLTGSQRIGMFGAQKDDLPAIWARLIDAGFETGHAYAKALRMAKTCVGSTWCRFGVGDSVGFGVALEHRYKGIRAPHKIKFGISGCTRECAEAQGKDVGIIATENGWNLYVCGNGGMKPRHADLLAADLDEETLMRYLDRFMMFYIRTADKLQRTSVWLESLEGGIRYLQLVILEDKLGINDQLEAEIARLRDKVACEWKATVENPAAQVRFAHFINSSLRDPNVQVVREREQHRPARPDERIPVRVLELEDNA

SEQ ID NO: 26548 - protein, 774 aa, Burkholderia mallei
MTETVALKIVQRIADELSVQPRQVAAAVQLLDEGSTVPFIARYRKEVTGNLDDTQLRQLEERLLYLRELEERRATIIASIDEQGKLTDELRAAIDAADSKQTLEDLYLPYKPKRRTRAQIAREAGLEPLAQALLANPLLDPQAEAAAYVNTDRGVADVKAALDGARDILSEQFGETAELLGKLRDYLFERGVVSSAVVDGKQGEEGEKFRDYYDYSETIKTVPSHRALALFRGRNAGVLTVKLGLGEELDAQVPHPGEAMIARHFGIANQNRPADKWLSDVCRWCWRVKVQPHIETELLTQLRETAEHEAIRVFARNLKDLLLAAPAGPKAVIGLDPGLRTGVKVAVVDRTGKLLATDTIYPHEPRRDWDGSLAKLARLAAQTQAELVSIGNGTASRETDKLASELIAKHPELKLQKIVVSEAGASVYSASELAAKEFPELDVSLRGAVSIARRLQDPLAELVKIEPKAIGVGQYQHDVNQRELARSLDAVVEDCVNAVGVDANTASAALLARVSGLNSTLARNIVDYRDANGPFPSREHLRRVPRLGDKTFEQAAGFLRINGGENPLDRSSVHPEAYPVVERMLAKISKRIDDVLGNRDALAGLSPAEFVDERFGLPTVRDILSELEKPGRDPRPEFKTATFREGVEKVSDLAPGMVLEGVVTNVAAFGAFVDIGVHQDGLVHVSAMSTKFIKDPHEIVKAGQVVKVKVLDVDVKRQRISLTMRLDDDAAPSAPGNRGGAERGAMRGGARAQRSREPEPAGAMAAAFAKLKQR

SEQ ID NO: 26549 - protein, 451 aa, Staphylococcus aureus
MCIVSHRYIPLTEKDKQEMLQTIGAKSIGELFGDVPSDILLNRDLNIAESEAETTLLRRLNRIASKNITKETHTSFLGAGVYDHYAPSVVDAMISRSEFYTAYTPYQPEISQGELQAIFEFQTLICELTDMDVANSSMYDGMTSFAEACILAFSQTKKNKIVVSKGLHYQALQVLHTYAKTRKEFEVVEIDLDGTVTDLKKLEAAVDDDTAAVAVQYPNFYGSIEDLEKIHSFIEDKKALFIVYANPLALGLLTPPGSFGADIVVGDTQPFGIPAQFGGPHCGYFATTKKLMRKVPGRLVGQTQDDEGNRGFVLTLQAREQHIRRDKATSNICSNQALNALASSIAMSALGKQGIYDIAVQNIEHANYAKQQFIKKGFEVLDGTSFNEFVVKFDKPIQQVNEELVKYNIIGGFDLGVVSDDFKNHMLIAVTELRTKDEIDTFVEKAGELND

SEQ ID NO: 26550 - protein, 352 aa, Oryza sativa
MATTASSLLKTSFAGVRLPAAARNPTVSVAPRTGGAICNSISSSSSTPPYDLNAIRFSPIKESIVSREMTRRYMTDMITYADTDVVVVGAGSAGLSCAYELSKDPSVSVAVIEQSVSPGGGAWLGGQLFSAMVVRKPAHLFLDELGVAYDEQEDYVVIKHAALFTSTVMSRLLARPNVKLFNAVAVEDLIVKKGRVGRVVTNLGACVNDHDTQPGMDPNVMEFKVVVSSCGHDGPFGATGVKRLQDIGMIDAVPGMRALDMNTAEDEIVRLTREVVPGMIVTGMEVAEIDGAPRMGPTFGAMMISGQKAAHLALKALGRPNAIDGTIKKAAAAAAHPELILASKDDGEIVDA

SEQ ID NO: 26551 - protein, 85 aa, Stenotaphrum secundatum
ECQKVGAPPEVSARLSAMAQELEARQRTALGGLGAATEPELDQFMEAYHEMLVKFREELTRPLQEAMEFMRRVESQLNSLSISGR

SEQ ID NO: 26552 - protein, 286 aa, Selenomonas ruminantium
MEIWFSQMDTENVKTSVRVDRQLFSRQSEYQRINVFESREFGRMIVLDGEIIFSEADEFIYNEMVVHVPMAVHPCVKNVLIIGGGDGGVAKVLTQYPEIEAIDVVEPDEMFIEVSREFFPETARGFDDDRVKITNMDGLRFLRRCRDKYDLIINDSTDPFGHTEGLFTREFYGNCYRALHDDGIMVYQHGSPFYDEDEAAFRAMHRKAYQSFPVSRVYQASIPTCPAGIWMFGFASKKYHPLKDFDAQRWNERQLETWYYTTHLHKGAFMLPKYVEDILSEEEMKK

SEQ ID NO: 26553 - protein, 85 aa, Panicum bulbosum
ECQKVGAPPEVSARLTVMAQELEARQRTALGGLGAATEPELDQFMEAYHEMLVKFREELTRPLQEAMEFMRRVETQLNSLSISGR

SEQ ID NO: 26554 - protein, 1022 aa, Medicago truncatula
MKNILKKLHIMSNNQSEDAQAERSNKSNDGSSSSPTTRNKLSNWLHSVSSNRKQSPGSPPSGERVEELSDSLTFGGGGGGLDMVVSDSTKRDSGSSSSRDPEVEEEYQIQLALELSAKEDPEAVQIEAVKQISLGSCHPDNTPAEVVAYRYWNYNALGYDDKISDGFYDLYGVLTDSTSTRMPSLIDLQGTPTANDVKWEAVLVNRVADSNLLKLEQKAMGFAVKSREDFEIVVDRNLVHKLAILVAEYMGGSVEDPESMSRAWRSLSYSLKATLGSMVLPLGSLTIGLARHRALLFKVLADSLGIPCRLVKGMQYTGSDDVAMNFVKIDEGREYIVDLMAAPGTLIPSDAAGSHIEYDDSSFVASPSSRDLDSSHITSFSSGVGSSSEETSDFRTFEKGNRYKHFADAGKESDVSSRPPTCKEELKKPLNEFKNIPNVEKIKARESVSRPNNYPYMHGRSPSWTEGISSPEAHRMKVKDVSQYMIDVTKENPKLAQKLHNVLLESGVVAPPNLFSEIYHEQLGSQNEANSPTEEDEYKHRSAQKEAKEDSDNLAPRFLPPLPPHIIHPKASPSNQLEHSKPVEGLGIGLSLDSREAAVQHTYSDAEATLVKYGKNVPVAAAAAAAAAVVASSMVVAVAKSSTDSSFEIPVAAAATATAAAVVATTAAVSKQYELGNRSDGDAEGSGNEPKGSGDGENNALGANSEGGEKSDRSVSNDSTKSDLALDDVAEYDIPWEEITMGERIGLGSYGEVYRGEWHGTEVAVKRFLLQDISGESLEEFKSEVQIMRRLRHPNVVLFMGAITRPPNLSIVTEFLPRGSLYRLIHRPNNQLDERRRLRMALDAARGMNYLHNSTPVIVHRDLKSPNLLVDKNWVVKVCDFGLSRMKYSTFLSSRSTAGTAEWMAPEVLRNELSDEKCDVFSYGVILWELFTMRQPWGGMNPMQVVGAVGFQHRRLDIPDDVDTAIANIIRQCWQTDPKLRPTFAEIMALLKPLQKPITGSQAHRASVHAHSSRSAEDPAAA

SEQ ID NO: 26555 - protein, 458 aa, Streptomyces cattleya
MAGFLLRCRPEGAVPQHLGAGTGLATEVTRDGADVLVVHGDPLTPGGQAPIHAPLDELIAWTVRAYSRFCAVLVRDDRAVLWSDNGATCPLHYARGADDTLLVATSAGALLPLLGTAPVLGEGDRAVLPGGRFAGVTAVPAGTAVTLAVAGFDTEPLLTRRYHRLPARPTETDPERAVTAVRDALTHAVGRLATGLTEAGVMLSGGVDSSSVAALAAREVTSLSTYTVGTPFGDEFAQAAWFAERLGSKHHELVFEPEQLTALLPEMIRSLETWDLLTLQIAAPACFLLGHIATGARQVMLSGYGADLIFAGLGGTGTETRIERSVAAQTAATAVSNEFNPAYADARDVVVRYPYWTREVMSTALGIRGRLKVRPDTAKWVLRSAVTGILPDEVAWRPKRGIHEGTAMSRMFAAALGSDDRHTQARRLYEMATEVFRDTAAGTDELEGSDEGLAGVAS

SEQ ID NO: 26556 - protein, 85 aa, Panicum bulbosum
ECQKVGAPPEVSARLTAMTQELEARQCTALGGLGAATEPELDQFTEAYHEMLVKFREELTRPLQEAMEFMRRVETQFNSLSISGR

SEQ ID NO: 26557 - protein, 432 aa, Sulfolobus tokodaii
MDCIFIFRRDLRLEDNTGLNYALSECDRVIPVFIADPRQLINNPYKSEFAVSFMINSLLELDDELRKKGSRLNVFFGEAEKVVSRFFNKVDAIYVNEDYTPFSISRDEKIRKVCEENGIEFKAYEDYLLTPKSLFHHRNFTSFYNEVSKVKVREPETMEGSFDVTDSSMNVDFLLTFKKIESPLFRGGRREGLYLLHRNVDFRRRDYPAENNNYRLSPHLKFGTISMREAYYTQKGKEEFVRELYWRDFFTLLAYYNPHVFGHCYRREYDNISWENNESYFEAWKEGRTGYPIIDAGMRMLNSTGYINGRVRMLVAFFLVKVLFVDWRWGERYFATKLVDYDPAINNGNWQWIASTGVDYMFRVFNPWKQQEKFDPEAKFIKEWVEELKDVPPSIIHSIYKTKVPGYPSPIVNWLERVNYVKSEYKNVKAVL

SEQ ID NO: 26558 - protein, 484 aa, Streptomyces cattleya
MQVLLVNARRSPYSGESISAPQLGLLSLASVLREGTFHDTAGTDVHFIDDQLFVLQRPLSTPSEFLRGYRPDIVGIQVLTSSLKNGIKLASEVRHRHPNALTVLGGVGASPIARKLIEENAADVVVRGEGEYSFSQLVHEFGKNGRKNFAKVRGITFRDDEGEVVETPAAPQVVNLDKLPKPARDLADLDLYRRISRGRSGNLVTSRGCSYACAYCYSKHQWGVGQRRHSAARVVDEIRELVEVYGFDRIRIEDDDFVEDVPRMQELCDGIAKSGLQGKFEWEAKARPDLINDDMARMLRESGCFRLLVGVETLSWNLLKRLGRPVKVDVTERAISCLTNNGIGVQATMILGIPGETDEAMRTTITWLQARLGKNKHDLVSPCFFVPFHQEVEKDMAKRVDFTVETSDTDCYTGHIPVTSSMGASIDELWKLYDDMTPSRSQGQYKRIAFLANLQTVQTRLGLLDGDGASNLSNEPAALVPEVQ

SEQ ID NO: 26559 - protein, 147 aa, Staphylococcus aureus
EFLKAEGFDDIEWGEDFGAPHETAIANHYDLPVFITNYPTKIKPFYMQPNPENEETVLCADLIAPEGYGEIIGGSERVDDLELLEQRVKEHGLDEEAYSYYLDLRRYGSVPHCGFGLGLERTVAWISGVEHVRETAPFPRLLNRLYP

SEQ ID NO: 26560 - protein, 169 aa, Leifsonia xyli
MTERAILAGGCFWGMQDLIRKRPGVLRTRVGYTGGDVPNATYRNHGSHAEAIEIEFDPSRIGYRDLLEFFFQIHDPSTANRQGNDVGASYRSAIFYEDEEQRRVAEETIAEVDASGLWSGKVVTEVSPAGPFWEAGPEHQDYLERIPWGYTCHFPRPGWTLPKREAAGD

SEQ ID NO: 26561 - protein, 173 aa, Vitis vinifera
MARMSDPLIVGRVIGDVVDSFCSTVKMTVTYNSNKQVYNGHELFPSSVTIKPKIEVEGGDMRSFFTLIMTDPDVPGPSDPYLREHLHWIVTDIPGTTDSTFGREIVNYEMPRPNIGIHRFVFLLFKQKRRQTVNPPSSRDRFSSRNFAEENELGPPVAAVFFNAQRETAARKR

SEQ ID NO: 26562 - protein, 258 aa, Arabidopsis thaliana
MENGKSVDERDEFKETFDVTMDLIGGIDKRPDSIYKDKSRDECVGPELGLSLKRSCSVSFENQDESKHQKLSLSDASAFSRFEESKSAEKAVVALEESTSGEPKTPTESHEKLRKVTSDQGSATTSSNQENIGSSSVSFRNQVLQSTVTNQKQDSPIPVESNREKAASKEVEAGSQSTNEGIAGQSSSTEKPKEEESAKQRWSRSQREAALMKFRLKRKDRCFDKKVRYQSRKKLAEQRPRVKGQFVRTVNSDASTKS

SEQ ID NO: 26563 - protein, 380 aa, Lactococcus lactis
MAIEMLGLILAGGQGTRLGKLTKDVAKPAVPFGGRYRIIDFALSNCANSNVKNVGVITQYQPLTLNAHIGNGAPWGLNGINSGVTILQPYSSQEGSKWFEGTSHAVYQNISYIDQQNPEYVLILSGDHIYKMDYEAMLESHKEREASLTVSVMEVPLEEASRFGIMNTDDNDRIIEFEEKPKEPKSNLASMGIYIFNWKRLREVLVNGYSKGNPMEDFGGDVIPAYIEAGENVFAYRFKGYWKDVGTIDSLHQSSMEFLDLNNELNITDKSWRIYSHNDISAPQFITEKSNVKNALVGDGCYVDGTVLHSILSQNVHVQEGTVIEDSFIMSGTFIGENVTIKNAIIGENAKIGDNVEIIGENEVAVIGHGEIKGENKNEQ

SEQ ID NO: 26564 - protein, 283 aa, Hypocrea jecorina
MESQNQSAPTHPSHNRPTPVYDPTQGGHYGACAALASQGFAPAELYTGPWANVHQGLTGPYKDILTTYWQQTISHLESDTHDYKIHQLPLARIKKVMKADPEVKMISAEAPILFAKGCDIFITELTMRAWIHAEENKRRTLQRSDIASALAKSDMFDFLIDIVPREEATAHAKRTNTQPSAAQSVPGAGQAPMPGQHAGMAPAAGHPSSHSMATADYIGGHALPSEQDYRQPPSMYPGQVPQAPPAAYGQPQPQAAMYGEMDNMYQYSAMQPQQPPMPSEDFE

SEQ ID NO: 26565 - protein, 699 aa, Pseudoalteromonas tunicata
MSVTLEFLAGKPYPLGATLQNEGVNFAVFSAHATKIELCLFDASGHSEIARLAMLKGEEHVWHGFIKGAKAGMLYGFRAHGPYMPELGQRFNANKLLIDPYSKALHGEFRWSNLHSVELSEPLLNANFINNSDSASDTPKSKVVSLAKYTGQKPHIPWSKTVIYECHVKGATARHPGITPQKQGTFLGLSEPAFITHLKSLGVTTIELLPCHHFISERFLTDKGLKNYWGYNTLSFFAPHSDYLVNDNIAEFQTMVSRFHQAGIEVILDVVYNHTAEGNHLGPTLSWRGLDNLTYYRLDTANPRHYINDTGCGNTININHPRVLQLILDSLRYWVEVMGVDGFRFDLAPILGRQYSGFKSRHAFFQSINQDPILSQVKLIAEPWDIGPGGYQLGGFPIAWREWNDKYRDTMRRFWRGDLGLLPEFAQRLHGSNDLFEHNGRGPLASINFITAHDGFTLADLVMYQDKHNLQNGENNQDGHSENLSANYGVEGPSEDVQINALRLRQQKNFLLTLILSQGVPMFAAGSELGHTQQGNNNAYCQDNEINWLNFKESTVCNELSPFIRKLIELRDRFFVYKKLNYLHHNDVDFHLTWLSTSGIAMTAEDWTNHQNQQLGYFIEPRAHIKSQEVLLVLFNASDKTQFFTLPTRQNIKQWQLCLTTLAVNESHTHYSSSDIIAVAAKSCWILSAVIQETPHGTL

SEQ ID NO: 26566 - protein, 438 aa, Oenococcus oeni
MKVTFKKDYLKDFVADSEVELLKPTAGFVRDTLLARTGVGNEMEDWLTLPSDYDKEEFARILKVADKIKSDSKVLVVIGIGGSYLGARAVIEFLKSEFHNEKANKEGLPEVYFVGTSASGRYIDDVIDLIGNRDFSINIISKSGTTTEPAIAFRTFKSLIEKKYGKEEASKRIFATTDAHKGALLNVAKENGYERFVVPDGIGGRYSVLSAVGLLPIAVAGINIQKLMDGAKAAQEEFAKDEDILNKPSILYAIYRNILYRKGFDVETIVGYEPQFRFLFEWWKQLMAESEGKDNKGIYPTSAIFSTDLHSIGQYIQDGKKILFETILDITKPISDRVVPSADDNTDNLDYILNKPMKEVNEAALTATAQAHTSAGVPNILLQLDDLDEFNLGNLIYFFEAAVAVSGYLDGINPFDQPGVEIYKTNMFKILGKPGYTD

SEQ ID NO: 26567 - protein, 479 aa, Xanthomonas oryzae
MPIPTPDSRLPTPDSRLPTPDSRLPTPDSRLPTPDSRLPTPDSRLPNPKSQIPNPKSQIPNPGPPMTIKTLALQCRDAAQVVSQLSSQAKCALLQAMAAALEADAGTILAANARDLEAARAKGTASAMLDRLALDDKRLAGIAAALREVALLPDPVGRITREDVRPNGIRVQKVRVPLGVIAMIYEARPNVTADAAALCIKAGNGVILRGGSEAIHSNTAIARALQRALREANVPEAALTLVEDLRRETMLELLQLNDIVDLAIPRGGEGLIRFVAEHARVPVIKHYKGVCHLFVDASAEMELALRLLIDGKATRPSACNSLETLLVHADIAERFLPLAAQALRERKVELRGDAATRAVLPEIAPASDDDYAAEFLDLILAMRVVADLDTALAHIRQYGSDHTEVIATQDPDNAERFVQSLRSAVVMVNASSRFSDGGELGLGAEIGISTTRLHSYGPMGLEALTVERFVVRGEGQVRH

SEQ ID NO: 26568 - protein, 303 aa, Shewanella oneidensis
MQYFPLFIDTVNLNVLLVGAGDVASRKLALLTRTEANIHVIAPEVNTEVQAYADKGRILLSQRSVVQADIQNYDLIYLATADDKLNSELATLATERGIWVNAVDNPAFCRFITPSIVDRGRLVVAISTAGAAPVFARTIRSRLETSLPQSLKPLFDFVADKRIEVQQRLTKTATRRLFWERFFDTNGDRFDARTLEHYQNAFNHIVSRGEILLLDEATPVELLPLAAMPLLQRLDWIYSQESLTNELSEFVRRDANRGGLPTLSEISHEYEQGTRMLIVADTQKINQLKAHFPVAKHLRPGAI

SEQ ID NO: 26569 - protein, 346 aa, Unknown
  Candidatus Pelagibacter ubique HTCC1002
MTKVGEHITLDIIGTNREYDPSVYENVIRKIAKAAEVTILEISKYKFEPQGFTILALLAESHISFHTFPEKGIISFDFFTCGKVSPSIALDIVKKEFKHKRIVTKAFDRDTKSLYHDIYSSPGLQKSYVVNEVLEDFKSKVGQHIEILDLEQFGKSLFIDNEIQVATNDEVLYSSTFVNAALKLNKDMGTAAIIGGGDGGVARECMSKGFDFIDWYELDPEVVEVCNKHLGSIGNKSTEKNSVKCIWGDAFESIKSVEDDKYDKIFVDLNDDQFCIDLAAKNMDSLIRILKPNGVITAQVGSQDKKPEQVEKWLDVFNKNFGNTTLDRVYIPSFDCSWNFSSSINH

SEQ ID NO: 26570 - protein, 394 aa, Geobacillus kaustophilus
MEMMIMDNRRGLSLLFLVMFLVMAGFGIIIPVLPFYAETIGATPTQLGWLMAVYSLMQFLFAPMWGNLSDRYGRKPMLLVGIFGLALSFFLLAVATKLWMLFAARIIGGCLSAATMPAAMAYVADVTTEEDRGKGMGMIGAAVGLGFIFGPGIGGVFSKASLTAPFWMAGSLALLTALFVFVFLHESLPREKRMNIRTKRPSLAAALQGPVARLYLLQLITTFSLAGLEATFAYFAAERAGLSSTELGYIFMIMGLAGAIVQGGLLGKLIRSFGEGAVIRVGLFLSAVGFFLILFVHSFWTAALYLTIFGIGNGVIRPCVSALLTKYTADGQGSATGVLSSFDSLGRIGGPAIAGWLFTLKSSLPYMAGIVLTFISFAVFQSFQRAMMQKDSAL

SEQ ID NO: 26571 - protein, 595 aa, Oryza sativa
MITAADFYHVMTAMVPLYVAMILAYGSVKWWRIFTPDQCSGINRFVALFAVPLLSFHFISTNNPYTMNLRFIAADTLQKLMVLAMLTAWSHLSRRGSLEWTITLFSLSTLPNTLVMGIPLLKGMYGEFSGSLMVQIVVLQCIIWYTLMLFMFEYRGARMLITEQFPDTAANIASIVVDPDVVSLDGRRDAIETETEVKEDGRIHVTVRRSNASRSDIYSRRSMGFSSTTPRPSNLTNAEIYSLQSSRNPTPRGSSFNHTDFYSMVGRSSNFGAADAFGVRTGATPRPSNYEDDASKPKYPLPASNAAPMAGHYPAPNPAVSSAPKGAKKAATNGQAKGEDLHMFVWSSSASPVSDVFGGGAPDYNDAAAVKSPRKMDGAKDREDYVERDDFSFGNRGVMDRDAEAGDEKAAAAAGADPSKAMAAPTAMPPTSVMTRLILIMVWRKLIRNPNTYSSLIGLIWSLVCFRWNFEMPAIVLKSISILSDAGLGMAMFSLGLFMALQPHIIACGNKVATYAMAVRFLAGPAVMAAASFAVGLRGTLLHVAIVQAALPQGIVPFVFAKEYSVHPSILSTAVIFGMLIALPITLVYYILLGL

SEQ ID NO: 26572 - protein, 88 aa, Panicum bulbosum
  misc_feature (52)..(52): Xaa can be any naturally occurring amino acid
ECQKVGAPPEVSARLTAMAQELEARQRTAFGGLGAATEPELDQFMEAYHENXEMLVKFREELTRPLQEAMEFMRRVESQLNSLSISGR

SEQ ID NO: 26573 - protein, 435 aa, Thermoplasma volcanium
MSGKADPLEIAKEQVAPVKEEIEEDPFEIALKQLNKAAKVLNLDEQALEILSSPQKILQVSIPVKMDDGKVRVFTGFRVRHNIARGPAKGGIRYHPQETLSTVKALSMWMTWKCAIADIPYGGAKGGIICDPSTLSQGELERLSRGYIRAIADFIGPEVDVPAPDVNTNPQIMAWMMDEYENIVRHSAANVITGKPLEVGGSLGRFDSTGKGGMFVLREGAKKIGLDLSKARVAVQGFGNVGQFAVKFVQEMFGAKVVAVSDIKGGIYSENGFKFDDLLAWSKKIGSVVGFPGSKPITNEELLESDVDVLIPAAIEEQITEKNADKIKAKIILELANGPTTPEADEILYKKGKLVLPDVLSNSGGVIVSYFEWVQNNYGEYWTTEEVYDKLDQKITKAARQVLDTMDKYHVDPRTAAYVIAVKKVADAMKVRGWY

SEQ ID NO: 26574 - protein, 436 aa, Oryza sativa
MALLQFGGTLAPKLGEKPQLLPRSPALTRVIYADPRFLVSKSGSGGRLKHLVSPTASLQSRTSSRLFNHAPSPRFRHRRSSRFIVRADADFYSTLGVSRNASKSEIKSAYRKLARSYHPDVNKDPGAEQKFKDISNAYEVLSDDEKRSIYDKYGEAGLKGAGMGAGDYSNPFDLFESLLEGFGGMGGMGGRAARNRPMQGDDEAYNLVLNFKEAVFGVEKEIEITRLEGCNTCDGTGAKPGTKPTTCKTCGGQGQVVSSTRTPLGIFQQVSTCNTCGGTGEFSTPCNTCGGDGRVRKTKRISLKVPAGVDSGSRLRVRSEGNAGRRGGPPGDLYVFIDVLSDPVLKRDGTNILYTCKVSYIDAILGTTVKVPTVDGMVDLKIPSGTQPGTTLVMSKKGVPLLGKSNARGDQLVRVQVEIPKRLSSDERKLIEELAN

SEQ ID NO: 26575 - protein, 416 aa, Thermoplasma volcanium
MPESIDPFEMALQQLDKAARVLNLDEQALEILRQPEKILQVSIPVRMDNGKIKVFTGFRVRYNTARGPGKGGIRYHPDETLSTVKALASWMTWKCAIADIPYGGAKGGIICDPKSMSQGELERLSRGYIRAIADFIGPEVDVPAPDVYTNPQIMAWMMDEYENIVRHSAPNVITGKPLEIGGSEGRGDATAKGGMYVLREGAKRVGLDLSKATVAVQGFGNAGQFAVKFVQEMFGAKVVAVSDTKGGIFKSDGINYEALLDHKRKTGSVVGFPGSKPITNEELLESDVDVLIPAAIEEQITEKNADKIKAKIILELANGPTTPEADEILYKKGRLDLPDFLSNSGGVTVSYFEWVQNNYGEYWTAEEVYEKLDKKMTKAAHEVFDAMDKYKINPRTAAYVISVKKVADAMKARGMY

SEQ ID NO: 26576 - protein, 85 aa, Panicum bulbosum
ECQKVGAPLEVSARLTAMTQELEARQRTAFGGLGAATEPELDQFMEAYHEMLVKFREELTRPLQEAMEFMRRVESQLNSLSISGR

SEQ ID NO: 26577 - protein, 560 aa, Methylococcus capsulatus
MNSIPKRILIVGGVAGGATCAARARRLCETCEIVVFERGPHVSFANCGLPYFVGDVIPSEANLLVASPDLFARRFNIEVHTETEVIGLDRHARRIEVRDLRTGAVRPEPYDALVLATGAQPVRPPLPGIDLPGIHVLRTIPDSRGIKAAVAHAKRVVLVGGGFIGLEMAENLVGLGLEVTLLELADQVLPPLDPEMATYAAERLKTHGVSLRLGEGVEAFDKHPEHGLNLRTSKGGTIAADLVILGIGVRPESGLAAAAGLELGAFGGIRVDEYMRTSDAAIWAVGDVVEVKNRVTGEWQLVPLAGPANRQGRVAATAILHHFECSDGTPPPLKFEGVLGTAVCEVFGLTIACTGANEKVLRRAGMDYDKVYLHPGHHASYFPGAKPIHIKLLFSRTDGRILGAQAVGELDVARRIDVIATAMMQGATVFDLEDLELCYAPQFGAAKDPVNLAGMIAANHLRGDLSLAAWEALTETTALLVDVRSEAEFAAGHIPHARNLPLETLRDRLSELPRDREIWLVCGVGQRAYYAYRLLYRAGFNVKVLSGGMQTYRAWMRARD

SEQ ID NO: 26578 - protein, 542 aa, Methanosarcina barkeri
MLTVIQYLLDRLKQLGIRDIFGVPGDFAFPINNAICDDKELRWIGCCNELNAAYAADGYARVKGMSALSTTFGVGELSTLCGIAGSYAEYNLVFHIVGMPKMQAQKTHAIVHHSLGAGKSSIFMEMATPVVCASTMLTPENCVQEVERVIETALENHRPVYIAIPHDYVNADISSFNSPARKPVKSDPVALEEVVSIIAGKLLNAKQACVIPGFLVDRFGLKDLSMAVITASGLPYVTMALDKSVLDETNPSYLGLYMGQLINPEIRKFVESCDCILAMGTILSDVNTGKFTANLDKSRIINIMPSSVHIGYTDYINVKMLDVLEELTRRLNKRTDISGPVARRPAVPEVNAEDPITADYLYAKYAEFFKPDDIIIADSSSSFYGLIPLLLPKGAKFESQMLWGAIGWATPASFGTALAAPDRRVILITGEGSHQMTAQEISQFYRHGLKPIIFVLNNHGYLIERMLSEKVDYCYNDLVEWQYYKLPDVFGCNDWITSKVTTCGDLDKVMRELDNAKVGAYIEIITPKLSAPQLMETIHKNL

SEQ ID NO: 26579 - protein, 290 aa, Selenomonas ruminantium
MRNVTVAAIQMKMTAVVSENISKAEALVREAGAKGAQVILLPELFERPYFCQQRQYDFYAYATTVEENPAVKHFRPIAKELAVVMPISFYEREGTRLFNTIAMLDADGSVMGVYRKTHIPDDHYYQEKFYFTPGNTGFKVWIPAMAKSAWAFAGISVPRSCPAMALQGAEMLLYPTAIGSEPILETDSMPHWRRCMQGHAGSNLLPVIAANRIGVEQVEPCAENGGQSSSLDFYGSSFITDNTGAILVEAGRREEQVLTASFDLDQYAKDRLSWGLFRDRRPEMYQELVR

SEQ ID NO: 26580 - protein, 455 aa, Triticum aestivum
MEARRISATPRPCNGRRVVARKRPRQEAVISSVRKLQRREISSRRERSFAMNSAKERFRNIQLQEEFDTHDPKENNVLLPYIRKRSKIIEIVAARDIVFALSQSGVCAAFSRVTNKRICFLNGSPDEVVRSLFYNKNNDSLITVSVYGSENFSALRCKTTRIEYIRRGTPDAGFPLFETESLKWPGFVEFDDVNGKVLTYSAQDSTYKVFDLKNYTLLYSISDKNVQEIKISPGIMLLIYTRTSSSIPLKILNIEDGTVLKFFNHLLHRNKKVDFIEQFNEKLLVKQDGENLQILDVRNFQLTEVSSTEFMTPSAFIFLYELQLFLTFRNRSVAVWNFRGELVTSFEDHLLWHPDCNTNNIYITSDQDLIISYCKADSTDSSSEENAGSINISNILTGKCLAKIKAGNFNEQKKTWKFQNTITEALEDITALYYDEERDEIYTGNRHGLVHVWAN

SEQ ID NO: 26581 - protein, 610 aa, Aspergillus nidulans
MPIIFPPLAVLPQLTLHPSVNADHLDVAKIVNDWLFSFTEKLSSGQQSNISSLFLEKESWFRDFVSFSWDFASHNGAAAICEYLAGSTSGFAEPKADQPGALRPQLVEIGGLQFVQAGFSFRNTFGTGRGVLRLANVEPEEWKAWTVFTVLERLNGQDELEATRAEKAEAQAGASGYGTEPSSVQSDDGGLQVLVVGAGQCGLALAAHLQNLGLNYLVVDKFSRPGDSWRARYDTVRLHTPIYTDHYPFLKYPASWPRYLDRAHVTKWMEHYEEIMGLNVRHSTLASNFRYNETSRVWTVDLQSKDCIQTVHAKHVVLATGLLGAIPNRPTFPGEASFKGQILHTSAHKSAALMPEALKKKITIIGSGTSAHDIAQDFVNHGAENVTMVQRGAMYVVSRDSMERIQLPLWNTPGVSLEDADLLSHSLPIAVARTLSVGESQMMSAKDKDMLDALEKAGMAVKRGDGDSLLDYQLIKGGHFYADQGACQMIIDGRIKVRQCEQGVQGYYEDGVILANGTKIESEVVILATGFELSTKLIERLMGEDVMNKVARICTLHNSQERIGVWKPTGVPGFWYMTGSFIWSRQFSGILALQIAAIERGMNTEYYESR

SEQ ID NO: 26582 - protein, 85 aa, Panicum bulbosum
ECQKVGAPPEVSARLTAMAQELEARQRTSFGGLGAATEPELDQFMEAYHEMLVKFREELTRPLQEAMEFMRRVETQLNSLSISGR

SEQ ID NO: 26583 - protein, 407 aa, Thermus thermophilus
MVSTLKRDEALFELIALEEKRQREGLELIASENFVSKQVREAVGSVLTNKYAEGYPGARYYGGCEAIDRVESLAIERAKALFGAAWANVQPHSGSQANMAVYMALMEPGDTLMGMDLAAGGHLTHGSRVNFSGKLYKVVSYGVRPDTELIDLEEVRRLALEHRPKVIVAGASAYPRFWDFKAFREIADEVGAYLVVDMAHFAGLVAAGLHPNPLPYAHVVTSTTHKTLRGPRGGLILSNDPELGKRIDKLIFPGIQGGPLEHVIAGKAVAFFEALQPEFKEYSRLVVENAKRLAEALARRGYRIVTGGTDNHLFLVDLRPKGLTGKEAEERLDAVGITVNKNAIPFDPKPPRVTSGIRIGTPAITTRGFTPEEMPLVAELIDRALLEGPSEALREEVRRLALAHPMP

SEQ ID NO: 26584 - protein, 262 aa, Oryza sativa
  misc_feature (202)..(202): Xaa can be any naturally occurring amino acid
MAAAAETSAKVGAPRRWSLQGKTALVTGGTRGIGRAVVEELAALGATVHTCSRKEEELSERLKEWEARGFRVTTSVCDLSVRDQRERLLRQVADLFGGKLDILVNNVGTNIRKPTTEFSAEEYSFMMATNLESAYHLCQLSHPLLKASGSGSIVFISSVCGLVAVFSGSLYAMTKGAINQLTKNLACEWARDNIRSNSIAPXLLANKDFEGAVVSRTPLRRVGEPEEVSSLVAFLCMPGSSYITGQTISVDGGMTINGLYPS

SEQ ID NO: 26585 - protein, 85 aa, Panicum bulbosum
ECQKVGAPPEVSARLTAMAQELEARQRTSFGGLGAATEPELDQFMEAYHEMLVKFREELTRPLQEAMEFMRRVESQLNSLSISGR

SEQ ID NO: 26586 - protein, 1478 aa, Saccharomyces cerevisiae
MPFLRKIAGTAHTHSRSDSNSSVKFGHQPTSSVASTKSSSKSPRATSRKSIYDDIRSQFPNLTPNSTSSQFYESTPVIEQSFNWTTDDHISAGTLENPTSFTNSSYKNDNGPSSLSDSRKSSGGNSVNSLSFDKLILSWDPTDPDEWTMHRVTSWFKFHDFPESWILFFKKHQLFGHRFIKLLAYDNFAVYEKYLPQTKTASYTRFQQLLKKTMTKNVTNSHIRQKSASKLKSSRSSSESIKSKLKNSKSQEDISNSRSTSESALSPTKSGPSKTDEKNFLHSTSTHQKTKSASSLYRRSFISLRGSSSSNASSAKSPSNIKLSIPARPHSIIESNSTLTKSASPPASPSYPSIFRRHHKSSSSESSLLNSLFGSGIGEEAPTKPNPQGHSLSSENLAKGKSKHYETNVSSPLKQSSLPTSDDKGNLWNKFKRKSQIGVPSPNTVAYVTSQETPSLKSNSSTATLTVQTADVNIPSPSSSPPPIPKTANRSLEVISTEDTPKISSTTASFKETYPDCINPDKTVPVPVNNQKYSVKNFLLDQKFYPLKKTGLNDSENKYILVTKDNVSFVPLNLKSVAKLSSFKESALTKLGINHKNVTFHMTDFDCDIGAAIPDDTLEFLKKSLFLNTSGKIYIKDQMKLQQKPKPAPLTSENNVPLKSVKSKSSMRSGTSSLIASTDDVSIVTSSSDITSFDEHASGSGRRYPQTPSYYYDRVSNTNPTEELNYWNIKEVLSHEENAPKMVFKTSPKLELNLPDKGSKLNIPTPITENESKSSFQVLRKDEGTEIDFNHRRESPYTKPELAPKREAPKPPANTSPQRTLSTSKQNKPIRLVRASTKISRSKRSKPLPPQLLSSPIEASSSSPDSLTSSYTPASTHVLIPQPYKGANDVMRRLKTDQDSTSTSPSLKMKQKVNRSNSTVSTSNSIFYSPSPLLKRGNSKRVVSSTSAADIFEENDITFADAPPMFDSDDSDDDSSSSDDIIWSKKKTAPETNNENKKDEKSDNSSTHSDEIFYDSQTQDKMERKMTFRPSPEVVYQNLEKFFPRANLDKPITEGIASPTSPKSLDSLLSPKNVASSRTEPSTPSRPVPPDSSYEFIQDGLNGKNKPLNQAKTPKRTKTIRTIAHEASLARKNSVKLKRQNTKMWGTRMVEVTENHMVSINKAKNSKGEYKEFAWMKGEMIGKGSFGAVYLCLNVTTGEMMAVKQVEVPKYSSQNEAILSTVEALRSEVSTLKDLDHLNIVQYLGFENKNNIYSLFLEYVAGGSVGSLIRMYGRFDEPLIKHLTTQVLKGLAYLHSKGILHRDMKADNLLLDQDGICKISDFGISRKSKDIYSNSDMTMRGTVFWMAPEMVDTKQGYSAKVDIWSLGCIVLEMFAGKRPWSNLEVVAAMFKIGKSKSAPPIPEDTLPLISQIGRNFLDACFEINPEKRPTANELLSHPFSEVNETFNFKSTRLAKFIKSNDKLNSSKLRITSQENKTE

SEQ ID NO: 26587 - protein, 174 aa, Xanthomonas campestris
MPLTDLQHVPGATAAPADTQGFVFNHTMLRVKDAPRSLDFYTRVLGFRLLDARDFAEAKFSLYFLALLPEGTAVPDDDAARRLWMAGIPGVLELTHNHGTETQDGAVYHDGNSDPRGFGHICISVPDIHAACARFDSLGVPYQKRLEDGRMKHLAFIKDPDGYWVEIISNTPLA

SEQ ID NO: 26588 - protein, 152 aa, Arabidopsis thaliana
MAEAARRQGGGRPLPPPPRGVNQQPPRPKPEPVDREKTCPLLLRVFTKSGGHHTSEDYAVRSKEPKDEVQIYTWKDASLRELTDLVKEVSVAARRRNARLSFAFVYPNNKGGYNVREVGETMAYPNRKQPDDSKTLSELPFEIGDYLDVAIY

SEQ ID NO: 26589 - protein, 159 aa, Streptococcus pyogenes
MPNLYDFTVKAQDGSDISLVNYKEKVVLVVNTATKCGLTPQYQALQALYDTYHDKGFEVLDFPCNQFLNQTPGEAEEINRFCSLTYHTTFPRFAKIKVNGKDADPLFTWLKEEKSGPLGKRIEWNFTKFLIDQNGQVIKRYSSKTDPKLIEEDLKALLG

SEQ ID NO: 26590 - protein, 346 aa, Arabidopsis thaliana
MENTDELVSIELPAPASWKKLFYPKRAGTPRKTEIVFVAPTGEEISSRKQLEQYLKAHPGNPVISEFEWTTGETPRRSSRISQKVKATPDKEPLLKKRRSSLTKKDNKEAAEKNEEAAVKENMDVDKDGKTENAEAEKEKEKEGVTEIAEAEKENNEGEKTEAEKVNKEGEKTEAGKEGQTEIAEAEKEKEGEKAEAENKEAEVVRDKKESMEVDTSELEKKAGSGEGAEEPSKVEGLKDTEMKEAQEVVTEADVEKKPAEEKTENKGSVTTEANGEQNVTLGEPNLDSDAEQIREKNPKNMMRRRQKLRRIRKMTLKNLMRRRQKLQQIRRTKPKSLMSRRPKLQ

SEQ ID NO: 26591 - protein, 85 aa, Panicum bulbosum
ECQKVGAPPEVSARLTAMTQELEARQRTAFGGLGAATEPELDQFMEAYHEMLVKFREELTRPLQEAMEFMRRVESQLNSLSISGR

SEQ ID NO: 26592 - protein, 303 aa, Unknown
  Mycobacterium sp. MCS
MSPMTIGHVTVLTNPLSGHGNAPHATERAVARFQRRGVDVTAIVGTDAAHARRLVDEALAGGTDALVVVGGDGVISLALQALAHGDVPLGIVPAGTGNDHAREYRLPTGDPEAAADVIADGHTETVDLGRIDDASGGHKWFGTVMAAGFDSLVSDRTNRMRWPHGRMRYNVAMVAELSKLRLLPFRLRFDGGEEVRTDLTLAAFGNTRSYGGGMLICPDADHTDGLLDVTMVHSASRTRLIRLFPTVFKGTHVNLDDVTTARARVVEVDCPGINAYADGDYACPLPVTVSAVPGALRILVPAP

SEQ ID NO: 26593 - protein, 301 aa, Oceanobacillus iheyensis
MKTVAVIVNPNAGNQQLKNEIDTIEARLKDVFEEVTIYKTEKEGDGKKIIEKIYSKVDLIIGGGGDGTIFELVNALAPLDHRPAFAVLPGGTCNDFSRTIGMNQNPLVALEQILQKQIKTVDVGKYNENYFLNFWGIGIISKVAKEMEGDNKKLLGKMSYYINTSKVVFQNETFQLKVTSEEMNYDEEAVMMVVGNGAFLGGMKSFFPHADIQDGKFDVLIIKLAKLQHFWTWLETQMQNDYPDNRNDEVMYFRTSKLQVESSPEQNIDSDGEILTQTPAEITVLPKHLKVVIGDEAFGTV

SEQ ID NO: 26594 - protein, 673 aa, Methanocaldococcus jannaschii
MEFKIVNTICPYCGVGCGLGLVVKDGRVIGIHPNKRHPINEGKLCAKGNYCYQFIHSKDRLTKPLIKKESGFVETTWNKALEVIAENLKTYKDEIGFFSSARCTNEDNYILQKFARVALKTNNIDHCARLCHSATVTGMSACFGSGAMTNSIEDIELADCILIIGSNTFEQHPLIARRIMRAKDKGAKIIVIDPRRTITAKNSDIYLQIIPGTNVALINAMINVIIKENLIDKEFIKNRTEGFEKLKEIIKKYTPEYASKICGVDKELIIESAKIYGNAERASIIYCMGVTQFTHGVDAVKALCNLAMITGNIGKEGTGVNPLRGQNNVQGACDMGALPNVFPGYQKVEDGYKLFEEYWKTDLNPNSGLTIPEMIDESGKNIKFLYIMGENPIVSDPDVKHVEKALKSLDFLVVQDIFLTETAKLADVVLPAACWAEKDGTFTNTERRVQLIRKAVNPPGEALEDWIIIKKLAEKLGYGDKFNYNKVEDIFNEIRKVTPQYRGITYKRLKIDGIHWPCLDENHSGTKILHKDKFLTDNGRGKIFPVEYREVAELPDKDYPFILTTGRIIFHYHTGTMTRRCKNLVEEINEPFIEINPDDAKSLKIENGDLVKVISRRGEITAKARITEDIKKGVVFMPFHFVEANPNVLTNTALDELCKIPELKVCAVKIERI

SEQ ID NO: 26595 - protein, 543 aa, Schizosaccharomyces pombe
MPAMKRKKLDMESSRWFPKGETCFQRWYRSFLPPEDGKPQKLKRTLTARHIQMIGIGGAIGTGVWVGSKNTLREGGAASVLICYSLVGSMVLMTVYSLGELAVAFPINGSFHTYGTRFIHPSWGFTLGWNYLASFLATYPLELITASICLQFWININSGIWITVFIALLCFVNMFGVRGYGEVEFFVSSLKVMAMVGFIICGIVIDCGGVRTDHRGYIGATIFRKNAFIHGFHGFCSVFSTAAFSYAGTEYIGIAASETKNPAKAFPKAVKQVFIRVSLFYILALFVVSLLISGRDERLTTLSATAASPFILALMDAKIRGLPHVLNAVILISVLTAANGITYTGSRTLHSMAEQGHAPKWFKYVDREGRPLLAMAFVLCFGALGYICESAQSDTVFDWLLSISNLATLFVWLSINVSYIIYRLAFKKQGKSYDEVGYHSPFGIYGACYGAFIIILVFITEFYVSIFPIGASPDAGAFFQSYLCFPVVVIVFIAHALITRQKFRKLSEIDLDTGFSKYDRLEESDKGPMTAKSLAKSVLSFCV

SEQ ID NO: 26596 - protein, 843 aa, Nicotiana sylvestris
MALCLNNKNQIMDNSKYVRYTPEQVEALERVYAECPKPTSLRRQQLIRECPILSNIEPKQIKVWFQNRRCREKQRKEASRLTTVNRKLSAMNKLLMEENDRLQKQVSQLVYENGYMKQQINTVSSTTTDTSCESVVVNGQQQRKNPTPQHPERDANNPAGLLAIAEETLAEFLGKATGTAVDWVQMIGMKPGPDSIGIVAVSRNCSGVAARACGLVSLEPTKVAEILKDRPSWYRDCRCLNILSVIPTGNGGTIELIYLQTYAPTTLASARDFWTLRYTTSLEDGSLVICERSLTTATGGPTGPPATSFVRAEMLPSGYLIRPCEGGGSMIHIVDHIDLDAWSVPEVLRPLYESSKILAQKTTVAALRHIRQIAQETSGEIQYTGGRQPAVLRALSQRLCRGFNDAVNGFVDDGWTVMDSDGVEDVTVAINSSSTKFLGSQYNTLSILPTFGGVLCARASMLLQNVPPALLVRFLREHRSEWADYGVDAYSAASLKASPYAVPCARPGGFPSSQVILPLAQTVEHEEFLEVVRLEGPAFSPEDIALSRDMYLLQLCSGVDENASGACAQLVFAPIDESFGDDAPLLPSGFRVIPLEPKSDGPAATRTLDLASTLEAGTGGTRPAGEIEASNYNHRSVLTIAFQFTFESHYRDNVAAMARQYVRSIVGSVQRVAMAIAPSRLSSQLTPKPFPGSPEAVTLARWISRSYRVHTGGDLLQVDSQDGDAVLKQLWHHSDAIMCCSVKMNASAVFTFANQAGLDMLETTLLALQDIMLDKILDEAGRKVLLSEFSKIMQQGFAYLPAGICVSSMGRPVSYEQAVAWKVLNDEDSNHCLAFMFINWSFV

SEQ ID NO: 26597 - protein, 197 aa, Arabidopsis thaliana
  misc_feature (55)..(55): Xaa can be any naturally occurring amino acid
  misc_feature (94)..(94): Xaa can be any naturally occurring amino acid
  misc_feature (125)..(125): Xaa can be any naturally occurring amino acid
  misc_feature (189)..(189): Xaa can be any naturally occurring amino acid
VRLKLRTFFVFIDANYRSIDRSRRVRPKSLSESSVKVGTAVVPWKGGRLALGRLXGDICEQLAELTSDGSEVSLGSSGAVGLARQRVRYSNSSXSSSFADLQKSQMGLDGKPSMLVLRQSSVMQXYEIMFGQWDVAAVQMPVSDSSHSDKVFRNRISVTVKGMQRMRVIPVFNEKDAIDAGRDGYKDHXGIFCDNRI

SEQ ID NO: 26598 - protein, 340 aa, Zymomonas mobilis
MPVLEEKKTADHFHHIGVLGAGSWGTALAAVASYKGAVTLWGRKREIIDAINQRHINPDYLPDIIIPRTIHATDELNDLSSASALLVAIPAQKMRSVLRQIPNDSRPLILCAKGIEAESGLLMSQLAADIFPHRPIAVLSGPTFASEVARHLPTAVTLAAKEKDIRAALMQRLAIPTFRPYASSDVIGADVGGAVKNVLAIACGVVAGAKLGNNARAAVISRGFAEMNRFGIALGAKEETLTGLSGLGDLVLTCSSELSRNFTFGKKLGEGYSYEEQQKKRAVTTEGVFTAPVLQRVANKLKVEMPLVSAICDLIEGKSVNSVLERLLSRPLKGEYSISV

SEQ ID NO: 26599 - protein, 380 aa, Zea mays
MALAVRTPRFQPRPASISAPTTPASNSLAAAAAANARPRPCAGAAVRASPFTEATSSSRYRRDAWSYAADGSSNSASPSSAAAAAAGRRDDEIALQLPELRRLLDVLRASRGRGAEEGGGPGRVALVGTGPGDPELLTLKAVRAIEAADLVLYDRLVSNDVLDLVGEGARLLYVGKTAGYHSRTQEEIHELLLSFAEAGANVVRLKGGDPLVFGRGGEEMDFLQQQGIKVEVIPGITSASGIAAELGIPLTHRGVATRFLTGHSRNGGTDPLYVAGNAADPDTTLVVYMGLSTLASLAPKLMKHGLPPDTPAVAVERGTTPQQRMVFALLKDLVDEVKSADLVSPTLIIIGKVVSLSPFWVESSEHDALKIESSYASEAR

SEQ ID NO: 26600 - protein, 1185 aa, Lactobacillus acidophilus
MKKYNKWGTKGVFICASALLSVWLGATWTDGNVQAAETPDAGNQASTEVSQRVITENEKKTVVQPAKDTQTDEKDTDNTQLASATPSEETTQVEEAKQQALKDTTKVVVHYQGDGSKWVPYIWGKKPNGNGNQYKWDGKDDYGYYSNITVDGNEQEMGVLIKGKDSWDKDGQGNDRIVKVGDNGKAEVWYKEGSDEAQDVKPTYDSAKVNIHYQGNDDVTSISYWTNTDPQNKKIIDLSKSDVQEKEGSFDLSNTKFNSIFVAPIGTDTEVREFTPLPGKSATDIYLVTKDPTVYYTKSFALATQSLTSASMDSGKTVNIQTGKEMTAAEAKKNLSIKDNSIVNVVAVNPDQDGKSKQFTITTAQDLSILDNNQIGIYGNYKSIDIGSYVRSKDFDTKYYYNGDDLGATYTEKQSQIKLWAPTAKKVVLNLYDSLNNDASATKTFVMNRGDKGVWSVILPGDYKNWAYDYSLSFGNGTTTQTNDPYSKAVTINGDRSVIEDVDAIKPNDFSRLPQFSAPTNAIIYETSIRDFTSDKNSGIKDKGKYLGMIESGVTPDGQITGLDYLKSLGVTHVQIMPMFDFASINESKADDSYNWGYDPKNYNVPEGSYSSNAADPTTRIMEMKEMINGLHKAGIRVVMDVVYNHVYNTDEQSLNKTVPGYYFQYDSEGHTTNGTGCGNDMASERLMARKYIVDSVKYWAKNYNIDGFRFDLMGILDVDTMNEVRSELNKIDPSILVYGEGWDMRKTDHDIGAGQYNADKVDKSIGFFSDDIRNAIKGAEFGGVTPGLVEGNGKEENYKEDAKKFIDGFLGGQNYGKDAKHPYQAPEQTINYVACHDNRTLYDMLKTLMPDESEANIIKRDKLATSMMMLSQGIPFIHAGQESLGTKDGNENSYNASVEVNEINWGRVKENKDMVDYFKKLVNLRKSQSVFRQNDYSQINKNVKVLNDGQNGVFAFEYNTNGKKLYVAFNVNDKDAKLENVDLSVATKLLDSDGNTQIGKESVLKPLSTLVAEVSTKEAKPDDSSSIINPPVNTNIGDNNTDTLLSTVDIVLTHNAYIYENDGITTVKANDGKNVTLKVGQTIHALNKAQIVILNNKEFYQIGDNQYVKVNNTLNWNILKHNSFVYSKSGKALKKNHKRILLKKGHKVLLLDNACLTKIHGKQFYRIGNNKYVKAVNVVIEVKA

SEQ ID NO: 26601 - protein, 115 aa, Arabidopsis thaliana
MPSLQTSLPPELANNVVRLYRECLRRAKFIGKQSLSNLEQNVERFSFVSVDSLEQHNTELVVGMVRQQFKKHMNETDPEKIQKLKDDAARGLINHMLFESAKLTGGKANNATKLA

SEQ ID NO: 26602 - protein, 221 aa, Arabidopsis thaliana
MADSSSDKEKKENNKQPVYRGVRMRSWGKWVSEIREPRKKSRIWLGTFPTAEMAMRAHDVAAMSIKGTSAILNFPELSKLLPRPVSLSPRDVRAAATKAALMDFDTTAFRSDTETSETTTSNKMSESSESNETVSFSSSSWSSVTSIEESTVSDDLDEIVKLPSLGTSLNESNEFVIFDSLEDLVYMPRWLSGTEEEVFTYNNNDSSLNYSSVFESWKHFP

SEQ ID NO: 26603 - protein, 332 aa, Burkholderia vietnamiensis
MKVAVLGAGAWGTALAGHLAARHDTLLWARDAALIAGLQARHENSRYLEGIALPDALRYDADLDAALAHGAADDALCVIGAPVAGLRTLLRAMRDARCVPAHVVWVCKGFEADTHLLPHQVIAAELPEQRSNGVLSGPSFAREVGLGLPVALTVASASAACRERTLAAFHHGAMRIYTGDDVVGVEVGGAVKNVLAIATGIADGLGLGLNARAALITRGLAEMSRLGVALGGRAETFTGLTGLGDLILTATGDLSRNRTVGLQLASGRSLADILGALGHVAEGVRCAQAVLALAHAHAIEMPITEAVCGVLFDGVAPRDAVSGLLRRDARAE

SEQ ID NO: 26604 - protein, 286 aa, Pseudomonas aeruginosa
MSDYQETLYQGYGQRFSIDNMLHEVRTEHQHLVIFENARMGRVMALDGVIQTTEADEFIYHEMLTHVPILAHGAARRVLIIGGGDGGMLREVAKHKSVERITMVEIDGTVVDMCKEFLPNHSQGAFDDPRLNLVIDDGMRFVATTEERFDVIISDSTDPIGPGEVLFSENFYQACRRCLNEGGILVTQNGTPFMQLEEVRTTAARTDGLFADWHFYQAAVPTYIGGAMTFAWGSTREGLRRLPLETLRQRFRDSGIATRYYNADIHLGAFALPQYVLQAIGKQDND

SEQ ID NO: 26605 - protein, 176 aa, Shewanella oneidensis
MKHTTEVMISAEEISKKLDQMAEQINAHYANSERLLMVGLLKGSVVFMADLCRRIKGHVEIDFMSVSSYGNAMTSSRDVKVLKDVQSDIADRDVLIVEDLIDSGNTLNKVREMLLLREPKSLALCTLLDKPERREVDVKVDFIGFTIPDEFIVGYGIDYAEQYRNLPYIAKVVPLE

SEQ ID NO: 26606 - protein, 326 aa, Rhodopseudomonas palustris
MDRESEIGPDLEEAAPSDGSDLGSAIPQAAPTRRLLMVINRGSRSGSQAVGLAGSKLSAAGFDLVVSAPSSRHEVAPWIEAHAEGAAAVVIAGGDGTLNAAAPALMKTRLPLGVIPAGTANDLARTLGLPLDMEAAADVIAAGHRKIIDLGDVNGHKFFNVASVGLSTDLARELSGESKRRFGRLSYALTAVKVLSKARPFHAVIVSGEEQVRVKTMQVAVGNGRYYGGGMAVEHTAEIDDGQFDLYSLEFAQVWKLLAVAYDFRKGRHGLWREVRAARGTSFEIRTRKPRPVNADGELVTFTPARFELLREAVSVFVPKDPAPRG

SEQ ID NO: 26607 - protein, 202 aa, Hypocrea jecorina
MNPEYDYLFKLLLIGDSGVGKSCLLLRFADDTYTESYISTIGVDFKIRTIELDGKTVKLQIWDTAGQERFRTITSSYYRGAHGICVVYDVTDMDSFNNVKQWLQEIDRYATEGVNKLLVGNKSDMSDKKVVEYTVAKEFADSLGIPFLETSAKNASNVEQAFLTMARQIKERMGTTTANNTKPSVHVGQGQGVGNSSSSSCC

SEQ ID NO: 26608 - protein, 346 aa, Triticum aestivum
MLGVGEMNHRLEANGHGKPVAMAKQEQLQQRGDHEETLWYEEEIHDDLKICYALNSVLHRGKSKYQEIALVDTKCFGKALIIDGKMQSADADEFIYHESLIHPPLLFHPNPETVFIMGGGEGSAAREALKQKTVQRVVMCDIDEEVVHFCRTHLSVNWDAFASDKLCLVINDARAELEKMREEKFDVIVGDLADPMEGGPCYQLYTRSFYEQVLKPRLHDGGIFVTQAGPAGVLTHKEVFSSIYNTLRHVFKHVKAYTAHVPSLADTWGWVMASDHPFTLTAQQINERITDRIDGELSYLDGETLISSTTLNKTVFHSLLNERHVYTEDDARFVHGHGTGRAAMLN

SEQ ID NO: 26609 - protein, 85 aa, Panicum bulbosum
  misc_feature (42)..(42): Xaa can be any naturally occurring amino acid
ECQKVGAPSEVSARLTAMTQELEARQRTAFGGLGAATEPELXQFMEAYHEMLVKFREELTRPLQEAMEFMRRVETQLNSLSISGR

SEQ ID NO: 26610 - protein, 173 aa, Pseudomonas syringae
MSLHELNTLPGVTANPEAPTRQFVFNHTMLRVKDITQSLDFYTRVLGFSLVEKRDFPEAEFSLYFLALVDKAQIPDDDAARNEWMKSIPGILELTHNHGTESDANASYHNGNSDPRGFGHICVSVPDVKVACERFEALGVDFQKRLSDGRMNSLAFIKDPDGYWVEIIQPTPL

SEQ ID NO: 26611 - protein, 350 aa, Arabidopsis thaliana
MVMETESKFHVLAVDDSLFDRKMIERLLQKSSCQVTTVDSGSKALEFLGLRVDDNDPNALSTSPQIHQEVEINLIITDYCMPGMTGYDLLKKVKESAAFRSIPVVIMSSENVPARISRCLEEGAEEFFLKPVKLADLTKLKPHMMKTKLKKESEKPVAIEEIVVSKPEIEEEEEESSVIEILPLHQEIESEQLEPMLSSNKRKAMEEVVSTDRSRPKYNDITTSNLSVEDLLTLASEANNNGLQGGLTQPEKPLQDLYGECQQNLSVEDLLTLEYEANNNGLLGVIPQQHRYHQEKETMQTQGDPLNRIPIQSEASNHSDSGDSTLTMAQNQDGLGHSSCFILCQFTSLP

SEQ ID NO: 26612 - protein, 551 aa, Oryza sativa
MEASDEDRPLIHHLPPQEQCSKYTCDGTVNIDSVEFTECICFYGVSKNLVTYLTSVLHESNVNAAQSVSIWIGSCFFTPLIGAFLADTYWGRYWTVVMSILVIILGMIVLTVSASPLFLNASFYNGGISRLTVYLGLYLFALGTGGIKPNIPAFGADQFDGADPVERVTKGSFFNWYYFSINVGSLLSSTVVVWVQDNIGWSVGFAGPMLLLGFGLAMFIAGRRAYRYKKLGGSPLTRVFQVLVAAVRNHRLNLPDDSSLLHELPGVTEGDYRTQHTYQFRFLDKAAILSDKNCAPAAPSSPWRLCTVSQVEELKMLLRTFPVWASLVGFFMVTAQMTSTLIEQGVAMDGRVGRFTVPPASLATFDVVAVLALIPVYDAALVPLARRVTGRDRGVSHMQRIGVGLALSAVAMAYSALVEARRLAMAAAAAGTRMSIAWQVPSFFVLGAGEVFAVIGMLEFCYEQSPASMKSLGTALVQLAVAVANYLNSGMLRVVAAATARGGGAGWIPDKLDEGHLDYFFWMMAALSVLNLLQFLHCSIRFRGNNTLSSS

SEQ ID NO: 26613 - protein, 714 aa, Brassica napus
GGVGGSGSGGGDGGGSGSGSQQHHDGSETDKKKKRYHRHTAQQIQRLESSFKECPHPDDKQRNQLSRELGLAPRQIKFWFQNRRTQLKAQHERADNNALKAENDKIRCENIAIREAIKHAICPNCGSPPVNEDPYFDEHKLRIENAHLRDDLERMSTVASKYMGRPISSHLSTLHPLHISPLDLSMTGPSLDFDLLPGSSMHSQPNNNLATISDMDKPLMNDIALTAMEELLRLFNTNEPLWTRGDGGREILDLGSYENLFPRSGNRGKNHNVRTEASRSSGIVFMNAMTLVDMFMDGVKWGELFPCIVASSKTLAVVSSGMGGTHEGALHLMYEEMAVLSPLVATREFCELRYCQMIEQGSWIVVNVSYHLPQFVSQSSHSYKFPSGCLIQDMPSGYSKVTWVEHVETEEKEQTHELYREVIHKGIAFGAERWVTTLQRMCERFASLLAPSTSSRDLGGVIPSPEGKRSMMRLAHRMVSNYCLSVSRSNNTHSTVVAELNEVGVRVTAHKSPEPNGTILCAATTFWLPNSPQSVFNFLKDERTRPQWDVLSNRNAVQEVAHIANGSHPGCCISVLRASNASQSQSNNMLILQETSIDSSGALVVYSPVDLPALNIAMSGDDTSYIPLLSSGFAISPDGNHSSSTTEQGGGASTSSGFGGGGSLITVGFQIMVSNLPSAKLNMESVETVNNLIGTTVHQIKTGLNNCPSGSTTA

SEQ ID NO: 26614 - protein, 463 aa, Burkholderia thailandensis
MKGSQTGLGTGLKQRHVTMLSIAGVIGAGLFVGSGHAIAEAGPAALIAYAIAGLLVVLVMRMLGEMAVAQPDSGSFSTYADRAIGHWAGFTIGWLYWWFWVLVIPIEATAAATILNAWFPGVATWIFALGITSVLTVTNLFSVKNYGEFEFWFALIKVVAIVVFLAIGGAAIVGLLPGSNVSGAARLVNAGGFMPNGIGAVLAAMLTTMFSFLGTEIVTIAAAESEHPERQIVRATNSVIWRISLFYLGSIFVVAALVPWNDALLPAHGSYQRAMELIGVPHAKAIIDVIVLVSVASCLNSALYTASRMIFSLSRRGDAPALLRRTDASGTPRAAVLASTAFGFITVIANYVMPEQVFGFLLATSGAIALLVYLVIAISQLRMRKMLDATGERLQLRMWCFPWITWAVILFICGVLTVMLVSEAHRMEVGATAVLALIVLAASWLNKRGRDAQASVGRRVSAT

SEQ ID NO: 26615 - protein, 71 aa, Rickettsia prowazekii
MSKDDLIQFTGTVLELLPNATFRVKLENDHIIIAHTSGRMRKNRIRILLGDKVTVEMTPYDLTKGRVIHRH

SEQ ID NO: 26616 - protein, 116 aa, Brassica napus
  misc_feature (21)..(21): Xaa can be any naturally occurring amino acid
  misc_feature (78)..(78): Xaa can be any naturally occurring amino acid
  misc_feature (81)..(81): Xaa can be any naturally occurring amino acid
  misc_feature (108)..(108): Xaa can be any naturally occurring amino acid
  misc_feature (115)..(115): Xaa can be any naturally occurring amino acid
MASSMLSSAAVVTSPAQATMXAPFTGLKSSAAFPVTRKANNDITSIASNGGRVSCMKVWPPVGKKKFETLSYLPDLTXVEXGVKEVDYLLRNKWNFLCVEFELEHGFXVYREHGXH

SEQ ID NO: 26617 - protein, 85 aa, Panicum bulbosum
ECQKVGAPPEVSARLTAMAQEPEARQRTALGGLGAATEPELDQFMEAYHEMLVKFREELTRPLQEAMEFMRRVESQLNSLSISGR

SEQ ID NO: 26618 - protein, 369 aa, Leifsonia xyli
MADHYEVLGVERNATPDEIKKAYRRLARELHPDVNPSTEAQERFKLVTHAYDVLSDPQQRQQYDRGGASGFGGGGGADFSGFGDIFETFFGGGGASRGPRSRRERGQDALLRVEVDLDEVVFGAHRDLEVDTAIVCETCDGSCCQPGTAPVPCDICHGTGSIQRSVRSLLGNVMTSSPCGSCRGYGTVIATPCVTCQGQGRVRARRTVPVDIPAGVDTGLRLQMPGSGEAGPAGGPNGDLYLEIKVKHHDVFSRDGDDLLCTLEVSMADAILGAAATIKALDGDIRLELKPGTQSADIVSVKDRGITHLRCSGRGDLRVGIQVVTPTKLDHREKELIKKFAESHKASEPSLARFQQGLFAKLRDRFLNV

SEQ ID NO: 26619 - protein, 471 aa, Arabidopsis thaliana
MDHDLDKFPLLSYVLHQHDSNLHAPPSMAAQETLLPSFPLLSNPEIMSMLTQSIPTTITQTLFVFNSLGSRPDPLAVSSARFKIAQIMDSLSPEEAAKESEIYAGVVRLDEVHDSYEKKLKDTEEELSRVYSTEVESMLRSGEEVNEKVLAVLKEAESGGTVERIDLSSQELKLIPEAFWKVVGLVYLNLSGNDLTFIPDAISKLKKLEELDVSSNSLESLPDSIGMLLNLRILNVNANNLTALPESIAHCRSLVELDASYNNLTSLPTNIGYGLQNLERLSIQLNKLRYFPGSISEMYNLKYLDAHMNEIHGIPNSIGRLTKLEVLNLSSNFNNLMGVPDTITDLTNLRELDLSNNQIQAIPDSFYRLRKLEKLNLDQNPLEIPSQEVATQGAEVVREFMRKRWGDIMAEQQQRIGVEAERHGDENGWVYWGTSMVTNLVSGVTHTIGFGGATSDGGDKKPGDSYFYHQI

SEQ ID NO: 26620 - protein, 927 aa, Alkalilimnicola ehrlichei
MTRPASDTTRAITFTLDGETVTAGPGETLLQVARRQGQALPTLCHQPGYRPAGNCRACMVEIEGERVLAPACVRQPSPGMVVHSTSGRAARARRMVLELLQSDMPAAARTPDNELQQWCDRLGVDAPRFPARSQPAPDASHPAMSVRLDACIQCTRCLRACREEQANDVIGMAHRGDRTAVVFDLADPMGRSSCVACGECVQACPTGALLPAGDRPPEAPDRRVDSVCPWCGVGCLLTYELKGERILRVQGRPDGPANRGRLCVKGRFGQDYVRHPGRLTRPLIRRKDAPKTLPVDFDPGAPLRYFREADWEEALDRAADGLLRIRDRHGPRALAGFGSAKGSNEEAYLFQKLVRTGFGSNNVDHCTRLCHASSVAALMEGLGSGAVSNPVSDVAHCELILVIGANPTVNHPVAATFMKNAARAGKHLVVMDPRRTELAREADRFLQFRPDTDVALLNAMMHTIIEEGLTDEGFIAERTEGFEALRDRVMADYSPEAMAPVCGIPARTIREVARQYARSRSMIFWGMGVSQHVHGTDNARCLIALALMTGNLGREGTGLHPLRGQNNVQGASDAGLIPMFYPNYAPVGDPDTRRWFERFWGVAALDPEPGLTVVEVVDAIHAGGVRGMYILGENPAMSDPDLNHAREALARLDHLVVQDIFLTETAAFADVVLPASAFPEKSGSFTNTDRRVQIGRQALDPPGDARQDWWLIQAIARRMGLDWQYDGVAAVFEEMRRAMPAIRGITWTRLQREDSVTYPCDTEADPGQPVLFRDRFPRGRGRFVPAPFSRADELPDQAYPWVLITGRQLEHWHTGAMTRRSRVLDALEPAPTVCLHPEDLAALGASPGEAVTLHSRRGRLTAYARADDGLQRGEVFLPFAYVEAAANLLTNAALDPWGKIPEFKFCAVRISAGGQVPAARFGIAPTA

SEQ ID NO: 26621 - protein, 298 aa, Buchnera aphidicola
QKKAYKLVSSMLKNISAKFKNEPCVSYIGPNGAGHYVKMIHNGIEYGDMQLIAESYFLLKYLLNMSNKELANTFSEWNQGELNSYLIDITKDIFLAKDNNGNYLIDCILDVAEDKGTGKWISQDALELREPLSLITESVFLRYLSSLKSQRVAASKILTGPNIERGVIKDKKIFIEEIRRALYLGKIISYAQGFSQLKKASEKYNWDLKYGEIAKIFRSGCIIRAKFLQKITEEYSYNEKIVNLLLTPYFSKIANKYETSLRKIVVESVKNGIAIPAFSTAISYYDSYRTVHSSANLI

SEQ ID NO: 26622 - protein, 266 aa, Brassica napus
  misc_feature (44)..(44): Xaa can be any naturally occurring amino acid
  misc_feature (68)..(68): Xaa can be any naturally occurring amino acid
MVTLISPRSLFPPLSSKPTSKSSSFSKPVSSQSPKFAKPESPAXINLLTDAKQACAVGRRRSMMMGAXLLMSGLIVSEANLPTSAFALTPVFREYIDTFDGYSFKYPQNWIQVRGAGADIFFRDPIVLDENLSVEFSSPSSSKYKSLEDLGPPEEAGKRVLRQYLTEFMSTRLGVKRESNILTTSSRVADDGNLYYQVEVNIKSYANNNELAVMPQDRVARLEWDRRYLAVLGVENNRLYSLRLQTPEKVFLEEEKDLRRVMDSFR

SEQ ID NO: 26623 - protein, 297 aa, Buchnera aphidicola
QKEVYDFIAPLFEKISAKFEGQPCVSYIGTDGSGHYVKMVHNGIEYGDMQLIAESYFLMKHLFNMSNKELSDIFSKWNQGELNSYLLSITVDILVKKDNIGNCILDYILDEASNKGTGKWATKSALDLNEPLTLITASVFFRYLSSLKSQRLLASKLLFGPKYRSISNDKLDLVEQIRQALYLGKVISYSQGFSQLNSASKKYNWKFQYSEIARIFQSGCIIRAKLLKNISQEYLRNKNIVNLLLTSYFSDIANNYQNSLRRVVSIAVKLGIPVPALSSAISYFDCYRTSFLPANLI

SEQ ID NO: 26624 - protein, 211 aa, Triticum aestivum
LQKSLYKKAGCVPVRNSRDIVDPRVRTVMSRLLARPNVKLFNAVAVEDLIVKENRVAGVVTNWALVSMNHDTQSCMDPNVMEAKVVVSSCGHDGPFGATGVKRLQDIGMIQAVPGMKALDMNTAEDAIVRLTREVVPGMIVTGMEVAEIDGAPRMGPTFGAMMISGQKAAHLALKALGRPNGIDGTLKNVTPALHPEMILAATNNGDIVDA

SEQ ID NO: 26625 - protein, 297 aa, Buchnera aphidicola
SRKAYDYIAPILKKISSKFEGQPCVSYIGKDGSGHYVKMVHNGIEYGDMQLIAESYFLMKNLLKLDNQELSDIFLEWNKGELNSYLISITTNILIKKDINNSYIVDYILDEADNKGTGTWATKSALDLNEPLTLITSSVFFRYLSSLKSERMLASKMLFGPKNNHMLSNKIDLIEKIRKSLYLGKIISYAQGFSQLSSASKKYDWNLQYSEIARIFQSGCIIRAKLLKYISQGYLKNKDIVNLLLISYFKNIVNSYQDALRDVVSIAIKSGIPVPALSSAITYFDCYRSAILPANLI

SEQ ID NO: 26626 - protein, 554 aa, Spirochaeta thermophila
MTRISPLQKARYGYVPKLPPVLQDEIARIQAELGQPTEAVADREDLKRLFANTYGKPIATLTRGSNPEAGRRRTVGVILSGGPAPGGHNVICGLFDALKKANRESTLIGFKGGPSGILDDEWIEFTDSLINQYRNTGGFDIIGSGRTKIETPEQFAKALENAKKHGLDALVIIGGDDSNTNAALLAEYFVQQGAPIQVIGIPKTIDGDLKNEYIEASFGFDTATKVYAELIGNIARDAISSRKYWHFIRLMGRSASHIALECALQTHPNVCIVSEEVREKNMTLSQIVDQIVDAVVKRAAKGENFGVVLVPEGLIEFIPEVGALIDELNTLLAKEAEVFNRIDDPRERISWVKGKLSGNNQHVFSSLPETIQAQLLMDRDPHGNVQVSRIETEKLLIEMVSSRLKALKEEGAYKGKFSALNHFFGYEARCAFPSNFDADYCYALGFTAFVLIANGLTGYIAAIKNLARPAVEWKPMGIPLTMMMNMEKRHGKMKPVIRKALVDLEGAPFKRFATQRDAWATESAYVFPGAIQYYGPDDVCNQPTMTLKLEQGLE

SEQ ID NO: 26627 - protein, 162 aa, Zea mays
  misc_feature (119)..(119): Xaa can be any naturally occurring amino acid
  misc_feature (127)..(127): Xaa can be any naturally occurring amino acid
MSTSASALLTPSTFSTVISQKNPNSISFHGLRPLRLGGSSSSSLPKLSTTAGRRSSSAVVRAELSPSVVISLSTGLSLFLGRFVFFNFQRENVAKQVPEQNGKTHFEAGDDRAKEYVSXLLKSNDPXGFNIVDVLAWGSIGHIVAYYVLATSSNGYDPSFFG

SEQ ID NO: 26628 - protein, 554 aa, Suaeda japonica
MWSQLSSFFASKMDMVSTSDHASVVSMNLFVALLCGCIVIGHLLEENRWMNESITALLIGLSTGIIILLISGGKSSHLLVFSEDLFFIYLLPPIIFNAGFQVKKKQFFRNFITIILFGAVGTLVSFIIISLGSIAIFQKMDIGSLELGDLLAIGAIFAATDSVCTLQVLNQDETPLLYSLVFGEGVVNDATSVVLFNAIQNFDLTHIDHRIAFQFGGNFLYLFFASTLLGAVTGLLSAYVIKKLYFGRHSTDREVALMMLMAYLSYMLAELFYLSGILTVFFCGIVMSHYTWHNVTESSRVTTKHAFATLSFVAEIFIFLYVGMDALDIEKWRFVSDSPGTSVAVSSILIGLLMVGRAAFVFPLSFLMNLSKKSNSEKVTFNQQIVIWWAGLMRGAVSVALAYNQFSRSGHTQLRGNAIMITSTITVVLFSTMVFGLLTKPLILFMLPQPKHFTSASTVSDLGSPKSFSLPLLEDRQDSEADLGNDDEEAYPRGTIARPTSLRMLLNAPTHTVHHYWRRFDDYFMRPVFGGRGFVPFVPGSPTEQSTTNLSQRT

SEQ ID NO: 26629 - protein, 520 aa, Pseudomonas syringae
MLDANLKAQLKSYLERVTRPIEIVASLDDGAKSQEMLALLNDVISVSKDVTLNDSGTDARTPSFSLSSPGHDISLRFAGIPMGHEFTSLVLALLQVGGYPPKVSAETIEQVRALQGEFHFETYFSQSCQNCPDVVQALNLMAVLNPGIKHVAIDGALFQDEVTERKIMSVPSIYLNGELFGQGRMGLEEILAKIDTGAGARQAEKLNAKQSFDVLVVGGGPAGSAAAVYAARKGIRTGVAAERFGGQVLDTMAIENFISVQHTEGPKLAVALEEHVKQYEVDIMNLQRADKLIPGAAGELHEVKFASGASLKAKTVILATGARWREMNVPGEQQYRNKGVAYCPHCDGPLFKGKRVAVIGGGNSGVEAAIDLAGIVSHVTLLEFDVQLRADAVLQRKLHSLPNVTVLTSAQTTEVTGDEQKVNGLRYKNRTTGEEITIPLEGIFVQIGLLPNSEWLKGALELSPRGEIVVDARGETSVSGIFAAGDVTVTPYKQIIIALGEGAKASLSAFDHLIRTSAPA

SEQ ID NO: 26630 - protein, 158 aa, Triticum aestivum
MAFSEAQEELVLRSWKAMKPDSESIALKFFLRIFEIAPAAKPMFPFLRDAGEDAPLESHPKLKAHAVTVFVMACESATQLRKTGDVKVREATLRRLGATHVRAGVADAHFEVVKTALLDTIEGAVPGMWTLEMNAAWEEAYDQLAAAIKEEMKLAAAA

SEQ ID NO: 26631 - protein, 175 aa, Bacillus cereus
MNIEIKDTLISEEQLQEKVKELALQIERDFEGEEIVVIAVLKGSFVFAADLIRHIKNDVTIDFISASSYGNQTETTGKVKLLKDIDVNITGKNVIVVEDIIDSGLTLHFLKDHFFMHKPKALKFCTLLDKPERRKVDLKAEYVGFQIPDEFIVGYGIDCAEKYRNLPFIASVVTE

SEQ ID NO: 26632 - protein, 354 aa, Oryza sativa
MSTIYMSQLPATLPLMEGDQDQGLYPAFHRAKDPPILFPFMIDSAVEHQGQIYGDQGLRRQQVLGESNQQFNDHMMMGGSDVFLTPSPFRPTIQSIGSDMIQRSSYDPYDIESNNKQHANGSTSKWMSTPPMKMRIIRKGAATDPEGGAVRKPRRRAQAHQDESQQQLQQALGVVRVCSDCNTTKTPLWRSGPCGPKSLCNACGIRQRKARRAMAAAANGRSGRWRRQRGVAAAPVNNKPAAKKEKRAADVDRSLPFKKRCKMVDHVAAAVAATKPTAAGEVVAAAPKDQDHVIVVGGENAAATSMPAQNPISKAAATAAAAAASPAFFHGLPRDEITDAAMLLMTLSCGLVHS

SEQ ID NO: 26633 - protein, 554 aa, Nicotiana tabacum
EFPCRELPVTLVCAGNRRKEQNMVKQTIGFNWGAAAVSTTIWRGVPLRALLKRCGVFSKNKGALNVCFEGADVLPGGGGSKYGTSIKKEFAMDPARDIIVAYMQNGEKLAPDHGFPVRMIIPGFIGGRMVKWIKRIIVTTQESDSYYHFKDNRVLPPHVDAELANTEAWWYKPEYIINELNINSVITTPCHEEILPINAWTTQRPYTLRGYSYSGGGKKVTRVEVTLDGGETWQVSTLDHPEKPTKYGKYWCWCFWSLEVEVLDLLSAKEIAVRAWDETLNTQPEKLIWNVMGMMNNCWFRVKMNVCKPHKGEIGIVFEHPTQPGNQSGGWMAKERHLEISAEAPQTLKKSISTPFMNTASKMYSMSEVRKHSSADSAWIIVHGHIYDATRFLKDHPGGTDSILINAGTDCTEEFDAIHSDKAKKLLEDFRIGELITTGYTSDSPGNSVHGSSSFSSFLAPIKELVPAQRSVALIPREKIPCKLIDKQSISHDVRKFRFALPSEDQVLGLPVGKHIFLCAVIDDKLCMRAYTPTSTIDEVGYFELVVKIYFKGI

SEQ ID NO: 26634 - protein, 149 aa, Rhodopseudomonas palustris
MRYLHTMLRVRNLDTALEFFVGALGLKEVRRIDNDKGKFTLLFLCAPEDEELVKQSKGRPAPTIELTHNWDEESYGEDRFFGHLAFEVDDIYATCERLMKLGITINRPPRDGQMAFVRSPDLQSVELLQKGEALPPQEPWASMPNTGHW

SEQ ID NO: 26635 - protein, 85 aa, Panicum bulbosum
ECQKVGAPPEVSARLTAMAQELEARQRTALGGLGAATEPGLDQFMEAYHEMLVKFREELTRPLQEAMEFTRRVETQLNSLSISGR

SEQ ID NO: 26636 - protein, 589 aa, Saccharomyces cerevisiae
MTISSAHPETEPKWWKEATFYQIYPASFKDSNDDGWGDMKGIASKLEYIKELGADAIWISPFYDSPQDDMGYDIANYEKVWPTYGTNEDCFALIEKTHKLGMKFITDLVINHCSSEHEWFKESRSSKTNPKRDWFFWRPPKGYDAEGKPIPPNNWKSYFGGSAWTFDEKTQEFYLRLFCSTQPDLNWENEDCRKAIYESAVGYWLDHGVDGFRIDVGSLYSKVVGLPDAPVVDKNSTWQSSDPYTLNGPRIHEFHQEMNQFIRNRVKDGREIMTVGEMQHASDETKRLYTSASRHELSELFNFSHTDVGTSPLFRYNLVPFELKDWKIALAELFRYINGTDCWSTIYLENHDQPRSITRFGDDSPKNRVISGKLLSVLLSALTGTLYVYQGQELGQINFKNWPVEKYEDVEIRNNYNAIKEEHGENSEEMKKFLEAIALISRDHARTPMQWSREEPNAGFSGPSAKPWFYLNDSFREGINVEDEIKDPNSVLNFWKEALKFRKAHKDITVYGYDFEFIDLDNKKLFSFTKKYNNKTLFAALNFSSDATDFKIPNDDSSFKLEFGNYPKKEVDASSRTLKPWEGRIYISE

SEQ ID NO: 26637 - protein, 597 aa, Oryza sativa
MGRGGSRAACAAAAPPWHSLPDEVWEHAFSFLPAAADRGAAAGACSSWLRAERRSRRRLAVANCYAAAPRDAVERFPSVRAAEVKGKPHFADFGLVPPAWGAAAAPWIAAAADGWPLLEELSFKRMVVTDECLEMIAASFRNFQVLRLVSCDGFSTAGLAAIAAGCRVGRHLRELDLQENEIEDCSIHWLSLFPESFTSLVTLNFSCLEGEVNITVLERLVTRCHNLKTLKLNNAIPLDKLASLLHKAPQLVELGTGKFSADYHSDLFAKLEAAFGGCKSLRRLSGAWDAVPDYLPAFYCVCEGLTSLNLSYATVRGPELIKFISRCRNLQQLWVMDLIEDHGLAVVASSCNKLQELRVFPSDPFGAGFLTERGLVDVSASCPMLESVLYFCRRMTNEALITIAKNRPNFTCFRLCILEPHTPDYITREPLDAGFSAIVESCRGLRRLSISGLLTDLVFKSIGAHADRLEMLSIAFAGNSDLGLHYILSGCKSLKKLEIRDCPFGDKPLLANAAKLETMRSLWMSSCLLTLGACRQLARKMPRLSVEIMNDPGRSCPLDSLPDETPVEKLYVYRTIAGPRCRMKIHSLFQDMEMHGL

SEQ ID NO: 26638 - protein, 505 aa, Citrus sinensis
MVLSILRKMDPVTKFSLTLQILGLTLCALSLLCSAFTFQDYSDALGKSILFFEGQRSGRLPPNQQLTWRGNSGLSDGSSYHVDLVGGYYDAGDNVKFGLPMAFTTTLLSWSVIEFGSSMQNHLENAKAAIRWGTDYLLKASTATPGALYVQVGDPNMDHHCWERPEDMDTPRNVYKVSTQNPGSDVAAETAAALAAASVVFKDSDPSYSTKLLKTAMKVFDFADKYRGSYSDSLNSVVCPYYCSYSGYLDELLWGASWLHRASQNSSYLAYIQSNGHILGADDDDYSFSWDDKRAGTKVLLSKGFLEKNTQEFQLYKAHSDNYICSLIPGSSSFQAQYTAGGLFYKASESNLQYVTTTAFLLLTYAKYLSSNGGVATCGSSTVKAENLIALAKKQVDYILGDNPAKMSYMVGFGERYPQHVHHRGSSLPSIHAHPDHIACNDGFQYLYSRSPNPNVLTGAILGGPDNRDNFADDRNNYQQSEPATYINAPFVGAVAFFSSKTTTN

SEQ ID NO: 26639 - protein, 1113 aa, Bordetella bronchiseptica
MPATHPAPDPLWYKDAVIYQLHVKSFFDANDDGVGDFAGLLAKLDYIVELGVNTIWLLPFYPSPRRDDGYDIADYRGVHPDYGSLADARRLVRAAHARGLRVITELVINHTSDQHPWFQRARAARPGSAHRAYYVWSDDDKAYAGTRIIFCDTEKSNWTWDPVAGAYFWHRFYSHQPDLNYDNPQVLREVLGAMRYWLDMGVDGLRLDAVPYLVEREGTNNENLPETHAILRRIRRVIDSEYPGRMLLAEANQWPEDAQEYFGAGDECHMAFHFPLMPRMYMAIAQEDRLPVTDIIRQTPSIAPQCQWAIFLRNHDELTLEMVTSRERDYLWNVYAAEPRARINLGIRRRLAPLLERDRRRIELMNSLLLSMPGTPVLYYGDELGMGDNIHLGDRDGVRTPMQWSPDRNGGFSRADPERLPLPLLMGPLYGYEAVNVEAQQRDPHSLLNWTRRMLAKRRQSHVFGRGELSFLYPGNRKILAYLRTWEDTVVLCVANLSQAAQPVELHLSEYAGRVPVEMLGGTAFPQIGELPYLLTLPPFGFYWLDLSAGAAPPAWHSELPPQMPESITLVSRGAGAALRLTEASRRQLEADVLPAYLQRQRWYAARRKPGVMRLAYSVPLNDDVESYYEAEIEVSDDGPPRRFHTPVALAWQDDTAAQYPLARVRRGAQLGTLTDASLQPGYARVLLAALTAGRDIQAGGEPAVRLRFLPEPGLADLALRDDSEVRALSADQSNSSLLVGERVVFKLLRELHAGPHPEAEMTRYLTQAGYAHTPALLGEVVRVQGDQAPHTLALAHAYVVNEGDAWNWTVAYLKRTVDAAMLTGASADDYQQELAGYEVLAGTIGQRLAQMHSVLARAGELPGFAPRPASERDAALAGEHAVAQLDRALQALRACESGLAPASHACAQWLFEHRDRLAAHIMTLAQAETGALRIRVHGDFHLGQILVAQTDAYLIDFEGEPARPMAERRQLSSPFKDVAGILRSFDYAVAELSRDDPLGGAPRDFNTGVAEPADPASAPRETREALLARFRQRAGAALLASYGNAIDPVLALPPERAQALTCLYLLEKAAYEICYESAYRPERLPVPIHGLAETARAALLAAAVDHDEGPAP

SEQ ID NO: 26640 - protein, 85 aa, Panicum bulbosum
ECQKVGAPPEVSARLTVMAQELEARQRTALGGLGAATEPELDQFMEAYHEMLVKFREELTRPLQEAMEFTRRVETQLNSLSISGR

SEQ ID NO: 26641 - protein, 510 aa, Saccharophagus degradans
MKTPLTDINAKQAGVLLFSILIVALCGIVYELIIGTVSSYLLGNSVHQFSLTIGFFMFAMGVGSMISKYFDDQFVRNFIFVEIAIALVGGICSILLFIAFPMARALYELVMYSLILIIGALVGMEIPILTSLLAQKRSLKESIANVMSLDYVGALIGSVSFPLLLLPSLGLVQSSFAIGLINILVATINVIVFRHYLRHYHAMLLSCIGILVLLTGCIFYGTVLTRFAEKHLYFDQVIYSTQTPYQKLVVTRSTTTREQRLYIDGHIQFSSRDEYRYHEYLVHPVMSIPGPRKNVLILGGGDGLAAREVLKYDDVETIHLVDIDPEMLRIANELPMLRRLNKGSLDAEKLTAFSQDAFSFINEPGIDYDRVIIDMPDPHNEAINKLYSREFYTMIKRRMTPEGILVSQSSSPFFTRHVFWCIEQTLDHVFDNTLSYHTALPSFGIWGFNMARNNVAFPADIEFNIETRALTQASMQAARNFDKDIAKVETTVNSIMEPKLYHLYIEDLRR

SEQ ID NO: 26642 - protein, 120 aa, Haloarcula marismortui
MASQSIFERIGGRDAVDAVVSDFYDRVRDDPLLEPYFEETDMDQLRSHQTQFISTVAGGPVDYDGDDMQTAHEGMGITEDAFASVATHLEAALRANGVPDDDVEAILTEVAAMKDDIVEA

SEQ ID NO: 26643 - protein, 565 aa, Xylella fastidiosa
MAAAMRGMAVTFFSQFMVSCMHSIQIVLAMLLVVAASGYLVRIIPFSMPLPLLQIALGAVISGVFDGGYELQPEVFFLLFLPPLLFLDGWRIPKQGLFRDKNVILELALGLVVFTVLGIGFLIHWMIPTMPLALAFALAAILSPTDPVALSSITSRVRIPKRMMHILEGESLLNDATGLVCFQFAIAAVLTGHFSLATASLTFVWVLVVGLSLGMTTTYVLSRVQRWVWRHFGGEPAAAILVNLLTPFAAYLLAESMQASGILAAVAAGITMSYVELSGNAPATIRVQRWAVWETVQFTFNGIIFVLLGEQLPGILDDLVHSAQQAGHMNVGWLLVDVAVISAGLMLLRFLWVWLSLQWNLFKAVCCGKQRISPPWQIVVAMSLSGVRGAVTLAGVLTLPLLMPDGTPLPARQLVIFLAASVILVSLLLASVALPYLLRGLELPEKSSYDKEEDFARRVSAQAALEAVERLRQRLVEDSANAERYNEAAHQVSQLYQRKLGAVDLANVDPQETKVFEQVVRRFRQVGLAAERDELFRLAREHNISDELLQRMVRNLDLIEARRRS

SEQ ID NO: 26644 - protein, 103 aa, Tamarix androssowii
MARCSYSNAKLVSTLVVDNLSLALSRRSYAQGMVMSNSSNVMRRAGGSNNATSTTPNDENSWVPDPVTGYYRPANHADDVDVAELREMLLTTSNANKFNRSSH

SEQ ID NO: 26645 - protein, 277 aa, Unknown
  Marinobacter sp. ELB17
MTSKIRVAVAQINPELLEVKHNLALHCDYVAQAREQGAELLLFPELSLSGYQVSRNAPAIAMHAHDPVLHALAREAVGITVVAGFVEEGRPGELFNAMAYLRDGKVMHIQRKINLPTYGGLEEGKWFHSGQDLNIVEIKPGWQATCLICADLWNPALTHCAMLQRPEILLAPINSASGVVSEDFSNEQNWVTNVSFYAMMYGTPVLLANRFGREKELSFWGGSCILGPKGEVLAKADDREMLIFAELDRKRIGTARFDMPTVRDANTALIRKFLADY

SEQ ID NO: 26646 - protein, 262 aa, Triticum aestivum
MATGGSVPVNGGGGNDGGGDGGARGVEHGPRPGARVAEQLVGLARCLQYVQGQARSPAPDCCGGLSQVLDKSPKCLCVLVKDKDDPNLGIKINASLALALPSACRNTKANVSHCPELLHLPPNSKDAAIFSPGGDKGSAAALAKDNTASTANSRAQQAASAGTASSTATAGVALAALLAGYLALLLPADFLAAASSVVAAAVRARLSPPPYGATEDRSGAGEPGTSDSVWGNEMPQVGSIMHVVVCDRDGSGGSGWFVLVLY

SEQ ID NO: 26647 - protein, 354 aa, Coccidioides immitis
MSISKIGNDNLYLGGFMSLSNTLALRNANITHVVTVMRGGVDKDRFKSFQGHLHIAVDDISDEDLLQHFPTTNAFIRSGLEQGGGVLIHCAMGKSRSATVCIAFLLHRDPTAIDPHEALRLLRETRQMCEPNDGFMEQLKLYHEMGCPESVENHPIYQRWLYQRAVEESVACGRGPELEEVRFEDKAKSANHSDDKGVEVRCRKCRRQLAALPFIIPHDTPQQQYTTKSQPEATQLSSACAHVFLHPLTWMRPSLFPSTDDPLAQETPSESPLAGRLVCPNATCGANIGKFAWPGMRCSCGTWVVPAIALARARVDVVDVGIRIAGLAGGGAGIRMPPSMRVQGNKVEEERGLL

SEQ ID NO: 26648 - protein, 381 aa, Streptococcus pyogenes
  misc_feature (81)..(81): Xaa can be any naturally occurring amino acid
MYGDLMTCFEQLLTQLKDWTDVYFNYDESGYGRLRDQKAAQFFKKNGIAVHTYQDHYLHGSQEIINQSGQPYKVFTPYYRXWQNYPKETPIKVELSQGRWLNLETPDDVLRTVESFKDEKYQDVATFDEASKQLNRFIQDQLAAYHANRDFPAQLGTSRLSPFLRIGAIGIRTVYHAVRQAPNSLGQATFLKELAWRDFYNMVYVAYPDQKTQPIQKAFSQIEWVNNPDWFQLWKEGKTGYPIVDAAMLQLQKTGWMHNRLRMIVASFLTKDLLCDWRLGEQYFQQQLIDYDAASNIGGWQWAASTGTDAVPYFRIFNPVTQGKRFDPKGEFIKAYLPQLEHVPEKYLHEPWKMPKNLQESVSCIIGTDYAQPIVDHAKQR

SEQ ID NO: 26649 - protein, 505 aa, Arabidopsis thaliana
IPGSTHASALSFSFLLPLSLTKTLVSFTRRRFSRHRNLQIRLSLHYDPCPVTSTPVIPPIRRHLAFASTKPPFHPSDDYHRFNPSSLSNNNDRSFVHGCGVVDREEDAVVVRSPSRKRKATMDMVVAPSNNGFTSSGFTNIPSSPCQTPRKGGRVNIKSKAKGNKSTPQTPISTNAGSPITLTPSGSCRYDSSLGLLTKKFVNLIKQAKDGMLDLNKAAETLEVQKRRIYDITNVLEGIDLIEKPFKNRILWKGVDACPGDEDADVSVLQAEIENLALEEQALDNQIRQTEERLRDLSENEKNQKWLFVTEEDIKSLPGFQNQTLIAVKAPHGTTLEVPDPDEAADHPQRRYRIILRSTMGPIDVYLVSEFEGKFEDTNGSGAAPPACLPIASSSGSTGHHDIEALTVDNPETAIVSHDHPHPQPGDTSDLNYLQEQVGGMLKITPSDVENDESDYWLLSNAEISMTDIWKTDSGIDWDYGIADVSTPPPGMGEIAPTAVDSTPR

SEQ ID NO: 26650 - protein, 231 aa, Zea mays
MAGNNDLKVLGVWTSPFVIRVRIVLNLKGLAYEYVEEDLSNKSALLLGSNPVHKSVPVLLHAGRAINESQVILQYIDEVWAGTGPDVLPADPYERAVARFWGAYIDDKVESAWLGMLFRCANEEERAAAVARAREALDALEGAFRDCSRGRPFFGGDGIGFVDAVLGGYLGWFGAVGRIIGRRLIDPARTPLLAAWEDRFRAADVAKGVVPDDLDRMLAFLQTLRAMNYAK

SEQ ID NO: 26651 - protein, 376 aa, Xanthomonas oryzae
MSKRDYYEVLGVARGASDEELKKAYRRCAMKHHPDRNPGDAAAEAAFKECKEAYEVLSDGNKRRAYDAHGHAAFEHGMGGGGGGPGSPDMGDIFGDIFGNIFGGGAAGPRAARRGADVGYVLELDLEEAVAGIERRIEIPTLIECVSCHGSGSEDGKVQTCGTCHGRGQVRIQRGIFAMQQSCPHCDGRGTLIQNPCKTCHGAGRVEENKVLSIKVPAGVDTGDRIRLAGEGEAGPAGTPPGDLYVEVRVREHAIFQRDGDDLHCEVPIRISQAALGDTVRVATLGGEAEIRIPAETQTGKLFRLRGKGVRSVRSRSEGDLYCRVVVETPVNLTADQRELLQQFEATFTGEDARKHSPKSATFIDGVKGFWDRMTS

SEQ ID NO: 26652 - protein, 606 aa, Phaseolus vulgaris
MATVSMASCVASKGAWSTETKVKSSGQMSLNRHELKYDGLRSLNKVLVRSTHASKMGSSLAAKSSKSGREKVLEKIECGMNLIFVGAEVAPWSKTGGLGDVLGGLPSALAEHGHRVMTVSPRYDQYKDAWDTNVTVEVKVADRIETVRFFHCYKQGVDRVFVDHPCFLEKVWGKTGSKLYGPSAGVDYEDNQLRYSLLCQAALEAPRVLNLNSNKYFSGPYGEDVIFVANDWHTALLPCYLKSMYQTRGVYRNTKVAFCIHNISYQGRHPFEDFPLLNLPNEYRSAFDFTDGHLKPVRGRKINWMKAAILESDLVLTVSPYYAKELVSGEDRGVELDNIIRKTGVAGIVNGMDIREWSPKTDKFIDIHFDTTSVKEAKFLLKEALQAEVGLPVNRDIPLIGFIGRLEEQKGSDILVEAIPKFIDQNVQIIILGTGKKSMEKQIEQLEEIYPEKARGIAKFDGPLAHKIIAGSDFIMIPSRFEPCGLVQLHSMPYGTVPIVSSTGGLVDTVQEGFTGFHMGAFNVDCEAIDPADVEKIATTVRRALGTYGTVAMEKIIQNCMAQDFSWKGPAKQWEKVLFSLDVGRSEAGIEGDEIAPLAKENVATP

SEQ ID NO: 26653 - protein, 540 aa, Aeluropus littoralis
MGPGVVAHLVRLGVLSSTSGHASVVSINLFVALLCACIVLGHLLEENRWVNESITALIIGLCTGVVILLTTKGKSSHILVFSEDLFFIYLLPPIIFNAGFQVKKKRFFRNFMTITLFGAVGTMISFFTISIGAIAIFSRMNIGTLEVGDFLAIGAIFSATDSVCTLQVLNQDETPLLYSLVFGEGVVNDATSVVLFNALQHFDLNKIDVAVVLKFLGNFCYLFLSSTFLGVFAGLLSAYIIKKLYIGRHSTDREVALMMLMAYLSYMLAELSDLSGILTVFFCGIVMSHYTWHNVTESSRVTTKHAFATLSFIAETFLFLYVGMDALDIEKWKFASDSPGKSIGISSILLGLVLVGRAAFVFPLSFLSNLTKKADFEKITWRQQIVIWWAGLMRGAVSIALAYNKFTRSGHTQLHGNAIMITSTITVVLFSTMVFGMMTKPLIQFLLPASSHTVTSEPSSPKSLHSPLLASMQGSDLETASHSHIVRPSSLRMLLSKPTHTVHYYWRKFDDALMRPMFGGRGFVPFSPGSPTEQSIHWGR

SEQ ID NO: 26654 - protein, 130 aa, Shewanella oneidensis
MSEFLEILTHGRRFKAAVKDLSVEELRDLAAKLDKILVERESMEAEELQAIAARNAKIEEIRQQMEAVGLSIDDLGGVAVKASSKKRAPRPAKYQIEVDGEVIQWTGQGRMPTVFKNEVNKGRSMDDFLI

SEQ ID NO: 26655 - protein, 706 aa, Bordetella bronchiseptica
MYPSLPDRLLPGLPAPLGATSDGLGVNFAVFSANAARIELCLFDARGRKELARLPMPECTDEVWHGYLPDAQPGLVYGYRAHGPYNPRAGHRFNPHKLLLDPYATALTGALRWSDALFGYRMQHPRADLSMDRRDSAAGVPKAVVTEPAFHWGATRRPATAWAHTVIYEAHVRGVSMLRSDLREPIRGTCAALADPRFIDHLHRLGVTALELMPVHAFLQDRTLVERGLRNYWGYNTLAYFAPEPAYLADGQPHDLRRAIRRLHAAGIEVILDVVYNHTCEGNELGPTLSWRGLDNASYYRLVPGDERRYIDDTGTGNTLNLSHPRVLQMVMDSLRHWTTHYRVDGFRFDLGVTLGREGTGFDAGSGFFDALLQDPVLARVKLISEPWDVGPDGYQLGRHPPGMAEWNDQFRDTARRFWRGDPGMAGALATRLTASRDVFDHRHRRPWSSINFAAAHDGFTLQDVVSFAERHNEANGEDGADGHGENYSSNWGVEGAASSAVIRETRARVQRALLATVMLADGTPMLLAGDEFGNSQGGNNNAYCQDGPMGWLDWAVAQSTPGRALTAYAARLAGLRRAHPSLRATRYGDPAHQWQEGLGAIDWFNGRGAPMTSADWDAPEGRLLVLRRALPDPAQPGRVDVTLLLCNAAAEPRPCVLPAPTLAWTLALDSASPEAPAAPCDGGEAIVGARAVLLLTASVDGAHAP

SEQ ID NO: 26656 - protein, 584 aa, Bordetella bronchiseptica
MNEPAPHGATVCAPGKIRFRLWAPSAPPALALEIEGRAPIALRPGPDGYAQAIVDGAPGLRYRYRLAADCAVPDPASRLQDGDVHGHSVVVGPDRYPWRHTGWRGRPWQDSVIYEAHAGLCGGYAGLRRRLPEVARLGVTLLELMPIADFPGPRNWGYDGVLPYAPDTAYGTPDELKALIDAAHGLQMGVMLDVVYNHFGPDGNYLHRYAADFFDARADTPWGAAIDYRQQAVQRYFIDNALYWLREYRFDGLRLDAVHAMGRTDWLAGLAREARAACPDRRVHLVVENDANQASLLAQGFDAQWNDDAHHVLHHLLTGERQGYYADYAQAPAALLARALGEGYVYQGQAAPTRGGRARGEPSAHLPPWAFVLFLHNHDQVGNRADGLRLTSLLAPGSPALRAAIALQLLAPHIPLLFMGEEYGSTAPFFYFTSHGPELAAAVRAGRAREFAASMHDCDPPPDPNDPDTYRRSCPWPPPGAERQAWFEYYRELLRLRARLLGGRLTGARADGAAALGPAAVRAAWRLGDGARLTLYANLLPGSVIVPAPPAGQLAYATLAGAGQDLAAGVLRGGCALALWEPAP

SEQ ID NO: 26657 - protein, 584 aa, Saccharomyces cerevisiae
MTISDHPETEPKWWKEATIYQIYPASFKDSNNDGWGDLKGITSKLQYIKDLGVDAIWVCPFYDSPQQDMGYDISNYEKVWPTYGTNEDCFELIDKTHKLGMKFITDLVINHCSTEHEWFKESRSSKTNPKRDWFFWRPPKGYDAEGKPIPPNNWKSFFGGSAWTFDETTNEFYLRLFASRQVDLNWENEDCRRAIFESAVGFWLDHGVDGFRIDTAGLYSKRPGLPDSPIFDKTSKLQHPNWGSHNGPRIHEYHQELHRFMKNRVKDGREIMTVGEVAHGSDNALYTSAARYEVSEVFSFTHVEVGTSPFFRYNIVPFTLKQWKEAIASNFLFINGTDSWATTYIENHDQARSITRFADDSPKYRKISGKLLTLLECSLTGTLYVYQGQEIGQINFKEWPIEKYEDVDVKNNYEIIKKSFGKNSKEMKDFFKGIALLSRDHSRTPMPWTKDKPNAGFTGPDVKPWFLLNESFEQGINVEQESRDDDSVLNFWKRALQARKKYKELMIYGYDFQFIDLDSDQIFSFTKEYEDKTLFAALNFSGEEIEFSLPREGASLSFILGNYDDTDVSSRVLKPWEGRIYLVK

SEQ ID NO: 26658 - protein, 324 aa, Pseudomonas syringae
MQLGIIGLGRMGGNIARRLMLDGHTTVVYDRDEASRGALANEGSTAVADLAELVSALEKPRAVWVMLPAGAPTEDTIQTLSQLLEADDVIIDGGNTFYKDDIRRAQELSEKGLHYVDVGTSGGVWGLERGYCMMIGGDVAAVERLDPLFASLAPGLGSIERTRGRTSTDDRAERGYIHSGPAGSGHFVKMIHNGIEYGMMQAFAEGFDLLKQKNSEHLPAEQRFDLNTADIAEVWRRGSVVSSWLLDLTADALATDPQLDAFSGSVADSGEGRWTIEAAIEQAVPVPVLSSALFARFRSRQTSSYADKMLSAMRFGFGGHKEPK

SEQ ID NO: 26659 - protein, 269 aa, Haloarcula marismortui
MPEMSDAMSKPHTERFRLENQRAIITGASSGIGRAIAEEFAADGADVVVCSREQDNVGPVADEINDSDRPGEAVAIECDVTDREAVEALVEATVDEFGGLDVLVNNAGASFMSGFDDISENGWKTIVDINLHGTYHCTQAAGDALAADGGGTVINLSSVAGEQGAPYMSHYGAAKAGVSNLTSTLSAEWADRDIRINCIAPGFVATPGVESQMGVSADNIDREAVERRIGLSEEIADIALFLASPASSYIVGQTITAAGVPRLEETPDI

SEQ ID NO: 26660 - protein, 94 aa, 'Chlorella' fusca
YKVTLKTPSGEETIECPEDTYILDAAEEAGLDLPYSCRAGACSSCAGKVESGEVDQSDQSFLDDAQMGKGFVLTCVAYPTSDVTILTHQEAALY

SEQ ID NO: 26661 - protein, 85 aa, Setaria verticillata
ECQKVGAPPEVSARLTAMAQELEARQRTALGGLGASTEPELDQFMEAYHEMLVKFREELTRPLQEAMEFMRRVESQLNSLSISGR

SEQ ID NO: 26662 - protein, 148 aa, Mesembryanthemum crystallinum
MAATTAALSGATMSTAFAPKTPPMTAALPTNVGRALFGLKSSASRGRVTAMAAYKVTLVTPEGKQELECPDDVYILDAAEEAGIDLPYSCRAGSCSSCAGKVTSGSVNQDDGSFLDDDQIKEGWVLTCVAYPTGDVTIETHKEEELTA

SEQ ID NO: 26663 - protein, 668 aa, Bacteroides thetaiotaomicron
MKMGTNYLAILGVTTVTTVMSCTTAKKEYMSYELYPVRTGSLIEMEYTPEATKFTLWSPTADEVRLMLYEAGEGGHAYETVKMQSGEEGTWTAVVSKDLIGKFYTFNVKIDDKWQGDTPGINARAVGVNGKRAAIIDWQSTNPDGWESDTRPPLKSPADMIIYEMHHRDFSVDSTSGVKNKGKYLALTEHGTMNSDKLLTGIDHLIELGVTHVHLLPSFDYASVDETRLNENSYNWGYDPQNYNVPDGSYATDPYQPATRVKEFKQMVQALHKAGIRVIMDVVYNHTFNTDESNFERTVPGYFYRQKEDKTLANGSGCGNETASERLMMRKFMVESVLYWIKEYHVDGFRFDLMGIHDIETMNEIRKAVNAVDPTICIYGEGWAAEAPQYPADSLAMKGNIAQIPGVAVFSDELRDGLCGPVGDKRKGAFLAGIPGGEMSVKFGIAGAIEHPQVQCDSVNYTQKPWAKQPVQMISYVSCHDGLCLVDRLKASMPDITPEQLIRLDKLAQAVVFTSQGIPFIYAGEEIMRDKQGVDNSYKSPDAVNAIDWRRKTTSADVFMYYKRLIDLRKSHPAFRMGDAGQVRKHLEFLPVEGSNLIAFRLKDHANGDHWEDIIVAFNSRPTPARLTIPVGKYTVVCKGGVIDVRGLGIQNGPEVIIPSQSALILYK

SEQ ID NO: 26664 - protein, 609 aa, Oryza sativa
MSALTTSQLATSATGFGIADRSAPSSLLRHGFQGLKPRSPAGGDATSLSVTTSARATPKQQRSVQRGSRRFPSVVVYATGAGMNVVFVGAEMAPWSKTGGLGDVLGGLPPAMAANGHRVMVISPRYDQYKDAWDTSVVAEIKVADRYERVRFFHCYKRGVDRVFIGHPSFLEKVWGKTGEKIYGPDTGVDYKDNQMRFSLLCQAALEAPRILNLNNNPYFKGTYGEDVVFVCNDWHTGPLASYLKNNYQPNGIYRNAKVAFCIHNISYQGRFAFEDYPELNLSERFRSSFDFIDGYDTPVEGRKINWMKAGILEADRVLTVSPYYAEELISGIARGCELDNIMRLTGITGIVNGMDVSEWDPSKDKYITAKYDATTAIEAKALNKEALQAEAGLPVDRKIPLIAFIGRLEEQKGPDVMAAAIPELMQEDVQIVLLGTGKKKFEKLLKSMEEKYPGKVRAVVKFNAPLAHLIMAGADVLAVPSRFEPCGLIQLQGMRYGTPCACASTGGLVDTVIEGKTGFHMGRLSVDCKVVEPSDVKKVAATLKRAIKVVGTPAYEEMVRNCMNQDLSWKGPAKNWENVLLGLGVAGSAPGIEGDEIAPLAKENVAAP

SEQ ID NO: 26665 - protein, 329 aa, Fusobacterium nucleatum
MRVKIKKMEKKLAILTSGGDAPGMNAAIRATAKIAEYYGFEVYGIRRGYLGMLNDEIFPMTGRFVSGIIDKGGTVLLTARSEEFKEARFREIAANNLKKKGINYLVVIGGDGSYRGANLLYKEHGIKVVGIPGTIDNDICGTDFTLGFDTCLNTILDAMSKIRDTATSHERTILIQVMGRRAGDLALHACIAGGGDGIMIPEMDNPIEMLALQLKERRKNGKLHDIVLVAEGVGNVLDIEEKLKGHINSEIRSVVLGHIQRGGTPSGFDRVLASRMAAKAVEVLNKGEAGVMVGIEKNEMVTHPLEEACSVDKRKSIEKDYELALLLSK

SEQ ID NO: 26666 - protein, 217 aa, Sulfolobus tokodaii
MFGPSFLSENEVEFILWAPYQKKATLRLNEEKYDMEKDEKGYFRITVNAKEGDKYSFIIDKGEIPDPASRYQPDGVHGRSQLISLKYEWKSREVKIKPEDLIIYELHIGTFTQEGTFYSAVEKLDYLVNLGVTAIEIMPVHQFPGKKDWGYDGVYLYAVQNTYGGPYAFMKFIDEAHQRGLAVILDVVYNHVGPEGNYMMFLGPYYDVFRSLLFTKV

SEQ ID NO: 26667 - protein, 96 aa, Unknown
  Synechocystis sp. PCC 6803
ASYTVKLITPDGESSIECSDDTYILDAAEEAGLDLPYSCRAGACSTCAGKITAGSVDQSDQSFLDDDQIEAGYVLTCVAYPTSDCTIETHKEEDLY

SEQ ID NO: 26668 - protein, 716 aa, Sulfolobus tokodaii
MVFSHKDRPLRPGEPYPLGANWEEEDDGVNFSIFSENATKVELLIYSPTNQKYPKEVIEVKQRSGDIWHVFVPGLGPGTLYAYRIYGPYKPDQGLRFNPNKVLIDPYAKAINGTLNWNDAVFGYKIGDSNQDLSFDDRPDDEFIPKGVVINPYFEWDDDHFFRRKKIPLKDTIIYEVHVKGFTKLRPDLPENIRGTYKGFASRQMIEYLKDLGVTTVEIMPVQQFVDDRFLVEKGLRNYWGYNPINYFSPECRYSSSGCMGEQVNEFKEMVNELHNAGFEVIIDVVYNHTAEGNHLGPTLSFRGIDNLAYYMLVPDNKRYYLDFTGTGNTLNLSHPRVLQMVLDSLRYWVLEMHVDGFRFDLAAALARQLYSVNMLSTFFVAIQQDPVLSQVKLIAEPWDVGPGGYQVGNFPYLWAEWNGKYRDTIRRFWRGEAIPYEELANRLMGSPDLYAGNNKTPFASINYITSHDGFTLEDLVSYNQKHNEANGFNNQDGMNENYSWNCGVEGETNDANVIQCREKQKRNFIITLFVSQGVPMILGGDELSRTQRGNNNAFCQDNEISWFNWNLDERKQRFHDFVRSMIYFYRAHPIFRRERYFQGKKLHGMPLKDVTFLKPDGNEADEQTWKSPTNFIAYILEGSVIDEVNDRGERIADDSFLIILNGSPNNIKFKFPQGKWSLVVSSYLRELRDDERVVDGGKELEIEGRTAMVYRRIEY

SEQ ID NO: 26669 - protein, 366 aa, Arabidopsis thaliana
MALSAIGFEGYEKRLEVTFFEPSIFQDSKGLGLRALTKSQLDEILTPAACTIVSSLSNDQLDSYVLSESSFFVYPYKVIIKTCGTTKLLLSIPPLLKLAGELSLSVKSVKYTRGSFLCPGGQPFPHRSFSEEVSVLDGHFTQLGLNSVAYLMGNDDETKKWHVYAASAQDSSNCNNNVYTLEMCMTGLDREKAAVFYKDEADKTGSMTDNSGIRKILPKSEICDFEFEPCGYSMNSIEGDAISTIHVTPEDGFSYASFEAVGYDFNTLDLSQLVTRVLSCFEPKQFSVAVHSSVGANSYKPEITVDLEDYGCRERTFESLGEESGTVMYHTFEKLGKYCGSPRSTLKCEWSSNNSCSSEDEKDEGI

SEQ ID NO: 26670 - protein, 335 aa, Burkholderia thailandensis
MLSMKVAVLGAGAWGTALAAHLAARHDTLLWARDAALVAELAARRENVRYLDGVALPPALRYEADLTAALSHAQADDALCVIAAPVAGLRALCRAMRDAGRVPAHFVWVCKGFEADTRLLPHQMVAEELPDHASYGVLSGPSFAREVAQGLPVALTVASASAACRGRTLAAFHHGAMRIYTGDDVVGVEVGGAVKNVLAIATGIADGLGLGLNARAALVTRGLAEMSRLGVALGGRAETFTGLTGLGDLILTATGDLSRNRTVGLQLAAGRSLDDILAALGHVAEGVRCARAVLSIARERGVDMPITEAVCAVLFDGVAPRDAVSGLLRRDAKAE

SEQ ID NO: 26671 - protein, 103 aa, Solanum lycopersicum
MSGRGKGGKGLGKGGAKRHRKVLRDNIQGITKPAIRRLARRGGVKRISGLIYEETRGVLKIFLENVIRDSVTYTEHARRKTVTAMDVVYALKRQGRTLYGFGG

SEQ ID NO: 26672 - protein, 173 aa, Solanum lycopersicum
AGINISGINGEVMPGQWEFQVGPSVGISAGDEVWVARYILERIAEIAGVVVSFDPKPIPGDWNGAGAHTNYSTKSMREDGGYEIILKAIEKLGLKHKEHIAAYGEGNERRLSGKHETANINTFKWGVANRGASVRVGRDTEKAGKGYFEDRRPASNMDPYVVTSMIAETTIIG

SEQ ID NO: 26673 - protein, 173 aa, Brassica napus
MSPPERKRKKTKQSLVLEPTPESTPITSLPDDLVVSCLARVSRLQYPTLSLVSKSFRSLLASPHLYETRSSLGRTESCLYVCIRFPDETIPRWFTLCQKPKKKNKRTKKASGYVLAKLPTPPSRSAHWSGLVAVGSDIYNIGGPIDEADEPSSSVSILDCRSNTWREGPRQCD

SEQ ID NO: 26674 - protein, 394 aa, Unknown
  delta proteobacterium MLMS-1
MKACEIKPDIFWVGAVDWNNRDFHGYSINRGTTYNAYLLRDDKTVLFDTVRSGFKSDLLHHLHQVSKPEEIDYLVVNHVEMDHSGCLPEIIELIKPEKIFCSPMGQKALLEHFHRPDWPLEVVKSGDEISVGKRSIQFIETRMLHWPDSMFSYIPQEKLLISSDAFGQHWATSERFADEVDQGELLAHAAKYYANILLPYSPLVQKLLAQVQAEGPEIEMIAPDHGLIWRGNPATIINAYDRWSRQQSRHKAVIIYDTMWQSTEKMARALMSGLQQEGINEIRLLHARKNHRSDIMTEVLDARALLIGSPTLNNHLMPAMADVLTYMKGLRPKEKVGAAFGSYGWSGEAVKQLTAYLEEMGVAPVAEGVRIKNVPNHDSLQACVELGKAVARAM

SEQ ID NO: 26675 - protein, 220 aa, Brassica napus
  misc_feature (210)..(210): Xaa can be any naturally occurring amino acid
METGLTILKLSFFLGLVVVVSCSQAPAPWNPSMGMRPGTCDHYECPTYKLVQAGYGYEIRMYNSAVWMSTDPITAQSMTQGTKTGFQRLFRYIQGDNKSKIKMNMTAPVITQITPGAEMYMYTVSFYIPKKNQQTPPLADDLHVQSWKPTYVAVRQIGGYVTDDLAIKEAVALMDSLNGTERKFRIEKSKGKQPDYFVADYNPPFQTTAXVNEILVPFNM

SEQ ID NO: 26676 - protein, 501 aa, Oryza sativa
MPRRPSGGGGGAGPAAAAVRKVPLRKLLRAASVACGVQFGWALQLSLLTPYVQELGIPHAFASLVWLCGPLSGLLVQPLVGHLSDRIAPAASPLGRRRPFIAAGAASIAAAVLTVGFSADLGRIFGDSITPGSTRLGAIIVYLVGFWLLDVGNNATQGPCRAFLADLTENDPRRTRIANAYFSLFMALGNILGYATGAYSGWYKIFPFTVTPSCSISCANLKSAFLLDIIILVVTTCITVASVQEPQSFGSDEADHPSTEQEAFLWELFGSFRYFTLPVWMVLIVTALTWIGWFPFILFDTDWMGREIYRGSPDDPSITQSYHDGVRMGSFGLMLNSVLLGFTSIVLEKLCRKWGAGLVWGVSNILMALCFVAMLVITYVAKNMDYPPSGVPPTGIVIASLVVFTILGAPLAITYSIPYAMAASRVENLGLGQGLAMGILNLAIVIPQVIVSLGSGPWDQLFGGGNAPAFAVAAAASFIGGLVAILGLPRARIASRRRGHR

SEQ ID NO: 26677 - protein, 976 aa, Picrophilus torridus
MGTLTIEKNRYNFLEGDTLLNVFIKAGIDIPHVCYNPALGPLQSCDTCIVSVNGRLVRSCSTIAEDNMNIEYKNNDVKNAQIEAINRLLREHNLHCTVCENNNGDCALHNAVDSSGLERQKYKYEKKPYEIDDSNPFYRYDPNECILCGRCVEACQDVEVNETIHIDWTLERPRVVWDDGKMINESSCVSCGHCVTVCPVNALMEKSMLEEAGYFTSLTRKAKESLIDFGKNLEDQLTIRPIMEISNIEARMRNEQIKKTKTVCTYCGVGCSFTMWTKGRKILKVQPEIESPANGISTCIKGKFGWGFVNSDDRLKRPLIRKNNKFVEVSWDEALDFAAAGLKRISDKYGGDSIMFIASSKGTNEEAYLIQKMARQIFKTNNVDNSSRFCQAPATTGLWRTVGYGGDAGSIDDIYNSELVMIVGANTAESHPVIATRIKRAHKLNNQRLIVIDLRRNEMAQRADLFLHPRPGTDLFLLSAITKYIIDNNWHDKKFIEERVNNFDEYYKSLDNFTLENAEKITGIDKNEIIKVASMIHSVKSMCILWAMGVTQHSAGSDVSTAISNLLLITGNYGRPGTGAYPLRGHNNVQGASDFGAMPTYLPGYQSIKNKDAIKKFEKAWNTKLPMNPGIDNVSCIENIDNDKIKAMYIIGQELAETGPDTNMINKSLEKLEFLIVQDVFFSETARYADVVLPSCVSLEKEGTYVNTERRIQRIYKVMEPYAETRPDWEIIQDIARRLGYNWNYKSPSDIMDEAASLCPIFSGVSYSRLEGFNSMQWPTYENGDSSKYLYKDGFNFPDGRARLYILKYRPPIMEDDDYPLHLNNGRMLEHFHEGNETFKTPGIRDKVPDTFLEISPELADEYNIKTGDFVRVTSRYGSIKVRALVTDRVKGKELYMPMNAASSDNGINLLTSYSRDPDSDTPAYKELPVRIKKLKDNGGSPLPKTNPRFGTPVPQIGINIEMKWKRADYKKITGD

SEQ ID NO: 26678 - protein, 413 aa, Burkholderia pseudomallei
MSTADPYLIAGGGHAARRAAETLRERDAAARIVMIGAEPELPYDRPVLSKEALVGGDAGERRAFVRDAAWYRERDIELRLGVRVEAIERGARRVRLSDGARLGYARLLIATGSRVRRFAGPVDAGVHVHYVRTLADTRALRAALAPGKRVAVLGGGFIGLEVAASAVRLGCRATVVDPAPRLLQRGMPEAVGAFALALHARHGVDVRLGALPERIRRAANGSAVVETSAGGIVADVVVAGIGVVPNVELAQAAGLDVDDGVCVDEMCRTTDPAIFAAGEVTRHFNPLVGRALRIESWQIAENQPAVAAANMLGAAETYAQWPWLWSDQYDCNLQTLGLFGGEQTLVLRGSPERDRAFCVFALNARRELAAVAAVNAGREIAVCRRLMTAGVALDPARLADPSDALRAMLPRGV

SEQ ID NO: 26679 - protein, 266 aa, Pinus thunbergii
MATASAIQSSSLAGQTLLRPQQNELVKKVGTAQARITMRRTVRSAPESIWYGPDRPKYLGPFSEGTPSYLTGEFPGDYGWDTAGLSADPETFAKNRELEVIHCRWAMLGALGCLFPELLAKNGVKFGEAVWFKAGAQIFSEGGLDYLGNPNLIHAQSILAIWACQVVLMGLIEGYRVGGGPLGEGLDPLYPGGAFDPLGLADDPEAFAELKVKEIKNGRLAMFSMFGFFVQAIVTGKGPIENLYDHLADPVANNAWAYATNFVPGK

SEQ ID NO: 26680 - protein, 112 aa, Herminiimonas arsenicoxydans
MKLITAIIKPFKLDEVREALSAIGVQGITVTEVKGFGRQKGHTELYRGAEYVVDFLPKTKIEAAVDDAIVDRAIEAIETAARTGKIGDGKIFVYDLQQVVRIRTGETGKEAL

SEQ ID NO: 26681 - protein, 144 aa, Solanum lycopersicum
MASISGTMISTSFLPRKPAVTSLKAISNVGEALFGLKSGRNGRITCMASYKVKLITPEGPIEFECPDDVYILDQAEEEGHDLPYSCRAGSCSSCAGKVTAGSVDQSDGNFLDEDQEAAGFVLTCVAYPKGDVTIETHKEEELTA

SEQ ID NO: 26682 - protein, 99 aa, Leptolyngbya boryana
MPSFKVTLINETEGLNTTIEVPDDEYILDAAEEQGIDLPYSCRAGACSTCAGKITAGTVDQSDQSFLDDDQIQAGYVLTCVAYPTSDCTILTHQEEDLY

SEQ ID NO: 26683 - protein, 91 aa, Brassica napus
MPTLQGSLPPELANNVVRLYRECLRRATFIGKQQHNTELVVGMVRQQFKKHMNETDPEKIHKLKDDAARGLINHMLFESEKLTGRKVSQRS

SEQ ID NO: 26684 - protein, 177 aa, Staphylococcus aureus
MTKEYATLAGGCFWCMVKPFTSYPGIKSVVSGYSGGHVDNPTYEQVCTNQTGHVEAVQITFDPEVTSFENILDIYFKTFDPTDDQGQFFDRGESYQPVIFYHDEHQKKAAEFKKQQLNEQGIFKKPVITPIKPYKNFYPAEDYHQDYYKKNPVHYYQYQRGSGRKAFIESHWGNQNA

SEQ ID NO: 26685 - protein, 165 aa, Oryza sativa
MSYIDAHVPVGVPGSHFNLTVVVVSEALHCVYPEFAIMSGKKPKAEKRLPAGKGEKGSGEGKKDRAGRKKAKKSVETYKIYIFKVLKQVHPDIGISSKAMSIMNSFINDIFEKLAAEAAKLARYNKKPTITSREIQTSVRLVLPGELAKHAVSEGTKAVTKFTSA

SEQ ID NO: 26686 - protein, 263 aa, Sulfolobus tokodaii
MIYNKNPIPTEGEILIATVKQIFDYGSYVTLDEYGNLQAFLPWSEISSRWVKNIRDVIKEGRKIVVKVIRVDKRKGTIDVSLKKVTEDEKRKKMSQWKKIQKVDKILEIVSQKINKTEKEGWEQVAWKLEDKYGDAYDALVKAVKEGDSILKNAGVPEVWIKPLMEEIGKHIEEKRVKKSEIVTLRSSDPAGIEKIRKVLGAAVEIAENADVDIKIYTIGAPRYRIDIIGTDPKLLSKVMTEILDNIREISKEEKVEFNVVRK

SEQ ID NO: 26687 - protein, 941 aa, Mycobacterium avium
MPDHTTFAARHIGPDPQAVAAMLDVIGVGSLDELAAKAVPAGIRDRLSADGIAPGLDRLPPPASETEALAELRGLAEANTVAVSMIGQGYYDTLTPPVLLRNILENPAWYTAYTPYQPEISQGRLEALLNFQTMVADLTGLEIANASMLDEGTAAAEAMTLMHRASRGKSNRLAVDVDVFAQTAAIVATRARPLGIEIVTADLRDGLPDGDFFGVIAQLPGASGAITDWAALVAQAHERGALVALGADLLALTLITPPGEIGADVAFGTTQRFGVPMGFGGPHAGYLAVHANHARQLPGRLVGVSLDADGSPAYRLALQTREQHIRRDKATSNICTAQVLLAVMAAMYASYHGAEGLTAIARRVHGHAEAIAAALGTAVVHDRYFDTVLARVPGRAHEVIAAAKARGINLWRVDDDHVSVACDEATTDEHVAAVLEAFGVAPAEPVASEIATRTSEFLTHPAFTQYRTETAMMRYLRTLADKDIALDRSMIPLGSCTMKLNAAAEMEPITWPEFARQHPFAPASDTPGLRRLIGDLENWLVAITGYDAVSLQPNAGSQGEYAGLLAIHDYHASRGEPHRDICLIPSSAHGTNAASAALAGMRVVVVGCHDNGDVDLDDLRAKVTDHRDRLSTLMITYPSTHGVYEHDIAEICAAVHDAGGQVYVDGANLNALVGLARPGKFGGDVSHLNLHKTFCIPHGGGGPGVGPVAVRSHLAPFLPGHPHAPELPQGHPVSSAPYGSASILPISWAYIRMMGADGLRAASLTAITSANYIARRLDEYFPVLYTGENGMVAHECILDLRPITKATGVTVDDVAKRLADYGFHAPTMSFPVAGTLMVEPTESETLTEVDAFCDAMIAIRGEIDRVGAGEWPVEDNPLRGAPHTAECLVTTDWDHPYSREQAAYPLGKDFRPKVWPPVRRIDGAYGDRNLVCSCPPVEAFA

SEQ ID NO: 26688 - protein, 386 aa, Exiguobacterium sibiricum
MAKKNVVAMLLAGGEGKRLGALTKHTAKPAVAFGGKYRIIDFPLSNCTNSGIDTVGVLTQYEPLELNRYLGIGSAWDLDRRNGGLTILPPYQAQNGKNWYEGTANAIYRNMSYINQYDPDYVLVLSGDHIYKMDYEKMIEEHRQGGADVTISVREVPWEEAPRFGILNTDEDLRINEFEEKPENPKSNLASMGIYVFNWDVLKRHLIQDAGDAESSFDFGKNIIPNMLYENLNIRAYKFKGYWKDVGTIQSLWEANMDLLEADPEFDLYEPSWKVHSVNPNQQPQYIGNNASIETSIINEGCHIEGEINHSVLFYGVDVAEGSLVKDSVIFPNVKIGKDVTIHRAILADGVVVEDGATIGTPNGEVFVIEANSVIPKNEVVKEAIQ

SEQ ID NO: 26689 - protein, 661 aa, Desulfitobacterium hafniense
MKIIRAEKAGFCFGVKRALDMAERTVQSSSTASLGPLIHNQQVVEKMEKQGVRVVGEVKETQAGDTLIIRSHGVPPDIYEEARRCQVKVVDATCPFVQKAQRLAAESSQSGQVVVVGDRQHPEVQGILGWAGGNAIAIETLEEARELPFYEQLSVLAQTTQPAANFHGIVDELKTHTQALKVHNTICNATEERQTVARELAGKVDVMIVVGGKNSANTRKLAGICSERTQTYLIETADELEDNWFTGVVTVGLTAGASTPDWIIEEVYRKMSTMENKETHEMMNMEDWAEGMQNLHRGALVTGTVVKINHDEVFVDLGWKSEGVIALKELTVASDLQTSDIVAIGDKISAVVLRVENEEGNPVLSKRRADEMAAVDKLKELAESKEEIQGKVADVVKGGLIVDVGMRGFVPASQIQPGYVEDLNQFKGQTLRLRVIEFDPAKRRVVLSQKEILQEEQAAKKEHLLATLQEGDVVSGVVKRLAQFGAFVDIGGVDGLLHVSDIAYTRIKHPSEYVNVGDEVEVQILKVDKEQGKISLGLKQLKPSPWEIAPEKYALGSLVTGKVVRIAPFGAFVQLEDGIDALIHISQLSEKRVNKVEDVVKVGDMVQAKVIECKPEEKRISLSIREAAAEAQATEDAELLASQPEAPQVTIGDVVQSESES

SEQ ID NO: 26690 - protein, 550 aa, Geobacter sulfurreducens
MGMFCNQCEQAAKGVGCEIMGVCGKNPEVAALQDLMLYGLKGLAIYADKARELGARDEAIDLFMIEGLFTTVTNVDFDPVSLAGKLRTCYDMKEKAKSLYETAYREKNGGHAPAIAAGPAAWVIASDLEGLVKQGLEHGINTHHTDADVRSAIEILIYGLKGMAAYADHAYILGKKDEEVFAFFHKAMAATADPAKGLMDFVGLSMECGKLNIKVMGMLNEGHVDHYGHPVPTKVPTGTRRNKGILVSGHDLRMLEELLKQTAGKGIDIYTHGEMLPAHGYPGLKQKYPHLYGNFGGAWQDQAKEFPLFPGAIIFNTNCIQRPADSYKDRLFSWGQVGWPGVKHISGWDFSEVINKALECPELADAPEKEILTGFGHNAVLGVADKVIEGVKAGAIKHFFLIGGCDGAKPGRNYYTELAEKVPQDCVILTLACGKYRFNKLEFGDIGGIPRLLDIGQCNDAYSALQIALALANAFNCGVNDLPLSMILSWYEQKAVVILLSLLHLGIRNIKIGPSLPAFVTPNVLNFLVENFNLGPITTVEADLKAALGQ

SEQ ID NO: 26691 - protein, 112 aa, Alkalilimnicola ehrlichei
MKKVEAIIKPFKLDDVREALSDIGITGMTVTEVKGFGRQKGHTELYRGAEYVVDFLPKMRLEVVIADDQVDRCLEVITKAAHTGKIGDGKIFVSDVERVIRIRTGEEDENAI

SEQ ID NO: 26692 - protein, 221 aa, Ralstonia solanacearum
MAKNKFNQSWLHDHINDPYVKLAQREGYRARAAYKLKEIDEQDKLIKPGQVIVDLGAAPGSWSQYVRNKLAASPRAKDGRIDGAIVAIDILPMEPVADVTFIQGDFREESVFQQLETIVLDATGGGKVDLVLSDMAPNLSGVASADAARMEHIAELAVEFAQAHLKPEGALLIKCFHGSGYSQIVEMFKRHFRVVAPRKPKASRDKSSETFLLGRQLKHPG

SEQ ID NO: 26693 - protein, 756 aa, Corynebacterium glutamicum
MERRMIVRERQRHDHPGLVTQVGVLEDDQLVEQFVTSDAQMSMVGNIYLGRVQNVLPSMEAAFIDIGKGRNGVLYAGEVDWKAAGLGGRGRRIEQALKAGDQVLVQVSKDPLGHKGARLTTQISLAGRYLVYVPGGRSAGISRKLPGPERKRLKEILGRVVPAQGGTIIRTAAEGVSEENIAADVNRLHTLWEQIKERTAEEKKSRGSKPITMYEEPDMLVKVIRDLFNEDFTSLIVDGDRAWNTVRAYIQSVAPDLVSRVEHFNRADFDGKDAFEAFDLNTQLEEALSRKVNLPSGGSLIIDRTEAMTVIDVNTGRYTGKGGGNLEETVTLNNIEAAEEIVRQMRLRDLGGMIVVDFIDMVLPENQELVLRRLNEALENDRTRHQVSEVTSLGLVQMTRKRIGAGLLETFSSPCEHCEGRGIIVHVDPVDTVDERVEAKAEERSRRHQRSNSTNKAAAEHPMVVAMRDLVESDEHDLDQEFEELAASVIVLDDSDLDDVVNDKLDEPERILAESTVEPEEGPRRRARRQRQESAADDIAAIAAAAVDIASEEDPDEPSGSSYVSDFEAEPIAPVVEKAAEPVAEPTADYEKARAEFEASPRRRRKTRGNSRSDHAPKPEDFAPVVEEVAETPVKTPARKAPRRNRPSELSSGAPSSAPSTRNRRRAVRRQLVEAPETVVEIAPEAAPEQVAEPQVEFDQPDNRRKRRRAVRVTAAPVEKKVASTSNARAPKKEPQAASTTNPGRRRRATRRGPRS

SEQ ID NO: 26694 - protein, 338 aa, Unknown
  Burkholderia sp. 383
MNLQRFPRYPLTFGPTPIQPLKRLSEHLGGKVELYAKREDCNSGLAFGGNKTRKLEYLVPDALEQGADTLVSIGGVQSNQTRQVAAVAAHLGMKCVLVQEHWVNYEDPVYDRVGNIQLSRMMGADVRLVSDGFDIGIRRSWEEAMESVRQAGGKPYPIPAGCSEHPLGGLGFVGFAEEVRAQEAQLGFKFDYIVVCSVTGSTQAGMVVGFAADGRANRVIGIDASATPERTHEQITRIARHTAELVDLGRPITTADVVLDTRYAGPEYGLPNDGTLEAIRLCARLEGMLTDPVYEGKSMHGMIDKVQLGEFEPGSKVLYAHLGGVPALSAYHETFRNG

SEQ ID NO: 26695 - protein, 441 aa, Salmonella enterica
MYHGQLKNILLLSLRFIMDKLSYASDSSTSAWNTYLQQIERVAPYLGELSPWVDTLRHPKRALIVDIPVQMDDGTIRHFEGYRVQHNLSRGPGKGSVRYHPDVDLNEVMALSAWMTIKCAALNLPYGGAKGGIRVDPFSLSEGELEHLTRRYTSEIGIIIGPQKDIPAPDVGTNGKVMAWMMDTYSMNHGTTITGVVTGKPIHLGGSLGREKATGRGVFVSGLEAARRANIAVEGARVAVQGFGNVGSEAARLFAGAGARVVAIQDHTATLFNATGIDMKALTAWQTEHKQIAGFPGAETIASDAFWRLEMDILIPAALEGQITRQRAEALTCKLVLEGANGPTYPDADDVLASRGILVVPDVVCNAGGVTVSYFEWVQDMASFFWSEEEINARMDKIMTDAIVHVWEKAAEKSCSLRTAAYIVACERILLARKDRGIYPG

SEQ ID NO: 26696 - protein, 166 aa, Bordetella bronchiseptica
MNTMYDFSAPTITGAERALADFRGQVALVVNVASRCGFTPQYSGLEELYRSYRNEGFVVLGFPCNQFGRQEPDDEAAIAQFCETQYAISFPLFAKIDVNGAHAHPLYRWLKARKPGLLGTRAIKWNFTKFLVGRDGLPLRRYAPAHTPESLRHDIARACAAPGPTP

SEQ ID NO: 26697 - protein, 191 aa, Legionella pneumophila
MLRILLYFLLLINTTFCLAKTEKAIFAGGCFWCMEADFDHLPGVLSTTSGFDGGTLKDPTYEQVSAGNTHYAESVMVEFDPNKLSYKKLVEYFFRHIDPTVKNAQFCDHGSQYRSAIFYLSDQQKKIAMEYKKELEQKFPTVYTEIAPSTSFYPAEEYHQNYYKKNPIRYKYYRYRCGRDTRIQEVWGNKK

SEQ ID NO: 26698 - protein, 440 aa, Burkholderia mallei
MIISDQSTYIYIIEYSPKYARDSFNCHEKIVVVGAGIAGLTLALTLHSRGLAVRVFEAAPRIEPLGVGLNIQPYAVRVLHELGLLETLARQSITTKEMVFFTRYGQRIYSLPLGKYGGHNFPQLSIHRGILQLALLKAATERLGPDFLVNGHSFVSCTQNSRSVNAVFSGAPGGADLVSVECDALIGADGVHSKVYRSLYPDGPRTKGNGVLMWRGVTIAPPFLTGASMVRMGVPSHGKLVVYPIRSDVNAQGDQLINWVAELDEAVYREGANAAPGNGKDFIRFFASRTFDWLDVPALLERAASPIIAMPMADRDPLPRWQTGRVTLIGDAAHPMVPVGSNGAGQAMLDAHSLGTRLAETADIEAALATYEHERRAYTSNIVLGDRLDLPDRLIQEVDCRSHGKPFSDIGEIIASDEASRLALPDYHGRPLAPTQAGGA

SEQ ID NO: 26699 - protein, 354 aa, Chlamydomonas reinhardtii
MASLRKPSNHADRACSRRLRVATRVAGRRMCRPVAATKASTAVTTDMSKRTVPTKLEEGEMPLNTYSNKAPFKAKVRSVEKITGPKATGETCHIIIETEGKIPFWEGQSYGVIPPGTKINSKGKEVPTARLYSIASSRYGDDGDGQTASLCVRRAVYVDPETGKEDPAKKGLCSNFLCDATPGTEISMTGPTGKVLLLPADANAPLICVATGTGIAPFRSFWRRCFIENVPSYKFTGLFWLFMGVGNSDAKLYDEELQAIAKAYPGQFRLDYALSREQNNRKGGKMYIQDKVEEYADEIFDLLDNGAHMYFCGLKGMMPGIQDMLERVAKEKGLNYEEWVEGLKHKNQWHVEVY

SEQ ID NO: 26700 - protein, 843 aa, Unknown
  Frankia sp. EAN1pec
MRAVVMAGGEGTRLRPLTANLPKPLLPVVNRPIMEHVLRLLKRHGFDETVVTVQFLAAMIRNYFGSGDELGMHLSYATETTPLGTAGSVKNAEDALRHEEFLVISGDALTDIDLTDLVAYHRAQGALVTVALKSVPDPLEFGIVITGEDGRISRFLEKPTWGQVFSDTVNTGIYVMEPEVLDHVPAGEAVDWSGDVFPRLVAAGAPVFGYVAGGYWEDVGTIASFQRAQADVLNRQVDVSIGGFEVSPGVWIGEDADVHPDAILKGPLVVGDYSKVEAGAELREFTVLGSNVVVKRGAFLHRVVVQDNALIGPRTNLRGCVIGKSTDVLRAARIEEGAVIGDECVIQEEAFVSHDVKVYPFKTIEAGAVVNTSVIWESRGQRSLFGPRGVSGLVNAEITPELVVRLASAYATTLKKGSTVTTARDGSRAARALKRAVISALTAGAINVRDLEVAPLPVARFDVRTSDAAGGIMLRSKPGDAERIDIVFLDADGDDLSPAAQRKLDRVFTRQEFRRAFPGEIGDLRFPARTADVYTQDLLDRVDTSGLAEADLKVVVDPSGGAASLLLPTLLGRLGVDVLTVNGRLDETYPEPGAEQERRALDRLGALVASSRAAFGVRFDHIGERITIVDERGDLISDERALLVMLDLVAAENRGAQAAVPVTTTRVADQVGRFHGLTVRRMSMSGSELSRVVQAEPIVFAADGRGGFVVPEFAPVIDGLAAFVRLVALVARTRLTLSAIDARIPPVAMVRASVPTPWAEKGTVMRRVVESVDVDSGDQVDTTDGVRVVGPDGSWVLVLPDPSEAVTHLWAEAADLGGAQKLVRRWSAVVETVPPEQAPVTRS

SEQ ID NO: 26701 - protein, 566 aa, Corynebacterium diphtheriae
MDTRDPHAWWRDAAIYQIYPKSFASSGGPMGTLRGITSRLDYVRDLGVDAIWLSPFYTSPQRDGGYDVADYFSVDPLFGSNADAEELISEAHDRGLRVIFDLVPNHTSDQHVWFREALQAGPGSPKRNHYWFREGKGPQGCEPPNDWLSIFGGSAWTQVCARDDAPDSPWEHDTSWYLHLFDSSQPDLNWSNKDVVEFFDSILRFWLDRGVDGFRVDVAHGLAKDPELPDWQFHWTMVDGGHDSPEDVPPPPMWNREEVHQIYRHWRTVLDEYPGNRALVAEAWVDATTDIAHYVQPDEMNQAFNFDFLICPWRSEDLGRVIHTSLEALAPTGSPATWVMSNHDVVRASSRLGLSTPGARPNGIRATDEQPDADLGARRARAAHMLMYSLPGSVYIYQGEELNLPEHTTLDDALRQDPTYFRTEHREAGRDGCRIPLPWTSQRPGLGFSPTGQTWLPQPEGWENRAVSHQESDPHSDLMLFRRMLQVRKSLNFGRGRLSPVWLKQDCLAYINSDDGRCDVMLIVAFDQDVAVPEGWHIALSTEECHDVVAANSAAWLLREGDSWHV

SEQ ID NO: 26702 - protein, 596 aa, Corynebacterium diphtheriae
MHPNCNDIAQPHPLLPMDINRALARNEPICRYFYPHTTTPTTPLVITSYLTTKNTSRELSTIESMTSKSLPTRTTLSSGTFYQIYPPSFADSNKDGIGDFRGIISRLDYLSDLGITGIWLNACFDSPFKDGGYDVRDYTKVASRYGTHEDLVELFHQAHARGIAIILDLVPGHTSEQHPWFQQSAASKYTDFDDRYIWTSHAFEGGAGLAFIGGEHPRNGAYIINFFKSQPALNYGFAELTQPWHQPVDAPGPRANQDAMVEIMKYWLSQGADGFRVDMADSLVKNDGTSKRATIGIWQSMLSQVRAEFPNAIFVSEWGTPTQAFEAGFDADFYLDWRGNGYNLLARNTDTPLERRDDASFFNSDSATGAQEFLDMYLPQWERTHEAGLFSFISGNHDCPRLAPRLNEQERALFFLFQLTMPGLPFIYYGDEIGLPYAEIPTKEGGYARTGSRTPMCWDSQLPNGGFSLGDAPLYLPMTDTSQNVAQQRERADSLFHHVQKLIQLRSQLPALDGFADLEFDLSLLKKHPKVMVYRRTHHHGDSVLIALNAGNKPIRVELQQPQAHELFRCGDVTYPDLSDHSVVELGPTSGVILSV

SEQ ID NO: 26703 - protein, 404 aa, Brassica rapa
MGICMSVQVKAESPSNTGASPKYMSSEANDTQSMGSKCSSVSVRTSPRTEGEILQSPNLKCFSFAELKAATRNFRLDSVLGEGGFGCVFKGWIDEESLTASKPGTGMVIAVKRLNIEGWQGHQEWLAEVNYLGRLSHPNLVKLIGYCLEDEHHLLVYEFMPCGSLENHLFRRGSYFEPLSWNIRLKIALGCAKGLAFLHSAETQVIYRDFKTSNILLDSNYNAKLSDFGLAKDGPTGDNSHVSTRVIGTYGYVDPGYLLNGHLTTKSDVYSYGVVLLEMLSGRKVVDNNRPPREQKLVDWAKPLLANKKKVSRVIDNRIRDQISVKEAHKVATQVFRCLDVDKNQRPNMNEIVFHLENIQASREEGGNKTEKRMRRRRDSFAQQTGVGGIATAYPRPSASPLFV

SEQ ID NO: 26704 - protein, 341 aa, Pseudomonas syringae
MTTQQPVAVLGGGSFGTAIANLLAENGHQVLQWMRDPEQAQAIRVNRENPRYLKGIKVRPEVEPVTDITATLEACELIFVALPSSALRAVLSPHVERLNGKMLVSLTKGIEAQSFKLMSQILEEIVPQARIGVLSGPNLAREIAEHALTATVVASEDEALCQQVQAALHGRTFRVYASNDRFGVELGGALKNVYAIIAGMAVALDMGENTKSMLITRALAEMTRFAVSQGANPMTFLGLAGVGDLIVTCSSPKSRNYQVGFALGQGLTLEAAVTRLGEVAEGVNTLKVLKVKAQEVQVYMPLVAGLHAILFEGRTLSQVIEALMRAEPKTDVDFISITGFN

SEQ ID NO: 26705 - protein, 468 aa, Oceanobacillus iheyensis
MKQQIGVIGLAVMGKNIALNMESKGFSVAVFNRSYEKTENFLANEASGKKFIGAKTIEEFVDSLEKPRKIMLMVKAGPATDATIESLKPHLDKGDILIDGGNTLYEDTIRRNKELDESGIHFIGTGVSGGEEGALNGPSIMPGGQAEAYKLVAPIFEAISAKVDKDPCVTYIGPNGAGHFVKMVHNGIEYGDMQLIAEAYDLMKNVLGLDAKELHNVFKEWNDGELDSYLIEITADIFTKVDEETGKPLVEVILDKAGQKGTGKWTSKNALDLGVPLPLITESVFARFISSLKDERVRASKELSGPTNAMLGESKEELIEAIRQALYMSKIVSYAQGFAQMRAASDEYDWNLSYGDIAMIWRGGCIIRAKFLQKIKDAYDRDSQLPNLMLDPYFKEIVEGYQSSLRKVVSLAVAHGIAVPTFSSAIAYYDSYRSEDLPANLIQAQRDYFGAHTYERKDKDGIFHSQWF

SEQ ID NO: 26706 - protein, 95 aa, Rhodospirillum rubrum
MAKEELIEMDGVVTDVLPDSRFKVQLDNGHEVMAYSAGKMKKHRIRIMVGDRVDMEMTPYDLTKARITYRHKVGGPPGPVTGGGNRPPPRQPRRR

SEQ ID NO: 26707 - protein, 99 aa, Tulipa gesneriana
MAKNHKLPAAALKQMLMRCSSIGRRQNCQGLPVDVPKGHFVVYVGEKRSRFIVPISYLARPEFQQLLRHAEEEFGFEHDIGLTIPCEEVVFRLLTLALR

SEQ ID NO: 26708 - protein, 107 aa, Tulipa gesneriana
MAVRKSSNLPQAAVIRHILKRCSSFGRKNGACSDKGHSLPLDVPKGHFAVYIGEKRSRFIVPISLLAHPEFQSLLRAAEEEFGFDNDMGLTIPCEEVVFRSLTAVLC

SEQ ID NO: 26709 - protein, 204 aa, Triticum aestivum
LSDEQIIDLIMTIIYDGYETMSTTSMMAVKYLSDHPRALQELRREHLDIRKGKSPEEAINYEDFKSMAFTRAVIFETLRLATVVNGLLRKTTQNVEMNGFVIPKGWRIYVYTREINYDSFMYSDPMTFNPWRWLEKNMESHPHFMLFGGGSRMCPGKELGTAEIATFLHYFVTRYRWEEEGKNTILKFPRVEAPNGLHIRVQDY

SEQ ID NO: 26710 - protein, 108 aa, Coccidioides posadasii
MAPKTHISNAENLKKYMELDQRGKIMAEYIWIDAYGGVRSKTKTVNKVVKSADELPEWNFDGSSTGQAPGDNSDVYLRPVAIFPDPFRRGENILVLCETWDSDGSPNK

SEQ ID NO: 26711 - protein, 251 aa, Thermococcus kodakarensis
MREIEISRAIVEAYFNDLLQNLQLDIAIVGAGPSGMVAGYYLAKGGAKVAIFEKKLSVGGGIWGGAMGFNRVVVQESAREILDEFGVDYSQVGNGLYVLDSIELASTLASKAVKAGAKIFNMVEVEDLVVKDGRVSGLVINWTPVMMTGLHVDPLTVEAKFVVDSTGHGAQISQHLLKRGLIKAIPGEGPMWAEKGEELTVEHTREVFPGLYATGMAANALAGAPRMGPIFGGMLLSGRKAALEILQKLGK

SEQ ID NO: 26712 - protein, 360 aa, Vitis vinifera
MAAMVLLLGFLLATLQITGVKSVGVCYGMLGNNLPPASQVVALYKSRNIDRMRIYDPNQAALQALRGSNIQLMLGVPNSDLQGLATNPSQAQSWVQRNVRNYWPGVSFRYIAVGNEVSPVNGGTSRFAQFVLPAMRNIRAALASAGLQDRVKVSTAIDLTLLGNSYPPSQGAFRGDVRGYLDPIIRFLVDNKSPLLANIYPYFGYSGNPKDISLPYALFTANSVVVWDGQRGYKNLFDAMLDALYSALGRAGGASLEVVVSESGWPSAGGFGTTVDNARTYNSNLIRHVKGGTPKRPGRAIETYLFAMFDENKKEPQLEKHFGLFFPNKQPKYSINFSGEKPWDVSTENDTNEESLKSDI

SEQ ID NO: 26713 - protein, 227 aa, Xanthomonas oryzae
MRWITGVVLNYNTDTQAVNCLSSPTDGTPSPVRRLNYRRALLMLLNRLLVIVFIGFFAKSAFAAGTPVLDVDYRPLAGKTPINLNLTYGGKVVMVVNTASKCGYTPQYEGLEALNQRFASRGFTLLGFPSNDFHGQEPGSEKQIQEFCTLTYGVKFPMFEKVHVLGAEATPLYQRLTQATGVAPGWNFHKYLIGRDGRVVAQFPSKIKPDDPSVLAAIERELKAPSR

SEQ ID NO: 26714 - protein, 389 aa, Desulfitobacterium hafniense
MSTQKKTINFLQEFSIPLILGVLIALVWANLAPENYHHFVHNEIIGHISLHFFVNDIFMVFFFAMAAIEITQSLLPGGSLNPLKRAINPLMATLGGVLGPALVFLGLNALIGSPEFARGWGIPTATDIALAWLVARVVFGAQHAAVSFLLLLAIVDDGIGLMIIAFFYPDPANPVAPLWLLLTVAGMLVAYLLRRKNVQSYWPYIILGGILSWAGLYLAHIHPALALVFIVPFLPHPPREEFGLFEDDPQDHSTLKTFEHEWKIFVDFGLLLFGLTNAGVEFSEINTLTWLVLIALVGGKTIGIFLMGSLATVIGFPFPKGMGYKELLVAGVIAAMGLTVALFVSGVAFIDPGLQGAAKMGALFSAVAAVIAFALGKVLGIKKVKDTQA

SEQ ID NO: 26715 - protein, 406 aa, Haloferax volcanii
MMTDTVDDVDLPYDKDSASQQEKITALQERLEVLETQNEEMRDKLLDTNAENNKYQQKLERLTHENKKLKQSPLFVATVQEITDEGVIIKQHGNNQEALTEVTDEMREELEPDARVAVNNSLSIVKRLDKETDVRARVMQVEHSPDVTYEDIGGLEEQMQEVRETVEMPLDRPEMFAEVGIDPPSGVLLYGPPGTGKTMLAKAVANQTNASFIKMAGSELVHKFIGEGAKLVRDLFEVARENEPAVIFIDEIDAIASKRTDSKTSGDAEVQRTMMQLLAEMDGFDERGNIRIIAATNRFDMLDPAILRPGRFDRLIEVPKPNEDGREIIFQIHTRKMNVSDDVDFVELAEMADNASGADIKAVCTEAGMFAIRDDRTEIFMQDFVDAWEKIQQEASDETEVSRAFA

SEQ ID NO: 26716 - protein, 643 aa, Shewanella oneidensis
MCGFAGFFNTSNLTDHARILECMGLELFNRGPDSFGIWFNSDDRIGLVHRRLAIVDLSAAGHQPMTSDSGRYIISYNGEIYNHQELRDELESIRQYNWRGHSDTETLLAAIEQWGLKITLQKATGMFGIALWDTLNKELYLARDRFGEKPVYYGLHKDAFIFASQLNAFRAYPDFKPEINRDSITLLLRHNYIPAPYSIYSDIHKLLPATILKLDSNNNISLETYWSAKDIMSNASSTETDLPVGKQVEALENTLKKAVALQMSADVPLGAFLSGGVDSSLIVSLMQAQSNKPVKTFSIGFDDPRFNEAVFAKEVAKHLGTEHTELYLTAEDALEVIPKLAEIYDEPFSDSSQIPTFLVSKIARQYVTVSLSGDAGDELFCGYNRYLMTSKVWKRLSVLPVFLRSFLANVFTFVPVNVWNLFGKLLPSRLQLSNLGDKLHKAAAVLACRDVEQLYLGLVSHWQNPEQVVLGSKEPLTVLTDPKRKANFSDPILQMMAQDTLSYLTDDILVKVDRAAMAVSLETRVPFLDHSVLEHAWRLSLDLKLRDGKTKWCLREILYKYVPKDLIERPKMGFAVPLDAWLRGPLKVWADNLLAAERLRQEGFFDAELIDRMWQEHKSGKRNWQYQLWDILMFQSWYEKYHK

SEQ ID NO: 26717 - protein, 484 aa, Legionella pneumophila
MLIFELSKTGRQAKAQIPRAVSKNYSIPEEFQRKSRPRLPACSELQVVRHFTCLSQKNFSIDTNFYPLGSCTMKYNPRGVHKAASLPGFINRHPLAMDNESQGFLETLYKLQNYISEITGMPGVSLTPMAGSQGEFAGVAMIKAYHQSRGDTARDEILIPDAAHGTNPASAVMCGFKVVEIATAPDGDIDLDELKRKVGPRTAGIMLTNPSTLGLFMRQIKEIASLVHQAGGLLYYDGANLNAILGKVRPGDMGFDVMHLNLHKTFATPHGGGGPGAGPVAVGKRLIPYMPLPVVKKTDSGYHWATRQDYPQSIGRLSCFMGNAGILLRAYFYMLVLGKEGLLRVSEFATLNANYLLKELTKVGYTAAYPDRRASHEFILTLNSEKKNYDVTAMDFAKRLLDYGVHAPTTYFPLLVPECLLIEPPETESKEELDAFVAVMKTIREEASKQPDILKAAPHTLPVKRLDDVKAARELDLNYFATHE

SEQ ID NO: 26718 - protein, 376 aa, Pseudoalteromonas tunicata
MSKRDYYEVLGVERDASERDIKKAYKRLAMKYHPDRTAGDKDLEAKFKEVKEAYEILTDSQKRKTYDQYGHAAFEQGGGHGGFGGGQGDFGDIFGDVFGDIFGGGGRRQSRQQRGADLRYNMDLSLEEAVRGKSVEIKVPTWVSCDPCDGSGAKAGSKPTTCGTCHGSGQVQMRQGFFAVQQTCPTCSGRGQIISDPCNKCHGQGRVEKTKTLSVKIPAGVDTGDRIRLSGEGEAGLNGAPAGDLYVQVSVREHAIFVRDGNNLYCEVPISFTTAALGGDVEVPTLDGRAKLKIPSECQTDKMFRLRAKGVKSVRSGAIGDLICKVVIETPVNLNERQKELLRELEESMGSNTSKNRPKEQGFFDGVKKFFDDLTK

SEQ ID NO: 26719 - protein, 517 aa, Aspergillus oryzae
MAAISEEYPPEFSDERGLALISDIVDWQINHGSLLKRIDTETQFPDDAPQCYPVGVTVFPTLFPREQFDRACGLQIIYNELYCAMAEDEHWIFETIRDMIPIDPLAAALWGIHEEVKKVGYAQKVSVGIFRSDYMLDAPGMEFPLRPGETFDGSLKQVELNTFSCSGATHANKAADMHRYLARTNAYDTGDDRQINISLDTLPRNNNIPSLSACLAAAHDAYGPKKSSVATDTAVLFVVQPNNFNIADERPLEYALWDRDPPVPAYRVDYPNDFLQYTTLTESRELLFHPPWLGSKCVEISVAYMRAGYEVHEYDTTGKEARLRIELSTAIKCPSLLAHICTFKRVQCALTSPGALEHFISPAKAALVRSTFVSMYPLDGSEAGFRARRLATDPELSRDYILKPSLEGGGHNIFGEDIPDFLASVPESKWGAYILMERIRSPSVSNVLLSSAGLDSGGVVSELGVFGTCLWWKGTEGRHCEMLLNSVGGWSFKTKHEDVNEMSVVKGYGCFDTPLLF

SEQ ID NO: 26720 - protein, 456 aa, Legionella pneumophila
MPYIPHTPNDTKEMLAAIGAQDIQDLFDEIPASLQYAGFQNIPAGINEMEMLKEAQNQAQKNRNGICFIGAGCYEHHIPAAVWDIASRGEFLTAYTPYQAEASQGTLQLLYEYQTMICELTGMEVSNASMYDGATALAEAVLMAVRLNKHSKTNRVLIAGTVHPFYRETIETIVRNQHIEVITLPFDEQQGITDLGSLNQYTGEDITALVIAQPNFFGCLEQVDKMTSWAHHNKTISVACINPTSLALLKPPGSWGEHGVDIVCGEGQPLGSPMASGGPYFGFLSTRMAHVRQMPGRIIGRTVDKDGKTGFSLTLQAREQHIRRAKATSNICTNQGLLVTAATIYMSLLGPEGLSQVATQCHQNTHELITALTQIEGVEQAFKASFFHEALIKLNQPVQSVLQQLADAGIAGGYAPEQHYPQLANTLLVCATEVRTAEDIAKYAKTLKAIMSKRGA

SEQ ID NO: 26721 - protein, 175 aa, Glycine max
  misc_feature (6)..(7): Xaa can be any naturally occurring amino acid
  misc_feature (33)..(33): Xaa can be any naturally occurring amino acid
  misc_feature (36)..(36): Xaa can be any naturally occurring amino acid
  misc_feature (39)..(39): Xaa can be any naturally occurring amino acid
  misc_feature (41)..(41): Xaa can be any naturally occurring amino acid
  misc_feature (47)..(47): Xaa can be any naturally occurring amino acid
  misc_feature (55)..(55): Xaa can be any naturally occurring amino acid
  misc_feature (61)..(61): Xaa can be any naturally occurring amino acid
  misc_feature (67)..(67): Xaa can be any naturally occurring amino acid
  misc_feature (89)..(89): Xaa can be any naturally occurring amino acid
  misc_feature (105)..(106): Xaa can be any naturally occurring amino acid
  misc_feature (109)..(110): Xaa can be any naturally occurring amino acid
  misc_feature (114)..(115): Xaa can be any naturally occurring amino acid
  misc_feature (117)..(117): Xaa can be any naturally occurring amino acid
  misc_feature (120)..(122): Xaa can be any naturally occurring amino acid
  misc_feature (126)..(127): Xaa can be any naturally occurring amino acid
  misc_feature (130)..(130): Xaa can be any naturally occurring amino acid
  misc_feature (133)..(135): Xaa can be any naturally occurring amino acid
  misc_feature (139)..(139): Xaa can be any naturally occurring amino acid
  misc_feature (148)..(148): Xaa can be any naturally occurring amino acid
  misc_feature (154)..(154): Xaa can be any naturally occurring amino acid
  misc_feature (157)..(157): Xaa can be any naturally occurring amino acid
  misc_feature (160)..(161): Xaa can be any naturally occurring amino acid
MAAASXXSTMISTPALSPSTSIQKHHHLKPSNXCFXGLXPXTRFTTXVSSTTKRXIPKGGXGVRAEXNSSLVISLSTGLSLFLGRFVFXNFQRENAVKQVPEQNXXTHXXEAGXXRXMEXXXLLKXXDPXGFXXXDVLXWGSIGHVVXYYILAXISXGYXXIFRNFFYGCRIMDC

SEQ ID NO: 26722 - protein, 431 aa, Picrophilus torridus
MNLFIFRRDLRLYDNTALLKSLNNETATIFIMDPAQVKNNEYRSEKALNFMISSLYDLMTDIEGNHGKLAVFHGDPVDVLKRLVNRENINEIYINRDYTPFSIKRDERIKEFSIKNNIKFNALDDYFLSDPELRTGSGSFFKNFTAFYNRAMEINVKKPVYEIKKSNLIPIDGDDMELKYNNYGRKTAIEKMHNFIKNDYSLRDFPELNMTSFLSADIKFGNISIREAYHYIKDPEFRRQLYWRDFYLYIAYHFPYVFGSNFNRKYNIKWENKEKYIDAWKNGLTGYPIVDAAMRSLNETGYINNRLRMIVSSFLVKDLHVDWRIGEKYFAQKLIDYDPASNNGNWQWVASTGVNSRGMYRIINPWIQQKKFDPECKFIKRYVNELSDLEPEIIHNLYKIRLNNYPAPLVDHKTAVMEFRKLINQTPTYLS

SEQ ID NO: 26723 - protein, 111 aa, Triticum aestivum
  misc_feature (4)..(4): Xaa can be any naturally occurring amino acid
  misc_feature (28)..(28): Xaa can be any naturally occurring amino acid
  misc_feature (33)..(33): Xaa can be any naturally occurring amino acid
  misc_feature (42)..(42): Xaa can be any naturally occurring amino acid
  misc_feature (45)..(47): Xaa can be any naturally occurring amino acid
  misc_feature (65)..(65): Xaa can be any naturally occurring amino acid
  misc_feature (67)..(67): Xaa can be any naturally occurring amino acid
  misc_feature (71)..(71): Xaa can be any naturally occurring amino acid
  misc_feature (73)..(73): Xaa can be any naturally occurring amino acid
  misc_feature (90)..(90): Xaa can be any naturally occurring amino acid
  misc_feature (98)..(98): Xaa can be any naturally occurring amino acid
  misc_feature (102)..(102): Xaa can be any naturally occurring amino acid
VDRXQIGMRGVFGKPKGVCARVAIGKVXLFVGXKPKNAIHAXEAXXXAKLKFPGPQKIIERRKWXFXKLNXKXYLKLKSEGRILPDGVKXKLLGCHGXLGNXAPGKVFLFA

SEQ ID NO: 26724 - protein, 931 aa, Bartonella henselae
MLERPFFSRHIGLRPDEKQKMLDIVAVDSIDTLVSQALPHSIHLGRPLNLPKAVSEGQALEELSKMMERNYLHKSFIGQGYHGTYVPPVILRNLFENPAWYTAYTPYQAEISQGRLELLFYFQTLISELTGLPVAAASLLDEATALAEAITVAFRFTREKKMKISLQSLLHPQILSVVQTRAETQGLQVSKNSEICSDTAAIVLSWPDTKGSFNDYSEVIKEAKAKGALVIVVADPLALTLMEAPAKWGADIVVGSMQRYGVPMGFGGPHAGYLAVSDALTRLIPGRIVGQSVDTKGRVGFRLALQTREQHIRRDKATSNICTAQALLANMATAYAVWHGPQGLQEIAQRVHHLTCRFVGGLEAVGISCEGEYFFDCVSIVVKGKAREIACQAKAGGRLIRVLDDDRVVINFDELSTQEDAHALAQLFGAGLVDQASPRLMGKGRDTTFLSQPFFHAVHSETDMMRFLRRLSDKDLALDRAMIPLGSCTMKLNAAAELMPVSWPTVANIHPFASREDAVGYQEMIHQLNAWLCEITGFAQVSFQPNSGAQGEYAGLLAIRRYHQSRGEHQRTLCLIPASAHGTNPASAHMAGMEVVVVKCLNDGDVDLDDLKMKAQLYKERLAALMITYPSTHGVYEESIKDICSLIHENGGQVYFDGANLNALVGLARPADIGADVCHMNLHKTFAIPHGGGGPGVGPIGVVEHLKPFLPGHEQEGTTHAVSAAPYGSASILVITWMYIRMMGAEGLKYATQTAILNANYIAARLSQVYSILYRGKHGRVAHECIVDTRVLKEQYGVSVDDIAKRLIDYGFHAPTMSFPVPGTLMIEPTESEPKAEIDRFCDALLSIAEEAKKIGSGVWPKDDNPLVHAPHTLVDTLDDTWARPYSRQEAAFPNCSLDPANKYWPPVSRIDNVAGDRMLICSCPPLGNTY

SEQ ID NO: 26725 - protein, 917 aa, Arabidopsis thaliana
MAASVDNRQYARLEPGLNGVVRSYKPPVPGRSDSPKAHQNQTTNQTVFLKPAKVHDDDEDVSSEDENETHNSNAVYYKEMIRKSNAELEPSVLDPRDEYTADSWIERNPSMVRLTGKHPFNSEAPLNRLMHHGFITPVPLHYVRNHGHVPKAQWAEWTVEVTGFVKRPMKFTMDQLVSEFAYREFAATLVCAGNRRKEQNMVKKSKGFNWGSAGVSTSVWRGVPLCDVLRRCGIFSRKGGALNVCFEGSEDLPGGAGTAGSKYGTSIKKEYAMDPSRDIILAYMQNGEYLTPDHGFPVRIIIPGFIGGRMVKWLKRIIVTTKESDNFYHFKDNRVLPSLVDAELADEEGWWYKPEYIINELNINSVITTPCHEEILPINAFTTQRPYTLKGYAYSGGGKKVTRVEVTVDGGETWNVCALDHQEKPNKYGKFWCWCFWSLEVEVLDLLSAKEIAVRAWDETLNTQPEKMIWNLMGMMNNCWFRVKTNVCKPHKGEIGIVFEHPTLPGNESGGWMAKERHLEKSADAPPSLKKSVSTPFMNTTAKMYSMYEVKKHNSADSCWIIVHGHIYDCTRFLMDHPGGSDSILINAGTDCTEEFEAIHSDKAKKMLEDYRIGELITTGYSSDSSSPNNSVHGSSAVFSLLAPIGEATPVRNLALVNPRAKVPVQLVEKTSISHDVRKFRFALPVEDMVLGLPVGKHIFLCATINDKLCLRAYTPSSTVDVVGYFELVVKIYFGGVHPRFPNGGLMSQYLDSLPIGSTLEIKGPLGHVEYLGKGSFTVHGKPKFADKLAMLAGGTGITPVYQIIQAILKDPEDETEMYVIYANRTEEDILLREELDGWAEQYPDRLKVWYVVESAKEGWAYSTGFISEAIMREHIPDGLDGSALAMACGPPPMIQFAVQPNLEKMQYNIKEDFLIF

SEQ ID NO: 26726 - protein, 177 aa, Haloarcula marismortui
MMTEQATFAGGCFWCTESVFKQINGVTDVVSGYAGGHVADPSYEAVCREETGHAECVQLTYDPEEVSYEDLLAVHFTTHTPTTKDREGNDVGTQYRSAVFYHDEAQRETVEALIEEIEPGYDSDIVTEVEPLETFYPAEEYHQDYFEKNPDQSYCQLTIPPKIEKLEETHEELLRAD

SEQ ID NO: 26727 - protein, 107 aa, Tulipa gesneriana
MAVKKSPKISEAAAIKQILKRCSSIGRKHGAYSEENYCLPLDVPKGHFAIYVSEKRSRFVVPISLLAHPEFQSLLRDAQEEFGFDHDMGLTIPCEEIVFKSLTAVLW

SEQ ID NO: 26728 - protein, 571 aa, Coccidioides immitis
MDKSEKGIVVAGNDQSNLPAYESSEDARDAIENQEQLGFWTRMGCTPESFKQRTLADKHNQLNRTLKGRHLHMIAIGGSIGAGLFVGSGSALHDGGPATLIIDFMIIGVMMFNVVFALGELAIMYPVSGGFYTYSTRFIDPSWGFAMGWNYVFQWAIVLPLELTVAGLTIGYWQVDVSVGVWITVFIIAIILINIFGVLGYGEEEFWSSCLKLAAVVIFMLIALVCVLGGGPSHGKYGEYWGARLWYDPGAFRNGFKGVCSVFVTAAFAFSGTELVGLAAAESKTPVQSLPSAIKQVFWRITLFYILGLFFVGLLVDSNDERLLGSGLIDVTASPFVIAAKDAGLDGFDSFMNVIILISVLSIGNSGVYGGSRTLTALAEQGYAPKMFAYVDRAGRPLYSTIFLIAFSLLAYVNLSASGAEIFDWLQALSGLAALFTWGSICLAHIRFRSAWKYHGHTLDELPFKAALGVVGSWIGLTLVIIVLIAQFYTAVWPLGGGVNNAEGFFKSYLAMPVVLFFWACGYFWKGKGWLKLSQIDVDSGRREIDWEAHNAMMEKRRNAALIKRIMYFLF

SEQ ID NO: 26729 - protein, 72 aa, Corynebacterium diphtheriae
MAKEGAIEVEGRIIEPLPNAMFRVELDNGHKVLAHISGKMRQHYIRILPEDRVVVELSPYDLTRGRIVYRYK

SEQ ID NO: 26730 - protein, 266 aa, Lactuca sativa
MAASTMALSSPFAGQAVKTSPSSSELFGNGRVSMRKTAAAKKAAPSGSPWYGPDRVKYLGPFSGEAPSYLTGEFPGDYGWDTAGLSADPETFSKNRELEVIHCRWAMLGALGCVFPELLARNGVKFGEAVWFKAGSQIFSEGGLDYLGNPSLVHAQSILAIWATQVILMGAVEGYRIAGGPLGEVVDPLYPGGSFDPLGLADDPEAFAELKVKEIKNGRLAMFSMFGFFVQAIVTGKGPLENLADHLADPVANNAWSYATNFVPGK

SEQ ID NO: 26731 - protein, 208 aa, Hypocrea lixii
MASPLPVRAAALSRDTNETSIQIALSIDGGELPQDADPRLLEASSAHASQTSKSQVISINTGIGFLDHMLHALAKHAGWSMALNCKGDLHIDDHHTAEDCCIAVGTTFAKALGALTGVARFGYAYAPLDEALSRAVVDLSNRPYTVVDLGLKREKLGELSCEMIPHCLQSFAQAARITLHVDCLRGDNDHHRAESAFKALAVAVRWYD

SEQ ID NO: 26732 - protein, 706 aa, Candida glabrata
MSEHNNENLNLHEGLNLDDDDLENMLKNPNLFTTSPGIDVESIPSATNQNSVNGQDDKSGIKSQNSDTNEVIEDIVNPSIDPYVSTPHNDEMASPEDDIDSINNKDSNKLMTSLVRQNYGPHLGRDNADINSSNFRSHYQNLFDDNYLKTDMGSPVNKNKRKREDDDDDQLYSSQILRGPLSPGGNAHKVDNRLMSYGSNNLNSRQQTPGMENTPSVLNRRFQNKTRPAFVNKVWSMINDPVNSHLIQWSEDGLSLIVVNREKFVHEILPKYFKHSNFASFVRQLNMYGWHKVQDVKSGSIQSSSDDRWQFENEFFVRGREDLLNRIVRQKGTSANATPGTQSNMKYGNGNQIRGLPNVNGQTLRLMNEANMGNTMDITAVLGELEQIKFNQMAISKDLMRINKDNELLWKENMIARERHRTQQQALEKIFRFLRNVVPHADQKLLMDVAEPVSSRIEEAQDISDAPSVSSKSFDFDDGKEDRSRYIPLQDEDGKRPLYLLKNRTMSENSNKSSGGRLASTHNDSSGRISEIPFEEDDLSPPRHEVTDVGHISGQKNVAIDKLKADLHEQEARIKYLEDMVENKTLDSHLNDSMTMPMMPSPSTMLMHDMVEPSTIALGKEATDTSEGKHHGHDQQGQVQGQDQVQGQDQMHSQDQQNDMSAIGGLSELSPGLSPGLSSGLSPGFDIGDYLNSSQNHMTPMYEDKK

SEQ ID NO: 26733 - protein, 319 aa, Listeria innocua
MASEEKIYDVIIIGAGPAGMTAALYTSRADLDTLMIERGVPGGQMVNTAEVENYPGFDSILGPDLSDKMLSGAKQFGAEYAYGDIKEVIDGKEFKTVTAGSKTYKARAIIIATGAEHRKLGAAGEEELSGRGVSYCAVCDGAFFKNRELVVVGGGDSAVEEGTYLTRYADKVTIVHRRDKLRAQQILQDRAFKDEKVDFIWNNTVEEIIGDGKKVTSVKLVSTVDGSESIMPVDGVFIYVGLVPLTKAFLSLGITDEEGYIVTDEEMRTNLPGIFAAGDVRAKSLRQIVTATGDGGLAGQNAQKYVEELKEALEAEAAK

SEQ ID NO: 26734 - protein, 625 aa, Bordetella parapertussis
MCGVAGLIHLDGAAVDPAVLQGMTDAIAHRGPDGEGHWIDGNVGLGHRRLAIIDLSPAGHQPMISADSRYVLSYNGEIYNFRELRAELETAGYRFKSRTDSEVLLYAVIAWGLEKALKRFNGMFAFALWDRHERRLILARDRYGIKPLYYAEQGGTLAFGSEQKAILALPGFRRKLDKAALLEYFTFQNIFTSKVLLEDIQILPAGHYAIVEPDRRASISLTQYWDFCFREPDVAATDQEYREELDRLFVQAVKRQLVSDVELGSYLSGGMDSGSIAAVAAAEHPYIKTFTCGFDLNSASGIELGFDERSKAEYMSYCFKTEHYEMVLKAGDMERILPHVACHLEEPRVGQSYPNFFAAKLASRFVKVVLSGAGGDELFAGYPWRYYRAVVNDDFEHYVDKYYNFWQRLLPNSELKRVFAPIAGEVEHVWTRDIFRNVFRHHADQLYRPEDYINHSLYFEAKTFLHGLLVVEDKLSMAHGLETRVPFLDNDLVEFAMRCPIRLKLNNLAEVVKINENETGNKVRKFFEKNRDGKTILREVMNHRLPADISKAEKQGFSAPDASWFKGESLEFVRRKLLDGHSPLYEIMDAATVRELVNEHLGGIRNRRLLIWSLLSVDAWMRQTF

SEQ ID NO: 26735 - protein, 236 aa, Amborella trichopoda
MARRYWDINLEEMMGAGVHFGHGTRKWNPRMAPYISGKRKGIHITNLTRTARPLSEACDLVFDAASRGKHFLIVGTKDKAADSVASAAIRARCHYVNKKWLGGMSTNWSTTETRLHKFRDLRAEQKMGRFKRLPKRDAAMLKRQLSHLQTYLGGIKYMTGLPDIVIIVDHQEEYTAIRECLTLGIPTICLIDTNCDPDLADIPIPANDDAIASIQLILNKLVLAIREGHYSYLGSH

SEQ ID NO: 26736 - protein, 381 aa, Aspergillus nidulans
MKRQALTLIPLLGAAAAQSGPYGQCGGNDWSGATTCVSGHSDQFVHDADDDDQRYNKNNDNDDNMLTNDADVDLVLDHIASSGHKILRIWGFNDVNTEPSTGQVWFQKHQGGVSTINTGQYGLQRLDAVVSSAEKRGIKLIINFVNNWDDYGGMSAYLNAYGGSTKTDWYTSATIQAAYRTYIKAVIDRFIDSPAIFAWELANEPRCNGCDTSILYDWIADTSAYIKSLDPLHMVCIGDEGFGLDEGSDGSYPFSYNEGLDFAANLAIDTIDFGTFHLYPGSWGVSYDWGNLWAITHGAACATAGKPCLFEEYGAPSDHCAIEVPWQTTAVSSTGIAGDLFWQWGDTLSTGQTHNDGNTIYYGSDEYTCMVTEHMERIAAR

SEQ ID NO: 26737 - protein, 195 aa, Triticum aestivum
GEVKRVTKETNVHVKINLDGTGVANSSTGIPFLDHMLDQLASHGLFDVYVKATGDTHIDDHHSNEDIALAIGTALLQALGDRKGINRFGHFTAPLDEAAVEVILDLSGRPHLSCGLSIPTERVGTYDTQLVEHFFQSLVNTSGMTLHIRQLAGNNSHHIIEATFKAFARALRQATEYDLRRQGTMPSSKGVLSRS

SEQ ID NO: 26738 - protein, 113 aa, Brassica napus
  misc_feature (17)..(17): Xaa can be any naturally occurring amino acid
  misc_feature (33)..(33): Xaa can be any naturally occurring amino acid
  misc_feature (45)..(45): Xaa can be any naturally occurring amino acid
  misc_feature (87)..(87): Xaa can be any naturally occurring amino acid
LKMGMIGLDKEKQFVFXKNEAGGENEIDDLPNXGIRKILLKYHIXGYEFETCGYCMNSIEGDAISTIHVTHEDGFRYARLEAVGNEXSTLDMSQLVTRVLSCVQPKQLFVSAQ

SEQ ID NO: 26739 - protein, 270 aa, Mycobacterium avium
MAKTIVITGASDGIGRAAARILRDAGHTIVVVGRSLEKTKAIADELGCRHHIGDFARLEDVRRLAGELLEQYPVIDVLCNNAGGIMADRRTTVDGHEMTLQVNHLAPFLLTTLVLPRLISSKATVIATSSSVNRRGRIRLDDLEGERRYSATGAYSAAKLANILFTKELHRRYADAGVTAVSFEPGPVASNFGADSTLLMRLIYHSVANRFLLSPTRGADTLAWLADSRPDVDWSSGLHYRKRKPVKPSRLADDAALGRQLWKQSELMVQ

SEQ ID NO: 26740 - protein, 412 aa, Haloferax volcanii
MSRSPSLPERPHLDLDPEMSDAERLSALRQHFERMVDVNRELDQRLQNADDRHAELVDEVDQMKARNEALKTASYYIATVEELTDDGVIIKQHGNNQEVLTEFAPSLNIDDIEPGDRVAINDSFAVQTVLDDETDARAQAMEVVESPTVTYDDIGGIDEQVREVREAVEQPLENPEMFAEVGIDPPSGVLLYGPPGTGKTMLAKAVANETNASFIKMAGSELVQKFIGEGARLVRDLFKLAAEREPVVVFIDEIDAVASKRTDSKTSGDAEVQRTMMQLLSEMDGFDDRGDIRIIAATNRFDMLDEAILRPGRFDRLIEVPKPAVEGRRHILDIHTRDMNVADDVDLDALAEELDDYSGADIASLTTEAGMFAIRDGRTEVTGADFDAAHEKLSNVDESGTGPISGFTDYQY

SEQ ID NO: 26741 - protein, 544 aa, Desulfovibrio desulfuricans
  misc_feature (399)..(399): Xaa can be any naturally occurring amino acid
SNAMFCYQCQETVGNKGCTQVGVCGKKPETAALQDALIYVTKGLGQIATRLRAEGKAVDHRIDRLVTGNLFATITNANFDDDILAERVRMTCAAKKELAASLTDKSGLSDAALWEASEKSAMLAKAGTVGVMATTDDDVRSLRWLITFGLKGMAAYAKHADVLGKHENSLDAFMQEALAKTLDDSLSVADLVALTLETGKFGVSAMALLDAANTGTYGHPEITKVNIGVGSNPGILISGHDLRDLEMLLKQTEGTGVDVYTHSEMLPAHYYPAFKKYAHFKGNYGNAWWKQKEEFESFNGPVLLTTNCLVPPKDSYKDRVYTTGIVGFTGCKHIPGEIGEHKDFSAIIAHAKTCPAPTEIESGEIIGGFAHNQVLALADKVIDAVKSGAIKKFVVMAGXDGRAKSRSYYTDFAEGLPKDTVILTAGCAKYRYNKLNLGDIGGIPRVLDAGQCNDSYSLAVIALKLKEVFGLEDVNDLPIVYNIAWYEQKAVIVLLALLSLGVKNIHLGPTLPAFLSPNVAKVLVEQFNIGGITSPQDDLKAFFG

SEQ ID NO: 26742 - protein, 379 aa, Triticum aestivum
  misc_feature (182)..(182): Xaa can be any naturally occurring amino acid
  misc_feature (216)..(216): Xaa can be any naturally occurring amino acid
  misc_feature (226)..(226): Xaa can be any naturally occurring amino acid
MATAAASQVAFSAPVGGSDRAVRSSGIQGINSLSFGNKSWIGTALACDSKAAAQPRHVCRAVQQSSKSKVSVAPLDLESAKEPPLNTYKPKGPYTATIVSVERAVGPNAPGETCHVVIDHGGNVPYWEGQSYGIIPPGENPKKPGNPQNVRLYSIASTRYGDSFDGKTASLCVRRAVYYDPXETGQGGPSERMGVCSNSLCNSKPWGQDSKMTGPXGKIMLLPGEXPNATHIMIATGTGVAPYRGYLRRMFMEDVPNFRFGGLAWLFLGVANSDSLLYDEEFTSYLKQYPDNFRFDKALSREQKNKSGGKMYVQDKIEEYSDEIFKLLDGGAHIYFCGLKGMMPGIQDTLKKVAEQRGESWDQKLSQLKKNKQWHVEVY

SEQ ID NO: 26743 - protein, 497 aa, Tuber borchii
MYLNASRKPPSRKGSMHDVPNDLMKHIHDLEKMFTIDTTKLHEVVSVFQEELVKGLSVTGGTIPMNPTWVIGYPTGDETGTYLALDMGGTNLRVCEVELPEEQGQYDIYQSKYRLPEEIKSGTGEQLFDYIAECVKQFLIANHEGQDIKDLKELHLGFTFSYPCEQNAIDHGILQRWTKGFDIEGVEGHDVVPMFEEALERKGVPIKITALVNDTTGTLIASAYTDNTTRIGCIFGTGCNAAYMETIGCIPKLAHMNLDPSLEIAINCEWGAFDNEHRVLPRTVYDKHIDENSPRPGQQTFEKMVAGLYLGEIFRLVLVDLYSNPDVSIFEKQDISTLQAEYSLDASFLAEIESDPWENLMETHALFEKKLKIVTTEPERKLIRRLAELIGTRAARLGACGVAAICKMKNIESCHVGADGSVFNKYPNFQERGAKALREIFGWGRTIRKDPIQIVPSEDGSGVGAALIAALTMKRIRKGIHAGVNVKRKNSLIPPVP

SEQ ID NO: 26744 - protein, 544 aa, Desulfovibrio desulfuricans
SNAMFCYQCQETVGNKGCTQVGVCGKKPETAALQDALIYVTKGLGQIATRLRAEGKAVDHRIDRLVTGNLFATITNANFDDDILAERVRMTCAAKKELAASLTDKSGLSDAALWEASEKSAMLAKAGTVGVMATTDDDVRSLRWLITFGLKGMAAYAKHADVLGKHENSLDAFMQEALAKTLDDSLSVADLVALTLETGKFGVSAMALLDAANTGTYGHPEITKVNIGVGSNPGILISGHDLRDLEMLLKQTEGTGVDVYTHSEMLPAHYYPAFKKYAHFKGNYGNAWWKQKEEFESFNGPVLLTTNCLVPPKDSYKDRVYTTGIVGFTGCKHIPGEIGEHKDFSAIIAHAKTCPAPTEIESGEIIGGFAHNQVLALADKVIDAVKSGAIKKFVVMAGCDGRAKSRSYYTDFAEGLPKDTVILTAGCAKYRYNKLNLGDIGGIPRVLDAGQCNDSYSLAVIALKLKEVFGLEDVNDLPIVYNIAWYEQKAVIVLLALLSLGVKNIHLGPTLPAFLSPNVAKVLVEQFNIGGITSPQDDLKAFFG

SEQ ID NO: 26745 - protein, 124 aa, Solanum tuberosum
VTVRCGHCTNLLPGWLLPSTNHHHHSGHTYFSPSHNLLEEISNATPNFLMNQSNSAHEFLQLPARPGFDDLPRPPPVINRPPEKRQRVPSAYNRFIKEEIQRIKAGNPDISHREAFSAAAKNWA

SEQ ID NO: 26746 - protein, 199 aa, Zea mays
  misc_feature (72)..(72): Xaa can be any naturally occurring amino acid
  misc_feature (74)..(74): Xaa can be any naturally occurring amino acid
  misc_feature (124)..(124): Xaa can be any naturally occurring amino acid
PFQGRPRVRLNLICTIHAWRKRDAPLYGPKFGTPVYIWWSATQPNLALLKIGASILECVVRWEPHEAEYLQXVXEVVHSLEPVLVKNTQYIQILERLLDLERCFIFRVPWIDDRGEAHVNRVLXFQFSHVSDPCRGGLRFHPPMSLSVAKCLAFEHVILYLPKLPFHSRTHNIFVFPCLQDIVIVPLYVNYEGAFVMLI

SEQ ID NO: 26747 - protein, 288 aa, Zea mays
  misc_feature (114)..(114): Xaa can be any naturally occurring amino acid
MGGAAEEALRREYVVGEEIGRGRFGTVRRCYAAATGEPFALKTTPNAALRADPLDLALAEQEPKVHHLASAASRHVVALHAAFEDADAVHLVLDLCAGGDLFALVSARGRAPGXRGAEFQGGISPRRSPGCHRRGGPAPRTVKPDNLLFDAAAGGALRLGDFGSAAWFGDGRPMTGLVGTPYYVAPEVVAGREYTEKVDVWSAGVVLYMMLSGTVPFSGATAGEIFQAVLRGNLRFPPRAFAAVSPEAKDLLRRMLCRDVWRRLSAEQVLSHPWIVTRGGSVPGGRLV

SEQ ID NO: 26748 - protein, 405 aa, Unknown
  Candidatus Kuenenia stuttgartiensis
MQEEAKRQQETIDLIASENICSLAVQEAQGSLMTNKYAEGYVNKRWYAGCANVDTVEHLAVQRAKQIFGAEHANVQPNAGSQANMAVCFAVLKPGDRVLGMDLSHGGHLTHGFKKNFSGMMYEISHYGVKRETGCIDYDELRNIALAFKPKLIIAGASAYPRIIDFKKFRAVADEVGAYFMADIAHIAGLIAAGVHPSPVPFADFVTTTTHKTLRGPRGGLILCKSKYAKQIDAMVFPGIQGGPFMHSIAAKAVAFKEAMSEEFKKCQQQTVKNAQAMANEFVKKGYDIVSGGTDNHLFLVDLRNKNITGKEAQILLETVNIVLNRNTVPYDERGANEPSGIRIGTPTIASRGMDEKDSVKIAECIDKILSRPHNDQAKRDVKNIVKDLCAAYPLHESGACPSTK

SEQ ID NO: 26749 - protein, 133 aa, Zygosaccharomyces rouxii
HTGVGFLDHMIHALAKHSGWSLIVECIGDLHIDDHHTTEDCGIALGDAFKQALGQVRGVKRFGFGFAPLDEALSRAVVDLSNRPYSVIELGLKREKIGDLSCEMIPHFLESFTEAARLTVHVDCLRGFNDHHR

SEQ ID NO: 26750 - protein, 356 aa, Unknown
  Candidatus Kuenenia stuttgartiensis
MQQAGFNPACFYMQIKMTQNFSAKNITVIGNGGWGTALAILLYNKGNKIGLWGHDKSYTDYLNEKRENTKYLKGIIIPPDIAITSEITATLMDTQFILSATPTPYLRSVLLKFKEVFVNKTPIISITKGIENETLMRPSEIIRDVLGDPPVSLLLGPSHAEEVAHGLPTTIVASSNDLSLAQTVQELFTTDRFRVYTNTDIIGVEIGAALKNVIAIAAGICDGLSLGDTTKAALITRGLAEISRLGTAMGAKKITFSGLSGLGDLITTCISPYGRNRWVGEQIGKGKMLEEILRDMKQIAEGVWTTKSVIELSKKYRIEMPITHEIYSVLFSGKKPLEALNNLMLRTPKSEIEEIY

SEQ ID NO: 26751 - protein, 350 aa, Arabidopsis thaliana
MSSPVKKMKKKTTTSPILSPTPHSTQILSLPVDLLISILARVSRLDYPILSLVSKSFRSLIASPELYETRSLLGRTESCLYLCLGIPSDFNPRWFTLCRKPKPSGHVMAAISIPNSRPVHCSGLVAVGSDIYNIGGSIINEHSSSVSILDCRYHTWRDAPNMLVERNSHAANVIDGKIYVAGGSRDSNSSNWMEVFDIKTQTWEPVLNPIADGCDRRIRKSAVIEEAICLFGYKGVGVAYNPRIDKWEAIGEVNYLDLGWIGCWMKLKGLEGLPEFASYSYVRLADYGGKMAVLWDKLPTTGNNNMVIWCAVITLEKRHNENIWGRVEWFDAVLTVPEPYEFVCARSANV

SEQ ID NO: 26752 - protein, 131 aa, Zygosaccharomyces rouxii
GFLDHMIHALAKHSGWSLIVECIGDLHIDDHHTTEDCGIALGDAFKQALGQVRGVKRFGFGFAPLDEALSRAVVDLSNRPYSVIELGLKREKIGDLSCEMIPHFLESFTEAARLTVHVDCLRGFNDHHRSE

SEQ ID NO: 26753 - protein, 376 aa, Bacillus cereus
MAQKQKCVAMLLAGGKGSRLSALTKNLAKPAVPFGGKYRIIDFTLSNCANSGIETVGILTQYQPLELHNYIGIGNAWDLDRVSGGVTVLPPYAESSGVKWYTGTASAIYQNLNYLSQYEPEYVLILSGDHIYKMDYSKMLDYHIEKEADVSISVIEVPWDEASRFGIMNTNEEMEIVEFEEKPQFPRSNLASMGIYIFNWAILKEYLEMDARNPESSNDFGKDVLPLLLDEGKKLMAYPFEGYWKDVGTVKSLWEANMDLLRDETSLNLNDRNWRIYSVNPNEPPQYIAEKAKVEESLINEGCVIEGDVKHSVLFQGVTVEEGSMVIDSVVMPGAKIGKNVVIERAIVGSEMVIEDGTIIRPEKNVDDVVLIAEGK

SEQ ID NO: 26754 - protein, 588 aa, Hordeum vulgare
MVMGSTDRFDKSPLLDGGSSSQESTTEYTGDGSVCTSGHPASKKHTGNWKASSLTIVCSFCCYLAYSSIGKNLVSYLTKVLHETNLDAARHVATWRGTSYLAPLVGAFVADSYLGKYRTALIACTIFIMGMMMLLLSAALPLISAGPHAWTLWADPVSSRYIMFLVRLYMVGLGYGAQSPCVTSFGADQFDDTDEVEKTRKSSFFNWHYFSINAGSLIAGTVIVWVQEHEGWLWGFTISTLFVTLGISVFSLGSIVYRFQKPGGSPLARIWQVVVAASRNFDKVLPCDSSALYEFSGQGSAIEGSRKLVHTSGLEFFDKAAIVTLPDCESPGQLNEWKICTVTQVEELKILIRMFPIWSAMVLFAAVQEQMFSTFVEQGMTMEKHIGSFEIPAASFQSIDTITVIMLVPIYEKVLVPVIRKFTGRANGITSPQRIGIGLCFSMFSMLLAALVESNRLQIAQAEGLVHSKVVVPMSILWQGPQYFLLGVAEVFSNIGLTEFFYDESPDAMRSLGMAFSLLNISVGNYLSSFILSLVPVFTARGGSPGWIPDNLNEGHLDRFYLMMAGLSLLNIFVFAFYARRYKCKKAS

SEQ ID NO: 26755 - protein, 554 aa, Clostridium perfringens
MNKKWWKELIAYQIYPKSFMDSNGDGIGDIQGIISKLDYLKDLGIDLIWLCPMYKSPNHDNGYDISDYKDILDEFGTMDDFNELLNEVHNRGMKLIIDLVINHTSHEHPWFIESRSSRDNPKRDWYIWREGKGDEEPNNWESIFKGSAWEFCENSEEYYLHLFAKEQPDLNWENKEVRNELYKMINWWLDKGIDGFRVDAISHIKKEEGLKDMDNPEGLKYVSSFEKHMNVEGINSHLKELKEETFSKYNIVTVGEANGVSANEADHWVAEDEGTFNMIFQFEHLNLWNYEEGQGFDVKAYKDVLTNWQNSLEGKGWNALFIENHDIPRVVSTWGNDKEYLTECAKAFGAIYFLQKGTPFIYQGQELGMTNVKYHSISEYNDVKTINTYNERIESGVSEEIALKEAWVTSRDNSRTPMQWNSSENAGFTCGKPWIGVNENYKTINVEVEERDENSVLNFYKKLIKLKKSNEALIYGVYDLILEEDENIFAYTRTLNNEKFLIMANLTGENAKYMYEKEKLNSKDLILNNYEVCEHKNLTEFTLKPYECRVYKLS

SEQ ID NO: 26756 - protein, 238 aa, Oryza sativa
RLHRPPRSASAAAAMGRRPARCYRQIKNKPYPKSRYCRGVPDPKIRIYDVGMKKKGVDEFPYCVHLVSWEKENVSSEALEAARIACNKYMTKNAGKDAFHLRVRVHPFHVLRINKMLSCAGADRLQTGMRGAFGKPQGTCARVDIGQVLLSVRCKESNAKHAEEALRRAKFKFPGRQKIIHSRKWGFTKFTREEYVKLKAEGRIMSDGVNAQLLGSHGRLAKRAPGKAFLAETIQASA

SEQ ID NO: 26757 - protein, 542 aa, Prosthecochloris aestuarii
MGMYCDQCQESVKGTGCIARGVCGKNEVTAKLQDTLVYILEGLALCAEAAGKSIDDNVGRLIGEGLFVTVTNTNFDDDAITEKIRETIALRDQLKTTLASVPDHDCVSWNGSTKEEFVGKAERSGIEALSTHEDLRSLKSLILYGLKGLAAYTDHAAVLGYTDDAIHQFYVTALAALAKDLDADSLLGLTMETGNIAVKAMALLDKANTETYGNPEITKVNIGVGNRPGILISGHDLKDMEELLKQTEGTDVDVYTHCEMLPAHYYPAFKKYSHFVGNYGSSWWAQDKEFESFNGPILMTTNCIVPVKESYRGRLFTTGNAGYEGVRHIPAPKDGSSKDFSEMIKLAGTCKPPVEIETGEIIGGFAHNQVIALADKVVDAVQSGAIKRFVVMAGCDGRHNSRKYYTDVAGQLPKDTVILTAGCAKYRYNKLQLGDIGGIPRVLDAGQCNDSYSLAVIAMKLKEVFGLDDINDLPISYDIAWYEQKAVAVLLALLALGVKGIRLGPTLPEFLTPNIAAALVEKFDIKPIDTAESDISAMMAGA

SEQ ID NO: 26758 - protein, 229 aa, Daucus carota
MDHSEESQQQQEEVIDIAYGMPQYHAGPGVATGTPVVPVSAATQAQHFFQQKLQLQQQDQLQAFWANQMQEIEQTTDFKNHSLPLARIKKIMKADEDVRMISSEAPVVFAKACEMFIMDLTMRSWSHTEENKRRTLQKNDIAAAVSRTDVFDFLVDIIPKDEMKEDTRASIPLMGQPPADSVPYYYVPQQHAAGQAGFYPDQHQQQPLPYMQWQQPQQDQNQQQQENGN

SEQ ID NO: 26759 - protein, 358 aa, Leifsonia xyli
MLRGGDKAGGDEKRSSMKIGILTSGGDCPGLNAVIRGAVLKGDRVLDAEFAGFRYGWRGVVEGDIMPLDRHSVRGLSRQGGTILGSSRTNPFEGEKGGPENIQRMMDENGIDAIIAIGGEGTLTAARRLTDAGLRIVGVPKTIDNDLAATDYSFGFDTAVEIATEAIDRLRTTAESHQRCMVLEVMGRHVGWIALHSGMAGGAHAILIPELPQSVDRICEWVESVRDRGRAPVIVVSEGFHLDTMEEAHSHKGLDAFNRPRLGGIGEMLAPLIQERTGIESRATVLGHMQRGGVPSAYDRVLATRLGMAAVDAAYEGRWGSMVALRGTDVVNVSIADATGGLKTVPQARYDEAALLFG

SEQ ID NO: 26760 - protein, 236 aa, Cucumis sativus
MTRRYWNIHLEEMMEAGVHFGHGTRKWNPRMAPYISAKRKGIHIINLTRTARFLSEACDLVFDAATRGKQFLIVGTKNKAADSVARAATRTRCHYVNKKWLGGMLTNWSTTETRLHKFRDLRTEQKTGGLNRLPKRDAAMFKRQLSHLQTYLGGIKYMTGLPDIVIIVDQQEEYRALQECITLGIPTICLIDTNCDPDLADISIPANDDAIASIRLILNKLVFAISEGRSSSIRNS

SEQ ID NO: 26761 - protein, 894 aa, Zea mays
  misc_feature (67)..(67): Xaa can be any naturally occurring amino acid
  misc_feature (80)..(80): Xaa can be any naturally occurring amino acid
MSTCVEQPTHSASLDPTAAQRLPYPDLPVDILRRSSVRGSGFVAAALVSSARKADDDARHDDDDPSXGDRHETYGSHYLXANLGVEQSVRDEGTVDAWVESSQSLIRLTGKHSLNGEPPLPRLMRHGFITPVPRHYVRNHGPVPRGDWATWTVEVTGLVRRPRALTMDELARDFPALELPVTLVCAGNRRKEQNMVRQTLGFNWGPGAVSTSVWRGARLSDVLRRCGSMSRKGGALFVCFEGAEDLPGGGGTKYGTSITREVALDPTMDVMLAYQQNGGPLLPDHGFPVRLIVPGCTAGRMVKWLKRIVVAPAESDNYYHYRDNRFLPSHVDAKLADAEGWWYKPEYVINEMNTNSVITTPAHNEFLPINAITTQRIYTMKGFAYSGGGKKVTRVEVTLDGGENWLLCELDHPEKPTKYGRYWCWCFWSIDVELIDLLACKEIAVRAWDQSLNTQPEFLTWNLMGMMTNCWFRVKVNVCRPRHGEKAGLAFEHPVQPGNQPGGWMAQQKHLETAERTSAATSTTNQQFTMSEVRKHASQDSAWIVVHGHVYDCTAFLKDHPGGADSILINAGTDCTEEFDAIHSDKAKELLDTYRIGDLVTTGGAEQRSPLELAPSPPIRHEGPAAPVIALSNPREKVPCQLVARTVLSRDVRLFRFALPSSGQVLGLPVGKHIFVCASIDGKLCMRAYTPTSSVDEVGHFDLLVKVYFRNENTKFPDGGRMTQYLDSLPVGAHVDVKGPLGHVEYVGRGGFVIDGKPRKAGRLAMVAGGSGITPIYQVIQAVLRDQPEDKTEMHLVYANRTEDDILLRAELDRWAAEYPERLKVWYVVSQVKRLDEWKYSVGIVTEAVLRDDVPEARDGTLALLCGPPSMIQSPILPNLEKMKHQLDDSVVSF

SEQ ID NO: 26762 - protein, 249 aa, Daucus carota
MDESEEPQQQQEAVIDSASQMTYGVPHYHAVGLGVATGTPVVPVSAPTQHPTGTTSQQQPEYYEAQHVYQQQQLQLRTQLQAFWANQIQEIGQTPDFKNHSLPLARIKKIMKADEDVRMISSEAPVIFAKACEMFILELTMRSWLLTEENKRRTLQKNDIAAAISRTDIFDFLVDIIPRDELKEEGLGITKATIPLLGSPADSAPYYYVPQQHAVEQAGFYPDQQAHPQLPYMSWQQPHEHKDQEENGD

SEQ ID NO: 26763 - protein, 430 aa, Staphylococcus aureus
MKTTIKQAKDHLNQDVTIGAWLTNKRSSGKIAFLQLRDGTGFMQGVVVKSEVDEEVFKLAKEITQESSLYVTGTITEDNRSDLGYEMQVKSIEVISEAHDYPITPKNHGTEFLMDHRHLWLRSKKQHAVMKIRNEVIRATYEFFNKDGFTKVDPPILTASAPEGTSELFHTKYFDQDAFLSQSGQLYLEAAAMAHGKVFSFGPTFRAEKSKTRRHLIEFWMIEGEMAFTNHAESLEIQEQYVTHVVKSVLENCKLELKILERDTSKLEKVATPFPRISYDDAIEFLKSEGFDDIEWGEDFGAPHETAIANHYDLPVFITNYPTKIKPFYMQPNPENEETVLCADLIAPEGYGEIIGGSERVDDLELLEQRVKEHGLDEEAYSYYLDLRRYGSVPHCGFGLGLERTVAWISGVEHVRETAPFPRLLNRLYP

SEQ ID NO: 26764 - protein, 300 aa, Sulfolobus tokodaii
MYEWHWHIEWQTPYEFHGHAITKVIAEEKTPYQRALLVELARFGKALILDGKIQSTITDEFIYHEALVHPLLLSINNPEKILILGGGEGATLREVLKHKTIKNVTMVDIDPVVIDFAKKYLQEWHQGAFDNPKSKLVIEDGYKFIKETKEKFDAVVIDLTDPIKDSPSQMLYTKEFYEEVKRISKWGIVTQATSPSFSLETFSIIYNTIKHVFKKVSAGITYVPAFDGLWGFVYASDEVNPAEFSKEEINNRIKERIDGSLRFYDGETHITMFSIPKHIREVLEKENKISTRENPVAVPA

SEQ ID NO: 26765 - protein, 152 aa, Casuarina glauca
MALTEKQEALLKQSWEVLKQNIPAHSLRLFALILEAAPESKYVFSFLKDSNEIPENNPKLKAHAAVIFKTICESATELRQKGHAVWDNNTLKRLGSIHLKNKITDPHFEVMKGALLGTIKEAIKENWSDEMGCAWTEAYNQLVATIKAEMKE

SEQ ID NO: 26766 - protein, 654 aa, Sulfolobus tokodaii
METVKSICPFCGVGCGVELYVESSTIIRLSPVKEHVVSRGHLCGKGTLAYEPIFAWDRLTYPLKKVKGEHIRISWEIAIKEIASKLKEIIQQYGSDAIAFYGGCQNTLEEDYLMQKLARAMGTNNIDSCARVCHDPSATALKEMVGIGASSVSVEMIPRMKVVVITGESITESHPVLSQYLTEAKKNGTKLIVIDPRVTGTAKFSDLHLRLRPGTDIALFNAVGNYLIENSLIDEKFIKERVIGFEEYAKGVSKYTLEYAEKVTGVRKENIKKFAELIAQKGVIFSWGLGLTQSSGVNGVRAYINLALLTGNIGKNGGLLVFRGQTNVQGSGDLLKPDKFPNGTMDEENAKKLAEIWNFLPPTKPGLSVTEALLRDNNIRAIIFMGFNPLISLPNREKVERKLKSLDLLVVIDAFMTETASLAHYVLPAAVWAEKEGSVTNLDRLAKWRFKAIDPPGEAKPDYEILKKLAEELGYNFSSDPKEIFEEMKKVVPLYSNLTLDEIMDYSSSSRYPNHEIYLYDEKFYTETNKAKLILVEQPEVKNGIILITVRNVTRYNTDVITGRIPGYGKYESLIYVSQEDALELKIRDNEEVLVTSECGKMNFRVMISKDVQKGTAIMYMHDPKVNYIICDELDEITKTPKYKYTEIKIMKLN

SEQ ID NO: 26767 - protein, 748 aa, Propionibacterium acnes
MRLTPTLPDGHGLRIGILTSGGDAQGMNAAVRAVVRSALSVGAEVYAIYEGYQGMIDGGDGIRRFGWDDVGSILNRGGTVIGTFRCKGMRERPGRLKAVRNLLEHGIDRLVVIGGDGSLTGLDVLRTEWTDLVAELVDTGQVSAEVAREHPALMIAGLVGSIDNDLVGSDMTIGADTALHRIVDAIDDLASTAASHQRSFVVEVMGRHCGYLALMAAVAGGADYVLIPERPPEDGWEDRMCAELKRGRQAGRRDSIVVVAEGATDRSGNRISSEYVRQVLEDKLGEDARVTILGHVQRGGRPSAYDRWASTWLGYHAVHEVLSTTPEAEGRVIGTGSNRIHRLPLVKAVADTKSVPGLITEGRYNEAMRMRGRSFVEMDAIFTELSEPARTTSDTAGDADRKRVAIMHAGGPAPGMNTAARAAVRLAISRGHTVVGIHNGFIGLATGDMSELAWSDVEGWAGEGGAELGTRREIPSTRDLYAVSRALEDHHIDALLVIGGYSAYEGIYTMMTERDRYPAFRIPTVCIPASIDNNLPGSELSIGTDTALNVIVEAMDKIKESGIASRRCFVVETMGRDCGYLALMSGIAAGAERIYTNEDGISLDDLANDVHWLRESFAHGRRLFLAVRNENASHNYTTDFIARLLEEESHGMYDVRQVVLGHMQQGGSPSPFDRLLANRLGYRALNLIDDELAAHQDGSWFIGVNESGMRPCSMDTMPSLIDAAHRRPREQWWLQLRTIARMVSDEVR

SEQ ID NO: 26768 - protein, 1137 aa, Ustilago maydis
MSFSSEKGSSRRGSISLASKRRGSGTEKLETHHELRSFNCTSIGLAISTCSLETPTIWSLSSPTLLSSFFFSPIVTMSYLLQASLSLCVERAALTLNSLVKSSLTKQIASWHTSSHKHEENPHAHEEQLKQTYERFEKLFTITPQRLRMITDRFVGVLEEGLQKDGQTVPMLPAYVFGWPTGDEVGSYLALDLGGTNLRVCHVVLKGAGKFEITQSKFRLTEEQKQTEGQELFDFCADCLATFIKDHFGDQNGDVILEEELALGFTFSYPMEQDKIDHGKLVRWTKGFGNPNTEGRDCAAMFRKSLDKFNLPVKMVSIINDTTGTLIASNYVNRETRIACIFGTGCNAAYMEHMKDIPKIKHLGLPEEEDMAINCEYGAFDSFQHEHMAEIRTKYDEHIDLHSNKPHEQSYEKMIAGLYLGEIFRLCICDLIDEGTLFLGQNTYKLEKTNAFDTAFLSLIESDPTDELLTVTGLFTHFFGIDTTIEERQFFRKLAKLIGTRSARLSSCGIAALVTKMGYLDKGCGVGADGSLYSKYPGFADRLHQALEDIFGEKGRNIRTYQAEDGSGVGSAIIAAMTKARKEEGKTLELTSLSDGYAQDRAEMREVARSLVLPFLLGWVWCIGLRDATFTIRDYDINTLQRKEKKRNSRDCRLRVAGNVCIAEKSPVSSCSCQLPHSRAIRTKANLGMCCEFWWSFMIELVGRFLVLMRQRMSVHCDRPNLRNIAVVEGGNRALHRRLEDVMKSCIAAQKSTVLSGTFSGTLTRNIRRGQFVPTARAPALAVGLYKLASSSHHPIIPATILSSRSITSFATMPATHFKLNSGASIPSVGLGTWQSPKGEVRDAVCHALKSGYRHIDCAWGYQNEDEVGEGIKLSGVPREEIWITSKLFEFHHNHVRQAVQDTLDKLDVKYLDLYLMHWNIAFVPEDVPAGQLPRDSKKDPATGKHLLDLETTENFVKVWAELEKLVDEGIVKNIGISNFSIRRTKELLKSCRIKPVVNQVELSFTFPQPELVGWLKKQDILPQAYSPLGSTGASQASLSVVDEIAKKHGVQGANVLISWQVARGCNPLPKSVTPARIENNIKLIDLSAEELDQLEKGALAQTPKKVCDQSDLVVPSYDIFEANNPTNNDKVQAAQD

SEQ ID NO: 26769 - protein, 222 aa, Brassica napus
  misc_feature (96)..(96): Xaa can be any naturally occurring amino acid
MGRRPARCYRQIKGKPYPKSRYCRGVPDPKIRIYDVGMKKKGVDEFPFCVHLVSWEKENVSSEALEAARIACNKYMVKSAGKDAFHLRIRVHPFHXVLRINKMLSCAGADRLQTGMRGAFGKALGTCARVAIGQVLLSVRCKDNHGAHAQEALRRAKFKFPGRQKIIVSRKWGFTKFNRADYTRLRQSKRVVPDGVNAKFLSNHGPLANRQPGSAFISATSD

SEQ ID NO: 26770 - protein, 628 aa, Bordetella parapertussis
MCGVLGAWWRHHDEHEDARFAAGLRKLAHRGPDDRGSEHFAASHGRLSLGHTRLAVIDLSAAGHQPMHADADRLAVVFNGEIYNYRELRSELRQIGAIFRGDSDTEVLLAAWQHWGVAALRRFKGMFAFALYDRRQQTLTLARDAFGIKPMYYHAAPERLLFGSELPAVQALLPHPPRLNWQRAYDYLAYGQYDQPPDTFIAGIRQLPAGHLLTLDLRTGQAGEPMAWDDPASQECRPIGFQEAAEELRARFLDNVRLHLRSDVPIGAALSGGIDSSAIVCAMRWLEPDLPIQTFSFISDDTHRSEERWVDLVNQHCGATGHKIHIAPHELLDDLDDLIRVQGEPVGSTSIYAQYRVFKLAREHGVVVTLDGQGADELLGGYGGYPTERLASLLETGRLGAAARLLRQQGRGAPARLLQAAALAAGGRHLANLRHATGRQHAPAWLDAQVLRDQGVTMREPAHAWAAATPLRGRRLVNELAHALYHRGLGALLRHGDRNSMRFSVESRVPFLTQDLAEFALRLPERYLVSDSGQTKHIFRKSMPRIVPDSNMDRDDKIGFATPEQQWMQATAPQMRQWLVDAADIPFLRNAEVTAQFDAMIAGATPFSWQAWRWVNFQRWMQHAQLCA

SEQ ID NO: 26771 - protein, 581 aa, Desulfitobacterium hafniense
MKKKVLIVGGVAGGASAAARLRRLDEDAEIILFERDDYISFANCGLPYYIGGTITKRERLMVQTPEDMQARFNIDVRIRSEVIRLDAANKKVLVRSQSRGTYEESYDALILSPGAKALRPNIPGIDSERILTLRNIPDTDAIKGLVDQKGVQSAIIIGGGFVGVEMAENLREQGLNVTLVEAAPHILAPFDTDMVVLAEKKLVAHGIRLILNDGVKSFQDLENQVEVTLASNRKLQGDLIILAIGVIPDTGFLKESGLELGPKGHLIVNERMATNLPHVYAAGDAVEVLDYITKTKTAIPLAGPANKQGRIAADNIAGLNSTYKGTQGTSIIKIFELTAASTGANERTLQRANLPYHVIHIHPVSHASYYPNAYPMTLKLIFGADGRIFGAQGIGRDGVDKRIDVISTVIRLGGTVEDLTELELAYAPPFSSAKDPVNMAGYVAQNVLTGQAHMLVWDDLNKIDEEYTFVDVRTKIEFAKGHVEGAINIPVDDLRQRIQELDPGKLIVVYCEVGLRGYFAERILTQKGYRVLNLTGGYTTYSVQGFDPNQALDDYKKDFNPYPCCADEDIIDPDTQRIKHQ

SEQ ID NO: 26772 - protein, 148 aa, Wolbachia endosymbiont
MGVIDGLLHITDISWSRVSHPSAVFTCGQTIKVKIIKIDKENAKISLGVKQLEDSPWQDAESKYPVDSVHKGYVTSIEDYGLFVELRPGIEGLVHSSEITWVKSNLPVSSLVTRGQEVYVKILSIDIAKSRMSLSMKRCVDTLGQYLS

SEQ ID NO: 26773 - protein, 197 aa, Triticum aestivum
HYRTSLYKKAGWYRSGIPGRSPPHASQRGRKKTEAAAAAARPRMASTSSLDLGKIGPTAGYLLHRCAAVPSAPVLRGRSASGRCGLAVSVSSSNGAAGLSPLSDSEKKGPVVMEIPLEDIRRPLMRTRANDPDKVQELMDSIRVIGLQVPIDVLEVDGVYYGFSGCHRYEAHQRLGLPTIRCKVRRGTKETLRHHMR

SEQ ID NO: 26774 - protein, 1299 aa, Unknown
  Nostoc sp. PCC 7120
MTTDRDSSSKKFGLSPEQFAALFPFHLVIDRELKIVQAGEVIQRILEPMVLLDSYLGEHFQISRPKCLTSFEGICQQTRSLFILQAHYQEIQLKGQMLNLESRDHLLFLGSPWITDIADLKNLGLKINDFPLHDSVSDYLFLLQAKNSALADAQKLTTKLKDQKTELQTTALRLRTLIESLQSGILLEDANQHIILVNQEFCDYFRIPLPPQALQGMDCQQALEASKHLFTEPERFICTTDEIIRQGKMFLHQEWELQDGRTLEQNYIPIVVDHKLYGHLWKYRDITQYKKSEVALRLSEERLKLAVDAVEEGLWDWNLVTGEVYRSARWFTMLGYTPMEIGNDIKFRDKLIHPDDIPLMQQRLISHLKGDTPFYEVEIRLLAKSGEWRWILDRGKLVSRDSQGRAIRMVGTHLDITQRKQAEQDLQQQYQHTLLLKQITEEIRQSLQWEKILKTTVTEVQRILQVDRALIFQINSDGSGKVVQEAVMPGWSVTLDQDIYDPCLKDGYLNMYRDGRITAIADVYQGGLKPCYVEFLQQFQVKANLVVPIRVRRNLWGLLIVHQCDRPRQWTELELDLLKHLADQMGIALTQSQLLAQETRQAQLLALQNEELNVAKQVAEKANMAKSNFLATMSHEIRTPMNAIIGMSGLLLDTTLKPEQFDYVETIRNSSHTLLTIINDILDFSKIESGKLELEEQPFDLRLCVEEALDLLAPQAASKGIELMYQLEPDTPTLVVGDITRIRQILWNLVSNAVKFTKIGEICITIGAKQKIYKQTDPTRYEFQFAVQDTGIGIERDRLHRLFKPFSQVDASMTRRYGGTGLGLAISKRLSEIMGGKMWVESQSHQGSIFYFTATLQVNSSAINSAAKVDPELVGKRLLLAVGNANLRKCLTRQLQSLGLDVQAVDSNATALHCLWQHTSLALAVLDVDSPQINGLHLSTKIRAIPQHQNLPLVMLSAKGKQTLEVKQVASEFTAFLHKPLRHYQLHNTLLQIVRGKWLSKSTPQGIIPSYSRLPKPNLPAIDTHLAENLPLKILLVEDVLVNQKIAMNMLHLLGYRTDVANNGLEALEALQRQLYDVVFMDIQMPEMDGWETTHKIRQEFSPTLQPWIIAMTAHARPEDRQQCLAAGMDDYISKPISLEDITTALKKFGSQRQPALESPASVSISAPPAPTPQPKIEEVIDQQTLEYLRNLGGSDEADEDGGGSSIITELIQLYLEDTPAKIQAIQDAATLEDRSQLARIAHALRSPSVSIGAINLGKICETVEDEAKEQSMDQLTALVNQLNNEYQNVVAALKTLIF

SEQ ID NO: 26775 - protein, 486 aa, Mycobacterium tuberculosis
MSVTPNAGCVDVVIVGAGISGLGAAYRIIERNPQLTYTILERRARIGGTWDLFRYPGVRSDSSIFTLPFPYEPWTREEGIADGAHIREYLTDMAHKYGIDRHIEFNSYVRAADWDSSTDTWTVTFEQNGVHKHYRSRFVFFGSGYYNYDEGYTPDFGGIEKFGGAVVHPQHWPEDLDYTGKKIVVIGSGATAVTLIPSLTDRAEKVTMLQRSPTYLISASKYSTFAAVVRKALPPKTSHLIVRMYNALLEAVFWFLSRKTPVFVKWLLRRTAIKNLPEGYDIETHFTPRYNPWDQRLCLIPDADLYNAITSGRAEVVTDHIDHFDATGIALKSGGHLDADIIVTATGLQLQALGGAAISLDGVEIDPRDRFVYKAHMLEDVPNLFWCVGYTNASWTLRADMTARATAKLLAHMAAHGHTRAAPHLGDEPMDEKPSWDIQAGYVKRAPYALPKSGTKRPWNVRQNYLADAIDYRFDRIEEAMVFGAA

SEQ ID NO: 26776 - protein, 541 aa, Glycine max
  misc_feature (519)..(519): Xaa can be any naturally occurring amino acid
MDISVSFSKTRPPPFSPSLCRQLSLRPNAPQLLRFSRNNGTFRRKPPPTISRPNKLAVTAIQISNLSENEDDFVLEDVPHLTDFLPNLPSYPNPLQKSQGYSIVKKTFVSPEDVVAENVVIQKGSPRGVHFRRTGPREKVYFKPEEVRACIVTCGGLCPGINTVIREIVCGLNNMYNVEDILGIEGGYKGFYSKNTMMLTPKVVNHIHKCGGTFLRTSRGGHDTHKIVDNIEDRGINQVYIIGGDGTHKGTALIYEEVKKRGLQVAVAGIPKTIDNDIAVIDKSFGFDTAVEEAQRAINAAHVEVESVENGVGIVKLMGRYSGFIAMYATLASRDVDCCLIPESPFYLEGRGGLFEFIEQRLKENGHLVIVVAEGAGQEYIAAEVHAADKKDASGNKLLLDIGPWLSDKIKDHFSMSRKMAVNMKYIDPTYMIRAIPSNASDNIYCTLLAHGAVHGAMAGYTGFTVGPVNSKHAYIPIARVTEKQNKVKLTDRMWARLLASTNQPSFVASDQERVEKEXNEYINNMNIASLSRFKCLMGID

SEQ ID NO: 26777 - protein, 131 aa, Zygosaccharomyces mellis
GFLDHMIHALAKHSGWSLIVECIGDLHIDDHHTTEDCGIALGDAFRQALGQVRGVKRFGFGFAPLDEALSRAVVDLSNRPCSVIELGLKREKIGDLSCEMIPHFLESFTEAARLTVHVDCLRGFNDHHRSE

SEQ ID NO: 26778 - protein, 121 aa, Zygosaccharomyces rouxii
LDHMIHALAKHSGWSLIVECIGDLHIDDHHTTEDCGIALGDAFKQALGQVRGVKRFGFGFAPLDEALSRAVVDLSNRPCSVIELGLKREKIGDLSCEMIPHFLESFTEAARLTVHVDCLRG

SEQ ID NO: 26779 - protein, 144 aa, Phytophthora infestans
MLVPKTNRIAVYSYLFKEGVMVAKKDFSLPKHEAVDVPNLQVIKLMQSLKSRGYVKETFNWQWFYWYLTNEGIEYLRSYLHLPAEIVPATLKKQAARPTRPQAPSAGGFGRGRFDKEKGVGPSGDFNPEFRRGGQDGYRREASN

SEQ ID NO: 26780 - protein, 130 aa, Zygosaccharomyces bailii
  misc_feature (104)..(104): Xaa can be any naturally occurring amino acid
  misc_feature (113)..(113): Xaa can be any naturally occurring amino acid
GFLDHMIHALAKHSGWSLIVECIGDLHIDDPTEDCGIALGEAFKQALGQVRGVKRFGCGFAPLDEALSRAVVDLSNRPYAVIDLGLKREKIGDLSCEMIPHFLXSFIEAARLXVHIDCLRGFNDHHRSES

SEQ ID NO: 26781 - protein, 450 aa, Bacillus cereus
MSTHVTFDYSKALSFIGEHEITYLRDAVKVTHHAIHEKTGAGNDFLGWVDLPLQYDKEEFARIQKCAEKIKNDSDILLVVGIGGSYLGARAAIEMLNHSFYNTLSKEQRKTPQVLFVGQNISSTYMKDLMDVLEGKDFSINVISKSGTTTEPALAFRIFRKLLEEKYGKEEARKRIYATTDKARGALKTLADNEGYETFVIPDDVGGRFSVLTPVGLLPIAVSGLNIEEMMKGAAAGHDDFGTSELEENPAYQYAVVRNALYNKGKTIEMLVNYEPALQYFAEWWKQLFGESEGKDQKGIFPSSANFSTDLHSLGQYVQEGRRDLFETVLKVGKPTHELTIESEENDLDGLNYLAGETVDFVNTKAYEGTLLAHSDGGVPNLIVNIPELNEYTFGYLVYFFEKACAMSGYLLGVNPFDQPGVEAYKKNMFALLGKPGFEELKAELEERLK

SEQ ID NO: 26782 - protein, 419 aa, Pyrococcus furiosus
VEADPYEIVIKQLERAAQYMEISEEALEFLKRPQRIVEVTIPVEMDDGSVKVFTGFRVQHNWARGPTKGGIRWHPEETLSTVKALAAWMTWKTAVMDLPYGGGKGGIIVDPKKLSDREKERLARGYIRAIYDVISPYEDIPAPDVYTNPQIMAWMMDEYETISRRKTPAFGIITGKPLSIGGSLGRIEATARGASYTIREAAKVLGWDTLKGKTIAIQGYGNAGYYLAKIMSEDFGMKVVAVSDSKGGIYNPDGLNADEVLKWKNEHGSVKDFPGATNITNEELLELEVDVLAPAAIEEVITKKNADNIKAKIVAEVANGPVTPEADEILFEKGILQIPDFLCNAGGVTVSYFEWVQNITGYYWTIEEVRERLDKKMTKAFYDVYNIAKEKNIHMRDAAYVVAVQRVYQAMLDRGWVKH

SEQ ID NO: 26783 - protein, 394 aa, Saccharomyces cerevisiae [sequence omitted]

SEQ ID NO: 26784 - protein, 261 aa, Aspergillus oryzae
MMSFMGHQPQSQAVGYTFSQPTNAPNKEHSFYPYTDNGGSTLGITGADFAILAGDTRSVAGYNINSRYAPKVFKIGGDDDTGEGAHIILSVVGFAADGQALKERLDAVVKMYKYQHGKPMSVRACAQRLSTILYQKRFFPYYVHAILAGLDEEGKGALYSYDPVGSYEREQCRAAGSAASLIMPFLDNQVNFKNQYIPSSGDGHALEPKKPEPLPRETVEQLVRDAFTSAVERHIEVGDGLQMMVITQNGIEEIYTPLKKD

SEQ ID NO: 26785 - protein, 425 aa, Anaplasma phagocytophilum
MVGYIGDIHISESDAEVAECLSAEYKRQNTSLQMIASENFVSRAVLQAQGSVLTNKYAEGYPGSRYYCGCSEVDVAETLAVERLCKLFGCKYANVQPHSGSQANQQVYMALLKPGDTVLGMSLDSGGHLTHGAGPNVSGKWFNAVPYNVRRDTNLLDMGEIEEIALRVKPNLIIAGASSYPRRIDFKAFRAIADKVGAYFLADIAHYSGLIAGGQYPTPFGYAHVVTSTTHKTLRGPRGGVIMTDDEEIHKKLRSAVFPGMQGGALMHVIAAKAVAFREAMSPDFKVYVSQILDNSRALAAVLATGGLDVVTGGTDSHMVVVDLRSKGLTGRDVSSSLERAGIVCNKNAVPFDTEKPWVTSGIRLGAAAETSRGLVVKDFEKIGQLVLKIVDSMRAGADMSVVESGVREEVATLVRVVPYDTLAC

SEQ ID NO: 26786 - protein, 129 aa, Prochlorococcus marinus
MRILHTMLRVGDLDKSIDFYVNILGMNLIRRKDYPHGEFTLAFVGYGSEKDNAVIELTHNWSKKSEDYELGNKYGHIAIGVKDIYDICQGLEDNGCNVTTKPKTMKNSTTVLAFVEDPDGYKIELIERD

SEQ ID NO: 26787 - protein, 335 aa, Unknown
  Rosa hybrid cultivar 'Kardinal'
MGVERVQDIASATSKDTIPVEFIRSENEQPGITTVPGTVLECPIIDFSDPDEEKLLKQIFEASTDWGMYQIVNHDISNEAIAKLQAVGKEFFELPHEEKEVYAKDPNSKSVEGYGTFLQKELEGKKGWVDHLFHKIWPPSAINYCFWPKNPASYREANEEYAKNLHKVVEKLFKLLSLGLGLEAQELKKAVGGDDLVYLLKINYYPPCPRPDLALGVVAHTDMSALTILVPNDVQGLQACRDGQWYDVKYIPNALVIHIGDQMEVMSNGKFKAVLHRTTVSKDKTRISWPVFLEPPPDHIIGPHPKLVNDKENPPKYKTKKYSEYVYNKLNKIPQ

SEQ ID NO: 26788 - protein, 376 aa, Synechococcus elongatus
MAADYYQLLGVARDADKDEIKRAYRRLARKYHPDVNKEPGAEDKFKEINRAYEVLSEPETRARYDQFGEAGVSGAGAAGFQDFGDMGGFADIFETFFSGFGGMGGQQASARRRGPTRGEDLRLDLKLDFRDAIFGGEKEIRVTHEETCGTCQGSGAKAGTRPQTCTTCGGAGQVRRATRTPFGSFTQVSVCPTCEGSGQMIVDKCDDCGGAGRLRRPKKLKINIPAGVDSGTRLRVANEGDAGLRGGPPGDLYVYLFVSEDTQFRREGINLFSTVTISYLQAILGCSLEVATVDGPTELIIPPGTQPNAVLTVEGKGVPRLGNPVARGNLLVTIKVEIPTKISAEERELLEKVVQIRGDRAGKGGIEGFFKGVFGG

SEQ ID NO: 26789 - protein, 247 aa, Pseudomonas syringae
MSQVNMRDMLKAGVHFGHQTRYWNPKMGKYIFGARNKIHIINLEKTLPMFNEALTFVERLASGKNKILFVGTKRSAGKIVAEEAARCGSPYVDHRWLGGMLTNFKTIRQSIKRLRELEVQSEDGTFAKLTKKEALMRTRDLEKLDRSLGGIKDMGGLPDALFVIDVDHERIAITEANKLGIPVIGVVDTNSSPEGVDYIIPGNDDAIRAIQLYMGSMADAVIRGRNNVAGGTDVFVEEAPAAAAVEG

SEQ ID NO: 26790 - protein, 244 aa, Arabidopsis thaliana
MDIAISKLNNGGWVHIFPEGSRSRDGGKTMGSAKRGIGRLILDADTLPMVVPFVHTGMQDIMPVGASVPRIGKTVTVIIGDPIHFNDILSTEGAQHVSRKHLYDAVSSRIGQRLYDLKAQVDRVYIEQQSMMSHNAKTPSDRAAEIFHRVDWDSFGMGAQFSEESSPSSKPIGQSDDRIVRSPKRRVSPEGGVSLKIKKLMDSTEMMGFAARGLLMNEYKSRVESANVGRPLKAWREYFMNRGL

SEQ ID NO: 26791 - protein, 559 aa, Blastopirellula marina
MPEKITIVIVGGVAGGASAATRARRMNEAAEIILLEKDEHVSFANCGLPYYIGGEIAERQKLLVATADLLRKRFRIDVRANQEATRIDRAAKQLDVRDHLKNEDYTLAYDKLILSPGAAPLVPPIENANAPGVFTLRNLADADKIREHAVKTSARKAVVVGAGFIGLEMVEQLHRLELKIVLAELQPQVLPPLDPEMTYPLEKALRDREVQLYLGDGIAGILTDERGNASGVKLQSGEVTTGDLVILGLGVRPNSQLAQEAGLEIGATGGIAVNRFSQTADPDIYAVGDAAEYPYGPTGKQQRVPLAGPANRAGRLAGEHAASGASAEMPDVQGTAIVRVFQQAAATTGLSVKMARKLGIDAWSVTIAANHHAGYYPGAKQLVLKLVFAPETGKILGAQCVGVAGVDKRIDVIATAMQFGGTVRQLAGVDLSYAPPFGSAKDPVHMAAFSACNYLDGVDLFLDSDANLSGQQVVDVRTEKEVSAKPLAGADDAIAIPLDDLRERLGELDQDRPTVVSCGVGVRAHVAARILRQNGFADVQNLSGGALVREWAIAQRTAE

SEQ ID NO: 26792 - protein, 174 aa, Xanthomonas campestris
MPLNDLQHVPGANAAPADTHGFVFNHTMLRVKDATQSLDFYTRVLGFRLLDARDFADAKFSLYFLALLPEGTAIPDDDAQRRLWMAGIPGVLELTHNHGTETQDGPVYHDGNSDPRGFGHICISVPDIHAACARFDSLNVPYQKRLEDGRMKHLAFIKDPDGYWVEIISNTPLA

SEQ ID NO: 26793 - protein, 917 aa, Unknown
  Pseudomonas sp. PCL1171
MLRKMGIKGRVLLLTLLPTSLMALLLGGYFTWMQLSELQTQLLQRGEMIAEQLAPLVAPPLSSKNTDLLERIATQSLEQPDVRTVSFLAPDRSSLAHAGPTMLNQPPIGNSSHLLQRTGNDATRYLLPVFGRHRNLAGELIPDESDRLLGWVEVELSHNGMLLRGYRSLFASLLLIAIGLICTAALALRISRTINSPISQIKLAVAQLKDGNLETRLPPLGSQELDQLASGINRMAETLQNAQEELQHSIDQATEDVRQNLETIEIQNIELDLARKEALEASRIKSEFLANMSHEIRTPLNGILGFTHLLQKSEMSPRQLDYLGTIEKSADNLLGIINEILDFSKIEAGKLVLDSVPFNLRDLLQDTLTILAPAAHAKQLELVSLVYRDTPLALVGDPLRLKQILTNLVSNAIKFTREGTIVARAMIEDEQEDSVQLRISVQDTGIGLSNQDVRALFQAFSQADNSLSRQPGGTGLGLVISKRLIEQMGGEIGVDSTPGEGSEFWISLNLPKTRDDVEDLPAAPLLGRRVAVLENHELARQALQHQLEDCGLEVTPFNSLENLTNGITSAHQTEQAIDLAVLGVTANDIPPERLNQHLWDLEHLSCKVLVLCPTTEQMLFNQSVPNPNSQLQAKPACTRKLRRALADLISPRPSRSEPGEPLSSRAPRVLCVDDNPANLLLVQTLLEDMGAKVLAVESGYAAIDAVKQETFDLVLMDVQMPGMDGRQSTEAIRQWESERHGTPLPVVALTAHAMANEKRALLQSGMDDYLTKPISERQLAQVVLKWTGLALRNQGPERAPDGLAPGVRLQVLDHEEGLRLAANKADLAADMLAMLLASLEADRQAITAAREANDNNALIERVHRLHGATRYCGVPQLRAACQRAETLLKQDDAKAMTALDELDMAIARLASEARVSA

SEQ ID NO: 26794 - protein, 113 aa, Drosera tokaiensis
MPGQWEFQVGPSVGISAGNELWVARYILERITEIAGVVLSLDPKPIEGDWNGAGAHTNNSTKSMREEGGYEVIKKAIEKLGLRHKEHIAAYGEGNERRLTGHHETANINTFLW

SEQ ID NO: 26795 - protein, 1283 aa, Yersinia pestis
MHTPIIWCNSLRTTFLLRGRFSLRTVLYCLLLISGQLHASLMTGRQGCDTGQPLTIHSIANSYNDDLLLTPATDTRQSSRRTVKVGVVMDANTPFVVNRDDNAIEGIVADYLKIISDASQLSFQMIGYCDYGLVLNALENGQIDLMAGTPMLAQPGLIASHAFFTNRHVEVRSKNWDPTKRTHPETVAIVNNEPLSPEFLFNYHADRIVAYPNQLQGLLAVAYGNADVFVANATSANYLIDQLQLLTLQIRNFAPYHPAPYSFLARESNQKLIDYLNQILELLPTRATGDIQQRWFGSKHHYNIDAKLLLTEQELSWIQHHPVVTYIAPLDLAPLIFRDRRTGEMAGFSVDLIDIIARRTGIKFDPVYTKDTGEGVRSFKAGKVDLLPIVAVRNGQYGNNLYSSSIAQSLWGIMTREDRMDINNVGDLAGKRVGIQAGSASSSIISNPLLAQRITFVEAPDTMTLVRWLQQGKVDAVVKNMMTANYLSAQNFSPNIKTVAVAGEEPLMMAFAIRPDLPELKTIIDKVIESIPPEEFDNLTSEWSTFKPKPISFDESSLDNELLMIALKISSGLLLVFGLYLCYLVFNKRRQAKLLHARLLQQESIINALPFAVFIRTASGELAVYNSHFADVHSDKLYDMLNQTHEPAHWPMTSPLDREIDKYCRSVLLNRKPQLVDLSVEIKGDIRDIFLWIIPLNNAEQGVLGGWLDISQRKTVERQLEAARVEAESANRTKSTFLATISHELRTPMYAIMGLLELEIRSNRPVEKDTLVTVSKSAQSLMLLLDDIIDSAKIEAGQLSIHPTAVDFHQEMERMFTLYQPIANERGLRFSGWLDDHIPPLLMADMLRVRQVMGNLLGNALKFTEQGSVSVDITWEPSDEQHGVMNIDITDTGIGISPAAQATLFQPFSQANEGKSPRFGGSGLGLWICHQLIHKMGGKIALESQLGKGTSLLITLPLNIATADDLAQDAAITHVDDERLNQLRNLRILVVDDLPANRQLLQQQLAFIGIEQVVTAENGAKACQILQHNNFDVVITDCSMPVMDGYELAAHIRQDPALKDLIVIGCTADAREESAARCIDAGMNACMIKPVAIDTLQATLLRKDIVSQISNTNHSQSTEDNDRGGNQSNLSEKNTAQQENAPAIHSTTITSSVNRLAAAQNKLRTLSGGNPAVELQLLQSLLESNLQDAVTLTQLYRQLCVEDEDVVETVDTAETVDTADTVEDGETRGPGSTVGRHSTAGSDHIPHADIYKQMASLVHRIKGSVQLIDAQELVASCVKFESQ

SEQ ID NO: 26796 - protein, 562 aa, Ralstonia solanacearum
MSQTNESFAALFEESIARSNMKAGEVISAEVVRIDHNFVVVNAGLKSEAFVPVEEFLNDQGELEVQVGDYVSVAIDALENGYGDTILSRDKAKRLASWLNLEKALESGEIISGTVTGKVKGGLTVMVNGIRAFLPGSLVDVRPIKDTTPYEGKTLEFKVIKLDRKRNNVVLSRRAVVEATLGEERQKLMETLKEGAIVNGIVKNITDYGAFVDLGGIDGLLHITDLAWRRVRHPSEVLSVGQEITAKILKFDQEKNRVSLGVKQLGEDPWVGISRRYPQGTRLFGKVTNLTDYGAFVEIEAGIEGLVHVSEMDWTNKNVAPSKVVQLGDEVEVMVLDIDEDKRRISLGMKQCKANPWDDFARNHKKGDKLAGQIKSITDFGVFIGLPGGIDGLVHLSDLSWQETGEEAVRKYKKGDEVEAVVLAIDVEKERISLGIKQLSGDPFNNFISANDKGSIVSVTIKTVDPKGAVVQLADDVEGYLRASEISSDRVEDARNVLKEGETMTAMIVNIDRKSRNINVSIKAKDSADQQEAMQKFAQDTGTAGTTNLGALLKAKLNETNQ

SEQ ID NO: 26797 - protein, 72 aa, Thermoanaerobacter tengcongensis
MAKDDVIEVEGTVIEALPNAMFQVQLDNGHKVLAHVSGKLRMNFIRILPGDRVKVELSPYDLTRGRIVWRGK

SEQ ID NO: 26798 - protein, 359 aa, Schizosaccharomyces pombe
RMRVAIIHVGAPAGGMNSATRAAVRYCLNRGHTPLAIDNGFSGFLRHDSIHELSWIDVDEWCIRGGSEIGTNRDTPDLDMGFTAFKFQQHKIDALIIIGGFEAFTALSQLESARVNYPSFRIPMAIIPATISNNVPGTEFSLGCDTCLNAVMEYCDTIKQSASASRRRVFVCEVQGGRSGYIATVGGLITGASAIYTPEDGISLDMLRKDIDHLKATFALEAGRNRAGQLILRNECASKVYNTKVIGNIISEEVISASPLVPLFPSRPTRCNPTPMDRARAARLAMRAIRFFETCRANDLGNDPSSAVVIGIRGTGVSFSSVADVENNETEIEMRRPKNAWWRDMHNLVNILAGKTFAD

SEQ ID NO: 26799 - protein, 361 aa, Aspergillus oryzae
MAAPEVHHLFHNPIADHSFSPDKSTLAVARDSNVELYQKAGNKFSLTDELKGHEKIVTGVDIAPNSGRIVTYRNAYVWERTPAGWKPTLVLLRINRAATFVRWSPSEQKFAVGSGARVIAVCYFEEENDWWISKHLKKPIRSTITTLAWHPNSVLLAAGSTDSHARVLSSYIKGVDTRPEPSAWGERLPFNTICGEFLNDSAGWIKGVSFSPSGNALAFTGHDSSVTVVYPSAPDQPPRAMLNITTRFLPFNSLIWNGENEIIAAGHDCEPYRFHGDENGWQLTGTIENKSGSGVGAVREESALNLFRQMDLKGQTQADTQLKTVHQNTINTVRVYEEANGNVSKFSTSGVDGRVVVWTIG

SEQ ID NO: 26800 - protein, 464 aa, Mycobacterium tuberculosis
MRIAQHISELIGGTPLVRLNSVVPDGAGTVAAKVEYLNPGGSSKDRIAVKMIEAAEASGQLKPGGTIVEPTSGNTGVGLALVAQRRGYKCVFVCPDKVSEDKRNVLIAYGAEVVVCPTAVPPHDPASYYSVSDRLVRDIDGAWKPDQYANPEGPASHYVTTGPEIWADTEGKVTHFVAGIGTGGTITGAGRYLKEVSGGRVRIVGADPEGSVYSGGAGRPYLVEGVGEDFWPAAYDPSVPDEIIAVSDSDSFDMTRRLAREEAMLVGGSCGMAVVAALKVAEEAGPDALIVVLLPDGGRGYMSKIFNDAWMSSYGFLRSRLDGSTEQSTVGDVLRRKSGALPALVHTHPSETVRDAIGILREYGVSQMPVVGAEPPVMAGEVAGSVSERELLSAVFEGRAKLADAVSAHMSPPLRMIGAGELVSAAGKALRDWDALMVVEEGKPVGVITRYDLLGFLSEGAGRR

SEQ ID NO: 26801 - protein, 129 aa, Unknown
  Vibrio sp. Ex25
MLRVGDLDKSIKFYTEVMGMQLLRTNENKEYEYTLAFLGYGDESQGAVIELTYNWGKTEYDLGTAFGHIAIGVDDIYTTCDAIKAAGGNVTREPGPVKGGSTHIAFVKDPDGYMIELIQNKQASAGLEG

SEQ ID NO: 26802 - protein, 371 aa, Unknown
  Azoarcus sp. BH72
MRDKIKNARRLIVKVGSALVTNNGAGLDPAALDDWARQIAALRARGREIVLVSSGAIAAGMQRLGWVKRPHEMHRLQAAAAVGQMGLVEAYEKAFSRHGLQTAQILLTHEDLADRTRYLNARSTLVTLLELGVVPIINENDTVVTDEIKFGDNDTLGALVANLVEADTLIILTDQRGLYTADPRRDPGATLISEGRAEDRQYEAMAGGAGSGISKGGMITKIRAAQRAARSGAHTCIASGRETDPLLRLADGEAVGTLLYADSTPLQARKQWLADHLQLAGSLIVDAGAARALDDGRSLLPVGVVEVQGEFKRGAAVACRDEHGTELARGLVNYSSAECRRILRRPTSDIEQLLGYIDEPELIHRDNLVIR

SEQ ID NO: 26803 - protein, 266 aa, Sulfolobus tokodaii
MDSNSIKVKQVDEVKISKYILKYTFQDWEDIVESDVVIVGAGPSGMTAAYYLAKAGLKTVVFERRLSFGGGIGGGAMLFHKIVIESPADEILKEMKIKLNKVEEGVYIVDSAEFMAKLAASAIDAGAKIIHGVTVDDVIFRENPLKVVGVAVEWTATQMAGLHVDPLFISAKAVVDATGHDAEVISVAARKIPELNIVIPGEKSAYSETAEELTVENTGMVAPGLYAAGMAVTEVKGLPRMGPIFGAMVLSGKRVAEIIIKDLRYS

SEQ ID NO: 26804 - protein, 229 aa, Clostridium perfringens
MDGIGIGIPKMVSGTHYGNLQKVRGGKRTFGITPHIPGGFITPEQLEKIAKVTKKYNGVIKITSGQRLLITNLKGEDLPKIWDELGMEPAVKKQNSVKNVEMCPAGFCKRSKFNTIGTGMKLLNKYKHMDMPCRTKIGVAGCRNACGSVYSKDVGVIADKTGFLVTAGGSAGHNPRMADILIKDVDEKEALRIVDKIFEVYKGEGEAGEKLGDFIDRIGIEVFKEKTLA

SEQ ID NO: 26805 - protein, 194 aa, Desulfitobacterium hafniense
MREAHIERQTKETRIRVKLNLDGAGTAQVDTGIGFFDHMLEALARFGYLDLEVAAEGDLQVDPHHTIEDCGIVFGQAIREALGERRGIERVGDTLLPMDEALVQVALDLSNRPYLVWDVECPEGMVGGFPVEMAEEFFRAVSVQAGITLHMRLFSGKNRHHILEAIFKGFGRALGLALRENPRFQGVLSTKGVL

SEQ ID NO: 26806 - protein, 332 aa, Staphylococcus aureus
MTKITVFGMGSFGTALANVLAENGHDVLMWGKNQDAVDELNTCHTNKKYLKYAKLDVNIIATSDMTKAIQFADIYLMALPTKAMREVASQINDKLTSKKTFIHVAKGIENGTFKRVSEMIEDSISPEYNAGIGVLSGPSHAEEVVVKQPTTVAASSKDKSVSKLTQDLFMNDYLRVYTNDDLIGVELGGALKNIIAVASGIVAGIGYGDNAKAALMTRGLAEISRLGEKLGADPMTFLGLGGIGDLIVTCTSTHSRNFTLGYKLGQGESMDQALSEMNMVVEGIYTTKSVYHLAKEKNVDMPITNALYRVLFENISVKECVKDLMERDKKSE

SEQ ID NO: 26807 - protein, 238 aa, Oltmannsiellopsis viridis
MKVSIEEMVQVGMHFGHQSRKWNPKMAPFIYTERNGIHIIDLIQTHAYLKQVSQFLTESSAAGKTILFVGTKKQASGLIAKVALQCNSPYVNQRWLGGMLTNWKTIQTSIKKLNEFDYQEKTGGFDLLSKQEAAQARKEKARLQKYLGGMKHMTTIPDVVVIVGQPDELNAVAECRRLGIRSVTILDTDCDPSLADLFVPANDDSVASIQLILTEFLRSILNGQQMFSEKQQRGKKTA

SEQ ID NO: 26808 - protein, 391 aa, Staphylococcus aureus
MTEEFNESMINDIKEGDKVTGEVQQVEDKQVVVHINGGKFNGIIPISQLSTHHIDSPSEVVKEGDEVEAYVTKVEFDEENETGAYILSRRQLETEKSYSYLQEKLDNNEIIEAKVTEVVKGGLVVDVGQRGFVPASLISTDFIEDFSVFDGQTIRIKVEELDPENNRVILSRKAVEQEENDAKKDQLLQSLNEGDVIDGKVARLTQFGAFIDIGGVDGLVHVSELSHEHVQTPEEVVSIGQDVKVKIKSIDRDTERISLSIKDTLPTPFENIKGQFHENDVIEGVVVRLANFGAFVEIAPGVQGLVHISEIAHKHIGTPGEVLEPGQQVNVKILGIDEENERVSLSIKATLPNEDVVESDPSTTKAYLENEEEDNPTIGDMIGDKLKNLKL

SEQ ID NO: 26809 - protein, 126 aa, Clostridium perfringens
MASKMLHTCIRVKDLDKSLKFYKEALGLVETRRRDYPEYKFSLVYLSDKEDGYEVELTYNYDQEKPYNLGNGFSHIAVGVEDIEAERERHISLGYEVTPMKGLSDGAATYYFVTDPDGYKVEVIKL

SEQ ID NO: 26810 - protein, 613 aa, Oryza sativa
MATASWGVWWLLWLSLFMYFCLFVRGSHRNRKDMRQLKHRGPDWSGLYQCEGNFLAQQRLAIVSPLSGDQPLYNADRTIVVVANGEIYNHKKIRKQFASKHTFSTGSDCEVIIPLYEEYGEDFVDMLDGVFAFVLYDTRTKTYMAARDAIGVNPLYIGRGSDGAVWISSEMKALNEDCVEFEIFPPGHLYSSAAGGLRRWYKPQWFAENVPATPYQPLLLREAFEKAVIKRLMTDVPFGVLLSGGLDSSLVAAVTKRHLIKTEAAEKFGAELHSFVVGLEGSPDLIAAREVADHLGTIHHEFHFTVQDGIDAIEEVIYHDETYDVTTIRASTPMFLMARKIKALGVKMVLSGEGSDELLGGYLYFHFAPNKEEFHKETCRKVKALHQYDCLRANKATSAWGLEVRVPFLDKEFINVAMSMDPEWKMYNADLGRIEKWVMRKAFDDEEHPYLPKHILYRQKEQFSDGVGYNWIDGLKAFTEQQVSDEMMKNAAKVYPHNTPVNKEAYYYRMIFERLFPQESARETVPWGPSIACSTPAAIEWVEQWKASHDPSGRLIASHNSASASANHTNHANANANGNSNGKANGNCAMAANGTNGVGLVVANGTANGKMEA

SEQ ID NO: 26811 - protein, 123 aa, Oryza sativa
MAAAPSRRGATLRVQAKKQTFSSFDELLEKSEKPVLVDFYATWCGPCQYMVPILQEVSEKLGDKIQVVKIDTEKYTSIANRYQIEALPTFIIFKNGKPCHRFEGALPANQLIQQIESALEVAK

SEQ ID NO: 26812 - protein, 218 aa, Triticum aestivum
MSSTGASGPDADAAAGEGLELAQFGAGCFWSVELAYQRLPGVARTEVGYSQGHLDGPTYRDVCGGGTGHAEVVRVHYDPKECPYAVLLDVFWAKHNPTTLNKQGNDVGTQYRSGIYYYTAEQERQARESLAEKQREWKEKIVTEVLPARRFYAAEDYHQQYLHKGGQSRQERGGPEPQSGCLRVGKLTGPRVPRTGPKAYGMAGIGPVKPSFKGDTRS

SEQ ID NO: 26813 - protein, 2300 aa, Neurospora crassa
MTRNDGGSRYSSIDSAQSSITAKPFPLTPTSSLGSSMTRPLSPSLQAGSSSSNGGHNVSRSASQGARRPAPTRLKTDDGTQFASRSSRDFESSQSQSQPSHTQTRSHSLSQATLQSCSQPQLSLNSQQSQSPSQYHSQQTPTQQQPQQQVSPTGGSRLTQSPTTPSNASIREHRMSELGGYRREMAAMLDTTGGALSRTSSHSQQQPQQPQQQQQQQQQQQGHAAGSVSGTFSNLSQYAPYLGGNNGGGMSMGSFLNDSTDNLSVISQLSPGIRPMTARPSQASAGSMEFPDSAYYDDERRPSIASITTTASSQGSRTSKTRGGLQKLQQFFGDRDDWPGRDSSEISLPQPSHSGPMSTGKEHRSHSYSLPGSGRSHRDRNYSNATDHHPSTFGSVSTVGGRDRDASPVPSRPRTPVPAPEVVPFLYQEADDIARYGEAPVRTSLTGPDRDRYIDSSQNPPKTSSSARSGHSIVHLPGHHKHNKSNEDPRALKPSLSREDSAASFARDFRNGSSSMMGTRSRAQSPAPSWTGTSRGLKANSISDGTSSPAPSHKKGILGRFRRHNKDKEDGSSLRSGSNHTLVHRPSRQDLTRAAESTYPASVYVSDPSEQREVPVRPGYVRQTTAPGFTTKLFTSKKSSSAKQPQDDMDEDIGPTDMHMGGGTVYHLDTNLNDMEGILTKPQPMTPLDNSISMRRESEKMIVPITTDPEGAWAAPDSWAVRDNKKSLAPQVNEDLCSRQPSEEKEKKSNYYIRVFRSDSTWTTLTLPLTATAEDVIMGVAKKTYLPPGAQDSYSLLIKKHDLFRVLNSAEQPLRIQKRLFQQIGYQEKDGIDEIGREDNSYICRWVFLKEKEADMHLLSPDINFRNQKLNHVDLSGRNLITIPVPLYRKAAEIVSLNLSRNLSLDVPRDFIQACTALRDIKYNNNEAQALPKSFATASKLTYLDVSNNRLQDLDHSELSKLTGLLKVNLANNCLRSLPPTLGAYKSLRTLNISSNFLDVFPSFICELETIVDLDLSFNSINNLPDNLMKLRNLEKFVITNNRLSGPISESVRDLVSLRELDIRYNQISTIDVLSDLPRLEILSADHNQISKFSGSFERLRSLKLNSNPIVKFEVKAPVPIPQILNLSNAQLASIDESIDNLMNLERLILDSNYFVSLPNQIGNLKKLDHLSMANNHLGELPPEIGCLTELRTLDVHGNNMRKLPNEIWWANKLEHLNASSNILTEFPKPASRAPQAPGEASPSPGAYPFPNANKNGLLSRTPSMDDLNGDASRRPSQASSTLLGVAVSPVPSGPDNRKSSMVSLYGKGGRKTSVVSRSTTQSSTGVITPSNGPRKDSSLSYRFTHTFSGSLKNLYLADNQLDDDVFEELKHLPELRVLNLSCNDLSDMPQGTIRSWPQLVELYLSGNELTSLPAEDFLEEHCLLQTLHINGNKFINLPAEISRAKKLQVLDCSSNNLKYNVTNVPYDWNWNFNRDLRYLNLSGNKRLEIKNNYRQPQSYRDDDFADTDFSKLTNLRVLGLMEVTHTLPNIPDQTEDRRVRTSEMKAGAYLPYGMADTLGKNEHLSLFDLVVPRLGSVETDTLVALFDGKELSTGGSKIAKFLYEEFSRLFILELEKVKGKPNENPADALRRTFLSVNKLLMSLSNSADERGLDSHPSRNYAHTVLTKEDLNSGCVATVAYLSELKLYVANVGDVQGMLIQANGSFKMLTKKHDPADPVERSRIRNAGGWVSRNGRLNDVLNVSRAFGYTELLPAVQAAPDITEHTIDDKDETVLIASKELWEHLRPELIVDVARECRSDLMKASQKLRDLAIAYGSTNKLLIMMIGVANLKQRQAQQFKGQLNATFSMPQDDPSHVPPSGNKRRKVRAEGPLDSNLMRLNAEVPPPTGQLSIVFTDIKNSTQLWENYPEAMRLAIKLHNEVMRRQLRMIGGFEVKTEGDAFMVSFPTATSALLWCFAVQMKLLTVDWPPEVLSNSSCQPIYDRNNNLITRGLSVRMGAHWGEPLAERDPVTRRMDYYGPMVNKASRISAVADGGQITASSDFITEIHRCLETYKESVDVDEDSLEDDATAKAIRAELRALSSQGFEVKDMGEKKLKGLENPELVYSVYPHALVGRTEQHHAHTESTQNQAALQPYGALATPKPATMDPDSEIQFEPETIWALWRVALRLEMLCSTLEEPNARGLQAPETELLERMKQRAGEVTDHFLLNFMEHQISRIETCITSLAVRHIAIGSGPITKLNDLRAPMNDVLSTLKEQMDELARYKAKYGSLDQAETDDATDNNSSGDVDTLDGSDTEQE

SEQ ID NO: 26814 - protein, 460 aa, Bacillus licheniformis
MHTLEKMEQTNFQTARDYVTQAYETVQKRNFYESEFLQAVKEIFDSLVPVLARHPKYIEHRILERIAEPERMITFRVPWVDDEGNIRVNRGFRVQFNSAIGPYKGGIRFHPSVNASIIKFLGFEQIFKNSLTGLPIGGGKGGADFDPKGKSDREIMSFTQSFMNELYRHIGPDTDIPAGDIGVGAREVGFMFGQYKKIRGRYDAGVLTGKGLEYGGSLTRKEATGYGLVYFVEEMLKDQGMRFENSTVVVSGSGNVALYAMEKAAQFGAKVVACSDSDGYVYDEKGICLETVKRLKEDGNGRIREYVSEHPEAHYFEGCTGIWSIPCDIALPCATQNEIDEEAAEVLISNGVKAVGEGANMPSEEGAVKRFLDAGVLFGPAKAANAGGVAVSALEMAQNSARLHWTAEETDAKLRAIMADIHKRSVEAASEYGRPGNLLDGCNIAGFIKVADAMIAQGVV

SEQ ID NO: 26815 - protein, 516 aa, Oryza sativa
MEWVRGKCVGRGAFGAVHVAVDRATGRAFAVKSVEAKGGAPAAAMACLESEIRILRRLSSPYVVEYLGDDGDAATTRNLHVELVPGGSAAAAAAMGGLGERGARGVVRRVAAALRYLHDVAGVVHGDVKGRNVLVGCDGDGRGAKLADFGAARLVSDAAVSRGPRGTPAWMAPEVARGGAPTPASDVWSLGCTAVELITGKRPWSELGGASEVGELLFLIGFGGKRPELPACASDSCRDFLDKCLRRDAGERWTCDQLLRHPFLSAADVHDGGEPSPFPSPRAVLDWAAASMSDSDSDDSGGAEARSEHEVMARAKGRLAELASNASWGREWGAGPTWEAADTWAPPSSPDTTATNAPVPSNPAAVADAGGPPAVIAGGRDSVLAVATAGAGRDRCDSQHGHYKCELARTRRARLAVASVAAVITTGNHHEQTSSNEYEYIAIPAIGKIRRSMGAYHDLRSAYASMLGVNPDPRNMGTDSMVAAVKMHTYNSTTRHRRGEELHIAYNCKTEIRIVE

SEQ ID NO: 26816 - protein, 599 aa, Arabidopsis thaliana
MASFTATAAVSGRWLGGNHTQPPLSSSQSSDLSYCSSLPMASRVTRKLNVSSALHTPPALHFPKQSSNSPAIVVKPKAKESNTKQMNLFQRAAAAALDAAEGFLVSHEKLHPLPKTADPSVQIAGNFAPVNEQPVRRNLPVVGKLPDSIKGVYVRNGANPLHEPVTGHHFFDGDGMVHAVKFEHGSASYACRFTQTNRFVQERQLGRPVFPKAIGELHGHTGIARLMLFYARAAAGIVDPAHGTGVANAGLVYFNGRLLAMSEDDLPYQVQITPNGDLKTVGRFDFDGQLESTMIAHPKVDPESGELFALSYDVVSKPYLKYFRFSPDGTKSPDVEIQLDQPTMMHDFAITENFVVVPDQQVVFKLPEMILGGSPVVYDKNKVARFGILDKYAEDSSNIKWIDAPDCFCFHLWNAWEEPETDEVVVIGSCMTPPDSIFNESDENLKSVLSEIRLNLKTGESTRRPIISNEDQQVNLEAGMVNRNMLGRKTKFAYLALAEPWPKVSGFAKVDLTTGEVKKHLYGDNRYGGEPLFLPGEGGEEDEGYILCFVHDEKTWKSELQIVNAVSLEVEATVKLPSRVPYGFHGTFIGADDLAKQVV

SEQ ID NO: 26817 - protein, 979 aa, Coprinopsis cinerea
MTRGLASLKQPSSLFAPLDTFKERHIGPDDGETSRMLKQLGYDSMDAFIADTVPKHIRISNTSVTNENIPVLSESELHATAKALGAMNKGYKSFIGMGYHNAVVPPVILRNVMENPAWYTQYTPYQPEIAQGRLESLINYQTMVMSLTSMDIANASLLDEGSAAAEGMVMSFVSTNSKKKTFIVDSGIAAQTLAVVESRAKGFNINVVVGDASKLVEDPKIQSDLCGVLVQYPDVDGNIKDWGSLAATTHKAGGYVVCATDLLALTQITPPGEWGADIVVGNSARFGVPAGYGGPHAAFFAVTDKLKRKMPGRLIGLSRDAQGKPAYRLALQTREQHIRREKATSNICTAQALLANMAAMYAVYHGPEGLKRIARKVHGFTQVFKNSVEAMGYKTENPVFFDTLTLDVTGATSSADAVHKAAAAAKINIRQIDSRRVGVTFDESVTPEELVRLINVFASASSKPSVSLADLAEPQQVSIPESFQRRSEFLPHPVFNKHHSETEMLRYIHHLAGKDLSLAHSMIPLGSCTMKLNSTSSMIPLTFPEFGGVHPFAPSDQVKGYEVIIKELEDYLCKITGFHSASLQPNSGATGEYAGLSVIRAYHESRGEGHRDICLIPLSAHGTNPASAVLAGLKVVSVKVHNDGNLDLEDLRAKAEKHKDNLAAFMITYPSTFGVFEDGVQAACEIIHQNGGQVYLDGANLNAQVGLTNPATCGGDVCHLNLHKTFAIPHGGGGPGVGPICVAEHLAPFLPGHPYMEGQGSKAIKPVASAPFGSASILLISWAYIKMLGGKGLVDSSKLALLNANYMASRLSGHYTLRYKNGKGRVAHELLIDLAEFDKAAGLKVTDFAKRLQDYGFHPPTCSWPISTCMLIEPTESETLEELDRFCDAMIQIRKEAEDIITGKQPKDNNVLKNAPHPMSVIALSEAEWNRPYSRETAAYPLPWLKEKKFWPTVSRLDDAYGDMNLVCDCPSVEELADN

SEQ ID NO: 26818 - protein, 278 aa, Unknown
  uncultured bacterium
QPNAMGGREVGGLANQLAAHLYFEDDKEIDLVKRFWQAPNMATQQGLKAVDMFNAVDEGKIKAIWIIATSPVVSMPNANLIKRALKKCPMVVLNECYEGSDTIKYADVILPATTWGEKHGSVTNSDRTISIQRGMVTAPGEARNDWQIVCEVAKKMGFKNAFDYKHSVEIFREHAAISGFENSHPTTVNRSDNDIYRVFDISALAQISNEAYDNFTPTKWPININNPYGTQRLYSDNVFTHKSTKANFIAITPRLPFYAPTEHQVIMNTGRIRDQWHT

SEQ ID NO: 26819 - protein, 303 aa, Salmonella enterica
MNTLEQTIGNTPLVKLQRLGPDNGSEIWVKLEGNNPAGSVKDRAALSMIVEAEKRGEIKPGDVLIEATSGNTGIALAMIAALKGYRMKLLMPDNMSQERRAAMRAYGAELILVTKEQGMEGARDLALAMSERGEGKLLDQFNNPDNPYAHYTTTGPEIWRQTSGRITHFVSSMGTTGTITGVSRFLREQEKPVTIVGLQPEEGSSIPGIRRWPAEYMPGIFNASLVDEVLDIHQNDAENTMRELAVREGIFCGVSSGGAVAGALRVARATPGAVVVAIICDRGDRYLSTCVFGEEHFSQGAGI

SEQ ID NO: 26820 - protein, 268 aa, Unknown
  uncultured bacterium
QPNAMGGREVGGLANMLAAHMDYNEENTSTVSEFWDTKNLTKTPGLKAVDLFEAVADGRIKAIWIMGTNPVVSMPDADRVRAALQACDTVIVSDCVADTDTTATANILLPASGWGGKSGTVANSERRISRQRALVKPVDQAKSDWWIISQVGQAMGFNNAFDYHSPRDIFIEHAKLSGFKNTGNRLFNISTLSHLSEQQYNQLEPIQWPVTPLKPKGAARLFEDKLFFTPSKKANFVVINPQLPQCHTPSDDFPLTLNTGRIRDQWHT

SEQ ID NO: 26821 - protein, 300 aa, Ralstonia solanacearum
MAYPTIEDTIGNTPLVRLQRIPGEDNARRGNVILGKLEGNNPAGSVKDRPALSMIKHAETRGRIKPGDTLIEATSGNTGIALAMAAAIRGYKMVLIMPEDLSVERRQSMAAYGAEIVLTPVKGGMEYARDLADAMERDGKGVILDQFANPDNPLAHYEGTGPEIWRDTEGRITHFVSAMGTTGTITGVSRFLKEKNPAIQIVGAQPAEGSRIPGIRKWPEAYMPKIYDPKHIDRTESVSQSDAEHMARRMAREEGIFCGISAAGALCVALRVAEAVENATIVFVVCDRGDRYLSTGVFPA

SEQ ID NO: 26822 - protein, 268 aa, Unknown
  uncultured bacterium
QPNAMGGREVGGLANMLAAHMDYNEENTSTVSEFWDTKNLTKTPGLKAVDLFEAVADGRIKAIWIMGTNPVVSMPDADRVRAALQACDTVIVSDCVADTDTTATANILLPASGWGEKSGTVTNSERRISRQRALVKPVDQAKSDWWIISQVGQAMGFNNAFDYHSPRDIFIEHAKLSGFKNTGNRLFNISTLSHLSEQQYNQLEPIQWPVTPLKPKGTARLFEDKLFFTPSKKANFVVINPQLPQCHTPSDDFPLTLNTGRIRDQWHT

SEQ ID NO: 26823 - protein, 168 aa, Oryza sativa
SEEKQQRESFSIPKSPPPPQTLAKLRSQQQLQMFWAEQYREIEATTDFKNHNLPLARIKKIMKADEDVRMIAAEAPVVFARACEMFILELTHRGWAHAEENKRRTLQKSDIAAAIARTEVFDFLVDIVPRDDAKDADAAAAAAAAGIPRPAAGVPATDPLAYYYVPQQ

SEQ ID NO: 26824 - protein, 512 aa, Apium graveolens
MENGTKELNKQPPPSAAMQVQTSPPKLPIATWKLILVAAIAAGVQFGWALQLSLLTPYVQLLGIPHKWAAYIWLCGPISGMLVQPIVGYYSDRCQSSFGRRRPFIASGAGCVAISVILIGFAADIGYKAGDDMTKTLKPRAVTGFVIGFWILDVANNMLQGPCRALLADLCNGDTRRMRSANAFYSFFMAVGNILGYAAGSYNNLYKLFPFSKTHACDLYCANLKSCFIISIVLLIFITVLALTVVREKQWSPDEADEEPPSSGKIPVFGELFGALKDLPRPMLMLLVVTCLNWIAWFPFILFDTDWMGREIYGGTAGQGKLYDQGVRVGSLGLLLNSVVLGLTSIAVEYLVRGVGGVKILWGLVNFLLAIGLVMTVVVSKVAQHQRQHGANGQLLPPSAGVKAGALSLFSILGIPLSITFSIPFALASIYSSGSGAGQGLSLGVLNLAIVVPQMIVSVLAGPFDSLFGGGNLPAFVVGAISAAISGVLAIVLLPKPSKDAAAKLTLSGPYH

SEQ ID NO: 26825 - protein, 268 aa, Unknown
  uncultured bacterium
QPNAMGGREVGGLANMLAANMDYNEENTSTVSEFWDTKNLTKTPGLKAADLFEAVADGRIKAIWIMGTNPVGSMPDADRVRAALQACDTVIVSDCVADTDTTATANILLPASGWGEKSGTVTNSERHISRQRALVKPVGQAKSDWWIISQVGQAMGFNNAFDYHSPRDIFIEHAKLSGFKNTGNRLFNISTLSHLSEQQYNQLEPIQWPVTPLKPKGTARLFEDKLFFTPSKKANFVVINPQLPQCQTPSDDFPLTLDTGRIRDQWHT

SEQ ID NO: 26826 - protein, 371 aa, Bacillus cereus
MSKRDYYEVLGLSKGASKDEIKKAYRRLAKKYHPDVSKEENAIEKFKEVQEAYEVLSDDQKRAQYDQFGHAGANQGFGGFGGGGDFGGGFGFEDIFSSFFGGGGGRRRDPNAPRQGADLQYQVTLDFEEAIFGKELNVEIPVEDPCDTCKGSGAKPGTSKETCKHCSGSGQVSVEQNTPFGRIVNRQACGHCSGTGQIIKEKCTTCHGSGKVRKRKKINVKIPAGIDNGQQIRVSGKGEAGVNGGPAGDLYVVVHVRNHEFFEREGDHIICEMPLTFAQMALGDEVEVPTVHGKVKLKIPAGTQTGTEFRLKGKGAPNVRGYGQGDQYVVVRVVVPTKLTSQQKDLLREFAGQEEQDDSLFGKLKRAFKGE

SEQ ID NO: 26827 - protein, 268 aa, Unknown
  uncultured bacterium
QPNAMGGREVGGLANMLAAHMDYSVENTATVREFWNTKNLSQTPGLNAVDLFEAVADGRIKAIWIMGTNPVGSMPNADRVRAALQSCDTVIVSDCMADTDTTATANILLPATGWGEKSGTVTNSERRISRQRALIHPVGQARSDWWIISQVGQAMGFNDAFDYHSPQRYFYRTCPTKCVKNTGNRLFNISTLSHLSEQQYNQLEPIQWPVTPLKPKGTARLFEDRLFFTPSKKANFVVISPQLPQLHTPNNDFPLTLNTGRIRDQWHT

SEQ ID NO: 26828 - protein, 576 aa, Glycine max
MGREGAPPPDLQLRRPPPPPPEKPLIQVNNREVAMPKPCDLKINIDGQQIFLLKEKVISKYCGGLKKILNHQKRRCHVKELGIRINDFPGGPKGFELVSMFCYNNGKIQITVANVSLLHCCAVYLGMTEEAFSNNLLQQTETFLERIYYWKWNDILASLKSCQLFYTYADGYGLLEKIISALAKFVQNSDSNLLTSSPSASSWSSSPESNFAKRFSFSSKKTTPEKIKSCLPRKAWWFDDLATLPPTIIEKLFQTIGAYKADNKDLILTRFLLHYLKIATQTKMVNCRNSNEYAALAETAAYGVISVGKETFSCRGLFWVLRIVSKFGLSRDCRTELEKLIGGMLEQATLDDLLVSGHDMGVYYDVNLVIRLVRLFVDINGSDGLSLQKVKRVGRLIDKYLREISPDQNLKISKFLGVAECLPDSARDCYDGVYKAIDIYLESHPTITFEERSRLCRCLNYSKLSFEACKDLAKNPRIPPRVAMQALISQQPKNSTSDRVTESPRMKHSQIVLYNEASRESFSQERRDMRLNIEKMQWGVIELAKLRKQTNVQMPQLFTHNVLLNPARASSSPRFC

SEQ ID NO: 26829 - protein, 135 aa, Picea glauca
GGFSEEEFSCGEIEVHEVDPRAEDRELKDQLLRKYSGYFSSLKQEFLKKKKKGKLPKEARQKLLEWWNVHYKWPYPSETDKVSLAESTGLDQKQINNWFINQRKRHWKPSEDMQFVVMDSLNPHGASFYMDGADC

SEQ ID NO: 26830 - protein, 161 aa, Triticum aestivum
REGLNSTFLTASHGWCARASQRRGSSAAEAVPDPKIRIYDVGMKKKGVDEFPSCVHLVSWEKENVSSEALEAARIACNKYLAAETLELAGNAARDNKKNRIVPRHIQLAVRNDEELSRLLGSVTIAARRGAAQHPHHAAPQEGRQGARATSAPLPRSFRLD

SEQ ID NO: 26831 - protein, 401 aa, Chlamydomonas reinhardtii
MASLLGRKACIPATCVQKSLTPPAPLRLGLACSALQRHQVQTAIASRVARQQEENGRAAAIVPRQRTVCQAAAVPADGESDKGKDMSGMMVLGLMFVAWYGTNIFFNIYNKQLFKVFPFPLTTTNIQFFIGSCLSMVFWVTGIVKLPKIDMALVKSIYPLAIINVLGNVLTNVSLGHVAVSFTHTVKAMEPFFSVIFSAIFLGDVPPVPVLLTLVPIVGGVVIASLTEATFNWTGFLSAIFSNMTFQSRNVLSKKLMIKKGAVDNMNLFQIITIMSFLMLLPVSTMVEGGAALLTPESLANLGLNEAAREQMFMRLLSAGICFHSYQQLSYMILSRVAPVTHSIGNCVKRVVVIVASLIAFQNPISMQNAIGTGIALFGVFLYSQAKRKYKGKGDVKPEAA

SEQ ID NO: 26832 - protein, 104 aa, Bacillus clausii
MAIVNATDQNFTEETKEGLVLVDFWAPWCGPCKMIAPVLEELDGDLGDKAKIVKVDVDENQETAGKFGVMSIPTLLVLKDGEVVDKAVGFQPKEALEELLNKQM

SEQ ID NO: 26833 - protein, 179 aa, Zea mays
MVEDAAVWCAVHGLVIGDRANQRSGTVPAVGLVHAPFSLLPARFPASFFNQACELAPIFNELVDRVSLDGEFLQAALSRTKQVDEFTSRLLEIHDKMMSINKKEDIHLGLHRSDYMLDSETNSLLQIELNTIPSSFPGLGSLVSELQRLYKMIFHQKAWMPCARCSSTCQHGQALHPPK

SEQ ID NO: 26834 - protein, 350 aa, Arabidopsis thaliana
  misc_feature (175)..(175): Xaa can be any naturally occurring amino acid
MAAIASTLSLSSTKPQRLFDSSFHGSAISAAPISIGLKPRSFSVRATTAGYDLNAFTFDPIKESIVSREMTRRYMTDMITYAETDVVVVGAGSAGLSAAYEISKNPNVQVAIIEQSVSPGGGAWLGGQLFSAMIVRKPAHLFLDEIGVAYDEQDTYVVVKHAALFTSTIMSKLLXARPNVKLFNAVAAEDLIVKGNRVGGVVTNWALVAQNHHTQSCMDPNVMEAKIVVSSCGHDGPFGATGVKRLKSIGMIDHVPGMKALDMNTAEDAIVRLTREVVPGMIVTGMEVAEIDGAPRMGPTFGAMMISGQKAGQLALKALGLPNAIDGTLVGNLSPELVLAAADSAETVDA

SEQ ID NO: 26835 - protein, 709 aa, Metallosphaera hakonensis
MVFETRDRPLRPGRPYPLGSNWIEEEDGVNFSLFSENAEKVEIVLFSNKNDPKEVIEVKNRTGDIWHTFVPGLIPGQLYGYRVHGPYKPEVGLRFNPNKVLIDPYAKAVSGPVKWDDSLFGYKIGDQAQDISFDERDSSGFIPKSVVIDPHFDWDDDFHKRRPELKDTIIYETHVKGATKLRLDLPEEIRGTYLGLSSRQMIEYLKDFGFTSVELMPVYQFIDQRFFVEKGLANYWGYDPINFFSPECRYSSSGCEGGQVIEFKRMVNELHNAGIEVIIDVVYNHTAEGNHLGPTLSFKGIDNLAYYMLVPDNKRFYLDFTGTGNTLNLSHPRVIQMVLDSLRYWVTEMHVDGFRFDLAAALARELYNVNMLNTFFITIQQDPILSQVKLIAEPWDVGPGRYQVGNFPHMWAEWNGKYRDTMRRFWRGEQLPYSEVANRLMGSPDIYLGNNKTPFASINYITSHDGFTLEDLVSYDQKHNEVNGFNNQDGMNDNFSWNCGAEGPTDDPKVWECREKQKRNFLITLMVSQGVPMILGGDELSRTQRGNNNAFCQDNEVSWYDWNLDERRAKFQEFVMRMVRFYRAHPVFRRSKYFQGKKLHGIPMKDVTFLTPDGKEVDEQTWNSPTQTVVVLLEGSAMDENNSRGERIADDSFLIVLNANPNAIKLNPPRGKWRLVVSSMREEKVDVVESGKEVEIEGRTALVFRRIES

SEQ ID NO: 26836 - protein, 175 aa, Unknown
  uncultured archaeon GZfos19A5
MGKKPARKYTKVTGHAYVRKKYMGGVPGSKIALFDMGNLSMGMDFPVALSLVAKEACQIRHNALEAARIFANRYLVKEVGRNNFYLKIRPYPHHVLRENKIASGAGADRVSSGMRHAFGKAVSSAARVKPGQRILSVGVEAQNFDDAKEALRRASYKLPTPCRFIIDKGEELLGV

SEQ ID NO: 26837 - protein, 268 aa, Prosthecochloris aestuarii
MDNEQFDFSCDVLEQSHDIAVLVDFWAEWCGPCRMLAPVLESVVARFNGKVVLVKINTEEHPAVAQKFNIRSIPNVKLFIDGKVADEFTGALPEAQIEQWLRKALPSPYTGEIRLARGLGQQGKQQQAISILEEVLLNEPDNIEATALLVRLTLFTKPTEAGKLIGRLEGESEYAEFAGSVRELVSMLVKKIDELPEDHVRDRYAAALLQLQAQDFNAALDGFIKVIKENRYYDDDGSRKACIAIFKYLGEDHTVTLKHRRVFDRALY

SEQ ID NO: 26838 - protein, 406 aa, Zea mays
  misc_feature (129)..(129): Xaa can be any naturally occurring amino acid
  misc_feature (160)..(160): Xaa can be any naturally occurring amino acid
  misc_feature (170)..(170): Xaa can be any naturally occurring amino acid
  misc_feature (198)..(198): Xaa can be any naturally occurring amino acid
MEVGDARNGSAAAALTKGSADDAARKPLPPCCVKAKARVPETEANCHDTVVSGWFTEPRSRFGKTSKVQYFNNPMWPGEAHSLKVEKILFQGKSPYQEILVFESSTYGNVLVLDGIVQLTDKDECAYQXNGCYFATEQIELKDVLPTLRLLMSSNFMGSXPYDISLLTDXVLVVGGGDGGVLREIARHDSVETIDICXKEFFPNLSIGFKDPRVRLHVGDAVDFLRNSPEGKYDAIIVDSSDPIGPAQALVEKPFIQTIARALKPGGVLCNLAESMWLHTHLIQDMLAICRQTFKGAVHHAWTSVPTYPSGVIGFLLCAKEGRAVNFLTPVNPIEKIEGTAKAGRELRFYNSEIHRAAFVLPTFVRRELEAYTTPSASAENEKPKESVSEPQKIKILSNNAILTAT

SEQ ID NO: 26839 - protein, 322 aa, Gibberella zeae
MSPPAAISPTSRSVELATSTTKLPVHAVKNINTKTVEEMLGNWDDFKFAPIRESQVSRAMTRRYFQDLDNYAESDIVIIGAGSCGLSAAYILGKKRPDLKIAIIEASVSPGGGAWLGGQLFSAMIMRKPADAFLREVGVPYEDEGNYVVVKHAALFTSTIMSKVLQMPNIKLFNATCVEDLITRPSDEGIRIAGVVTNWTLVSMHHDDQSCMDPNTINAPLIISTTGHDGPMGAFCVKRLVSMQRIEKLGGMRGLDMNLAEDAIVKGTREIVPGLIVGGMELSEVDGANRMGPTFGAMALSGLKAAEEALKIFDTRKKQNEQ

SEQ ID NO: 26840 - protein, 591 aa, Unknown
  Arthrobacter sp. BP2
MSTRSWPGGPPSWHRSSTSSRPGTGNNPATLRSHTIHYFVPCIRTTKEFAMTAQNTFQTVDAVVIGAGFGGIYAVHKLHNEQGLTVVGFDKADGPGGTWYWNRYPGALSDTESHVYRFSFDKGLLQDGTWKHTYITQPEILEYLEDVVDRFDLRRHFRFGTEVKSATYLEDEGLWEVTTGGGAVYRAKYVINAVGLLSAINFPNLPGIDTFEGETIHTAAWPQGKSLAGRRVGVIGTGSTGQQVITALAPEVEHLTVFVRTPQYSVPVGKRPVTTQQIDEIKADYDNIWAQVKRSGVAFGFEESTVPAMSVTEEERRQVYEKAWEYGGGFRFMFETFSDIATDEEANETAASFIRNKIVETIKDPETARKLTPTGLFARRPLCDDGYFQVFNRPNVEAVAIKENPIREVTAKGVVTEDGVLHELDVIVFATGFDAVDGNYRRMEISGRDGVNINDHWDGQPTSYLGVSTAKFPNWFMVLGPNGPFTNLPPSIETQVEWISDTVAYAEENGIRAIEPTPEAEAEWTETCTQIANMTVFTKVDSWIFGANVPGKKPSVLFYLGGLGNYRGVLDDVTANGYRGFELKSEAAVAA

SEQ ID NO: 26841 - protein, 576 aa, Oryza sativa
MTSARPAPVSAGEASLGRHLARRLVQVGVSDVFAVPGDFNLTLLDHLIAEPGLRLVGCCNELNAGYAADGYARARGVGACAVTFTVGGLSVLNAIAGAYSENLPVICIAGGPNSNDYGTNRILHHTIGLPDFSQELRCFQTVTCHQAVVTNLEDAHEQIDTAIATALRESKPVYLSISCNLPGLPHPTFSRDPVPFFLAPRLSNKMGLEAAVEATVEFLNKAVKPVLVGGPKLRVAKAGKAFVDLVDASGYAYAVMPSAKGLVPETHPHFIGTYWGAVSTAFCAEIVESADAYLFAGPIFNDYSSVGYSFLLKKDKAIIVQPERVIVGNGPAFGCVMMKEFLSELAKRVNKNTTAYENYKRIFVPEGQPLESEPNEPLRVNVLFKHVQKMLNSDSAVIAETGDSWFNCQKLKLPEGCGYEFQMQYGSIGWSVGALLGYAQGAKDKRVIACIGDGSFQVTAQDVSTMIRCAQNSIIFLINNGGYTIEVEIHDGPYNVIKNWNYTGLVDAIHNGEGKCWTSKVKCEEELTEAIGMALGEKKDCLCFIEVIAHKDDTSKELLEWGSRVSAANSRPPNPQ

SEQ ID NO: 26842 - protein, 488 aa, Corynebacterium efficiens
MTIRAAVSHPVGPSGRNPGTGQMRDAMQCGHGAGCGSRPPRCPRRPSIRGAVTHPRLTPWPPQKKYLFTGFKREQVFRFMVECVKGRPNVLAIVLAGGEGKRLFPLTEDRAKPAVPFGGTYRLIDFVLSNLVNAGYLKIAVLTQYKSHSLDRHISVSWNVSGPTGQYIASVPAQQRLGKRWFTGSADAILQSLNLISDEKPDYVIVFGADHVYRMDPSQMVDEHIKSGKSVSVAGIRVPRHEATAFGCIQSDDEGNITEFLEKPADPPGTPDDPDVTFASMGNYVFTTEALVRALKDDSENEDSEHDMGGDIIPYFVDRGDAHVYDFSRNIVPGATERDKGYWRDVGTIDAFYECHMDLISVHPIFNLYNKEWPIHTTVEGNLPPAKFVQGGIAQSSMVAPGSIISAGTVRNSVLSTDVIVEEGATVEGAVLMPGVRIGKGAVVRHAILDKNVVVRDGELIGVDHDRDSQRFKVSAGGVVTVGKNQVV

SEQ ID NO: 26843 - protein, 875 aa, Oryza sativa
MARSSADDMELKRSCEAGILSKEKDRETVVMSMRVAKGRGVWGKAGKLASRHMAKPRVLAVTTKKKGQRTKAFVRVLKYSNGGVLEPAKVYKMKHLSKVEVVPNDPSGCTFLLGFDNLRSQSVSPPQWTMRNKDDRNRFLMCILNMCKEIYGAIPKVVGMDVVEMAMWAKDNTTVKVTQVSTKDGPIESLVGEADSQVAIQKDLVLQTEDEDTEALLDTYIMAIGEAEAFSERMKRELVALESANVYALMETETVIEEVLEGLEIASICVEDFDEWLGIFNVKLRHMREDIQSIEWRNNKLELQSDSNVALIDELDKMLVLLQIPPEYEASLTGGSFDEGNMVKNIEACEWLTSAIKNLEASNLDPIYVKLRAVREKRAEFVLLKCTFVRRASEFLRNYFPSLIDFMLNDKGNFSQRGQLQRPDHADMRYKCRTYARLLQFIKNLDKSCLMPLRKSYCHSLNLLIRREAREFSSELRAGSKASKSSTPLFEGPASANQSISITDTTADAYCKMITVFIPLLVDESSFFAHFMCFDVAALAPSDESDNNNPVAVSEPPGSSAKPINSSAELGVLNQFLQELLDGIQEDFYAIVDWAFKLDPLSCISMHGITDRYLSGQKAEVAGYVHVLLDDLETRISILFSRFVDDACYQIEKYERNVRQIGVVPYIPRFSQLAARMEQYINGSRDLVDQAYTKIVTIMFVTLEKIAQVEPKYVDIVLLENYAAFQHSLYDLANVVPTLAKYYHQASEAYEQACSRHINLVIYIHFEKLFQFARKIEELMYNMSPEEIPFQVGMSKVDFRKMLKSSLSGLDKTINAMYRKLQKNITAEELLPSLWDKCKKEFLDKYATFLKLISKIYPSETVISVNEMKDTLASL

SEQ ID NO: 26844 - protein, 411 aa, Escherichia coli
MSIVVKNNIHWVGQRDWEVRDFHGTEYKTLRGSSYNSYLIREEKNVLIDTVDHKFSREFVQNLRNEIDLADIDYIVINHAEEDHAGALTELMAQIPDTPIYCTANAIDSINGHHHHPEWNFNVVKTGDTLDIGNGKQLIFVETPMLHWPDSMMTYLTGDAVLFSNDAFGQHYCDEHLFNDEVDQTELFEQCQRYYANILTPFSRLVTPKITEILGFNLPVDMIATSHGVVWRDNPTQIVELYLKWAADYQEDRITIFYDTMSNNTRMMADAIAQGIAETDPRVAVDRLSTRLQDAGFEMSLSLKAKWRPDQDALELCREHGREIARQWALAPLPQSTVNTVVKEETSATTTADLGPRMQCSVCQWIYDPAKGEPMQDVAPGTPWSEVPDNFLCPECSLGKDVFDELASEAK

SEQ ID NO: 26845 - protein, 377 aa, Escherichia coli
MSNGIVIIGSGFAARQLVKNIRKQDASIPLTLIAADSMDEYNKPDLSHVISQGQRADDLTRQTAGEFAEQFNLLLFPQTWVTDIDAEARVVKSQNNQWQYDKLVLATGASAFVPPVPGRELMLTLNSQQEYRACETQLRDARRVLIVGGGLIGSELAMDFCRAGKMVTLIDNAASILASLMPPEVSSRLQHRLTEMGVHLLLKSQLQGLEKTDSGILATLDHQRSIEVDAVIAATGLRPETALARRAGLTINRGVCVDSYLQTSNADIYALGDCAEINGQVLPFLQPIQLSAMVLAKNLLGNNTPLKLPAMLVKIKTPELPLHLAGETQRQDLRWQINTERQGMVARGVDDADQLRAFVVSEDRMKEAFGLLKTLPV

SEQ ID NO: 26846 - protein, 527 aa, Mycobacterium smegmatis
MGASLLAALVVAVLVAAVARRFDVSAPLVLVVAGLAGSTLPGFGDVALDPDLVLFVILPPLLWSAGMESSYVALRRNMRSIGLLAVGLPLVTTFVVGIVAYHTVPELTLAAALTLGAIVAPPDAVSATAVGRRLGLPRRTMTLLGGESLLNDATALTAYKVALAAAIGAATSWGTALGTFALAAVGGLVVGLVLGMLVHYVRTRLDDPLVESAIGLVAPFSIYLIAEEAHGSGVIAVVVAALLLGQRETQASYATRLQDKAVWKALQLVLESFAFLLIGLQLPAVVGELAGISAATLAISSAAVLAAVIGVRIVWVYGCTYLGRLFTKNHEPPPSHAQVFILSWAGMRGVVSLAAAFGIPLITLSGEQFPGRAQLCFLTFVVVVGTLLLHGLTLPWFIRVLGAEGDEAHSDAIATAAAQDKAARAAAERLDALLAEQPASAEVSHRAADVLRAWNTRRRNAAWERLGRDEEDIGESPTSAFRRLRLEMLAAERETFIAERDAGHIDDEVLRTVLHGLDLEEATLNRD

SEQ ID NO: 26847 - protein, 530 aa, Exiguobacterium sibiricum
MTTFRELNLSEALIKGVLKMGFEEATPIQAETIPVGLSGVDLIGQAQTGTGKTAAFGIPTIERLDAKSRYIQALILAPTRELAIQVAEELNRIGEVKRVHALPVYGGQQIDRQIRALRKNPQIVVATPGRLMDHMNRKTLNLDHVQTVILDEADEMLNMGFVEDIEKILGTLPPTRQTLLFSATMPPQIRKIADRFMTTPTHIKVKAKEMTVENIDQSFIELKESQKFDVLCRLIDTDSPELSIIFGRTKKRVDEMTEGLIQRGYTADGLHGDLTQAKRDQVIRRFKKGTIDILVATDVAARGLDISGVTHVYNFDVPQDPESYVHRIGRTGRAGKTGSAITFVTPREFGQIKTIERVTNKKMSRRHAPTLDEILEGNLKLAAQELIKRVEAKNSQEYTTLAQELLEEYEAVELIAAALKGLTKEPDATPVQISSIEPIRVKRFGSNGGGGNRRPYGNKGGSGSGSSSNRGGGYRGSNPRGGERREGGRPSEGNRSSSSASSDRREGGYAGRNRSESDRNRGGRKPRFEK

SEQ ID NO: 26848 - protein, 396 aa, Oryza sativa
MGTPETSREPCPDRILDDVGGAFGMGAVGGSLFHFLKGTYNSPNGERLVGGAQAVRMNAPRVGGSFAVWGGLFSAFDCTMVFMRQKEDPWNSIIAGAATGGFLSMRQGPGAAGRSALVGGMLLALIEGAGLMLNRVLATPPPLPVDDPNLPAVMGGGGGIPGIPQVPVAPPEVASSSGGGSGWFGSLFGKKEEEKKASPSGGKSEMLESFDTPSTPIPTFEYNKKARPSMERDPCPGRILDDIGASFGMGAVGGSFFHFVKGLRNSPSGARFAGGMEGVRMNAPRVAGGFAVWCGLFSACDCALVSVRQKEDPYNSIIAGAATGGILAARQGLRAVARASLQGAVLLALVSSFGIMMNRLPDAGSMPVNKTETCKEPQMPETFDVPSTPPPSFEYK

SEQ ID NO: 26849 - protein, 214 aa, Triticum aestivum
  misc_feature (133)..(133): Xaa can be any naturally occurring amino acid
  misc_feature (141)..(141): Xaa can be any naturally occurring amino acid
  misc_feature (151)..(151): Xaa can be any naturally occurring amino acid
MFLKGGEFPGYRRPTRPQAIYPHSTAMAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGXYYDGRYWXTMWKLPMFGXCTDATQVINEVEEVKKEYPGRLWSASLGFKQTCRKGEKAVSFNPPFKTTGAGTGSSGKGTKTG

SEQ ID NO: 26850 - protein, 268 aa, Unknown
  uncultured bacterium
QPNAMGGREVGGLANMLAAHMVYSVENTATVREFWNTKNLSQTPGLNAVDLFEAVADARIKAIWIMGTNPVVSMPNADRVRAALQSCDTVIVSDCMADTDTTATANILLPATGWGEKSGTVTNSERRISRQRALIHPVGQAKSDWWIISQVGQAMGFNDAFDYHSPRDIFIEHAQLSAFKNTGNRLFNISTLSHLSEQQYNQLEPIQWPVTPLKLKGTARLFEDRLFFTPSKKANFVVISPQLPQLHTPNNDFPLTLNTGRIRDQWHT

SEQ ID NO: 26851 - protein, 906 aa, Prunus persica
MTASVQNRQFTRLDAPINGVVRSFNFSDLTRPKTTANFVEIDDASYFSSSDDDDENDNPGGEYGDLIRKGNSELEPSILDPRDEATSDSWVHRNPSMVRLTGKHPFNCEAPLARLMHHGFITPVPLHYVRNHGVVPKGTWQDWTVEVTGLVRRPARFTMEQLVREFKSREFPVTLVCAGNRRKEQNMVKQTIGFNWGPAGVSNSVWRGVPLCDVLKRCGIYGRKSGALNVCFEGAEDLPGGGGSKYGTSVKKEVAMDPSRDIIVAYMQNGEQLMPDHGFPVRVIIPGFIGGRMVKWLKRIVVTTRESDNYYHYKDNRVLPSHVNAELANAEAWWYKPEYIINELNINSVITTPCHEEILPINSWTSQRPYTMKGYAYSGGGKKVTRVEVTMDGGDTWQVCTLDHQEKPNKYGKYWCWCFWSLEVEVLSLLVAKEIAVRAWDETQNTQPEKLIWNVMGMMNNCWFRVRSNVCKRHKGEIGIVFEHPTQPGNQSGGWMAKEKHLDSESNTTLKKSVSTPFMNTTSSKTYSLSEVEKHNSPQSAWIIIQGHIYDCTRFLNDHPGGADSILINAGTDCTEEFDAIHSDKAKKMLEDYRIGELVTTTYASDSTSNSPNISVHGPHRTSSEDISFLVTPLAPIKEITPVKSVALTPREKIPCKLVAKTSISHDVRLFRFALPSEDQVLGLPVGKHIFVCATIEGKLCMRAYTPSSSIDEVGYFDLVVKIYFKNVHPKFPDGGLMSQHLDSLPIGAAIDIKGPLGHIEYTGRGHFLVNGKPKFAKKLAMLAGGTGITPIYQVAQAILKDPEDETEMYVVYANRTVDDILLREELDAWAKKYERFKVWYVVENGREGWEYSVGFITDTIMREHLPDGSDGSLALACGPPPMIKFAVQPNLLKMNYDTTDSLLVF

SEQ ID NO: 26852 - protein, 268 aa, Unknown
  uncultured bacterium
QPNAMGGREVGGLANMLAAHMDYSVENTATVSEFWNTKNLSQTPGLNAVDLFEAVADGRIKAIWIMGTNPVVSMPNADRVRAALQSCDTVIVSDCMADTDTTATANILLPATGWGEKSGTVTNSERRISRQRALIHPVGQAKSDWWIISQVGQAMGFNDAFDYHSPRDIFIEHAQLSAFKNTGNRLFNISTLSHLSEQQYNQLEPIQWPVTPLKPKGTARLFEDRLFFTPSKKANFVVISPQLPQLHTPNNDFPLTLNTGRIRDQWHT

SEQ ID NO: 26853 - protein, 690 aa, Unknown
  Candidatus Pelagibacter ubique HTCC1002
MFKVYKKEIEVAGKKISLETGKVARQADGAIIASCGETVILATVVGAKKVNPDMDYFPLSVNYQEKYYAGGKIPGGYFKREARPTESEQLISRLIDRPIRPLFPSEFKNEVQLLPTVISYDKDNQPDILAITASSAALAISGMPFMGPVGASRVGLVDGKYILNPSKAELENSTLDLVVAGTKDAVLMVESETSGLTEEVMLDAVKFGHEGFVPVIEMIEELAKECRKPEWTVEKKDLSEVKKKLEENFTEDLTKAFATIDKQERSNQISEISDKAKQLFAEDENYSDFNVNDELKNLEKKIVRTDILKNKKRIDGRGLADVRAIECEVGVLPRTHGSALFTRGETQAIVVTTLGTSDDEQRLESLDGQHRERFMLHYNFPPFSVGETGRIGTGRREVGHGKLAWRAINSSLPPKEEFPYTFRIVSEITESNGSSSMASVCGASLALMDAGVPIKEPVAGIAMGLIKEGDDFSVLSDILGDEDHLGDMDFKVAGTKDGITSLQMDIKITGITFEIMEQALKQAKEGRIHILGEMNKALSESRADVGEHTPKMEQITVDKKDIAAVIGKGGATIREIVEKSGAKLDVNDEGVVTVAAPDEESRNIAMQMIKDITAKAELNKIYSGKVMKIMEFGAFVNFLGKQDGLVHISELATKRVEKVTDIVKEGDEVKVKVIGFDRGKVKLSMKQAAE

SEQ ID NO: 26854 - protein, 260 aa, Unknown
  uncultured bacterium
QPNAMGGREVGGMANLLAVHKDLHNEEHRREVAQFWGVDKISPKPGLTATEMFDALESGKLKAVWIACTNPLVSMPNSHQIEKAMANSKFVVVQEISHKSDTLQYADLVLPAAAWLEKEGTMTNSERRISYLPKEIEAPGEARPDVEIFCDFAQRMGFRGFNYNSTSEIYDEYASMTKGTNIDVSFLNYDRLKTEGTFQWPVNEYRHKGTPRLFEDKKFYTASQKAIFNIPSTIENTSVKTNDEFPLILTTGRVRDQWHT

SEQ ID NO: 26855 - protein, 379 aa, Salinibacter ruber
MPSDSLRVGVLTGGGDCPGINAALRAVTKSLTLQHDAEVLGFLDGFRGVVDRNVEPLHYRDVSGILTRGGTILGASNKADPFNYLPRGGADVSAQVMRTYRTLDLDALVAIGGDGTMSIAHRLTDLGVDIVGVPKTIDNDLVGTDRTVGFDTAVSTATDAIDRIHTTAQSHHRVMIVETMGRYSGWIALHAGVASGTDVILLPEIEYEVETVADVCRDRERSGQRFTIVAVAEGARRKEGDYVVQERGDEYTDSIRLGGISRVLADQLREHLDTSIRTTVLGHMQRGGSPTAYDRTLATTLGTRAATLVAEGTTGVMVAVQNDAFTQVPLDEIAGKTRTVPLDDPLIASGLDVGTSFGVAVSDLSEAASHSKPASPIQP

SEQ ID NO: 26856 - protein, 405 aa, Starkeya novella
MLNRRQILKSAGAAALGLGAGTLGWPGRHAFAADTVTLPFANGERPLVMYPGKRPLIGLTARPPQLETPFSVFDEGLITPNDAFFVRYHLAGIPLEIDPDAFRLEIKGKVGTPLSLSLQDLKNDFPASEVVAVNQCSGNSRGFVEPRVGGGQLANGAMGNARWRGVPLKAVLEKAGVQAGAKQVTFGGLDGPVIPETPDFVKALSIDHATDGEVMLAYSMNGADLPWLNGYPLRLVVPGYYGTYWVKHLNEITVIDKEFDGFWMKTAYRIPDNACACTEPGKAPTATIPINRFDVRSFITNVENGASVKAGEVPLRGIAFDGGYGITQVSVSADAGKSWTNATLDPGLGKYSFRGWKAVLPLTKGDHVLMCRATNARGETQPMQATWNPAGYMRNVVEATRVIAA

SEQ ID NO: 26857 - protein, 473 aa, Pseudomonas fluorescens
MSGQNSHSGELKRGLKNRHIQLIALGGAIGTGLFLGSAGVLKSAGPSMILGYAICGFIAFMIMRQLGEMIVEEPVAGSFSHFAHKYWGGFAGFLSGWNCWILYILVGMSELTAVGKYVHYWWPDVPTWASAAVFFVMINAINLANVKVFGEAEFWFAIIKVVAIVGMIALGSYLLVSGHGGPQASVSNLWSHGGFFPNGVSGLVMAMAIIMFSFGGLEMLGFTAAEADKPKTVIPKAINQVIYRILIFYIGALVVLLSLTPWDTLLVTLNASGDAYSGSPFVQVFSMLGSNTAAHILNFVVLTAALSVYNSGTYCNSRMLLGMAEQGDAPKALAKIDKRGVPVMSILASALVTFVAVVLNYLIPQHALELLMSLVVATLVINWAMISYSHFKFRQHMERTGQTSLFKALWYPYGNYVCLAFVVFILGIMLMIPGIQISVYAIPVWVVFMWVCYCIKNKRSAQHALQAASASLK

SEQ ID NO: 26858 - protein, 260 aa, Unknown
  uncultured bacterium
QPNAMGGREVGGMANLLAVHKDLHNEEHRREVAQFWGVDKISPKPGLTATEMFDALESGKLKAVWIACTNPLVSMPNSHQIEKAMANSKSVVVQEISHKSDTLQYADLVLPAAAWLEKEGTMTNLERRISYLPKEIEAPGEARPDVEIFCDFAQKMGFRGFNYNSASEIYDEYASMTKGTNIDVSFLNYDRLKTEGTFQWPVNEYRHKGTPRLFEDKKFYTASQKAIFNIPSTIENTSIKTNDEFPLILTTGRVRDQWHT

SEQ ID NO: 26859 - protein, 267 aa, Unknown
  uncultured bacterium
QPNAMGGREVGGLAGLLAAHMDYSLENIATVAEFWGTDSVSCEPGLKAIDLFDAVADGRIKAIWIMGTNPVVSMPNADTVMAALENCDTVIVSDCIAETDTTATANILLPATGWGEKEGTVTNSERRISRQRSLLPPLGEARHDWWIMCQVAQAMGYQKGLSYSSPRDIFIEHAALSTFKNKGNRLFNIGALSALSEAGYDQLDPIQWPVTAQNSIGTKRLFMDDKFLTPSGKAQFIGSTAELPRQSLSDRFPLALNSGRIRDQWHT

SEQ ID NO: 26860 - protein, 326 aa, Unknown
  uncultured gamma proteobacterium
MSRLYQNNAETIGGTPLVKINHISDGNIYAKLESRNPAMSVKCRIGASMVAAAEQDGSLKPGMTIVEPTSGNTGIALAFVAAAKGYGCILTMPNTMSLERRMLMKSLGAEVILTDGAKGIPAAIERAENIITSDPSKYWGPHQFENPANPAIHEQTTGPEIWEDTGGGIDILVSGVGTGGTITGISRYLKRICGKDVLSVAVEPDSTTMITAAKAGETPSHAPHKIQGIGAGFVPQNLDLEMVDQVEQVSSEEAMEWAHKLMQQEGILAGISSGAAMAVAHRLSQQEVHRGKMIVAILPDSGERYLSSALFAGRFSENETVQAAVS

SEQ ID NO: 26861 - protein, 161 aa, Narcissus pseudonarcissus
LKKGSSTDQDVEVYRGEEFDDDGRPRRTGTVWTASAHIITAVIGSGVLSLAWSMSQLGWIAGSVTLFLFSIVTFFTSSLLTDCYRSPDPVHGKRNYTYMSAVKSNLGSTKVWFCGICQYVILVGTAIGYTITASISAAAISKSGCFHKKGHEADCAVSDSL

SEQ ID NO: 26862 - protein, 426 aa, Mycobacterium tuberculosis
MSAPLAEVDPDIAELLAKELGRQRDTLEMIASENFAPRAVLQAQGSVLTNKYAEGLPGRRYYGGCEHVDVVENLARDRAKALFGAEFANVQPHSGAQANAAVLHALMSPGERLLGLDLANGGHLTHGMRLNFSGKLYENGFYGVDPATHLIDMDAVRATALEFRPKVIIAGWSAYPRVLDFAAFRSIADEVGAKLLVDMAHFAGLVAAGLHPSPVPHADVVSTTVHKTLGGGRSGLIVGKQQYAKAINSAVFPGQQGGPLMHVIAGKAVALKIAATPEFADRQRRTLSGARIIADRLMAPDVAKAGVSVVSGGTDVHLVLVDLRDSPLDGQAAEDLLHEVGITVNRNAVPNDPRPPMVTSGLRIGTPALATRGFGDTEFTEVADIIATALATGSSVDVSALKDRATRLARAFPLYDGLEEWSLVGR

SEQ ID NO: 26863 - protein, 405 aa, Unknown
  Azoarcus sp. BH72
MVIVGAGQSGLQVAESLRSEGYASVIVMIGDEPCPPYHRPPLSKAYLAGEASEAQLTIRAPEALAKKQIEFVAGVGVESIDRANTVLTLTDGRKLAYAALALATGSRARPLPVPGADLANVFALRTLEDTRRIAAALAAAQRVVVIGGGFIGLEFAAVAAKQGKQVTVLEAAGRLMARVVAPPVSDFYAALHRGHGVAIELGAAVSALRGKAGPAQDAVAAVCTADGREFPADLVIVGIGILPNSELAEAAGLACERGIVVDGCSRTADPRIVASGDCTARRLEDGSLLRLESVQNAVEQGKSAAAALLGKERRFDAAPWFWSDQYDVKLQMVGLSAGYDQVVSRGEVESQRFSVFYFRTGKLVAIDSINQPQVHMLGRKLLDKGNSLTAAQAADPAFDLAGAAA

SEQ ID NO: 26864 - protein, 209 aa, Unknown
  Vibrio sp. Ex25
MSKQKHSASSGRWLKEHFDDKYANEARKKGYRSRAYFKIDEIQTKDKLLKPGMTVVDLGAAPGGWSQYAAKIVGDSGQIIACDLLPMDPIAGVSFLQGDFRDDAVLEALLERIQPSMVDVVMSDMAPNIAGNNSVDQPRAMYLVELALDMCRQVLAPNGSFVVKVFQGEGFDQYVKEVRDMFKAVKIRKPDSSRARSREVFVVATGYKG

SEQ ID NO: 26865 - protein, 321 aa, Debaryomyces hansenii
MAPPTMIETSVRHEFSPIVTEDRVVRMSSDAQNSDVKFADWDKFKFTPIRESTVSRAMTSRYFADLDKYAESDVVIIGAGSAGLSAAYILAKNRPELKIAIIEAGVSPGGGCWLGGQLFSAMILRKPAHLFLEELGLEYEDEGDYVVVKHAAFFMSTLLSKVLLFPNVKLFNATAVEDLITRRDETTGDLRICGVVTNWTLVSLNHDTQSCMDPNTINANVILSASGHDGPFGAGSAKRLDKLGCIELGHMRGLDMNSAEDAIVKGTREVTPGLVVTGMELAEVDGSNRMGPTFGAMALSGVKAAEAVLNVYDLRKKQNNP

SEQ ID NO: 26866 - protein, 953 aa, Synechococcus elongatus
MSASPHNFAQRHLGPRPADVEQMLQKLGCESLEDLLAAVVPADIRLPRSLNLPEPCSEAEALAELRAIAHQNQILRSYLGQGYANCLTPPVIQRNILENPGWYTAYTPYQAEIAQGRLEALLNFQTMVSDLTGLEIANASLLDEATAAAEAMTLSLAVAKSKSQTYFVAHNCHPQTIAVVQTRAAALGIEVLVADLLQFDFQTPIFGLLLQYPATDGTIADYRSVIEQAHAQGAIATVACDLLALTLLTPPGEFGADIAVGNSQRFGVPLGYGGPHAAFFATKEAYKRQIPGRIVGVSKDAQGQPALRLALQTREQHIRRDKATSNICTAQVLLAVVAGFYAVYHGAEGLTAIARQVRRQTQILAEELQSLGFKIPQQPGFDTLIVEVEDPKVWQSRTEAAGFNLRCLSDRQLGISLDETTTDSDLLDLLTVFAQGRSLPAWEDLQAAVTDEVDPAFARQTPFLTHPVFQQYHSETELLRYIHRLQSRDLSLTTAMIPLGSCTMKLNATAEMLPISWPEFNQIHPFAPLSQTQGYQQLFQQLESWLAEITGFAAVSLQPNAGSQGEYAGLLVIQRYHQSRGEDHRQICLIPQSAHGTNPASAVMAGMKVVPIACDDRGNIDVSDLQQKAAQYADQLAALMVTYPSTHGVFEEAIAEICAIVHQQGGQVYLDGANLNAQVGLCQPAQFGADVCHLNLHKTFCIPHGGGGPGVGPIGVAAHLAPFLPSHPLVPEANADPQALGPIAAAPWGSASILPISWMYIRMMGAAGLTQASAIAILNANYIATRLAPYYPILYRGDRGFVAHECILDLRPLKRTAGIEVEDVAKRLMDYGFHAPTMSWPVLGTLMVEPTESESLAELDRFCEAMIGIYHEVDAIASGDLDPLDNPLKHAPHPADVLLQSDWNRAYSREQAAYPAPWTREHKFWPVVSRIDNAYGDRNLVCSCLPMSAYSDR

SEQ ID NO: 26867 - protein, 228 aa, Phytophthora sojae
MDVATDATVEFSEELKHGIKLANPKATEVFAAESKEKQEEWLNSFINAGAQYREVFNVADTAKIKSFYELKDFDMAGNEVSMAKYKGKVVLAVNVSSKCGLTPTNYPELQELYAKYKDEGLEVLAFPCNQFAGQEPGTHEEIMEFVKQYNVTFPFFEKHDVNGATARPVFTYLKTKLPGSFGDFVKWNFTKFLVDRNGQPYKRFAPKDRPLSFEEDIKTLLAQKASEE

SEQ ID NO: 26868 - protein, 343 aa, Anabaena variabilis
MVNQNLTATEIGFTHEDFAALLDKYDYHFSPGDVVPGTVFSIEPRGALIDIGAKTAAYIPIQEMSINRVDAPEEVLQSNETREFFILTDENEDGQLTLSIRRIEYMRAWERVRQLQAEDATVRSGVFATNRGGALVRIEGLRGFIPGSHISTRKPKEELVGEELPLKFLEVDEERNRLVLSHRRALVERKMNRLEVGEVVIGTVRGIKPYGAFIDIGGVSGLLHISEISHEHIDTPHSVFNVNDEVKVMIIDLDAERGRISLSTKQLEPEPGDMIKNRDLVYDKAEEMAAKYREQLLAKQQGIALPAEGAEDLIEEEIPSATEDAVAEEEISAVEEIPAAIED

SEQ ID NO: 26869 - protein, 495 aa, Debaryomyces hansenii
MMMKPFSRISIKEQNNDQAEEKKNEIPAKEEAPAQVETTSGAIETKAEEPAYGTPVQQQAAVPVAAPAQPEQNAIPPPPPVSDQMSGQMPGQMQGQMPGQMPGQMPGQMPGQMPGQMPGQMPGQPPQMPDFQQMQQMQQQFQGGMPLPPQPPQPPQPQQLPPSNMGKDHGKMFIGGLNWDTTEQGLVEYFTKYGEVIDHTIMRDNNTGKSRGFGFLTFKDPKSVDEVIKTDHILDGKLIDPKRAIAREEQDKVGKIFVGGIDPMVNEKDFNDFFSQFGSIIDAQLMIDKDTGRSRGFGFITYDSPDAVDRVTVNKYLTLKGKSMEVKRAEPRGQHQQNQMQQQQQQQQPYNYGNYGNQYGQTQYQQPGMASYGQGMNGMSPEMMQEYWQRMQQWYMYQQQQQQAQGSTGDYNQQSEQPEQPLNPQQQAPTESQDNQEPENGSDSSGTPSGPSRRMNLPKGPRRAPPSGPSGNSRGRGGYQNRNRGYHPYTRGGRR

SEQ ID NO: 26870 - protein, 464 aa, Unknown
  Synechococcus sp. CC9311
MAQSLSDPPVAGQIITVLGTDLNHQGLGLARWQGWVVIVPQLLPGEEAQVQLLQRKKSQWFARHLKTLVAAPGARKPPCILAKDCGGCSLQHLEESIQAEWKRSRLEQTLKRIGGINIQSPAPINNDLEHLGYRNRALIPLLRKEDQMRLGYYRRGSHRIVNLSRCPVLDPRIDALIKPLKQDLEGSGWPADADLHGELGLRHLGLRVGVRTGELLITLVSATAELNGMKDLAVEWMNRWPAVTGVTLNLQPRRSNTILGAITHTLAGRDCISERFCNLQLLLGTTTFFQINTDRAEQIVMVLRNWLLQRGDCKRLIDAYCGIGTISLPVAAAGIGVVGLEINPASVQQARQNAALNGLTDAKFEAGDVASLLSDYLPDHDALVVDPPRKGLASDVLDAILNCPPKRLAYLSCDSATLARDLKRLVSDNGPYAIDRIQPVDFFPQTTHLECLVLMERVNCEVQP

SEQ ID NO: 26871 - protein, 336 aa, Zea mays
MAEHLLSTAVHDTLPGSYVRPEPERPRLAEVVTGARIPVVDLGSPDRGAVVAAVGDACRSHGFFQVVNHGIHAALVAAVMAAGRGFFRLPPEEKAKLYSDDPARKIRLSTSFNVRKETVHNWRDYLRLHCHPLDEFLPDWPSNPPDFKETMGTYCKEVRELGFRLYAAISESLGLEASYMKEALGEQEQHMAVNFYPPCPEPELTYGLPAHTDPNALTILLMDPDVAGLQVLHAGQWVAVNPQPGALIINIGDQLQALSNGQYRSVWHRAVVNSDRERMSVASFLCPCNHVVLGPARKLVTEDTPAVYRNYTYDEYYAKFWSRNLDQEHCLELFRT

SEQ ID NO: 26872 - protein, 468 aa, Idiomarina baltica
MAAVVWFRSDLRTVDNPALDAACLNHKHVYALFLVPQRTWQAHDWAPIKVDLWWRHLAEFKQELADKGIGFSIFTIDRFSQSGATIADFCEKHKVNTVYANREYPLDEIERDKQARACFEQRDIEFQLFDGNLLVPPEAVETKQGGYYKVFTPFNRAWRTEVAKISDWTPESWRVENTVASSTELPQCPLERKNSQTYPVGRQAIMGKLGQFIEHQVDEYKARRDEPSVDGTSMMSAYFEMGAIAPKTVARALSSLSPEFPYGLEPGADTWLTEVAWREFYQHLMFHEPRLSRGENYQTETQGLPWRDAEEDFQAWCDGRTGFPIVDAGMRQLNETGWMHNRLRMIVANFLVKDLLIDWRKGEQYFMRNLVDGSFPANNGGWQWSASVGTDAVPYFRVFNPVRQSEKFDPDGIYIRTWIKELADVPSKHIHWPHSYLKQHKTGYVSPIVDHSEARERFLSTFKQVKNG

SEQ ID NO: 26873 - protein, 472 aa, Anabaena variabilis
MQIIDKKSSKKAWASALTEPAKEFPLTQLSIISGNIPEGLRGTLYRNGPARLERGRMLAGHWFDGDGAILAVNFTDGGVNAVYRYVQTIGYQAENAADKFLYGNYGMTAPGPVWNQWRRPVKNAANTSVLALPDKLLALWEGGKPYALDLQTLETWGEDNLGGLSNGLTYSAHYKQDPQTKEIFNFGISLGLNAKLNVYKSDSTGQIIQKAAYPLDGLPLIHDFVLAGQYLIFFISPVRLGMLPILLGTSNYSDSMQWRPELGTQILVIDRDSLSLVSRGEAEPWYQWHFANGYVDASGAVIVDIARYEDFQTNQYLKEVATGKTHTPAQSTLSRVTLHPQSGKVAAIEQLLDRHCEFPNVPRQNVGQESRYTYMSGFRQGTDISQELLNTIACFDHKTQTLTEAYPGENCYPSEPILAENWVLTVVYDGNSHGSQVWIYDSERLNEEPICKLKLPSIIPHSFHGTWKSQKR

SEQ ID NO: 26874 - protein, 356 aa, Oryza sativa
  misc_feature (312)..(312): Xaa can be any naturally occurring amino acid
  misc_feature (326)..(326): Xaa can be any naturally occurring amino acid
PTRPASRVVNKKPPRRSLNVSGPVQPYNPSLKNFWYPVAFSSDLKDDTMVPIDCFEEQWVIFRGKDGRPGCVMNTCAHRACPLHLGSVNEGRIQCPYHGWEYSTDGKCEKMPSTKMLNVRIRSLPCFEQEGMVWIWPGNDPPKSTIPSLLPPSGFTIHAEIVMELPVEHGLLLDNLLDLAHAPFTHTSTFAKGWSVPSLVKFLTPSSGLQGYWDPYPIDMEFRPPCMVLSTIGISKPGKLEGKSTKQCSTHLHQLHICLPSSRNKTRLLYRMSLDFAPWIKHVPFMHILWSHFAEKVLNEDLRLVLGQQERXDQWRKCLELASIIXKLGIRYRLWRDAIERGVDRLPFSNQSESGS

SEQ ID NO: 26875 - protein, 484 aa, Arabidopsis thaliana
MGNICPGSGSSTVNHEPVSTKPLPVRRVQTPENKKFPPPLVAMPALHPTFPLPETGHKLRPAATPPREKPQHRTTRSVENPPREKPQEKTRSVENPPREKPQEKTRSVETPPQEKTRPVDNPPSKPVEKLGLGRKAVPPSGKIVTPNLKMFTLVELKTATKNFRPESVIGEGGFGQVFKGWVDEKTLAPSRAGVGIPVAVKKSNPDSEQGLHEWQCEVRFLGKFHHPNLVKLLGYCWEENQFLLVYEYLPKGSLENHLFSKGAEALPWDTRLKIAIEAAQGLTFLHNSEKSVIYRDFKASNILLDSNFHAKLSDFGLAKNGPINGFSHVTTRVMGTQGYAAPEYMATGHLYVRSDVYGFGVVLLELLTGLRALDPNRPSAQQNLVEWAKPGLNQKKKVQKMMDPRLEQKYPLLAVTKTAELILRCLEADPKNRPPMDDVLRELEVVRTIRDQPQEERRKRSSGPDTNRVRGNDSPYGRRTGRTG

SEQ ID NO: 26876 - protein, 478 aa, Bordetella parapertussis
MSTTNAASTEQPLKFAGYRKRDMPAHDAELTSTMPGTPMGEYMRQYWQPVCLSEELRDVPKAIRILGENLVAFRDKSGNIGVMHRHCAHRGASLEFGVIQQHGIRCCYHGWHYGVDGTLLEAPCEHDDTRLRQTVCQGAYPAFERDGLVFAYMGPPENQPPFPEYDTYTLPKGTKLVPFSNVYPCNWLQVHENIMDHMHTAVLHNHMVVEGVDAEVSAGVTLEGFGDMPVMQWHPTRSGNGIVFVAGRRLPQDRVWVRITEMNLPNYLQIGSLVPTAARERHSTSGCTRWHVPVDDTNMIIFGWRHFNAEVDPDGMGCEADCGVDKIDFLVGQTGNRSYDEAQRAPGDWEALTSQRPIAVHALENPGASDVGVYMFRKLLRDALHGKTKPDPAYAQLLASGQSLPLYAQDSVLYAKQREDTAEDRKLINELGRKVLDIMRAADGLAAAERDAFVRAELDRIDDGVGKQIVAQALAMEA

SEQ ID NO: 26877 - protein, 540 aa, Unknown
  Rhodococcus sp. Phi2
MTAQTIHTVDAVVIGAGFGGIYAVHKLHHELGLTTVGFDKADGPGGTWYWNRYPGALSDTESHLYRFSFDRDLLQDGTWKNTYVTQPEILEYLEDVVDRFDLRRHFRFGTEVTSAIYLDDENLWEVTTDGGDVYRATYVVNAVGLLSAINFPNLPGLDTFEGETIHTAAWPEGKSLAGRRVGVIGTGSTGQQVITALAPEVEHLTVFVRTPQYSVPVGNRPVTPEQIDAIKADYDRIWEQAKNSAVAFGFEESTLPAMSVSEEERNRIFQEAWDHGGGFRFMFGTFGDIATDEAANEAAASFIRSKIAEIIEDPETARKLMPTGLFAKRPLCDAGYHQVFNRPNVEAVAIKENPIREVTAKGVVTEDGVLHELDVLVFATGFDAVDGNYRRIEIRGRDGLHINDHWDGQPTSYLGVSTANFPNWFMVLGPNGPFTNLPPSIETQVEWISDTIGYAERNGVRAIEPTPEAEAEWTETCTAIANATLFTKGDSWIFGANIPGKTPSVLFYLGGLRNYRAVLAEVATDGYRGFDVKSAEMVTV

SEQ ID NO: 26878 - protein, 721 aa, Oenothera picensis
EFESTILGPSVPDLVALTNEALSISITQKKSIIDTTTIRYALHRKTWDLEADRNLSPAKEHGTLFYQVGRAFAHTVLLRNCSIDPISIYIKKNLCEAGDSSLYKWYFELGTSMKKLTILLYLLTCSAGSIAQDLLSPPGPDEQNLITSYGLVENDSDLVHGLSDIVHGLLELEGALVGSSPTEEEVEGTEEEVEGTEEEVEGTEEEVEGTEDEEVEGTEEEVEGTEEEVEGTEEEVEGTEEEVEGTEDEEVEGTEDEEVEGTEEEVEGTEEEVEGTEEEVEGTEEEVEGTEDEEVEGTEEEVEGTEEEVEGTEDEEVEGTEEEVEGTEEEVEGTEDEEVEGTEEEVEGTEEEVEGTEEEVEGTEEEVEGTEEEVEGTEEEVEGTEEEVEGTEEEVEGTEDEEVEGTEKDSSQFDNDRVTLLLRPKPRNPLDIQRLIYQHQKYESELEEDDDDDEDVFAPQKMLEDLFSELVWSPRIWHPWDFLLDCEAEIPAEEIPEEEDELPEDALETEVAVWGVEEEGEADDEEDVLLEAQQEDELLEEEDEELDEEEDELDEEEEEPKEEEDELHEEEEEEEEEEEEEEEDELQENDSEFFRVKPIIPRHRWIFRKKKDVFEVLSYPEEATEISKELLRLLNPKTKRDAPKRPRQRWWTKKKQDKHYELLLDRQRWLITKRSLSKSNGFFRSNTPSESYQYLSNLFLSNRRLLDQMTKTFFRKMAFPG

SEQ ID NO: 26879 - protein, 579 aa, Mycobacterium avium
MAAVLTPRGPDAGGAWSQGRVALGHRRLKIIDLTEAGAQPMVDSELGLSIAWNGCIYNYKELRSELSGYGYRFFSHSDTEVLIKAYHRWGDDFVSHLFGMFAFAIVERDSGRVLLGRDRLGIKPLYLTEDSHRVRFASTLPALLAGGGVDTRIDPVALHHYMSFHSVVPAPATILRGVRKVPPASLVAIEPDGKRTVTTYWAPDFTRHADRADWSERDWEDAVLSTLRLAVKRRLVADVPVGCLLSGGVDSSLIVGLLAEAGQHGLSTFSIGFESAGGVKGDEFQYSDIVAQRFETNHHQIRIDSARMLPALDGAIGAMSEPMVSHDCVAFYLLSQEVARHVKVVQSGQGADEVFAGYHWYPPMGDPAAATLDGAVAQYRRAFFDRDTAGVAQLVGPGILAPGDPSLRFVTEHFAQAGAETGIDRALRLDTTVMLIDDPVKRVDNMTMAWGLEGRVPFLDHELVELAATCPPEYKIAHEGKGVLKQAARRVIPSEVIDRPKGYFPVPALTHLEGPYLDMVRDALYAPTAKERGLFNTDAVDALLANPNGKLTPLRGNELWQIALLELWLQRHGVTGPVA

SEQ ID NO: 26880 - protein, 462 aa, Blastopirellula marina
MPKCDVPETPLSELLPADVLADNPPALPELAEPEVVRHYTNLSTLNMSVDTHYYPLGSCTMKYNPKRNERLASLPGIVDLHPYQPEDSLQGMLQLLYELQQFLTEISGLPAISLQPAAGAHGEWTALMSAAAYFRSIGQEQRKLVLSPDSSHGTNPASAQMAGFTAVTVRTVDGAVDMDDLRSKLNDQVAVFMITNPSTLGLFETQMAEIADAVHAAGGLIYLDGANMNAVLGISRPGDVGADMMHYNPHKTFSGPHGGGGPGAGPICVAEKIAPFLPSPIVVKEGDKYRLDYDRPESIGRVRTFFGNVGVLVRAYCYILSYGPDGLKAVSENAVLNANYLLSKIKHFLPVPHGLRCMHEFVASAAKLKQEKGVTAMDIAKRLLDYGFHAPTVYFPLTVPEAMMVEPTETESKEMLDAFVEILFRITEEPAELLHEAPHTTPISRPNEVQAARQPCLRAVCG

SEQ ID NO: 26881 - protein, 455 aa, Blastopirellula marina
MAYLFNTPQEQQEMLASIGAASIEELFEQIPASLRLGRPLDLPPAMGELELTQHLATLAAKNQGPGDKICFLGGGSYDHFIPAAVDALASRGEFYTSYTPYQPEVSQGNLQAMFEYQTLICELTGLDVSNASLYDGGSAIAEAVIMSMNTVRRHDKIVVLGSVHPEYRQILDTYFGPLGTQIVVVPTPNGTVDPAEVAAVVDDQTACVVVQSPNFFGSPEQVQALADIAHAKDALLVQSFDPLSLGVIKRPGDLGADIAVAEGHSLGSPMQYGGPYLGIMACREQFVRRMPGRICGETVDRRGKRCWVLTLQTREQHIRREKATSNICTNQGLFALRASIYLALMGPHGLQDVGELCARKSHYAATQIASQERFELAFSTPFFKEFVVRDLQNDVATVLADASEAGFFAGVALGTWFPELADCFLVTVTEKRTRVEIDGLVKTLALTTNRTTIHA

SEQ ID NO: 26882 - protein, 141 aa, Glycine max
DLVPFSNKIYSGDLQKRLGITAGLCVLIQHELEKKGDRYEAIYSFYFGDYGHISVQGAYLTYQDTYLAVSGGSGIFEGVYGQVKLHQLVFPFKLFYTFYLKGVPDLPPELLGKPVEPSPSVEPSPAAMATEPHACLPNFTN

SEQ ID NO: 26883 - protein, 541 aa, Unknown
  Rhodococcus sp. Phi1
MTAQISPTVVDAVVIGAGFGGIYAVHKLHNEQGLTVVGFDKADGPGGTWYWNRYPGALSDTESHLYRFSFDRDLLQDGTWKTTYITQPEILEYLESVVDRFDLRRHFRFGTEVTSAIYLEDENLWEVSTDKGEVYRAKYVVNAVGLLSAINFPDLPGLDTFEGETIHTAAWPEGKNLAGKRVGVIGTGSTGQQVITALAPEVEHLTVFVRTPQYSVPVGNRPVTKEQIDAIKADYDGIWDSVKKSAVAFGFEESTLPAMSVSEEERNRIFQEAWDHGGGFRFMFGTFGDIATDEAANEAAASFIRSKIAEIIEDPETARKLMPTGLYAKRPLCDNGYYEVYNRPNVEAVAIKENPIREVTAKGVVTEDGVLHELDVLVFATGFDAVDGNYRRIEIRGRNGLHINDHWDGQPTSYLGVTTANFPNWFMVLGPNGPFTNLPPSIETQVEWISDTVAYAERNEIRAIEPTPEAEEEWTQTCTDIANATLFTRGDSWIFGANVPGKKPSVLFYLGGLGNYRNVLAGVVADSYRGFELKSAVPVTA

SEQ ID NO: 26884 - protein, 396 aa, Oryza sativa
  misc_feature (313)..(313): Xaa can be any naturally occurring amino acid
MAVLSVADSPPVSAIGFEGYEKRLEITFSEAPVFADPNGRGLRALSRAQIDSVLDLARCTIVSELSNEVFDSYVLSESSLFVYPYKIVIKTCGTTKLLLAIPRILELAEELSLPLEAVKYSRGTFIFPEAQPSPHKNFSEEVAVLNRYFGGLKSGGNAYVIGDPAKPGQKWHVYYATQHPEQPVVTLEMCMTGLDKKKASVFFKTSADGHTTCAKEMTKLSGISDIIPEMEVCDFDFEPCGYSMNAIHGPAFSTIHVTPEDGFSYASYEVMGFNPASLAYGDLVKRVLRCFGPLEFSVAVTIFGGRNHAGTWXAKGLDVGAYSCSNMVEQELPSGGLLIYQSFTATAEIATGSPRSVLHCFADENTEKAGKMEALYWEDDAVEEIDGTEGKKMRSC

SEQ ID NO: 26885 - protein, 350 aa, Propionibacterium acnes
MTTQALTPNTILGNISLSDPSEIDTTQPFPETVGADVHGNDEPRDVIIVGSGPAGYTAAVYTARAGLKPLVFEGSMDAGGALMQTTEVENYPGFSEGIMGPDLMAQMRAQAERFGAELIADDVTDIDLTGEIKKLVDTDGNTYKAHVVILAMGSAYRKLGLEDEPRLSGRGVSWCATCDGFFFTGKDIAVVGGGDSAVEEATFLTRFANSVTLVHRRDQLRASQIMADRAAADPKITFAWNSEVVAMQGESKLESITLRDTKTGEERQLEVAGVFEAIGHDPRSELVRGQVDLDDAGYVVCAEPSTRTNVPGVFACGDLVDSHYQQAVTAAGSGCRAALDAERFLTELGR

SEQ ID NO: 26886 - protein, 468 aa, Staphylococcus epidermidis
MTQQIGVVGLAVMGKNLAWNIESRGYSVSVYNRSRQKTDEMVKESPGREIYPTYSLEEFVESLEKPRKILLMVKAGPATDATIDGLLPLLDDDDILIDGGNTNYQDTIRRNKALAESSINFIGMGVSGGEIGALTGPSLMPGGQKDAYNKVSDILDAIAAKAQDGASCVTYIGPNGAGHYVKMVHNGIEYADMQLIAESYAMMKDLLGMSHKEISQTFKEWNAGELESYLIEITGDIFNKLDDDNEALVEKILDTAGQKGTGKWTSINALELGVPLTIITESVFARFISSIKEERVTASKSLKGPKAHFEGDKKTFLEKIRKALYMSKICSYAQGFAQMRKASEDNEWNLKLGELAMIWREGCIIRAQFLQKIKDAYDNNENLQNLLLDPYFKNIVMEYQDALREVVATSVYNGVPTPGFSASINYYDSYRSEDLPANLIQAQRDYFGAHTYERKDREGIFHTQWVEE

SEQ ID NO: 26887 - protein, 51 aa, Triticum aestivum
KIDPLRCISMHGITERYLSGQKDDAAGFVRKLLDDLESRISVVHCLNEVLT

SEQ ID NO: 26888 - protein, 258 aa, Unknown
  Vibrio sp. 'Belize Reef cb2216s4'
QPNAMGGPEGGGLANQLAVHRGFDDESIAKVEQFWQAPNMATEPGLKAVELFDAVSRGDIKVLWIMATNPVVSMPNSIEVRKALKACDFVIVSDISADSDVAEYADLLLPAAGWGEKQGMVTNSERVISRQRQFRPIPGEAKPDWWAINQVGQKWCAQNHWQNGFGFQTPAEIFREYAALTGINRKSRFQLDLSMFQTLSDSDYQNWQPTQWGGERPFTDHQFSTPLGKAQLVVTKPLKRDVSGLWLNTGRLRDQWHT

SEQ ID NO: 26889 - protein, 1387 aa, Streptomyces avermitilis
MLEPIEPTEGSDNNTPSDTLPPRRRRRAASRPAGPPAAVAETATGATAPAEAAAETTAPITRPADIAETAEDAEAAEAAGTEETEEAAVAEPAEVAAATEDAAPRRTRRRATRRVSAPAGAPEAAESATAAETDSAAESVTAATGSAEVSAPETGEAAAEEEAAPKGRTRRRATRRASAPAGAPKAAEATEATEAAEAPVTTEAEVTAVAPEVAQEETPEAEDAAPRRARRRATRRVTAPAAAPTGDAAEERVEAPVTASDKTEAQAATKAEAKAEAKATSETRAAAQAEEAPAAEAAAETAEDAGPRRSRRRATRKAAVGFSAPAPKVTGDDSGRRPARPAVAVFQAPVFTEPMFQTPERAAAAAAAEAAVERPAEPVEEETAEAAAESGAGAAAGSGAGSTARSGAGSTAGSRRRRRRGGAEDEPAAVTATEDVVEETEEAEEAEDSVDGDEAEETGSRRRRRRGGRRRRRGESADADDESGESDDLAAEQAEQDVEDTAEQVEEDDEEADEREESGGAGSSSSRRRRRRRRRAGDSGTDAEPGESDPERTVVKVREPRSSKKDEHPSDEVQSIKGSTRLEAKKQRRREGREQGRRRVPIITEAEFLARREAVERVMVVRQSGERTQIGVLEDNVLVEHYVNKEQSTSYVGNVYLGKVQNVLPSMEAAFIDIGKGRNAVLYAGEVNFEALGMANGPRRIESALKSGQSVLVQVTKDPIGHKGARLTSQVSLPGRYLVYVPEGSMTGISRKLPDTERARLKTILKKIVPEDAGVIVRTAAEGASEDELRRDVERLQAQWEDIQKKAKSGNAPTLLYGEPDMTVRVVRDIFNEDFTKVIVSGDEAWETIHGYVAHVAPDLSDRLSKWTSEVDVFATYRIDEQLMKALDRKVWLPSGGSLVIDKTEAMVVVDVNTGKFTGQGGNLEETVTRNNLEAAEEIVRQLRLRDLGGIVVIDFIDMVLESNRDLVLRRLLECLGRDRTKHQVAEVTSLGLVQMTRKRVGQGLLESFSETCVHCNGRGVIVHMEQPTSVGGGGKRKKRGRGGAEQELPHEHEHELAQEPEPDEAVAETEAEVAAEVAAPVALPAPGYEPDEELYSSAAEAEAAASRGRSRRRATRRASAPAGAPRAEERAPRSRAEERAPKSRAAAEAEPMAVEDPVVEPPVAAEPVVAEPVVAEPVAVAEEEAAPKGRTRRRATRKVSAPAGSPKAAGEAETVTVVASAPEAEEPKAEQPAEPVAEPAAGPEAPVESAAPARPRRRAVRKATAPTSSEETAVVVVPSSETASADTAAGAAPSGEAPSAEAPSAEAASSEAEEAPAKKTAARKTAKKATAKKAATKKTAATKTAAKKTTAKKTTAKKTAAKSTSKKTAAASQPAPSTVTASTDEA

SEQ ID NO: 26890 - protein, 1216 aa, Yersinia pestis
MKRMLINATQQEELRVALVDGQRLYDLDIESPGHEQKKANIYKGKITRIEPSLEAAFVDYGAERHGFLPLKEISREYFPNNYSSHGRPNIKDVLREGQEVIVQVDKEERGNKGAALTTFISLAGSYLVLMPNNPRAGGISRRIEGDDRTELKEALSSLQLPDGMGLIVRTAGVGKSADALQWDLSFRLKHWDAIKKAAEGRPAPFLIHQESNVIVRAFRDYLRPDIGEILIDNPKVLELAKEHIAALGRPDFSSKIKLYSGEIPLFSHYQIESQIESAFQREVRLPSGGSIVIDTTEALTAIDINSARATRGGDIEETAFNTNLEAADEIARQLRLRDLGGLIVIDFIDMTPVRHQREVENRLRDAVRQDRARIQIGRISRFGLLEMSRQRLSPSLGESSHHVCPRCSGTGTVRDNESLSLSILRLIEEEALKENTHEVHAIVPVQIASYLLNEKRESVNAIEKRQGGVRAVIVPNDQMQTPHYSVLRVRKGEEVPSLSYLLPQLHEAEMAQPLEEATIERKRPEQPALATFSLPTEVPPEEAPTVAKAKPAVATPAAVSTDVEQPGFFSRLFSGLKNMFGASAEAEVQPAEVVKTDTSENRRNDRRNPRRQNNGRKERNDRTPREGRDNSSRDNTNRDNTSRDNANRDGANRDNSNRDNSGRDNVSREGREDQRRNNRRPAQPTTTSQGQTEVVEADKAQREEQPQRRGDRQRRRQDEKRQAPQEIKADVAEAPVIEEVQPEQEERQQVMQRRQRRQLNQKVRIQSANDELNTLESPVSAPVAQVVVAEVQEEVKLLPQITAQTDDDSANERTTNNENGMPRRSRRSPRHLRVSGQRRRRYRDERYPAQSAMPLAGAFASPEMASGKVWVRYPVTPVVEQVVVEQIAIEQTTTVEQTAIVEQVSVANIVTAQLPVEQVQNTVAEQESSATPSVMTTPTVAVATAAVTLAPQHKPGGSSSSAAAVPGRAPIVAAVPVVAETTAAETVVAKTEAAIDAVAVVEPMAAVESIAAVETATVEPVVTEEPNVTEPAVAEPAIETDPVEETTSVVEIAPTVEPTPMIEDTAVVVAATVVDTTPETASTVQDDIVEETAVEAVNISETVAEETAITEPAAEAIATQQTTIAQETIAEPTVETAIDVVAVVKQPAVAHPEGVVFKHFASAPMTKAPAPDYAPESPTKGHWERPTFDFSGKGSAGGHAAATQATAPATKPQSVE

SEQ ID NO: 26891 - protein, 274 aa, Unknown
  Halomonas sp. 'Belize Reef cbno3r1'
QPNAMGGREVGGLANQLAAHMEYHTPGARELVSPFWTTQHLTPVLPDAPGYKAVELFDAIERGEISALWVMATKSAVSMPDGRKCAARWQKCPLVIVSECVANTDLLPFADIVLPASGWSEKDGTVTNSERRISRQRGLLPAPGEAKHDWWILCEVAKRLGWGEAFDYTQPWEIFDEHARLSGYENSGDTQRLFDISGLAGLGQSAYDALAPIQWPVTQQAPRGTARLFEDGRFATPNGRAKLLPITPRPPAQALSDDYPLRLNTGRIRDQWHT

SEQ ID NO: 26892 - protein, 1123 aa, Arabidopsis thaliana
MAASVQPACLDLHFSGKHPPLLKHNAIIVRCVSSPNVIPEADSISGPPDIINTNRDQRKVVRIAWEKLVRWSRSLRAKAKTDVLERTRKVVVLGGGSFGTAMAAHVARRKEGLEVNMLVRDSFVCQSINENHHNCDKVDSVASKYFPEHKLPENVIATTDAKAALLDADYCLHAVPVQFSSSFLEGIADYVDPGLPFISLSKGLELNTLRMMSQIIPIALKNPRQPFVALSGPSFALELMNNLPTAMVVASKDKKLANAVQQLLASSYLRINTSSDVTGVEIAGALKNVLAIAAGIVDGMNLGNNSMAALVSQGCSEIRWLATKVMGAKPTTITGLSGTGDIMLTCFVNLSRNRTVGVRLGSGETLDDILTSMNQVAEGVATAGAVIALAQKYNVKLPVLTAVAKIIDNELTPTKAVLELMNLPQVDYRFHRFPFRLGYSSVEDGGKETENLFVSSKNKMMKRAQQSARETKQEAKDASKAKSGLFASCSFSSLGLDTKLSDQLKERMGFEAPTLVQAQAIPVILSGRDVLVNAPTGTGKTIAYLAPLIHHLQGHSPKVDRSHGTFALVIVPTRELCLQVYETLEKLLHRFHWIVPGYVMGGEKKAKEKARLRKGISILIATPGRLLDHLKNTASFVHKNLRWVIFDEADSILELGYGKEIEQIIKLLGSGQNEQGEEDDIVPKGIQKQNLLLSATLNDKVNDLAKLSLDDPVMIGLDNTKLQQNLSIESPAAPDSDAEDMVIHVNKSANPLSEDYGIPSQLVQRYLRVPCGARLVALLSVLKNLFEREASQKVVVFFSTRDAVDFHYSLLSEFQWPPNSETEEEGTKELFLKCKTFRLHGSMEQEDRRSAFGTFKTEKQAVLLSTDVAARGLDFPKVRCIIQYDCPGEATEYVHRVGRTARIGEKGEALLFLQPIEIDYLKELKKHGASLTEYPLMKVLDKFPIPGNMPRIKKVLSLESHPWVISLQRALESLTYAEPKMKSLAKNAFVSWVRGYAAHKGELKSIFVVKKLHLGHVAKSFALREQPSLVGKSHHKETMKRKRDERQKGQQEKKTKTNKTRDGFLRTSLSTLMDHSKCIPTRPVRGNLQEEDQLGLCPFHKEAYMRLTLDYDTLNAASKTGII

SEQ ID NO: 26893 - protein, 126 aa, Schizosaccharomyces pombe
MSAAEKKPASKAPAGKAPRDTMKSADKKRGKNRKETYSSYIYKVLKQVHPDTGISNQAMRILNSFVNDIFERIATEASKLAAYNKKSTISSREIQTAVRLILPGELAKHAVTEGTKSVTKYSSSAQ

SEQ ID NO: 26894 - protein, 268 aa, Unknown
  Marinomonas sp. 'Barents Sea 8'
QPNAMGGREVGGLANQLAAHMDFATPGAQDLVQRFWQAPNMATKDGLKAVDLFQAMEEGKVKVVWIMSTNPMVSLPDTAQVRRALEKCELVIVSDCKAHTDTTVMADVLFPATGWSEKDGTVTNSERRISRQRGLFPAPGEAKHDWWVICEVAKSLGFQSAFPYQNVHEIFAEHAALSAFENNGKRDFDMGHFSQITKADYDALTPVQWPVPKSRPEGTKRMFEDGRFFTSDGRAKFVAISPSLPKHQASQEWPFTLNTGRVRDQWHT

SEQ ID NO: 26895 - protein, 487 aa, Bacillus cereus
MGVLLPVNAGQISKLRLEGDVQELEKNLKKDLKIRHITMISIGGVIGAGLFVGSGAVVHSAGPGSIISYALAGLLVIFVMRMLGEMAAINPTSGSFATYAREAIGPWAGYTIGWLYWFFWVIVIAIEATAGAGIIQYWIPEIPLWLLSLILTILLTLTNVFSVKSFGEFEYWFSFIKVISIVLFLCLGLAVILGFVPGTEAPGTSNLVGQGGFMPNGISSVLLGITVVIFSFMGSEIVAVAAGESAEPVKAVKTATNSVIWRILVFFIGSIAVVVTLLPWNSANILKSPFVAVLEHIGVPAAAQIMNFIVLTAVLSCLNSGLYTNSRMLFSMAERGDAPKAFLKLNNSGVPVRAVLFGTFFAYIGVVFSYISPDKVFLFLVNASGGIALLVYLVIAVSHLKIRKKMGKVEQQNLKVKMWFFPYVTYVTIAAIIAVLVAMLAIESLRSQALLTMLVTVLIILSYFIFNRNKNSTVSNTTSKNEESVRF

SEQ ID NO: 26896 - protein, 550 aa, Salmonella enterica
MQNPYTVADYLLDRLAGCGIGHLFGVPGDYNLQFLDHVIDHPTLRWVGCANELNAAYAADGYARMSGAGALLTTFGVGELSAINGIAGSYAEYVPVLHIVGAPCSAAQQRGELMHHTLGDGDFRHFYRMSQAISAASAILDEQNACFEIDRVLGEMLAARRPGYIMLPADVAKKTAIPPTQALTLPVHEAQSGVETAFRYHARQCLMNSRRIALLADFLAGRFGLRPLLQRWMAETPIAHATLLMEKGLFDEQHPNFVGTYSAGASSKEVRQAIEDADRVICVGTRFVDTLTAGFTQQLPAERTLEIQPYASRIGETWFNLPMAQAVSTLRELCLECAFAPPPTRSAGQPVRIDKGELTQESFWQTLQQYLKPGDIVLVDQGTAAFGAAALSLPDGAEVVVQPLWGSIGYSLPAAFGAQTACPDRRVILIIGDGAAQLTIQEMGSMLRDGQAPVILLLNNGGYTVERAIHGAAQRYNDIASWNWTQIPPALNAAQQVECWRVAQAIQLAEVLERLARPQRLSFIEVMLPKADLPELLRTVTRALEARNGG

SEQ ID NO: 26897 - protein, 270 aa, Unknown
  Marinobacter sp. 'Sargasso Sea s450ao'
QPNAMGGREVGGLANTLAAHMDYDSPGARSRVADFWGTGVVADGPGYKAVDMFEAVHRGDIRVIWIMGTNPAVSLPDSARVREALARCPTVIVSDCVAHTDTTDLADILLPAAGWGEKDGTVTNSERRISRQRCFLPLPAEVKPDWWIMSSVAGKLGFGEAFNYKRPADIFREHAALSAHENNGERLFNLAGLVNLSDPGYDTLQPVQWPILGSTGPGVVDSARLFADGRLSPTISAPDLLHRNRLAAQQTSDDYPMVVNTGRIRDQWHT

SEQ ID NO: 26898 - protein, 417 aa, Legionella pneumophila
MNTNIANQLRAAKKATTDLNLIQSDTRTIILKTLAANLEKHIENIIQENQKDLSLMLEQDPRYDRLLLNKERILSLVNDVRKVANLPNPLGVNLFEKSMPNGLSIKKITVPLGVIAVIYESRPNVTIDIFSLCFKSGNVCILKGGKEAHFTNSYLLLLIKNTLKNFNINTDIVCLLPPERALMTQLLNATGLVDLCIPRGSQNLINFVRDNAKIPVIETGAGIVHTYFDKSGDLGKGKKIINNAKTRRVSVCNALDTLIIHADRLKDLPELVETLSQKNVIIYADQDAYHVLDKNYPEQLLIKAKPQDFGHEFLDYKLAIKTVPNIKAAIDHIQQFSSHHSEAVIAEDESAIDKFLTEVDAAAVYANASTAFTDGGEFGLGAEIGISTQKVHARGPMGLEALTSYKWVIRGTGQIRD

SEQ ID NO: 26899 - protein, 239 aa, Unknown
  Synechococcus sp. RS9917
MAVVTLAEMMEAGAHFGHQTRRWNPKMSRYIYCARNGVHIIDLVQTAVCMNNAYKWVRSAARSGKRFLFVGTKKQASEVVALEASRCGASYVNQRWLGGMLTNWTTMKARIDRLKDLERMESSGAIAMRPKKEAAVLRRELDRLQKYLGGLKNMRRLPDVVILVDQRRETNAVLEARKLDIPLVSMLDTNCDPDLCEVPIPCNDDAVRSVQLVLSRLADAINEGRHGANDQRGADDAQG

SEQ ID NO: 26900 - protein, 97 aa, Triticum aestivum
  misc_feature (67)..(67): Xaa can be any naturally occurring amino acid
MPSLQKALPPELADNALRLFRECLRRAKFIGNQQHNTGLLVSMVRQQFKKNMHETDPEKIQKMKDEXSHCSVDNAARGLINHIIYESEKMTGRKFSG

SEQ ID NO: 26901 - protein, 451 aa, Schizosaccharomyces pombe
MSTPYEPEFQQAYKEIVGSIESSKLFEVHPELKRVLPIISIPERVLEFRVTWEDDKGNCRVNTGYRVQFNSALGPYKGGLRFHPSVNLSILKFLGFEQIFKNALTGLPMGGGKGGSDFDPKGKSDNEIRRFSQAFMRQLFRYIGPQTDVPAGDIGVTGFVVMHMFGEYKRLRNEYSGVVTGKHMLTGGSNIRPEATGYGVVYYVKHMIEHRTKGAETLKGKRVAISGSGNVAQYAALKCIQEGAIVKSISDSKGVLIAKTAEGLVPEEIHEIMALKEKRASIADSASLCKKHHYIAGARPWTNVGEIDIALPCATQNEVSGEEAAALIKQGCRYVAEGSNMGSSAEAVEVFEKSRASGEGCWLAPGKAANAGGVAVSGLEMAQNAQFSTWTHAEVDAKLAGIMQNIFEQSTDVASKYCDSGSNNIPSLVDGANIAGFLKVATAMQAVGDWW

SEQ ID NO: 26902 - protein, 356 aa, Legionella pneumophila
MKIIIKVGTQSILSVDGSPIYSVLNNLVNQIIYLKNLGHQVILVSSGAVGSGRKIAKNSLGKTYGDTVGEKQLLASIGQPELMNLYSSLFKNENILVSQLLLTKQDFHTRQHYLNIARLLTELLKHQNIIPIVNENDSVAIEELMFTDNDELAGLIAAQINADYLILLTNVDGVFTSHPNDPESKLINTIDPNSGWPNVSAVKSKLGRGGMVSKLDTARKMAGLGINTVIANVNVESIVPKILNREAVGTIILASKRKSSIKRWIAFSHRTSLPSIVINDNLITLLRNGNRVMSILPIGIEDFRGECKKGDLIDILNSNNEKIGVGIARYDFLRLKDYLRLQNKPAFIHYDQLHIL

SEQ ID NO: 26903 - protein, 478 aa, Legionella pneumophila
MNQSFSILEYIMTEVFTIKQCLDGEISIDETVTVRGWVKTRRDSKAGLSFISLHDGSCFSPIQIVATDQLSNYHKEVTKLTAGCSMIATGKLVASQGKGQFFEIQAESIEVVGWVENPDTYPIQAKRHTLEFLREVAHLRPRTNTISAVTRVRHSLAQAIHRFYHEQGFFWVHTPIITASDCEGAGEMFRVSTLDLLNIPKNDKGQIDFSKDFFGRETFLTVSGQLNVEAYCMAMSKVYTFGPTFRAENSNTSRHLAEFWMIEPEIAFANLEDICKLSQNMLRYLCKTVLEERADDMDFFNQFVAPGCIERMEHIADSEFEIMTYTDAIKALEASDQKFEFPVSWGLDLQSEHERYLAEVLCKKPVIVTNYPQEIKGFYMRLNDDGKTVAAMDVLAPGIGEIIGGSQREERLEILDRRMDECNLNKEHYQWYRDLRRYGTVPHAGFGLGFERLISYVTGVSNVRDVIPFPRTPGHADY

SEQ ID NO: 26904 - protein, 284 aa, Unknown
  Alteromonas sp. 'Sargasso Sea s450co'
QPNAMGGREVGGLANMLAAHMDLENPEHIEAVKTYWDAPVMPKGQTHKAVDLFNAIESGKVKFVWIMGTNPVVRMPNRGQVERALSKCEMVVVSDIVESNDTLNYAHIALPATGWSEKDGTVTNSERRISRQRGILPPPGSAKHDWQTMCNVAAKMGFGEAFNFTHPSQIFCEYAGLTGYHNNGKRQLDLSPLQGLSEAQYNGLSPVQWPFYNAALNTSSPGAKLEANDKPNLISKRPFEDKQFSTPSGKAKLIPVTYKAPLQVTSDAYPFVVNSGRARDQWHT

SEQ ID NO: 26905 - protein, 484 aa, Synechococcus elongatus
MAAPILFWHRRDLRLSDNIGLAAARAQSAQLIGLFCLDPQILQSADMAPARVAYLQGCLQELQQRYQQAGSRLLLLQGDPQHLIPQLAQQLQAEAVYWNQDIEPYGRDRDGQVAAALKTAGIRAVQLWDQLLHSPDQILSGSGNPYSVYGPFWKNWQAQPKPTPVATPTELVDLSPEQLTAIAPLLLSELPTLKQLGFDWDGGFPVEPGETAAIARLQEFCDRAIADYDPQRNFPAEAGTSGLSPALKFGAIGIRQAWRAASAAHALSRSDEARNSIRVWQQELAWREFYQHALYHFPSLADGPYRSLWQQFPWENREALFTAWTQAQTGYPIVDAAMRQLTETGWMHNRCWMIVASFLTKDLIIDWRRGEQFFMQHLVDGDLAANNGGWQWSASSGMDPKPLRIFNPASQAKKFDATATYIKRWLPELRHVHPKDLISGEITPIGRRGYPAPIVNHNLRQKQFKALYNQLKAAIAEPEAEPDS

SEQ ID NO: 26906 - protein, 231 aa, Magnetospirillum magnetotacticum
MRARMRDDGATWPTEAEMGSGTNDPSEVVAVVGGGSWGTALANAAAAAGRPVTLWMRDADAAARMQAERVNARYLPGVGLHAQVRATAEARALAEAGTVLLVVPAQTLRGVLSALAPSLRLGAQVVLCAKGIERGSDAFMSAVAAETLPAGMPVAVLSGPSFAADVARGLPTAVTLASEDGARAARLAGLLSGPAFRLYHTDDVRGVEIGGAGKNVLAIASGSSPARLSEA

SEQ ID NO: 26907 - protein, 86 aa, Synechococcus elongatus
MRVAELPVHQIRRPLPRNTDPQKVQDLMVSIAAEGLREPIEVLEVEGEYYGFSGCHRYEAHQRLGLETIRCRIRRAPRSVLALHLA

SEQ ID NO: 26908 - protein, 383 aa, Arabidopsis thaliana
MEYGEEPPIKRTRRSFLMLPDDLVLNCLARISRLHYPTLSLVSKTFRSLLASTELYQTRILLGRTESCLYACLRLRTDSELLHWFILCHRPHSSKNVLVPISSPSFTSPSLPGVVVVGPDVYAIGGGSKNKNVSIYATGSKTYNALSSVMIMNSRSHTWHEAPSMRVGRVFPSACTLDGRIYVTGGCDNLDTMNWMEIFDTKTQTWEFLQIPSEEICKGSEYLSVSYQGTVYVKSDEKDVTYKMHKGKWREADICMNNGWSLSSSSSYCVVENVFYRYCEGEIRWYDLKNRAWTILKGLGRLPSLPTSHSNVKLADHGGKMAISWEEYMFVDREKKIWCAEIAIEKHQNGEIWGTLEWFDNVFISKTPNGYVGLVHALTATVW

SEQ ID NO: 26909 - protein, 308 aa, Clostridium acetobutylicum
MKKEKILDLVIIGAGPAGLTAGIYSSRAKLDFIILENELVGGQIRETPSIENFPGFDSISGADLADKMQEHAEKAGAVIDEFGNITSVKLTDTEKIIETSDTIYKPKSVIIATGSKSRPLPVPEEKKLRGKGIHYCELCDGAMYDGKDIVVVGGGNSAIDAAIFLTKYAKNLTVVHRSEKLRAEMRSQDELFKHNNVKLLLNTQIKHVEGENSIENIVLENSKTGEKSSLKADAIFVYIGTMPKTELFKDFIDLTELGHIKTNENLETNIKGVFAAGDVREKEIRQLTTAVNDGSIASLMAEKYIRNS

SEQ ID NO: 26910 - protein, 125 aa, Methanosarcina acetivorans
MKEITAIIRMNKVQKTKNALLGCGFPSFTVRRVMGRGKQRGLCFEFNPPLPDPEKEAETCIRFIPKRMFTVVVDDENVSEVVQKIIEVNQTGNAGDGKIFVSNITEAIRIRTGESGEATISKELM

SEQ ID NO: 26911 - protein, 338 aa, Triticum aestivum
  misc_feature (234)..(234): Xaa can be any naturally occurring amino acid
  misc_feature (267)..(267): Xaa can be any naturally occurring amino acid
  misc_feature (292)..(292): Xaa can be any naturally occurring amino acid
  misc_feature (302)..(302): Xaa can be any naturally occurring amino acid
MASQGVASMFALALLLGAFASIPQSVESIGVCYGMSANNLPAASTVVSMFKSNGINSMRLYAPDQAALQAVGGTGVNVVVGAPNDVLSNLAASPAAAASWVRSNIQAYPKVSFRYVCVGNEVAGGATQNLVPAMKNVQGALASAGLGHIKVTTSVSQAILGVYSPPSAGSFTGEADAFMGPVVQFLARTGAPLMANIYPYLAWAYNPSAMDMSYALFTASGTVVQDGSYGYQNXLFDTTVDAFYTAMAKHGGSNVKLVVSESGWPSXGGGTAATPANARIYNQYLINHVGRXGTPRHPGAIXETYVFSMFNENQKDTGVGAKLGIFYPNMHTLPITSE

SEQ ID NO: 26912 - protein, 477 aa, Prosthecochloris aestuarii
MKRKTVICWFRQDLRLEDNPALFVAAEEGYVLPVYILDDSSPGTWQMGSATRCWLHHSLVSLNRSFDGKLGIFRGEPLEILKTLARQHKAEKIVWNRCYEPWRMKRDQGIKATLQAEGIEVSSFNGSLLWEPHEVLKQNNTPYRVFTPFFRRGCLNALPPRTPLPAPQRMLMADTIDNSISVQDLNLLPSIPWDSQLISHWSVGENSARQSLLRFLDQGLNGYKEGRDFPGQNHVSRLSPALHFGELSPNTVWYEAKRCGSGQDLDHFLSELGWREFAYTLLYHNHDMPEKNLQSAFDAFPWVHNDETLIRWQQGMTGYPLVDAGMRELWQTGYMHNRVRMITGSFLVKNLLLHWHYGQQWFHDCLLDADLANNSAGWQWIAGCGVDAAPYFRVFNPVRQGEKFDPDGTYTLRFVPELAKLPKKYLFNPWEAPKNILQEAGITLGKTYPEPIVDLAISRNRALSAYASIRKKKIQEK

SEQ ID NO: 26913 - protein, 830 aa, Yersinia pestis
MKLSRRDFMKANAAVAAAAAAGMTIPTVAKAVGETTNAIKWDKAPCRFCGTGCGVLVGTQNGRIVASQGDPDSPVNRGLNCIKGYFLPKIMYGKDRLTQPLLRMKDGQYDKEGDFTPISWEKAFDIMELKFKNALKEKGPTAVGMFGSGQWTVWEGYAALKLLKGGFRSNNLDPNARHCMASSVVGFMRTFGMDEPMGCYDDIEEADAFVLWGSNMAEMHPVLWSRMTSRRLTNAHVRIAVLSTYEHRSFELADNPIVFTPQTDLVIMNYIANYIIQNNAVDKDFLAQHVNFRRGATDIGYGLRPTHPLEKAAKNPGSDASEPMSFEDFKTFVAEYTLEKTAKMSGVPEDQLESLAQLYADPKVKLVSYWTMGFNQHTRGVWANNMCYNLHLLTGKISTPGSGPFSLTGQPSACGTAREVGTFSHRLPADMVVTNEKHRQIAETTWQLPAGTIPEKVGLHAVAQDRALKDGTLNAYWVMCNNNMQAGPNINEERMPGWRDPRNFIVVSDPYPTISALSADLILPTSMWVEKEGAYGNAERRTQFWRQQVPSPGEAKSDLWQIVEFAKRFNVEEVWPAELVNQKPEYRGKNLYEVLFANDVVSKYPLSEIPDDQLNDEARDFGFYIQKGLFEEYASFGRGHAHDLAPFDVYHQVRGLRWPVVDGKETLWRYREGFDPFVPKGEEVRFYGKPDGKAVIFALPYEPAAESPDQEYDLWLSTGRVLEHWHTGSMTRRVPELHRAFPEAVLFIHPLDAKARGLHRGDKVKVISRRGEVISLVETRGRNRPPRGLVYMPFFDAAQLVNNLTLDATDPLSKETDFKKCAVKLERVVA

SEQ ID NO: 26914 - protein, 340 aa, Synechococcus elongatus
MCGTSVMANLDVALLPNHWYAIAASTDLGSTPIAASLLDQQLVVYRTTAGQVVVLDDRCPHRGASLACGQVKGNAIACPYHGWQFDLDGHCAQIPSQQASARIPQAAKVASYPVQERYGLIWVFTGDRDRAAQTPLWELPEYDQAGWRVVQGQFDWAADYRRVTENGMDVAHSPFVHANSFGASGNEVIADFELEKSDLGAQIWIPIEPKANYRGSFNLLGRKQETPKAGRSGAAFHLPNITRIDIEFGNFHLILVGIHQPISATTTRSHWLHVRNFLTAGWADGGTRKRTAKLFQEDQKIIEGIAPLRDRNEISVASDRLQLYYRQLWQQHHSSLVAQG

SEQ ID NO: 26915 - protein, 233 aa, Synechococcus elongatus
MFLKNYWYPVALAQKVGDRPLSVTLCGEAIALYRDSAGQIHALSDRCVHRGAALSGGWVENDCLVCPYHGWQYDAQGHCRKIPANTEQQRIPFAAKVPHYDAIERYGLVWLFYGDLPEADRPPLPPLPEYDDPAWRTVQGEVTYTTHYTRVTENLMDFAHAPFTHSGSFGAASDPLIEPYKVEQLPDGLRAQTQFTNRPIAAFGSCSIVAMPHVPSPPQSPFTCPASSAPKRT

SEQ ID NO: 26916 - protein, 252 aa, Pyrococcus furiosus
MLKDVVISRAIVESYFKDLLNNLELDVAIVGAGPSGMVAGYYLAKGGAKVAIFEKKLSIGGGIWGGGMGFNKIVVQEEAKEILDEFDIRYEEFEKGYYVADAIEVATTIASKTVKAGVKIFNMVEVEDLVVKDDRVSGIVINWTPVKMTGLHVDPLTVEAKYVIDSTGHGAQVTQFLLKRGLIEKIPGEGAMWAEMGEKLTVENTKEVFPGLYVTGMAANAVSGAPRMGPIFGGMFLSGRKAAMEILQKLGL

SEQ ID NO: 26917 - protein, 237 aa, Vibrio vulnificus
MRDMLKAGVHFGHQTRYWNPKMKPFIFGARNRVHIINLEKTVPMFNEALAELVKVGEKKGKVLFVGTKRAASEAVKEAAIASNQYYVNNRWLGGMLTNYKTVRQSIKRLKELEVQSTDGTFDKLTKKEALMRTREMEKLEKSLGGIKDMGGLPDALFVIDADHEHIAIKEANNLGIPVFAVVDTNSNPDGVDYIIPGNDDAIRAVQLYLNAAASSLTEGRNKDVAAVAEKDGFVEAE

SEQ ID NO: 26918 - protein, 110 aa, Streptomyces coelicolor
MAGTLKHVTDDSFEQDVLKNDKPVLVDFWAAWCGPCRQIAPSLEAIAAEYGDKIEIVKLNIDENPGTAAKYGVMSIPTLNVYQGGEVAKTIVGAKPKAAIVRDLEDFIAD

SEQ ID NO: 26919 - protein, 438 aa, Pyrococcus furiosus
MRIVVIGSGTAGSNFALFMRKLDRKAEITVIGKEETMQYSPCALPHVISGVIEKPEDVIVFPNEFYEKQRIKLLLNTEAKKIDRERKVVVTDKGEIPYDKLVIATGSKAFVPPIKGVENEGVFTLKSLEDVRKIKEFIKKRNPKNAVVIGAGLIGLEGAEAFAKLGMKVTVVELLEHLLPTMLDKDIAKIVEENMRKYGVDFKFGVGVDEIIGDPVEKVKVGEEEIDADIVLVATGVRANVELAKEAGLEVNRGIVVNEYLQTSDPDIYAIGDCAEVIDAVTGKRTLSQLGTSAVRMAKVAAENIAGRNVKFRPVFNTAITEIFDLEIGAFGITEERAKKEEIEVVVGKFRGSTKPEYYPGGKPIVVKLIFRKEDRRLIGAQIVGGERVWGRIMTLSALAQKGATVEDVVYLETAYAPPISPTIDPITIAAEMAMRKL

SEQ ID NO: 26920 - protein, 545 aa, Desulfovibrio desulfuricans
MSNAMFCYQCQETVGNKGCTQVGVCGKKPETAALQDALIYVTKGLGQIATRLRAEGKAVDHRIDRLVTGNLFATITNANFDDDILAERVRMTCAAKKELAASLTDKSGLSDAALWEASEKSAMLAKAGTVGVMATTDDDVRSLRWLITFGLKGMAAYAKHADVLGKHENSLDAFMQEALAKTLDDSLSVADLVALTLETGKFGVSAMALLDAANTGTYGHPEITKVNIGVGSNPGILISGHDLRDLEMLLKQTEGTGVDVYTHSEMLPAHYYPAFKKYAHFKGNYGNAWWKQKEEFESFNGPVLLTTNCLVPPKDSYKDRVYTTGIVGFTGCKHIPGEIGEHKDFSAIIAHAKTCPAPTEIESGEIIGGFAHNQVLALADKVIDAVKSGAIKKFVVMAGCDGRAKSRSYYTDFAEGLPKDTVILTAGCAKYRYNKLNLGDIGGIPRVLDAGQCNDSYSLAVIALKLKEVFGLEDVNDLPIVYNIAWYEQKAVIVLLALLSLGVKNIHLGPTLPAFLSPNVAKVLVEQFNIGGITSPQDDLKAFFG

SEQ ID NO: 26921 - protein, 322 aa, Streptomyces coelicolor
MSDVRNVIIIGSGPAGYTAALYTARASLKPLVFEGAVTAGGALMNTTEVENFPGFQDGIMGPELMDNMRAQAERFGAELIPDDVVAVDLSGEIKTVTDTAGTVHRAKAVIVTTGSQHRKLGLPNEDALSGRGVSWCATCDGFFFKDQDIAVIGGGDTAMEEATFLSRFAKSVTIVHRRDTLRASKAMQERAFADPKISFVWDSEVAEVQGDQKLAGLKLRNVKTGELSDLPVTGLFIAIGHDPRTELFKGQLDLDPEGYLKVDAPSTRTNLTGVFGAGDVVDHTYRQAITAAGTGCSAALDAERFLAALSDEDKAEPEKTAV

SEQ ID NO: 26922 - protein, 350 aa, Arabidopsis thaliana
MAGAVSLWRREAVFLTAMLAGETSIVGLSTLFKVATSKGLNIYPFLSYSYLLASLLLLPSLFFTNSASILSKIGLLGFLGSMYVITGGIGIEYSNPTLASAIGNIVPALTFILAVIFRMEKVSFKERSSVAKVMGTILSLIGAFVVIFYHGPRVFVASSPPYLNFRQLSPPLSSSKSDWLIGGAILTIQGIFVSVSFILQTHIMREYPEAFTVSILYILCISIVTSMIGLVVEKNNPSIWIIHFDITLFTIVTTGIITSVYYVIHSWAIRHKRPLYLAIFKPLSILIAVVMGTIFLNDSLYLGCLIGGILITLGFYVVMWGKANEEKNKLLSFSGKEKTPLLLSGKNDQI

SEQ ID NO: 26923 - protein, 72 aa, Zymomonas mobilis
MAKEELLEMRGRVVELLPNAMFRVQLENDHEILGHTAGKMRKNRIRVLVGDEVLVELTPYDLTKGRITYRFK

SEQ ID NO: 26924 - protein, 959 aa, Unknown
  Bradyrhizobium sp. BTAi1
MSLIHETDYGTPRSKSETMVTLTIDGQSITVPAGTSIMRAAMEAGTQIPKLCATDMVDAFGSCRLCLVEVEGRAGTPASCTTPVAPGLVVHTQTERLKKLRKGVMELYISDHPLDCLTCAANGDCELQDMAGAVGLRDVRYGNQGENHVFADACGEANPAWLPKDESNPYFTYDPSKCIVCSRCVRACEEVQGTFALTISGRGFDSRVSPGMSESFLGSECVSCGACVQACPTATLTEKSVIEIGQPEHSAVTTCAYCGVGCTFKAEMRGEEIVRMVPYKDGKANRGHSCVKGRFAYGYATHKERILKPMIRESIDQPWREVSYDEAFTFAAQKMRGIQAKYGRDSIGGITSSRCTNEETYLVQKLIRAGFGNNNVDTCARVCHSPTGYGLATTFGTSAGTQDFDSVEDSDVIMVIGANPTDAHPVFGSRMKKRLRQGAKLIVVDPRKIDLVKSAHIEADYHLPLLPGTNVAIMTAMAHVIVTEGLVNETFVRERCDWSEFQDWAEFVALEKNSPEAIAAISGVDPEAIRGAARLYATGGNGAIYYGLGVTEHSQGSTTVIAIANLAMATGNIGRRGVGVNPLRGQNNVQGSCDMGSFPHELPGYRHISGDAVRDQFEAMWNVKLNPEPGLRIPNMFDSAIDGTFKGLYVQGEDILQSDPNTTHVVQALSAMECVIVQDLFLNETANYAHVFLPGSTFLEKDGTFTNAERRIQRVRKVMTPRNGLADWEVTIGLAKAMGFEMKYNHPSEIMDEIAALTPTFTGVSYQKLEEMGSVQWPCNETYPEGSPIMHVDGFVRGKGKFVVTEYVATDERTGPRFPLLLTTGRILSQYNVGAQTRRTDNVVWHGEDVLEIHPHDAEQRGIRDGDWVRLTSRAGETTLHALISERVAPGVVYTTFHHPLTQANVITTDYSDWATNCPEYKVTAVQVSQSNGPSDWQKAYDEQARNSRRIAPIVEAAE

SEQ ID NO: 26925 - protein, 188 aa, Guillardia theta
MGRRPWKCYRIVKNKPYPKSRYCRGVPEPKIKLYDLGNKSCDEKSLPLCVHLISDDFQQISSESIESARVACNKYLTTKVGKDLFHLKIRIHPFHVIRINKMLSCAGADRLQSGMRGAFGKPCGLTSRVTKNQVLISVRSKSSKAYEVIESLRRAKFKFPGKQKIIISQKWGFTFISKINYINYINNS

SEQ ID NO: 26926 - protein, 321 aa, Phaeosphaeria nodorum
MATDPSKYKLNHSMIRIKDPKRSVQFYEFLGMKLINQIKMPEAKFDLYFLAYDSPKAVSHGNHWTDREGIVELTHNYGTEDDPDYKISNGNTEPHKGFGHLCVSVDNIQAACQRLEDAGYKFQKKLTDGRMRHIAFVLDPDGYWVEVIGQKPLEETESVKDTDTSTYRMNHTMIRVKDKDVSLKFYQDVLGMQLKRTSESPNSGFNLYFLGYGAPASDETANGVNPTADHEGLLELTWNYGTEKEADFKYHNGNDEPQGFGHICIAVDDLEAACARFEEKKVNWKKRLTDGRMKSIAFVLDPDNYWIEVVQNEKLKTRSNV

SEQ ID NO: 26927 - protein, 380 aa, Unknown
  Frankia sp. EAN1pec
MAVDYYATLGVRRDATGDEIKRAYRKLARELHPDVNPDPEAQQRFRNVTNAYEVLSDPEKRQIVDLGGDPLAPGGGAAGAGSPFGAGFGGLGDIMDAFFGGGASRGPRSRVRRGNDALLRLELDLAETAFGATRDITVDTAVVCATCTGAGAAPGTQPSTCSTCHGRGEVQQVTRSFLGQMVTSRPCPRCSGTGTVIEHPCRDCSGDGRVRKRRTLTVKIPSGVEDGMRIRLSGEGEVGPGGGPPGDLYVEVSERQHAVFSREGDDLHCDLRLPMTAAALGTMATLETLDGSETITVKPGTQPGEVLRLAGRGVPHLRAVGRGHLHIHIVVETPTKLDAEQERLLRELAKLREEETPAVVGGSSSGSGLFSRRRGGRRNR

SEQ ID NO: 26928 - protein, 108 aa, Unknown
  uncultured gamma proteobacterium eBACHOT4E07
MSNVVVVENKDDFQNEVINTEGPVLVDFWAEWCGPCKQLAPLVEDASEEFKDKIKVCKMDVDANRETAAEYGIRSIPTLMIFENGELVGTEIGALSKLQLEEFIRSKI

SEQ ID NO: 26929 - protein, 159 aa, Propionibacterium acnes
MVRDASFDRDFSHRVMAASCSTPRVRLAFVNERCRSNRHDLDSSGRLRKAVMNNVIEVTDATFASEVLGASKPVLVDYWADWCAPCKQLSPIIEELAGTYGDRMVFAKVDTNANTRVAAEQGIMSLPTIQVWQGGQLVKSLQGGKTKKALVKIIEEFVA

SEQ ID NO: 26930 - protein, 467 aa, Unknown
  Synechococcus sp. RS9916
MTAAGQLGTSSTPGDGVENLVIIGSGPAGYTAAIYAARANLSPILITGFQRGGIPGGQLMTTTHVENFPGFPDGVLGPDLMDLMKAQAERWGTRLVEADADGIDLSSRPFQIKTEGRIIRAQAVILATGASANRLGLPNEDQFWSSGISACAICDGATPQFRNAELAVVGGGDSACEEAVYLTKYGSHVHLLVRSDQLRASAAMADRVQANPQITVHWNTEVVDANGADWLHSLTLRNRGNGEQSELPVRGLFYAIGHTPNTELVHDQLRCDGKGYLITEPGRPETSLEGVYAAGDVADAEWRQGITAAGSGCQAALAAERWLSHHNLAQLVSRESVEPKQAETPQVSEAVDETTYDPHALWQKGSYALRKLYHDSDRPLLVVYSSPSCGPCHVLKPQLKRVLKELEGGAQGIEIDIEAEQAIAEQAGVNGTPTVQLFHAKELKQQWRGVKQRSEFKAAIEQLLVKA

SEQ ID NO: 26931 - protein, 355 aa, Propionibacterium acnes
MLRIAVLGAGVMATALTFPAVENGNEVRFIGTHLDDDIIDSIQATRQHPVLELKVDERAKAYHFANAAEAIEGADVIMSGVNSFGVDWVGRQLAKLAKPGQIILCVTKGMQADEDGTLHILPEVLKKHMGNLADEAHWAAIVGPSNAGELAVHRDTRVVFCGEEQEVRDRLVAAYRTDYYHVWTSTDFVGHEVGACMKNIFAFGGGFAAGMLDKAGQTDAKYVMYDYTAALFGEGARELKQMVAFMGGDPEVATGLGGVGDMFVTTMGGRNVRARTYVGAGVPFSQIRNVKMKGITLEGVAAIGVVGEAIEKLTRRGVIAETDYPWCAPSTTSLLTMLPSICPGRSSSAEKSDVG

SEQ ID NO: 26932 - protein, 237 aa, Brassica napus
SHFTHTKSRPTRPPTRPDNSNQQSSPSAAGIPPPVSAVGGASYHHLLQQQQQQLQMFWSYQRQEIEQVNDFKNHQLPLARIKKIMKADEDVRMISAEAPILFAKACELFILELTIRSWLHAEENKRRTLQKNDIAAAITRTDIFDFLVDIVPREEIKEEPGIGGMMPPAVSGVPYYYPPMGGPGGMMIGRPAMDPSGVYVQPPSQAWQSVWQTSATGDDVSYGSGGSGGQGNLDGQV

SEQ ID NO: 26933 - protein, 461 aa, Arabidopsis thaliana
MEVFRLGELRHLLVTVFLSGLAEYLIRPVMTDVTVAAVCSGLDDSCSLAVYLTGVQQVTVGMGTMVMMPVIGNLSDRYGIKAMLTLPMCLSVLPPAILGYRRDTNFFYAFYVIKTLFDMVCQGTIDCLANAYVAKNVHGTKRISMFGILAGVSSISGVCASLSARFLSIASTFQVAAISLFIGLVYMRVFLKERLQDADDDDEADSGGCRSHQEVHNGGDLKMLTEPILRDAPTKTHVFNSKYSPWKDMVSLINNSTILIQALVVTFFATFSESGRGSALMYFLKARFGFNKNDFAELFLLVTIIGSISQLFILPTLSSTIGERKVLSTGLLMEFFNATCLSVAWSPWVPYAMTMLVPGAMFVMPSVCGIASRQVGSSEQGKVQGCISGVRAFAQVVAPFVYSPLTALFLSENAPFYFPGFSILCIAISLMIGFLQSLLIKDHPSLPLVNITINNPSKAEA

SEQ ID NO: 26934 - protein, 287 aa, Medicago truncatula
MAFPVVVDSEYLKEIEKARRDLRALIANRNCAPLMLRLAWHDAGTYDAKTKTGGPNASIRNEEEFSHGANNGLKKAIDFCEEVKAKHPKISYADLYQLAGVVAVEVTGGPTVNFVPGRRDSKVCTRDGRLPDAKQGVSHLRDIFYRMGLTDKDIVALSGAHTLGRAHPERSGFDGPWTEDPLKFDNSYFQILLEEDSAALLKLPTDRALLDDPEFRRYVELYAKDEDAFFRDYAESHKKLSELGFAPSSKATAPVDATVLAQSAFGVVAAAAVVILGYLYETHKRGK

SEQ ID NO: 26935 - protein, 430 aa, Xylella fastidiosa
MLIASPVFFSGVAMFPRDARLDMYDPELAKAIAAEVRRQEDHVELIASENYCSTLVMQVQGSQLTNKYAEGYCGKRYYGGCEYVDIAEQLAIERAKQLFGADYANVQPHSGSQANQAVYFALLQPGDTILGMSLAHGGHLTHGANVNVSGKLFNAVQYGVNAQGLIDYEAVESLALEHRPKMVVAGFSAYSQKIDWARFRAIADQVGAYLLVDMAHVAGLVAAGVYPNPLPHAHVVTSTTHKTLRGPRGGIIVAQAPQEALVKKLQSIVFPGIQGGPLMHVIAAKAVAFKEALEPAFKVYQQQVVKNAKAMAGTLMLRGYKIVSGGTENHLMLVDMIGRDVSGKDAEGALGQAHITVNKNAVPDDPRSPFVTSGLRLGTPAVTTRGYQEQDCVDLAHWIADVLDAPADVTVIAAVREKVAAQCKKYPVYR

SEQ ID NO: 26936 - protein, 428 aa, Streptomyces avermitilis [sequence omitted]

SEQ ID NO: 26937 - protein, 141 aa, Arabidopsis thaliana
MQGALFIKPTILLPLPSSVSSPKLTFLLPHATKASRLSSLRSNNSSSSSSLTSDPNTVDYNSSILSVFPAEACEVISGYACSADIYPEVKLDTKPVSRPVASEPVDREYEEYNSPKTVFREEACDDLGGEFCEPDFQKDAN

SEQ ID NO: 26938 - protein, 269 aa, Unknown
  Alteromonas sp. 'Sargasso Sea s450bo'
QPNAMGGREVGGLANMLAAHCDMKTLSTVNVKAFWQSPAMPECGGLKAVDLFSAMDAGQIKFVWIMGTNPVVSMPYREQVESAQKKCDMVVVSDIVQSNDTLAFADIALPATGWSEKDGTVTNSERRISRQRGIMPPPGEAKHDWQIMCDVANKMGFASGFSYSHPSEIFDEHARLTAYKNDGARCLNLARLTGKSQAQYDAMAPVQWPLTINSDKTLSAVRPFHNKVFSTPTGKANFVAVQFLPPTQVTSNAFPFVLKSGRMRDQWHT

SEQ ID NO: 26939 - protein, 323 aa, Shigella flexneri
MSKIFEDNSLTIGHTPLVRLNRIGNGRILAKVESRNPSFSVKCRIGANMIWDAEKRGVLKPGVELVEPTSGNTGIALAYVAAARGYKLTLTMPETMSIERRKLLKALGANLVLTEGAKGMKGAIQKAEEIVASNPEKYLLLQQFSNPANPEIHEKTTGPEIWEDTDGQVDVFIAGVGTGGTLTGVSRYIKGTKGKTDLISVAVEPTDSPVIAQVLAGEEIKPGPHKIQGIGAGFIPANLDLKLVDKVIGITNEEAISTARRLMEEEGILAGISSGAAVAAALKLQEDESLTNKNIVVILPSSGERYLSTALFADLFTEKELQQ

SEQ ID NO: 26940 - protein, 267 aa, Unknown
  Pseudoalteromonas sp. 'Barents Sea 16'
QPNAMGGREVGGLANQLAAHLDIENEGHQSLVQRFWLSPTMAKKAGSNAIDMFDEIAAGKIKAVWIMATNPMVSLPNNAAIKKALETCELVVVSDCIAKSDTLKFADVALPSTGWGEKNGTVTNSERRISRQRPLVAPYSGAKNDWQIMCNVAKKMGSERFDFIDPSGIPEQWAQLTDFENNGSRLLSLSGLVGLTKSQYDNLKPTMWPVVKNQSYKNGQVFTNNQFSTADKKARFIPITPQLPVQQTSSDYLFVMNSGRIRDQWHT

SEQ ID NO: 26941 - protein, 302 aa, Unknown
  Psychrobacter sp. 'Barents Sea 19'
QPNAMGGREVGALANLLAAHLDLSNGTHRQLVADFWQAPQSIAPEVGIQACDAADAILVGRIKAIWIMATNPVVSLPEADKFCRALAACDLVIVSDCSVDSDTVKCADIVLPAQGWGEKSGTVTNSERRISRQRALKPALGLAKPDWWILSQVATRMGLAGFEYQHPSEIFNEHVALTAYKNDPSQVPSISNQPRYLNLAKDLPMPILNRADYEVMTPFQWGDPRITMAHSNFIAITPSDSASLPNRHQRRSRPKANGHTESDNIASDNREKDNKSDKPHNGHSSTVNLRLITGRLRDQWHT

SEQ ID NO: 26942 - protein, 249 aa, Pisum sativum
GKSYPTVSPDYQKAIEKAKRKLRGFIAEKKCAPLILRLAWHSAGTFDSKTKTGGPFGTIKHQAELAHGANNGLDIAVRLLEPIKEQFPIVSYADFYQLAGVVAVEITGGPEVPFHPGREDKPEPPPEGRLPDATKGSDHLRDVFGKAMGLSDQDIVALSGGHTIGAAHKERSGFEGPWTSNPLIFDNSYFTELLTGEKDGLLQLPSDKALLTDSVFRPLVEKYAADEDVFFADYAEAHLKLSELGFAEA

SEQ ID NO: 26943 - protein, 154 aa, Narcissus pseudonarcissus
KVMKKASFIGVSTTTTFYLLCGCLGYAAFGNKAPGNILTGFGFYEPFWLVDIANLCIIIHLVGAYQVFSQPIFSAVETWITNRHPNINFLNHDRVLVIGKCFRYKINLFRLIWRTLFVIACTFIAILMPFFNDILGFLGAVGFWPLTVYFPTEM

SEQ ID NO: 26944 - protein, 206 aa, Oryza sativa
MTTSEREPCPDRILDDVGGAFAMGAVGGTAFHFLRGAYNSPNGHRLSGGSQAVRMSVPRTGGNFAAWGGLFSAFDCAMVHARQKEDPWNSILAGAATGAVLSLRQGPRATATSALVGASLLALVEGAGILLTRTMATLPQEDHAYPFPVVPPPEEVSAHESSPIAWVRGIFGRKEEKPAAAGGDRKSDVLESFETPSPPIPSFDYR

SEQ ID NO: 26945 - protein, 509 aa, Taxus cuspidata
MDVFYPLKSTVAKFNECFPAILFIVLSAVAGIVLPLLLFLRSKRRSSVGLPPGKLGYPFIGESLLFLKALRSNTVEQFLDERVKNFGNVFKTSLIGHPTVVLCGPAGNRLILANEEKLVQMSWPKSSMKLMGEKSITAKRGEGHMIIRSALQGFFSPGALQKYIGQMSKTIENHINEKWKGNDQVSVVALVGDLVFDISACLFFNINEKHERERLFELLEIIAVGVLAVPVDLPGFAYHRALQARSKLNAILSGLIEKRKMDLSSGLATSNQDLLSVFLTFKDDRGNPCSDEEILDNFSGLLHGSYDTTVSAMACVFKLLSSNPECYEKVVQEQLGILSNKLEGDEITWKDVKSMKYTWQVVQETLRLYPSIFGSFRQAITDIHYNGYIIPKGWKLLWTPYTTHPKEMYFSEPEKFLPSRFDQEGKLVAPYTFLPFGGGQRSCPGWEFSKMEILLSVHHFVKTFSTFTPVDPAEIIARDSLCPLPSNGFSVKLFPRSYSLHTGNQVKKI

SEQ ID NO: 26946 - protein, 821 aa, Arabidopsis thaliana
MENSDMKRNSSTLLDLPVVKSSLVVEAIHMSRKKLGWYNESRRDSETVKARVEAGLSEVKKSVEELALLIKRSNRSAGFQEKDMEVLKMEEKYAEVMRVLEVVKEEVSRVKLDVSSVLIERVAAEEKVEELRFKTEGGLRLLESLKKEIEVANEEHLMVALGKIEALKGYKEIERQREGKAIKVLDLLVERNKRIKNMLEEAERSKDIEIELFETSTDVEMLETQLKLFKKMERRVQGRDSSSMSRSNRSFGRGKYSLSVLKEVTEGKKEELASVKVEIFRVMTVMDALRNEIIRARDETACLGKILREDDVKIEKLNSKILIEKSKLEVVSIAEERISSLAENFVGSLEKIKKSRNAAKKEEFLFKEEKTVTKAETQKTKLDIDKKESELNSKLDELEKVKHTEALVLEKLESLVEDMMESREMESEHCSTITISRFEYEYLSKHASQAEETAEKKVAAAAAWVEALKASTKSFLMKTETLMRESEMTKAEEEREVFRMERSLSTKRLVEGEIQKIKRNSEAEGYISPKPVGKFTPVQRGKPRRYSSVGTPTFFVIKKKKKVPRLAKFFSRRRQQDLGCWSLFAMVSSTQRVAFTEKRTLVLAKLYIFKDFSSSVVKYNMRRPKSSHVRMEPVAPRSHNTMPMLDQFRSNHPETSKIEGVSSLDTALKVFWNNQREQLGNFAGQTHLPLSRVRKILKSDPEVKIYVNFQKISCDVPALFSKACEYFILEVTLRAWMHTQSCTRETIRRCDIFQAVKNSGTYDFLIDRVPFGPHCVTHQGVQPPAEMILPDMNVPIDMDQIEEENMMEERSVGFDLNCDLQ

SEQ ID NO: 26947 - protein, 189 aa, Pseudomonas syringae
MACAARRCRLTSVLTFRSSHRLVLRPLLMSENLLSIPVTTIKGEQKTLADYAGKAVLVVNTASKCGFTPQYKGLEKLWLDYKDKGLVVLGFPCNQFGKQEPGDEGAISGFCELNYGVSFPLFKKIDVNGAQAHPLFVQLKQQAPGLLGTERIKWNFTKFLIGRNGALVKRFAPLTKPEELTGEIEALLR

SEQ ID NO: 26948 - protein, 600 aa, Prochlorococcus marinus
MSVINTSSLLENKNLSIFEITENFICIRFLDQNKERFELEFNLEKGTSFNTFLIISYNDFFIIHPPEKEYSKLINEVISNFHDEFKFNKINIITGHVNPKIIETIKLISVQFSNLTLTCSNPGFKLISELWNQKNPNLKTFIERELPVINIVKKELYLELENISLKLIPVPTARWPGGLIIYEENQEILLSEKIFSAHLASEEWSETNRMSTEINRKHFYDCLMAPMSNQIVSIAEKISELDIKTIAPLHGPAIEYSLKSFLNDYIRWGENLSTNNSKIVLIYASAYGNTASIGDALAKGVNRTSVEVESINCEFTSNDELIKSIQNADGYLIGSPTLGGHAPTPIVSALGTLLSEGNRDKPVGIFGSFGWSGEAIDLLETKLKDGGFTFSFDPIRIKFSPNKPKIKELEEIGTHFGRKILKKAKQKIRKSDTGMISSKTDPTLQALGRVLGSLCVLTASKGKDENNVKGAMLASWVSQASFSPPGLSISVAKDRSVESLLQKGDSFALNILSEKDFREPLKRFTKPFSPGEDRFEGLDIELTPNDQVIIPESLAWLDASVKERMECGDHWVIYAEVLHGNILKSDSLTAVHHRKSGANY

SEQ ID NO: 26949 - protein, 1817 aa, Unknown
  Nostoc sp. PCC 7120
MNRQHKHHRCNSVNLLSKQNLLPFLLGIVILLVVVMLWLRLQAEEEIKIQQLIKQQAIATQTELVTQLNTRILALKRIGKHWEMHGNIPQAQWELEAKAYLEDYGGYQAIKLVDPSWQVLRAVSVANNKAAENLEMIPKFPQWTGATSHETTVTRTVNLNQGDRVFFACVPLWMGDKFGGAVLGVFQVKQLFESVLHIAPGYKIRVFDGQELIYDQDRQSSTLPLWQQAVNIDFYGMTWQLQIYPTPELLKDLFSPLPTVVLVAGIFNAGAVTLLIYFAQATKLSNHKIGRINQELADRIEKQTQVEIALRASETRLRELVETVRVIPWEFDLKTQHFTYVGPQVETLLAYPVAQWYEENFWDNHLHTLDRDWAVRFCQEAANKGQNHELEYRMLAADGRVVWLRDVVNVVQVDGTPVMLRGFMFDITDLKRVEETLRLRERALAASSNGIVISDAKLPHYPVIYVNSAFEQITGYKATEVVGRNCRFLLGNDTQQSAIEELRSALKAGKNCKVILRNYRKDGSLFWNQLSVSPIYNDNGQLSHFIGIQTDISDRQQAEASLRRQALTFENIYDGVIITNLQGQILDWNPAAERMFGYSKNHICGQSISTLHKVDEDAALNSAIIAEITKQGRWSGEINFVRQDGSQGICETTIVALQDDQGQSMATISVNRDITERKHAELLLRRSEERFQAFMNHSPTPAWITDIDGTIVYVSETYRRTFQLPTQELIGKNIVDIYPPELTQTFRETIQIVARTRQVMETVESAPCSDGTGRDFLVYKFPISSKPDECLIGCIAIDITERKQAEAALRKSEERWQLVIEGNQDAIWDWNIITNETFRSARWAELIKEQNYQPIADHADCVSRIHPDDYERVMAVKQDCLSRKIPNYVVEYRLRCNDDSYRWVLVHATGQWDEQGNPVRMVGSIKDITERIEAQEALQRQLHRTLLLEKITQKIRQSLDSKEIFETAATQIGQALAVDRCLIHSYISHHDPHIPLVAEYNNVLDYCSMQKWEFTTTGNQHILKMMSQDKAIASANVYTDPLLQTAVPSCCEIGVKSMLAVRTSYQGEPSGAICLHQCGYFRQWTNEEIELLEAVAAQLGIALAQAQLLEQETRQREELTIKNFALEQAKRAAEAANRAKSEFLAMMSHEIRTPMNAVIGMTGLLLDTELTSQQRDFVETVLTSGDALLSIINDILDFSKIESGKLELEEQPFEVRTCVEQVIDLLAAKAAQKDIELAYLIHPQVPMQIAGDLTRLRQILTNLLNNAIKFTPEGEVVVSVRSQPSPNQKNKNCCEIIFTIKDTGIGIAPETMDLLFQPFVQADASMTRKYGGTGLGLVISKRLGEMMGGYLWVESRGCVGGNPPPGWQTKNSISSASVATGSTFYFSMTVPVVAHADLETPITSPVQLSGKRLLIVDDNPTNRQILRLQAEPWQMETYTAPSGAEALALIDQGMAFDIAILDVQMPEMDGLTLARQIRQRPSYQHLPLVILTSWGQPDTDLSDIEFAACLNKPIKQSQLYDVLASTLGNQPIRASVVPDRSTEINSCLAQQIPLRILLAEDIVVNQKVALLILKKMGYRADVVANGLEVLEALQRQFYDVVLMDVNMPEMDGLKASQIICQTWSPSSRPYIIAMTANAMRGDREACLAAGMDHYISKPLQLEELAKALGKCHPSGSAIEKALEKTSSQNQTFTDISDLKFATIDTKILQALRDMLGGDKVAFAELINCYLTESPKLIQNIDVAINTKDTQGIWKTAHKFKSSSGSVGAVFLAQLCKLLETKGRNNNLEGCVELGSQLRQEYELVQTALHREVNKETS

SEQ ID NO: 26950 - protein, 528 aa, Synechococcus elongatus
MTAQQLWQRYLDWLYYDPSLEFYLDISRMGFDDAFVTSMQPKFQHAFAAMAELEAGAIANPDEQRMVGHYWLRDPELAPTPELQTQIRDTLAAIQDFALKVHSGVLRPPTGSRFTDILSIGIGGSALGPQFVSEALRPQAALLQIHFFDNTDPAGFDRVLADLGDRLASTLVIVISKSGGTPETRNGMLEVQSAFAQRGIAFAPQAVAVTGVGSHLDHVAITERWLARFPMEDWVGGRTSELSAVGLLSAALLGIDITAMLAGARQMDALTRHSDLRQNPAALLALSWYWAGNGQGKKDMVILPYKDSLLLFSRYLQQLIMESLGKERDLLGKVVHQGIAVYGNKGSTDQHAYVQQLREGIPNFFATFIEVLEDRQGPSPVVEPGITSGDYLSGLLQGTRAALYENGRESITITVPRVDAQQVGALIALYERAVGLYASLVGINAYHQPGVEAGKKAAAGVLEIQRQIVELLQQGQPLSIAAIADDLGQSEQIETIYKILRHLEANQRGVQLTGDRHNPLSLIASWQR

SEQ ID NO: 26951 - protein, 591 aa, Prochlorococcus marinus
MITSAKTSSSEMNKVEQKLSVQQKVFADDTIAIRSLDWDRSRFDIEFGLRNGTTYNSFIIKGQKIAIIDTSHAKFEKLWFEQLLREVNPEEIDYLITSHTEPDHSGLIGKLLTLNPQIIVVGSKLALKFIEDQIHIPFKSLEVKSGQYLDLGANPTSGVNHNIEFISAPNLHWPDTIFSYDHGTNVLYTCDAFGLHYCSDEFFDNDQKEIYEDFRFYYDCLMGPNARSVLQAIKRIDKLPRLKTIAVGHGPLLHNQVNFWKEKYSEWSSNKSKGNEFVSVCYISDYGYCDRLSQAISHGISKADAQVQLIDLRSSDSQELTGLISESKAVVIPTWPVTSDNELKESLGTLFAALKPKQFTAVYDAFGGNDEPIDSLASKLRELGQKEAFSPLRVKNIPDPIIYQQFEEAGTDLGQLINKKKNIASMKSLDSNLDKALGRLSGGLYVVTASQGEGSTFRQSAMVASWVSQASFSPPGITVAVAKDRAIESYMQVGEGFVVNILREDNYQKMFRHFLKRFAPGADRFADVDVVNNIANGGPVLSDSLAFLDCKVSSRLETPDHWIIYGIVQNGSVSDLSCKTAVHHRKVANHY

SEQ ID NO: 26952 - protein, 320 aa, Pseudomonas syringae
MSDVRHSRVIILGSGPAGYSAAVYAARANLKPLLITGMQAGGQLTTTTEVDNWPGDPHGLTGPALMERMREHAERFETEIVFDHINSVDLAGKPFSLQGDSATYTCDALIIATGASARYLGLPSEEAFMGKGVSACATCDGFFYRNREVAVVGGGNTAVEEALYLANIASKVTLVHRRETFRAEKILIDKLHARVAEGKIELKLNATLDEVLGDNMGVTGARLKNNDGTSDELKVDGVFIAIGHTPNTSLFEGQLALKDGYMVVHGGREGNATATSVEGVFAAGDVADHVYRQAITSAGAGCMAALDVERYLDGLANATF

SEQ ID NO: 26953 - protein, 197 aa, Unknown
  marine gamma proteobacterium HTCC2207
MTDRTATVTRNTLESQITVTVNLDGTGVANFNTPVPFLNHMLDQIARHGLVDLDIQAVGDTHIDDHHTVEDIGITLGMAIAEAIGDKKGLTRYGHAYVPLDEAMSRVVLDFSGRPGLIMKADFVRSHVGTFDVDLTREFFQGFVNHALVSMHIDNLRGANAHHQVETIFKAFGRALRIAASADPRMAGVMPSTKGTL

SEQ ID NO: 26954 - protein, 454 aa, Saccharomyces bayanus
MSEPEFQQAYDEVVSSLEDSTLFEQHPKYRKVLPIVSVPERIIQFRVTWENDKGEQEVAQGYRVQYNSAKGPYKGGLRFHPSVNLSILKFLGFEQIFKNSLTGLDMGGGKGGLCVDLKGRSNNEIRRICYAFMRELSRHIGQDTDVPAGDIGVGGREIGYLFGAYRTYKNSWEGVLTGKGLNWGGSLIRPEATGYGLVYYTQAMIDYATNGKESFEGKRVTISGSGNVAQFAALKVIELGGTVVSLSDSKGCIISETGITSEQVADISSAKVNFKSLEQIVGEYSTFTENKVQYISGARPWTHVQKVDIALPCATQNEVSGDEAKALVAQGVKFVAEGSNMGSTPEAIAVFETARATASTLKESVWYGPPKAANLGGVAVSGLEMAQNSQRITWSSERVDQELKKIMVNCFNECIDSAKKYTKEGNALPSLVKGANIASFIKVSDAMFDQGDVF

SEQ ID NO: 26955 - protein, 335 aa, Oryza sativa
MAYARGGKEESWNFVFAGAATSGFLRLRQGAVTAGRDALWSAAFFALAEGASLAIHRALDDLPPADGRRGLAARAPVGRPRRLPASPGFPGQLIVVKEVAVADNEDDSGFSDGFFAEERHASQAQLSLLRAPIMASPSPPRPDERDTDLPLPSPPRKPYPGFILDDAGGGFLIGGGVGSAYHAARGLLGSSSGHRLAGAARAVRANAPRISATWAARCGLYGAFKCALSLPRATDGDPVVSVLAAGAAGAAHCLRRGPLAVGRGALVGAASMAVIERADAALDNLRSWVHYHRRLVPEEDIDGGGGSDPKPDDEPPIGFLGVPPKPVVVEEVPAG

SEQ ID NO: 26956 - protein, 409 aa, Pseudomonas syringae
MKKLKLVMIGNGMAGVRTLEELLKLSEDLYDITVFGAEPHPNYNRIMLSPVLAGEQNFEDIVLNDLAWYESNGIQLLLNRRVVKIDRIKRVVIADDGTQASYDRLLIATGSRPFILPVPGNTLEGVIGYRDIGHTRQMIDTAVTHKRAVIIGGGLLGLEAANGLSLRGMQVTVIHNGQTLLERQLDKTSGLMLQAALEKRGLGFRLNEQTEALLGDDLGRVRAVQFKSGEVIDTDLVVMAAGIRPNTELAEQAGLPCNRGILVNDTLQTYDPRIYAIGECVSHRGIAYGLVAPLFEQARVCANHLAQLGFARYPGSVTSTKLKVTGIDLFSAGDFLGAEGTESITLSDPIGGVYKKLVIKNDVLVGVCLYGDTADGSWYLQQIRDGQGIDAIRNHLMFGKPAAPEAACA

SEQ ID NO: 26957 - protein, 339 aa, Oryza sativa
MPNLECRMYEPRFPEVDAAVMIQVKHIADMGAYVSLLEYNNIEGMILFSELSRRRIRSISSLIKVGRQEPAIVLRVDRDKGYIDLSKRRVSEEEAHACEDRYNKSKLVHSIMRHVAETLGIDLEPLYQRIGWPLYRKYGHAFEAFKLIVADPDAILDSLTYEEKETGADGQEVTKVVPAVTPEVKDALVKNIRRRMTPQPLKIRADVEMKCFQFDGVLHIKQAMRKAEAAGNDNCPVKIKLVAPPLYVLTTQTLDKDQGISVLTDAIKACTAEIENHKGKLIVKEAPRAVSEREDKLFNEHIETLNEQNAEVDGDADSEEEEDTGMGDIDLTNSGVNAD

SEQ ID NO: 26958 - protein, 258 aa, Bacillus cereus
MGKVYIVGAGPGDPDLITVKGLKCIEKADVILYDRLVNKELLSYAKPEADLIYCGKLPNYHTMKQETINTFLIKYAKKGKVVTRLKGGDPFVFGRGGEEAEALVKQGVPFEIIPGISAGIAAPAYAGIPVTHRDASASFAIVTGHRKEDAEEEVKWEHLAKGVETLAVYMGVSNLPYICEQLVKHGKDTSTPAAIIERGTTSMQRTVVGTLGTIVDVAKKEQIQNPSMIVIGEVVRFREKIHWFEKQTESTYQVSGVL

SEQ ID NO: 26959 - protein, 104 aa, Bacillus licheniformis
MAIVKATDQTFSSETSEGVVLADFWAPWCGPCKMIAPVLEELDQEMGDKLKIVKIDVDENQETAGKYGVMSIPTLLVLKDGEVVETSVGFKPKEALEELVNKHL

SEQ ID NO: 26960 - protein, 73 aa, Oltmannsiellopsis viridis
MEGVVTQCLSHGMFNVKLENGFNVLAHLSGKIRRNYIRILLGDKVIVELSPYDLTRGRIVYRVRQQSPQEETA

SEQ ID NO: 26961 - protein, 340 aa, Yarrowia lipolytica
MLKLFRRNSKDEAKGHPMLANNNGLPVTDSPLSSFAVGVTEDKNSRCRRTMEDYHVAAHNICGTPDSGLFAVFDGHAGKQAAEYCATAVVSEVESLIMESEGFKSEDSATEDPEVVQEEGLEHQDNDKSSKTVPELLNLAFMAIDRSIEQKNLNSGCTAAVALLRWEDSRGKPVTVSSDHSPKDYTPVFPRAPLSECKRKLYTANVGDTRLILCRAGKALRLSYDHKGTDLHESKRVTNNGGMMISNRVNGMLAVTRALGDTYLKQFIIGNPYTTETEIIADDEFLIVACDGLWDVCDDQKACDLVSGLEDPVEGSRILVEFALENFSTDNLTVMVVKLR

SEQ ID NO: 26962 - protein, 451 aa, Prochlorococcus marinus
MSDAISHEIDHFMKGLMKRNPGEPEFHQAVHEVVETLIPFILSNRVYKDAQILERMTEPDRVVIFRVCWEDDAGNIRTNRAWRVQFNNSIGPYKGGIRFHPNVTLSVLKFLGFEQTFKNSLTGLPMGGGKGGSNFNPKGKSDREIMRFCQSLMIELHRHIGEDTDVPAGDIGVGSREISYMFGQYKRLENRFSGILTGKGLSFGGSLVRTEATGYGCAYFCENMLNHIEDSLVDKICSISGSGNVALYAVEKAIELGAKVVTLSDSDGFVHVPNGINLEMLAFVKELKTVRRGRIHEFANHYKGVDFYAGKRPWNVPCDIAFPCATQNEINRADSQELINNGVKAVVEGANMPTNLDGIHEFRHAKVILAPAKAANAGGVAVSGLEQSQNALRLSWSREEVDQRLKSIMLEIHSKCVQHSHKYEDYTDYITGANIAGFKKVADAMLAYGIV

SEQ ID NO: 26963 - protein, 545 aa, Thellungiella halophila
MAMLASYFDSFISKMPSLSTSDHASVVSLNLFVALLCACIVLGHLLEENRWMNESITALLIGLATGVVILLISKGKSSHLLVFSEDLFFIYLLPPIIFNAGFQVKKKQFFRNFVTIMLFGAIGTVISCTVITLGVTQFFKKLDIGTFDLGDYLAIGAIFAATDSVCTLQVLNQDETPLLYSLVFGEGVVNDATSVVVFNAIQSFDLTHLNHEAAFHLLGNFLYLFLLSTLLGVATGLISAYVIKKLYFGRHSTDREVALMMLMAYLSYMLAELFDLSGILTVFFCGIVMSHYTWHNVTESSRITTKHTFATLSFLAETFIFLYVGMDALDIDKWRSVSDSPGTSVAVSSILIGLLMLGRAAFVFPLSFLSNLAKKNESEKINFKMQVVIWWAGLMRGAVSMALAYNKFTRAGHTDLRGNAIMITSTITVCLFSTVVFGMLTKPLIRHLLPHQKATTSMLSDDNNTPKSIQIPLLDQDSFIEFAGNHNVPRPDSIRGFLTRPTRTVHYYWRQFDDSFMRPVFGGRGFVPFVPGSPTERDPPDLSKA

SEQ ID NO: 26964 - protein, 789 aa, Magnaporthe grisea
MATNGPATKIGAPMPDKDLEKKPMELYPMVSWKYDTLLWVMSIIADLFFREIHPRSSWKIPKHGPILFVAAPHANQFVDALVLQKTLKKEAGRRVSLLIAQKSIHGFIGWASRQVGCVPVGRAQDAARPATGTIYLPNPIYDPTLIRGVGTKFDIEAEVGGSLFLPSVKGQTGSHVEIAEIISPEELRIKRALKGKLPMEQLTGRDDVDQDGIFKNKEVRSRKEGYQGTKYKLAPHIDQSKVYEAVFQRLRSGGCVGIFPEGGSHDRTELLPLKPGVAIMALGAMANYPDVGVKIVPVGMNYFHAHKFRSRAVVEFGNAIEVDPELVHMYKNNQRREAIGTLLDTVHQGLSAVTVSTPDYDTLMLIQAARRLYNPTGKKLPLPVVVELNRRLAVGYERFKDDERVIKVRESVKKYNKNLRYLGIRDHQVQVTRMSWHRVVRIFLYRILQLAVFFVATFPGLVLFGPVFIVAKVISIKKARSALAASTVKIQGRDVMATWKLLVSMAFAPIMYHVYCSLLAWKVARDGLWGFVPAWIVSLPWFVLVASIWLIGWPTFISITFAALRFGEIGMDVFKSLRPLLLCMFPSSKYNMQKLQEQRAELSAEVTNLINTLGPEIFPDFAQSRLIKASMDQHGAPLSPTHTRQPDSPTLKRRSDSELSFTGQASPGTSLHHPTSSNGIQRRNTQSSRAIPRNESFSNIGKAGIFATRPPSRNRSRTSSMGGFNVQAFTALDSQEGFDEASRKIREAMRERGEMRRRRSEARGMMIGGSEDEEEDHDDENSSDGKKNA

SEQ ID NO: 26965 - protein, 303 aa, Shigella flexneri
MSTLEQTIGNTPLVKLQRMGPDNGSEVWLKLEGNNPAGSVKDRAALSMIVEAEKRGEIKPGDVLIEATSGNTGIALAMIAALKGYRMKLLMPDNMSQERRAAMRAYGAELILVTKEQGMEGARDLALEMANRGEGKLLDQFNNPDNPYAHYTTTGPEIWQQTGGRITHFVSSMGTTGTITGVSCFMREQSKPVTIVGLQPEEGSSIPGIRRWPAEYLPGIFNAALVDEVLDIHQRDAENTMRELAVREGIFCGVSSGGAVAGALRVAKANPGAVVVAIICDRGDRYLSTGVFGEEHFSQGAGI

SEQ ID NO: 26966 - protein, 593 aa, Propionibacterium acnes
MLRPQDTATRDTKCLSGMWDFAFDAEDRGQTEKWFTRPLPTCTEMAVPASYQDLSTDPAARDHVGPVWYQREVRIPRGWTDDRVVVHFESATHAATVWVNDVEVVRHVGGYLPFEADITDHVCAGKKCRLTVRVDNRLSFQTIPPGIIVDSPEGPKQKYWHDFFNYAGIHRDVWLCRRPQAHIEDVTITTDIDGNDGIVTWSVLLHDAEPLTTRVTIFDTEGNVVAGGTSANAHARIPSVHLWQPGHGYLYEAEISLVDGDQVIDTYQQVFGVRTIRVDGARLLVNGEPVHLTGFGMHEDHQTIGKAHNDALMLRDAACLEWIGANSLRTSHYPYSERILDYADRHGLLVIDETPAVGINMGLGGGIFGAQGYPTFSAETINDKTQKVHAQVIRDLIARDKNHPSVIIWSIANEPESETEAAENYFLPLFDVARAADPTRPVSFVNVMLAPFGKCRVSQYSDVLLLNRYYGWYVDTGDLAAAERHWREEMAGWASENKPIIITEYGADTMPGLHQIPAQPWSEEYQVEVLKMNERVFDSFDAIVGEHIWNFADFATTSGTMRVGGNRKGIFTRDRQPKSAAFHLRKRWRGVAQ

SEQ ID NO: 26967 - protein, 553 aa, Photorhabdus luminescens
MDKIIPWWLQGVIYQIYPKSFQDTTGSGTGDLNGITYRLDYLKKLGVDAIWVTPFYLSPQVDNGYDVADYYAIDPAYGSMDDFKRLVDEAHQRDIRIIVDIVFNHTSTQHPWFKQAQDIDSPYRQYYIWRDGVPGTPPNNWLSKFGGNAWAWHEASQQYYLHLFAVEQADLNWEHEPVRAELKKICEFWAGLGVDGFRLDVINLVSKQQDFPESTQGDGRQFYTDGPRIHEFLQEMNREVFQPAGVMTVGEMSSTSLEHCHRYSSLDGEELSMVFAFHHLKVDYPNGEKWVAAPPDFIELKKIFAKWQQGMYERAWNALFWCNHDQPRIVSRFGGEGVWRVPSAKMLAMVLHGMQGTPYIYQGEELGMTNPHFSHIEEYRDIESLNIYQEKIEQGNDKQQILSVLAKKSRDNGRTPMQWDTTANAGFTQGEPWIALNSDYQDVNAENAMQDDDSVFHCYARLIKLRKEYPVLTYGSYEDLLPSHPSLWCYVRRWENQTLLVIANLSVEVQKWSLDASLSDCSWVKLMGNYPENHVPAKDMQLQPYEAVYWLAE

SEQ ID NO: 26968 - protein, 415 aa, Oryza sativa
  misc_feature (393)..(393): Xaa can be any naturally occurring amino acid
PLNITRRSLDEWPRAGSDDVGEWPNPTTPGASKAEGAGSAKPGEGLRLDLSSLRSQGRKDQIAFFDKECSKVADHVYLGGDAVAKNRDILRKNGITHVLNCVGFVCPEYFKSDLVYRTLWLQDSPTEDITSILYDVFDYFEDVREQGGRVFVHCCQGVSRSTSLVIAYLMWREGQSFDDAFQLVKAARGIANPNMGFACQLLQCQKRVHAIPLSPNSVLRMYRMAPHSPYAPLHLVPKMLNEPSPAALDSRGAFIVHVLSSIYVWVGMKCDQVMEKDARAAAFQVVRYEKVQGHIKVVREGSEVPEFWDAFSSAPVNSDSNTKISKDQIDSASKTGPGNRRVESYDADFELVYKAITGGVVPAFSSSGAGDETHLPARESTWSSLRRKFISRXSTSPPFLSPSSLSSDSSISSKY

SEQ ID NO: 26969 - protein, 431 aa, Unknown
  Synechococcus sp. RS9917
MKRVLAIILGGGAGTRLYPLTKMRAKPAVPLAGKYRLIDIPISNCINSNITKMYVLTQFNSASLNRHLSQTYDLSAGFGQGFVEVLAAQQTPESPSWFEGTADAVRKYQWLFQEWDVDEYLILSGDQLYRMDYSLFVEHHRQSGADLTVAALPVDPQQAEAFGLMRTDAHGTIQEFREKPKGDSLKEMAVDTSRFGLSPESAEQKPYLASMGIYVFSRKALIDLLNDHPQHKDFGKEVIPEALAGGMTLKSYVFDDYWEDIGTIGAFYEANLALTQQPSPPFSFYDEDFPIYTRPRYLPPSKLVDAQITESIIGEGTILKSCSIHHCVLGVRSRVENDVVLQDSLLMGADFFESSTERSVLRERGGIPVGVGQGTTVKRAILDKNTRIGSNVTIVNKDHVEEADRPELGFYIRNGIVVVVKNASIPDGTVI

SEQ ID NO: 26970 - protein, 472 aa, Unknown
  Synechococcus sp. RS9917
MSKAHFGLIGLGVMGENLVLNAERNGFSSVVYNRTYAKTEEFLAGRGAGRNIQGATDLQDFVNKLERPRRILMMVKAGGPVDAVIQQISPYLEEGDLLIDGGNSEYHDTERRVAELESKSFGFIGMGVSGGAKGALEGPSMMPGGTKASYDAIESLVCKMAAQVEDGPCVTYIGPGGSGHFVKTVHNGIEYGIEQILAEGYDLMKRVGGLSGSAMAEVFAHWNSTEELSSYLVEITEVCLRTKDPDDGSDLVEKIQDKAGQKGTGLWTVVSALQMGASVPTIYAALNGRVMSSMKDQRIKAEPLLKGPAIKPFDMGSPADGMAPLMDAMVLACMASYAQGMELLRIASAEHNYNLHMPSIAQIWKGGCIIRARLLKRIQDAFNADPQLPNLLIDPWFADQVNRRLPGLARIVAGAAEAGIPVPCLSSTLDYINSYRTSRLPQNLVQAMRDCFGSHTYERVDKDGVFHTEWLN

SEQ ID NO: 26971 - protein, 502 aa, Staphylococcus epidermidis
MISKSSPLIFERSKKDRYAYSLPQNDIENISIASLLDDKYIRKHKAEFPEVSELDLVRHYTELSNKNFGVDTGFYPLGSCTMKYNPKINEKVARISGFSESHPLQEEEHVQGSLEIIYSLQEELKEITGMDEVTLQPAAGAHGEWTALMIFKAYHEKNGQSHRDEVIVPDSAHGTNPASASFAGFKSVTVKSNQRGEVDIEDLKRVVNDNTAAIMLTNPNTLGIFEQNIIEIGKIVHEAGGLLYYDGANLNAILDKVRPGDMGFDAVHLNLHKTFTGPHGGGGPGSGPVGVVEKLASYLPKPMVIKDNDRYKYDNDIPNSIGRVKPFYGNFGIYLRAYTYIRSMGANGLKEVSEAAVLNANYIKSRLKNHFEIPFNQYCKHEFVLSGTLQKQYGVRTLDMAKRLLDFGVHPPTIYFPLNVEEGMMIEPTETESKETLDYFIDAMIQIADETKNDPDKVLEAPHTTIIDRLDETTAARKPILKFEELKDEKYKEHTNIDSEDN

SEQ ID NO: 26972 - protein, 448 aa, Staphylococcus epidermidis
MSHRYIPLTEQDKNEMLNSIGAKSISELFDDIPTDILLKRNLNIAESEAETILLRRLNRLAAKNTTKETHATFLGAGVYDHYTPAVVDAMISRSEFYTAYTPYQPEISQGELQAIFEFQTLICELTDMDVANSSMYDGMTSFAEACILALSHTKKNKIVVSSGLHYQALQILHTYAKTRDEFEIIEVDLKGTITDLEKLEQLIDDNTAAVAVQYPNFYGSIEDLEQINNYIKDKKALFIVYANPLSLGLLTPPGTFGADIVVGDTQPFGIPTQFGGPHCGYFATTKKLMRKVPGRLVGQTQDDEGNRGFVLTLQAREQHIRRDKATSNICSNQALNALASSIAMSALGKQGIYEIAVQNLKNANYAKNKFEEHGFEVLKAQSFNEFVVKFNQPIKNINLKLAEYGYIGGFDLGEVSDDFKNHMLVAVTELRSKDEIDDFVTKAGELND

SEQ ID NO: 26973 - protein, 85 aa, Unknown
  uncultured Chloroflexi bacterium
MQEVMMAKEEDKILVEGTVIEALPGTQFKVRLETGHEVLAYLSGKMRKYYIRILLGDSVRVEMSPYDLTRGRIVYRHKKAVAASF

SEQ ID NO: 26974 - protein, 108 aa, Zea mays
  misc_feature (70)..(70): Xaa can be any naturally occurring amino acid
MAATSTAAAVLCRPSVAGLRQAPTPERTRVSIRAAPAPARRSVAAHAELSTALAIIQRQGVSLFLCRCVXFNIQSENMAKQVPAHNGRTHVESDDERAKEFAALHKSN

SEQ ID NO: 26975 - protein, 504 aa, Physcomitrella patens
MSDPYGRRLLVDDFHVGPVLGTGGFSVVRAGVRKQDNLQVAIKTLKKFGYGRGDHGRPGAQMSQAEALVKNEIMVMMRIVDEVSPHPNVIHLIDVYEDDGAVHLVLELCRGGELFDRIVQHERYSERDAAKVVRQIASGLAALHQAQIVHRDLKPENCLYVNPLAEAPLKIMDFGLSYIHHNTNSIVGIFGSIDYMAPEQLSLSGIMPANDMWSLGVILYILLCGYPPFRARSSRDKQMQILTGSYSMEEESWRGISHEAKQLIRRLLSVDPFARPTARELLSHPWVSGDIANRDLLHKDVFMRLQHFNARRKFRATAYASIVRTKFLLRTRYLKELLGDRVLTDSELEALRVNFMRISSNGQTATLKEFEEVLRSINLHCFVPLAPRIFELFDYNHDGGIDLREVVCGFSLLRTSHLDDALQMCFKIYDRDDSGYISKGELARVLGALPEDYLPADISQVQMDDIFEHVDTDSDGRISYQEFRRALSLQDAVMNHFRMEGQVQ

SEQ ID NO: 26976 - protein, 911 aa, Zea mays
MAFKGLPRDSRGSLEVFNPDAPVSDRATTSPFLLPPAVASHPSLLAAGDGGDADVGRATQRAAEWGLVLQTDEHTGRPQGVVARPSGSNRTSESGNSIDERAAAAGAGRALPRVSEELRAALSAFQQTFVVSDATRPDHPILYASAGFFNMTGYSSNEVVGRNCRFLQGSGTDPVEISKIRQALAAGSNYCGRILNYKKDGTPFWNLLTVAPIKDEDGRVLKFIGMQVEVSKYTEGNKDTALRPNGLPESLIKYDARQKDHARSSVSELLLALKDPRSLSESRNNTLKRKSQESAGSALVPGKRSSETGSRRNSHSGMRNSLQKISEVPEGGNKTRKSGLRSFMGLIGMGHGNVEKNILKPREDPLLDSDDERPDSFDDDFRKKEMRKGIDLATTLERIEKNFVITDPRLPDNPIIFASDSFLRLTEYCREEILGRNCRFLQGPETDRGTVKKIRDAIDNQTEVTVQLINYTKSGKKFWNLFHLQPMRDQKGDVQYFIGVQLDGTERVREAAAKDGAILVKKTADNIDEAAKELPDANLRPEDLWANHSKPVLPKPHMKDTASWRAIQKVLENGESIDLKHFRPVRPLGSGDTGSVHLVELLGTGEYFAMKAMDKSVMLNRNKVHRATAERQILDMLDHPFLPTLYASFQTKTHICLIVDYCAGGELFMLLDRQPMKVLKEDAVRFYAAEVVTALEYLHCQGIIYRDLKPENILLHRDGHISLTDFDLSCLTSCRPQVFLPHDIDKKKKRRKSRSNPIFFAEPMRADNSFVGTEEYIAPEIITGAGHTSAVDWWALGILLYEMLYGYTPFRGKTRQRTFANILHKDIRFPASIQVSLAARQLIYRLLHRDPANRLGSYEGAMEIKQHPFFRGINWALVRAATPPELEAPLQDTLEATLPPPAADGAHTDMF

SEQ ID NO: 26977 - protein, 315 aa, Unknown
  Nostoc sp. PCC 7120
MQATPTLIKSDSYILTTNYKLRTLMSLRALLLVNRHARQGQERLLEAIDHLKKFNFQLIEETTEHPKHLSQVIHKYKDQVDLVIVGGGDGTLNAVVDALVETQLPLGILPLGTANDLARTLGISNSLPEACKTIAEGELRRIDLGWVNGKHFFNVASLGLSVKITRRLTKEFKRRWGVFAYAVTAIQVIWESRPFSAEIRSKDRVFRVKTVQIAVGNGRYYGGGMAIVPDASIDDQRLDLYSLEISHWWEIIPLLPAMRNGRHIHRQNVRALNGQEFEVYTRKPRAINTDGEITTYTPATFRVLPKAVAVLVPPV

SEQ ID NO: 26978 - protein, 203 aa, Solanum tuberosum
MNPEYDYLFKLLLIGDSGVGKSCLLLRFADDTYLESYISTIGVDFKIRTVEQDGKTIKLRIWDTAGQERFRTITSSYYRGAHGIIVVYDVTDQESFNNVKQWLSEIDRYASDNVNKILVGNKADLTANRVVSYETAKAFADEIGIPFLETSAKDATNVEQAFMAMTGAIKNRMASQPASNSAKPPTVNIRGQPVTQSGGCCSS

SEQ ID NO: 26979 - protein, 187 aa, Oryza sativa
MEEEWGVPYPDCVLDNAGAGFVGGAAAGTLAHLFTGLRDFPCGRHLAGAAQAVRDGAPCLATRWAARLAVYSAACHALSSATDRHDDPLVSVAAGAATGAVARLRHGPLAVGRAALVGAATLAAVELMIRDSVEEHDDDKPRRNQRPLPAKTKEDDVILRITPAIDHFPVPDPFIAASRGSLLRFRG

SEQ ID NO: 26980 - protein, 262 aa, Solanum tuberosum
MGSGKLGDSGMIAITAKVMMAVVVFLFFAVVLVFFLHIYSKFFTREDANPNDSTRRRRRRRRFDFAGGYQEVNALRGGLDRSILKTIPVIPFDTKDFKDGLECSVCLSEVCEGEKARLLPKCNHGFHVDCIDMWFQSHSTCPLCRNPVSEMSSTKSIIVESNSGAIRAPVEQGSVASTETRNLPTNVLFWGDETTTSSASTSTSRPDGVLMIDIPRQNSEEAEEEQKTPTPTRLRSLTRLFSSLNPCSPRNVDVEQGSRGQS

SEQ ID NO: 26981 - protein, 106 aa, Anabaena variabilis
MTVYQVRLINSAIALDCIISVPDDQYILDIAAEAGIRLPSGCKQGDCSACVAKLISGEVDQSEQQFLRPDEIQQGYVVTCVTYPLSDCTLETHQEQVLYNSSLYQP

SEQ ID NO: 26982 - protein, 354 aa, Cicer arietinum
MSPDIAKIRKLVRQSKCLQDKMTAKESATWLAIINQEEALARELYPDYCPSLSSGGGSGSMVINDCSEYDVDGADDETNFDVVEDRKPENLHPSNLGMERMRGMVPVQQPSLPMKGEVVTNLDFIRKRKISNDFNMIIDQKLYTCEHPQCPYSEVRLAFQDRSSRDNHQLNCPYRNSPADYGGSNFHATEVKPIIFPQSFVQPNSTAQPAGLVPPSFDLTGLGVPEDGQKMITELMSIYDTNVIGNKNASSTNCVAVENQNLSQPCIQQQQDNFFSSQGMVMEAANFFTRDESQFDRFKPINSPFETNHNNNNIHLMFGSPCDLASFDFKEDIQLQGVGIDTFHKQPDMSIWYN

SEQ ID NO: 26983 - protein, 114 aa, Vibrio vulnificus
MNMKKIEAIIKPFKLDDVREALAEVGITGMTVSEVKGFGRQKGHTELYRGAEYMVDFLPKVKLEIVVTEDVADKCVETIIETAQTGKIGDGKIFVTNVERVVRIRTGEEDEDAI

SEQ ID NO: 26984 - protein, 415 aa, Bordetella parapertussis
MFNRNLTLDQVDPDVWAAIQKEDVRQEQHIELIASENYASPAVMQAQGTQLTNKYAEGYPGKRYYGGCEYVDVVEQLAIDRLKQIFGAEAANVQPNSGSQANQGVYMAVLKPGDTVLGMSLAEGGHLTHGASVNASGKLYNFVPYGLDADEVLDYAQVERLTKEHKPKLIVAGASAYALHIDFERMARIAHDNGALFMVDIAHYAGLVAGGAYPNPVPHADFVTSTTHKSLRGPRGGVIMMKAEVEKAVNSAIFPGIQGGPLMHVIAAKAVAFKEALSPEFQDYAQQVVKNAKVLADTLVKRGLRIVSGRTESHVMLVDLRPKGITGKEAEAVLGQAHITVNKNAIPNDPEKPFVTSGIRLGTPAMTTRGFKEAEAELTANLIADVLDNPRDEANIAAVRARVNELTARLPVYGN

SEQ ID NO: 26985 - protein, 195 aa, Burkholderia xenovorans
MRLAEVVRNTSETQIRVKINLDGTGQQKLATGVPFLDHMLDQIARHGLFDLEIEAHGDLHIDDHHTVEDTGITLGQAVAKAIGDKKGIRRYGHSYVPLDEALSRVVIDFSGRPGLEFHVPFTRARIGTFDVDLSIEFFRGFVNHAGVTLHIDNLRGLNAHHQMETVFKAFGRALRMATELDERAAGQIPSTKGSL

SEQ ID NO: 26986 - protein, 588 aa, Thiobacillus denitrificans
MCGIAGELRFDDRAPDAATMTRMLARLARRGPDAEGQHAAGPLRLGHRRLAIIDLSPRSAQPMVDAATGTALVFNGTIYNYPELRAELIALGHAFHSDGDTEVILRAYLEWGERCVERLHGMFAFAIWHRDELFLARDRLGIKPLYYSENAGSLRFASTPQALLAAGEVDTGLDAVALHHLFTLHAVVPAPRTILNGVRKLAPGTTLTVNLRGELRHRSYWSLHAQRPAETRSEAEWTDAIHDALRRAVQKRIEIADVKVGVLLSGGLDSSLLVALLAELGVSDLMTFSVGFEDHPEERGNEFEYSDPVAAMYGTRHHKYLIPNSEVLRRLPEAVGEMSEPMFAQDAVAFYLLAEQVSRTVKVVQSGQGADEVFGGYFWYPRMAAEAEGSALDRFRRHYFDRDHAEFLELADPRYHGPDYTGELIAARLAEPFADEFIDQVLRTDTTMLITDDPVKRVDNMTMAWGLEARVPFLDHTLVELAATMPPAMKLASEGKHVLKRIARGRVPDAVIDRKKGYFPMPALKYVRGEFLDFMRDILDSQACRQRGLYRRAYVEHLLDAPEQHHTRIQGSKLWHLALLEYWLQTHV

SEQ ID NO: 26987 - protein, 825 aa, Caldicellulosiruptor saccharolyticus
MIVKAYIDDFNEITVVLAQMVHSVKKEDFKVFLDDQEIDIEKVEKLMPHSENPFEAETRGYEICEQKGKIRFVLKEGHFDFHRKSTVRPVFVIGDMNNWTISPEWELTYSKLRGRYELIKDLKDIKIGQKFKFAEGASRKLWYPPGYGNDIVIEDYFDREAAFTNMVKITTTKRLWANLKYKVVYKNEYKYARPREILTRNEYFYAGELGARYEPYGTYFRLWAPTAYKVKIQIFDEHENFKFGKEMSRAENGTWDVYLPGDLKNHFYLYEIWHYNYEDDEGYIVYHVPDPYSKASSSNSGKSYIFDPADGLIDGWQADSFVDNIEKQDDAIIYEMHVRDFTIDQSSGIGENLRGKFLGFCQEGYYKEGISTGLLHLKELGVTHVHLLPISDFGSVDDKNPDKRYNWGYDPVLYQCPEYWYSTKSGGIEALKELRTMIKKLHENGIGVVMDVVFNHTYHTKGGKFSIFDKIVPEYFYRVDDYGDYSNATGCGNELATEKPMVRKFILDTIIYWTEEFHIDGFRFDLMGLLTVKQSRQVANEVRKRNPKALVYGEGWVMGNSTCLVEEMATILSSCHQGYSIGLFNDRIRDAIRGDLDGYKTGYVHGNLSDVGRLKQGIKAAIDDFAKEPDECVNYVSCHDNLTLFDKLQKTMVGEDIFWIDRATRLANAIVLTSQGVAFLHGGVEFNRSKGGHPNTYNAGDNINKIDWSLKEKFFDTFKFYCDLINLRRKHIAFRMRSSGEIKKYLRFIPAPDGVVAFIITYPYDEWKKIIVAYNPFKEKKILQLPEGSWYVKANDGIVFPDSFEKEAIGSFEIAPVSLFIAYQK

SEQ ID NO: 26988 - protein, 960 aa, Pseudomonas putida
MINFFDPASDKSSDLGTPARESDVQVSLSIDGRAISVPAGTSVMRAAAMLGTSIPKLCATDSLEAFGSCRMCMVEIEGMRGYPASCTTPVSEGMVVRTETPRLAGLRRNVMELYISDHPLDCLTCSANGNCELQTVAGQVGLREVRYGYDGANHLDEKKDVSNPYFDYEPSKCIVCSRCVRACEDIQGTFALTITGRGFESRVAAAGGENFLASECVSCGACVQTCPTATLTEKSLVQLGQPERSVITTCAYCGVGCSFRAEIKGDQLVRMVPDKNGGANHGHACVKGRFAWGYATHPDRITKPMIRKRLEDPWQEVSWDEAVTYAASEFRRIQLKYGRDSIGGITSSRCTNEEAYLVQKLVRTAFGNNNVDTCARVCHSPTGYGLKQTLGESAGTQSFDSVMQADVVLVIGANPTDAHPVFGSQLKRRLRQGARLIVIDPRRIDLVDSPHARADLHLQLRPGTNVAMLNALAHVIVTEGLLAQSFIDARCETGDFARWRDFVSLPDNAPEVLGPVCGVPAEQIRAAARLYATGGNAAIYYGLGVTEHSQGSTAVMGIANLAMATGNIGREGVGVNPLRGQNNVQGSCDMGSFPHELPGYRHVSNEGVRAEFEQAWGVTLQPDPGLRIPNMFEAALDGSFKALYCQGEDIAQSDPNTQHVTAALLAMECVVVQDIFLNETAKFAHVFLPGSSFLEKDGTFTNAERRISRVRKVMEPLAGKADWEATVALANALGYPMNYRHPSEIMDEIARLTPTFRRISYAELDRHGSLQWPCNDAAPDGTPTMHIDQFVRGKGRFMLTGYVPTDEKVNNRYPLLLTTGRILSQYNVGAQTRRTGNVAWHDADRLEIHPTDAESRGIQDGDWVGIGSRAGQTVLRAKVSTRVAPGVVYTTFHFPESGANVITTDNSDWATNCPEYKVTAVEVVKVFQPSQWQKRYQDFSDEQQRLLKERRTAEKAEVRR

SEQ ID NO: 26989 - protein, 538 aa, Zea mays
  misc_feature (178)..(178): Xaa can be any naturally occurring amino acid
MPPPSPPASQVRTCDAGAAQSPTRGTVSEMARYFRSSNLASRVFERQLISPRPGATVNTIRQFYENLVPSYTIYDIDCPDYSFRKFTDDGKYFVAFSRNHQDLIVYRPIWLTYSCNEECDPHELPPKAKKFDSFFKQLYSIPLASGNEYICKDFFLYMECHRFGLFATSTAQSNESTXTEGAIHGVPLIEKITFHLVRLEDGVILDEKAFCNDFINLAHSIGAYMYEDLLCIVSLRYQTIHILQIRDSGNLVEVRSIGAFCREDDELFLHSHVQTGYAGSFLPGIKQRLLSYIFCKTWNEVPDQTLRVQHLKKFYFHFQDYVDLIIWKVQFLDRHHLFVKFGSVDGGVSRSTDQNLAFFAVYNMETTDIVSLHQNSSEELYALFEQFYDHFHANPQASSHGKFISSHSNDIHALDQLRVIKNKASSSSQFVKKMMTSLPYTCQSQSPSPYFDLSLFRYDEKLISAIDRHRHCTEHPIKFISVRQNVVKFKIKPGSDSGASDSRIKRISSFLFHPFFPLALSIQQTYMQPTVLNIHFRR

SEQ ID NO: 26990 - protein, 1007 aa, Lactobacillus delbrueckii
MSNKLVKEKRVDQADLAWLTDPEVYEVNTIPPHSDHESFQSQEELEEGKSSLVQSLDGDWLIDYAENGQGPVNFYAEDFDDSNFKSVKVPGNLELQGFGQPQYVNVQYPWDGSEEIFPPQIPSKNPLASYVRYFDLDEAFWDKEVSLKFDGAATAIYVWLNGHFVGYGEDSFTPSEFMVTKFLKKENNRLAVALYKYSSASWLEDQDFWRMSGLFRSVTLQAKPRLHLEDLKLTASLTDNYQKGKLEVEANIAYRLPNASFKLEVRDSEGDLVAEKLGPIRSEQLEFTLADLPVAAWSAEKPNLYQVRLYLYQAGSLLEVSRQEVGFRNFELKDGIMYLNGQRIVFKGANRHEFDSKLGRAITEEDMIWDIKTMKRSNINAVRCSHYPNQSLFYRLCDKYGLYVIDEANLESHGTWEKVGGHEDPSFNVPGDDQHWLGASLSRVKNMMARDKNHASILIWSLGNESYAGTVFAQMADYVRKADPTRVQHYEGVTHNRKFDDATQIESRMYAPAKVIEEYLTNKPAKPFISVEYAHAMGNSVGDLAAYTALEKYPHYQGGFIWDWIDQGLEKDGHLLYGGDFDDRPTDYEFCGNGLVFADRTESPKLANVKALYANLKLEVKDGQLFLKNDNLFTNSSSYYFLTSLLVDGKLTYQSRPLTFGLEPGESGTFALPWPEVADEKGEVVYRVTAHLKEDLPWADEGFTVAEAEEVAQKLPEFKPEGRPDLVDSDYNLGLKGNNFQILFSKVKGWPVSLKYAGREYLKRLPEFTFWRALTDNDRGAGYGYDLARWENAGKYARLKDISCEVKEDSVLVKTAFTLPVALKGDLTVTYEVDGRGKIAVTADFPGAEEAGLLPAFGLNLALPKELTDYRYYGLGPNESYPDRLEGNYLGIYQGAVKKNFSPYRPQETGNRSKVRWYQLFDEKGGLEFTANGADLNLSALPYSAAQIEAADHAFELTNNYTWVRALSAQMGVGGDDSWGQKVHPEFCLDAQKARQLRLVIQPLLLK

SEQ ID NO: 26991 - protein, 417 aa, Photorhabdus luminescens
MLKREMNIASYDPELWQAMEQEVVRQEEHIELIASENYTSPRVMQAQGSQLTNKYAEGYPGKRYYGGCEYVDVVEQLAIDRAKALFGADYANVQPHSGSQANAAVYMALLQPGDTILGMNLAHGGHLTHGSPVNFSGKLYNVVPYGIDESGKIDYDDIAAQAEKHQPKMIIGGFSAYSGVVDWAKMREIADSIGAYLFVDMAHVAGLIAAGVYPNPVPHAHIVTTTTHKTLAGPRGGLILAKGGDEELYKKLNSSVFPGCQGGPLMHVIAGKAVALKEAMEPEFKAYQHQVADNAKAMVEVFLARGYKVVSGSTENHLFLLDLVDKNITGKDADAALGRANITVNKNSVPNDPKSPFVTSGVRIGTPAITRRGFKQAEARELAGWMCDVLDNINDEVTIEMIKQKVLAICAKYPVYA

SEQ ID NO: 26992 - protein, 553 aa, Micromonospora olivasterospora
MSTRTDTGVTRVLLIKPPIRACMIEIGRHMPIGLAYLAAQLRNSGMEVDIFDSLAFSEDNHVVPPSQYTDIDRAKVAAHPRWDHLVHWGADWARVEQVLRRGYDVVGVSCMFTPYYEPAYELGRLAKQILPQARVILGGQHPTVAHPHALAEEAFDALVLGEAEANVVEIVEALAAGRSLRGMPGLTFRCGTGLCDCPRPSGVHLQPRAEFLQDLDGLALPAVDLLDMGSYDETATLITSRGCPFSCSFCTVHATVGKKFRARAPENVVDEIEHYVTEHGIRRFFIEDDNFTFDIARVHEICRAITRRGLDVELHLPNGMTVVKLDKPLVDDMAAAGFQSLFLGLETTDVKRLRQIRKGFTSLEKVNAGAGLFTDHGITVGASLIVGLLGQTPAEVARDSINLMLAGIRFWTNPFYPIPGSPDFQQCLANGLITHDTELALYDQFNFAIGSDHLSPAELYWSVVITQAMAHWPDYVLEGARVRRERGTVGLDEALQRLLAHSDSLFGPNGELEVPAVPGRSTATSCTATRRLLPRGAAHQPAATARRGLHLHR

SEQ ID NO: 26993 - protein, 301 aa, Oryza sativa
MAGGGGAGSKVSVAAVQFACTDVESENVDTAERLIREAHKKGANIVLVQELFEGQYFCQAQRLDFFQRAKPYKGNPTIIRFQKLAKELEVVIPVSFFEEANNAHYNSVAIIDADGTDLGLYRKSHIPDGPGYQEKFYFNPGDTGFKAFKTKYATIGVGICWDQWFPECARAMVLQGAEILFYPTAIGSEPQDNNLDSREHWKRVMQGHAGANLVPLVASNRIGRETVETEHGESTITFFGNSFIAGPTGEIVKLANDKDEDVLVAEFDLDEIKSTRHGWGIFRDRRPDLYKVLLTLDGEKS

SEQ ID NO: 26994 - protein, 178 aa, Zea mays
  misc_feature (4)..(4): Xaa can be any naturally occurring amino acid
  misc_feature (9)..(9): Xaa can be any naturally occurring amino acid
  misc_feature (11)..(11): Xaa can be any naturally occurring amino acid
  misc_feature (15)..(16): Xaa can be any naturally occurring amino acid
  misc_feature (21)..(21): Xaa can be any naturally occurring amino acid
  misc_feature (24)..(24): Xaa can be any naturally occurring amino acid
  misc_feature (26)..(26): Xaa can be any naturally occurring amino acid
  misc_feature (30)..(30): Xaa can be any naturally occurring amino acid
  misc_feature (32)..(32): Xaa can be any naturally occurring amino acid
  misc_feature (45)..(45): Xaa can be any naturally occurring amino acid
  misc_feature (49)..(49): Xaa can be any naturally occurring amino acid
  misc_feature (51)..(54): Xaa can be any naturally occurring amino acid
  misc_feature (63)..(64): Xaa can be any naturally occurring amino acid
  misc_feature (68)..(69): Xaa can be any naturally occurring amino acid
  misc_feature (74)..(74): Xaa can be any naturally occurring amino acid
  misc_feature (78)..(78): Xaa can be any naturally occurring amino acid
  misc_feature (82)..(82): Xaa can be any naturally occurring amino acid
  misc_feature (84)..(84): Xaa can be any naturally occurring amino acid
  misc_feature (86)..(86): Xaa can be any naturally occurring amino acid
  misc_feature (88)..(88): Xaa can be any naturally occurring amino acid
  misc_feature (90)..(90): Xaa can be any naturally occurring amino acid
  misc_feature (93)..(93): Xaa can be any naturally occurring amino acid
  misc_feature (96)..(96): Xaa can be any naturally occurring amino acid
  misc_feature (98)..(98): Xaa can be any naturally occurring amino acid
  misc_feature (102)..(102): Xaa can be any naturally occurring amino acid
  misc_feature (108)..(108): Xaa can be any naturally occurring amino acid
  misc_feature (110)..(110): Xaa can be any naturally occurring amino acid
  misc_feature (118)..(118): Xaa can be any naturally occurring amino acid
  misc_feature (121)..(121): Xaa can be any naturally occurring amino acid
  misc_feature (126)..(126): Xaa can be any naturally occurring amino acid
  misc_feature (130)..(130): Xaa can be any naturally occurring amino acid
  misc_feature (133)..(136): Xaa can be any naturally occurring amino acid
  misc_feature (139)..(139): Xaa can be any naturally occurring amino acid
  misc_feature (144)..(144): Xaa can be any naturally occurring amino acid
  misc_feature (148)..(148): Xaa can be any naturally occurring amino acid
  misc_feature (150)..(150): Xaa can be any naturally occurring amino acid
  misc_feature (172)..(172): Xaa can be any naturally occurring amino acid
  misc_feature (175)..(175): Xaa can be any naturally occurring amino acid
GRRXGRREXQXKNKXXPKARXGRXAXDPKXRXDEAGRKRKGADEXPNGXHXXXXEKENGTREXXEAAXXAGNKXRTKXAGKXAXHXRXRXHPXQGXRXNKRXTRAGAXRXQTGRRGAXGKXQGTGXRGDXGQXXXXGRXKDNKXAQAXEXRRRAKTKPPGRQKTTESRKRGXTKXSRA

SEQ ID NO: 26995 - protein, 604 aa, Aspergillus oryzae
MLKPQQTTTRDLISLDGLWKFALASDDNSTQPWTSQLKTSLECPVPASYNDIFADSKIHDHVGWVYYQRDVIVPKGWSEERYLVRCEAATHHGRIYVNENLVADHVGGYTPFEADITDLVAAGEQFRLTIAVDNELTYQTIPPGKVEILEATGKKVQTYQHDFYNYAGLARSVWLYSVPQQHIQDITVRTDVQGTTGLIDYNVVASTTQGTIQVAVLDEDGTTVATISGSNGTIHIPSVHLWQPGAAYLYQLHASIIDSSKKTIDTYKLATGIRTVKVQGTQFLINDKPFYFTGFGKHEDTNIRGKGHDDAYMVHDFQLLHWMGANSFRTSHYPYAEEVMEYADRQGIVVIDETPAVGLAFSIGAGAQTSNPPATFSPDRINNKTREAHAQAIRELIHRDKNHPSVVMWSIANEPASNEDGAREYFAPLPKLARQLDPTRPVTFANVGLATYKADRIADLFDVLCLNRYFGWYTQTAELDEAEAALEEELRGWTEKYDKPVVMTEYGADTVAGLHSVMVTPWSEEFQVEMLDMYHRVFDRFEAMAGEQVWNFADFQTAVGVSRVDGNKKGVFTRDRKPKAAAHLLRKRWTNLHNGTAEGGKTFQ

SEQ ID NO: 26996 - protein, 168 aa, Zea mays
MVSPESQTDARKENIHSDVAETDECTKTQKAALAGTEGENSAEDSGVPLSEMDKCNEMPKDAPTLTAAGANPAEDEASLKDLFVQTVNKASSASPAPDDPKASDEKTLAEENQKLKELLQKLLASGNDQMGVITDLSEKVKVLERRLARKKRPKVRVHRPSRHASCVH

SEQ ID NO: 26997 - protein, 116 aa, Zea mays
MDRRPPARRRPGDPHRRGAAMHGAVEQHKQHRGRRPPQGTVPPPPPAGYFTAELLLAFVFVAVSLAFLPLVLPPLSPPPFLLLLVPVGLLAVLLALAFVPLDAHSHLVVVGSGSSR

SEQ ID NO: 26998 - protein, 142 aa, Brassica napus
KIVMVLAATNFPWDIDEALRRRLEKRIYIPLPDLESRKALININLRTVEVASDVNIEDVARRTEGYSGDVLTNVCRDASMNGMRRKIAGKTRDEIKNMSKDDFSNDPVAMCDFEEAIKKVQPSVSSSDIEKPEKWLSEFGSA

SEQ ID NO: 26999 - protein, 335 aa, Bacillus cereus
MCGITGWVDYKRSLEGERDVVTKMAETLAKRGPDDNKVWIKGNVAFGHKRLIVVDPEGGKQPMTCLKDETNYAICYNGELYNTEDIRKELLRRGYRFKGHSDTEVLLASYIEWKEECVDHLNGIYAFAVWDEQKEQVFIARDRLGVKPLFYKYDSGRLLFGSELKAILSHPDVKAEVTLEGLSEIFGLGPSRTPGHGIYAGIKELRPGHAMTFSKNGLCIWRYWNVESKKHEDSFEETVEKTRFLLQDAITRQLVSDVPLCTFLSGGVDSSAITAIAAKEYERSGKGQLHTYSIDYEDNDKYFKANAFQPNSDAPFINLMTETFQTNPSSLRHFE

SEQ ID NO: 27000 - protein, 183 aa, Glycine max
MASQGVASMFALALLLGAFASIPQSVESIGVCYGMSANNLPAASTVVSMFKSNGINSMRLYAPDQAALQAVGGTGVNVVVGAPNDVLSNLAASPAAAASWVRSNIQAYPKVSFRYVCVGNEVAGGATQNLVPAMKNVQGALASAGLGHIKVTTSVSQAILGVYSPPSAGSFTGEADAVMGPVV

SEQ ID NO: 27001 - protein, 430 aa, Bacillus clausii
MKTTIAQVGRYVNEQVTIGAWIANKRSSGKIAFLQLRDGTGFIQGVVVKAEVPEDVFALAKSITQESSLYVTGTVREDERSPSGYELSVEQIELIHQATDYPITPKQHGTEFLMDHRHLWLRSKRQHAIMKIRSQIIRSTYDFFSERGFTKLDSPILTGSSPEGTSELFHTKYFDEDAYLSQSGQLYAEAGAMALGRVFTFGPTFRAEKSKTRRHLIEFWMIEPEMAFVEHEESLEIQEQYVAHLAKAVLDHCQLELKQLGRDVTKLEAIKAPFPRITYDEALDLLKEKGFDDISWGDDFGSPHETAIAEHFDKPVFITRYPRSLKPFYMQPAPDRDDVVLCADLIAPEGYGEIIGGSERIHDYDLLKQELEKHNLPLDAYGWYLDLRKYGSVPHSGFGLGLERTVAWLSGTEHVRETIPFPRLLNRLYP

SEQ ID NO: 27002 - protein, 562 aa, Zea mays
MALSASPAQEELLQPAGRPLRKQLAAAARSINWSYALFWSISSTQRPRVLTWTDGFYNGEVKTRKISHSVELTADQLLMQRSEQLRELYEALRSGECDRRGARPVGSLSPEDLGDTEWYYVICMTYAFLPGQGLPGRSSASNEHVWLCNAHLAGSKDFPRALLAKSASIQTIVCIPLMGGVLELGTTDKVPEDPDLVSRATVAFWEPQCPTYSKEPSSNPSAYETGEAAYIVVLEDLDHNAMDMETVTAAAGRHGTGQELGEVESPSNASLEHITKGIDEFYSLCEEMDVQPLEDAWIMDGSNFEVPSSALPVDGSSAPADGSRATSFVVWTRSSHSCSGEAAVPVIEEPQKLLKKALAGGGAWANTNCGGGGTTVTAQENGAKNHVMSERKRREKLNEMFLVLKSLVPSIHKVDKASILAETIAYLKELQRRVQELESRRQGGSGCVSKKVCVGSNSKRKSPEFAGGAKEHPWVLPMDGTSNVTVTVSDTDVLLEVQCRWEKLLMTRVFDAIKSLHLDALSVQASAPDGFMRLKIGAQFAGSGAVVPGMISQSLRKAIGKR

SEQ ID NO: 27003 - protein, 304 aa, Burkholderia thailandensis
MAAAEASGAKLSNFFRRCAPKSRAGAPRVSRRERQGRCPPSRHDTAAGLRPKPSWRIQMAVTMRQMLEAGVHFGHQTRFWNPKMAPFIFGHRNKIHIINLEKTLPMFNDAQKYVRQLAANRGTILFVGTKRQSRDTIAQEAQRAGMPYVNARWLGGMMTNFKTLKVSIKRLKDMEAAVEAGELEKMSKKEALLFEREIAKLQKSIGGVKDMGGIPDAIFVVDVGYHKIAVTEANKLGVPVIAVVDTNHSPEGVDYVIPGNDDSSKAVALYAEGVADAILEGRANAVNEVVQAVRGDDEYVEENA

SEQ ID NO: 27004 - protein, 319 aa, Bacillus clausii
MKRIGVLTSGGDSPGMNAAIRAVVRKAIFHGLEVYGISYGYQGLINGDIKKMELGSVGDIIHRGGTMLYTARCEEFKTLEGQQKGIEQLKKFGIEGLVVIGGDGSYRGAQQLTKHGFPTIGVPGTIDNDIPGTDFTIGFDTALNTVIDAIDKIRDTATSHDRTYVIEVMGRHAGDLALWAGLADGAETIVIPEAEHNMEQILATIKRGQERGKKHSIIVVAEGVGSGIEFGDRISKEMNMETRVTVLGHIQRGGSPTGADRVLASRLGAKAVDLLLEGKAGMTVGIQKNELVYHPIDEILDRPHTIDQEMYKLSQELSI

SEQ ID NO: 27005 - protein, 296 aa, Kluyveromyces lactis
MSSKHPCIKDGWFNEVSDKSFPGQAFSLKVNKILFHEKTQFQDILIFESSNYGNVLVLDGIIQVSEKDEFAYQELISHVPLYSHENPKKILVIGGGDGGVLREVVKHSCVEEATLVEIDAKVIELSKKYLPNMACSFKHPKVNVKLCDGFQFLRDVAESGTKYDVIITDSSDPEGPAEAFFQKEYFELLYKALTENGVVIAQASENVWLNLEYLKTLLNTSRSVFPVAEYCYTMLPTYTSGQLGLIACCKNPNTNLIDPCRAPTEDEQSQMRYYNNKMHSAAFVLPTWARKVLNPL

SEQ ID NO: 27006 - protein, 112 aa, Unknown
  Photobacterium sp. SKA34
MKKIEAIIKPFKLDDVREALAEVGITGMTVSEVKGFGRQKGHTELYRGAEYMVDFLPKVKIEIVVTDEVAEQCIDTIVETAQTGKIGDGKIFMFDIERVVRIRTGEEDEDAI

SEQ ID NO: 27007 - protein, 796 aa, Ustilago maydis
MDRPRRSARQSASAHHSPAPTSTPFASANVGSSSQIASNMVAPVGMANGISVSSRYEAGSYASPVAYSHPAASRPAYHQTPSASDSGLARSQQPVMQPRHSSFGPSDSQVVSQIALQSLPQTFIMGRGAAPIAPGTPSAPSRPCGTAASGATVPQAMYSTFPARIKAGTTNLLQTMPQSEWYDPSGKPLDPFSTPSHDASGGSTPYRSSRASGRRRAAAGFIRYAEAGSSDDEFEEDVGTEDEAGSRGVKRGIEHESEEDSSRAYLGLPPPASKMVAKRVYHRTNHVYHTDDDLVRQASRNEILVPIKIDLEAEQYRIKDSFTWNMNERLISPHHFAKLLLEDLDIPVEPYATQIMNMINQQIDDATGVADIEMEPAAGGVWASARFDDKQGELELLLPECERDQYDPVEEATKEGRPWNWGLERTDEQQRQWRKQMAQRLDAGRGLGEFEDDLRVIVDYEVQILRHMLRDRLEWDLCSPLTPESFARKLCDDLGLSGEAQALIANSVREQLINHKRAALELGLVGSGKVLKDKEKEIEAAWAELHAEKLEKQRKRLERGESATSVTDWQVQSRDATRANPTREASVQPSAPDSDQERKPAEDGEHDKTHLSSAAAQAGETAREDSGTPAARGDEAQDDEEDVETLHLTATATAAPTREGTCTPAIQASTTSSSIPATRSSARLSNMLLDATPAQPTTLSTSTPPAAGATSGVAIQPTLSAAQRLHNATYTVREILSRGPRPLDGIWRDWLESREFGPLLETLNDDDLDKLEEANIRASRRNRRDAARSLGGRRRR

SEQ ID NO: 27008 - protein, 416 aa, Unknown
  Photobacterium sp. SKA34
MLKRDMNIADYDAELFAAIQEETARQEEHIELIASENYTSPRVMEAQGSQLTNKYAEGYPGKRYYGGCEFVDKAEQLAINRACQLFGAEYANVQPHSGSQANNAVYMALLNAGDTVLGMSLAHGGHLTHGSPVNFSGKLYNVIPYGIDESGQIDYAEVEALALEHKPKMIIGGFSAYSQIVDWKRMREIADKVGAYFFVDMAHVAGLIAAGVYPNPVPHAHVVTTTTHKTLAGPRGGLILSNEGEDLYKKLNSAVFPGGQGGPLMHVIAAKAVAFKEAMEPEFKGYQARVVENAKVMVGEFLERGYKIVSGSTENHLFLVDLIDKGITGKEADAALGAANITVNKNSVPNDPRSPFVTSGIRVGTPSITRRGFTADDARQLAGWMCDVLDNVDNEEVIASTKAKVLDICKRLPVYA

SEQ ID NO: 27009 - protein, 238 aa, Prochlorococcus marinus
MISGPPPSTNQSVEELLERFTSGSKRQRLSLVKTIEERAEELAALAQAALASFDPDGDDWAAGWILQVFQRHQPQVLPSLLSSESRGWFSTPSAVGIDYEPLQRDLLAENFEEADRFTSATLRKLAGPGAEQRGYVYFSEVHAINGLDLVTIDRLWTAYSQGRFGFTTQARLLNALDGRYHSLWARIGWKHEGTWTRYPGSFTWSLSAPEGHMPLINQLRGVRLMDAVLHHPSLVARR

SEQ ID NO: 27010 - protein, 456 aa, Cellvibrio mixtus
MKNIIAVIVGFVSILLLAACDKKTPVAESNSAVAPTANVATSPAHEHFVRVNGGHFELQGKPYVITGVNMWYAAYLGAPNEVGDRDRLAKELDNLKAIGVNNLRVLAVSEKSEINSAVKPAVTNGFGNYDETLLQGLDYLLVELAKRDMTVVLYFNNFWQWSGGMTQYMAWIEGEPVQDPNVTNEWEAFMAKSASFYRSEKAQQEYRKTLEKIITRVNSINGKAYVDDATIMSWQLANEPRPGNSQTTAEEKQIYIDWVHAAAAYIKTLDAHHLVSSGSEGEMGSVNDMQVFIDAHATPDIDYLTYHMWIRNWSWFDKTKPAETWPSAWEKAQNYMRAHIDVAKQLNKPLVLEEFGLDRDMGSYAMDSTTEYRDNYFRGVFELMLASLEQGEPSAGYNIWAWNGYGRTTRANYWWQEGDDFMGDPPQEEQGMYGVFDTDTSTIAIMKEFNARFQPK

SEQ ID NO: 27011 - protein, 258 aa, Xanthomonas axonopodis
MTTHRWRLDGQTALITGASAGIGLAIARELLGFGADLLMVARDADALAQARDELADEFPERELHGLAADVSDDEERRAILDWVEDHADGLHLLINNAGGNITRAAIDYTEDQWRGIFETNVFSAFELSRYAHPLLTQHAASAIVNVGSVSGITHVRSGAPYGMTKAALQQMTRNLAVEWAEDGIRVNAVAPWYIRTRRTSGPLSDPDYYEQVIERTPMRRIGEPEEVAAAVGFLCLPAASYITGECIAVDGGFLRYGF

SEQ ID NO: 27012 - protein, 437 aa, Haemophilus influenzae
MEILMKSGDLNKYDLVKNTLVLVLAGGRGSRLHELTDKRAKPALYFGGNRRIIDFALSNCINSDLNRIGVVTQYAAHSLLRHLQTGWSFLPQERGEFIDMLPARQQIDDSTWYRGTADAVYQNMAIIKNHYRPKYILILAGDHIYKQDYSVMLMDHVNSGAKCTVGCIEVPRSEAHEFGVMAVNENLKVKAFVEKPKDPPAMVGKPDVSLASMGIYVFDADYLYKMLEREVNTPQTSHDFGKDVLPKCLAEETLYAHPFSRSCMGRNTEGEIYWRDVGTLDSFWQSNIDLVSENPQLDIYDQSWPIRGNPIQAYPSKFFYKHSNVHPVDNSLIGGGCVITDASISNSVLFDHIKIDAFSKVDHCVVLPQVKIGKNCVLKNCIIDRECEIPDGMQIGVNMEEDKKRFRISSTGKVILVTSKMLKILEGHEIGEEGHLD

SEQ ID NO: 27013 - protein, 146 aa, Magnetospirillum magnetotacticum
MSDTVARAARVLFVGTKRQALTAIAEAAKRSAQYYVNSCWLVGMLTNWKTISGSIQRLRKVDETLEGGAVGLTKKERLMLTREKEKLEKALGGIKDMVGVPDLLFVIDTNKEQLAIKEAQRLGIPVAAIVDTYCNPDGILLHRPGQ

SEQ ID NO: 27014 - protein, 449 aa, Bacillus anthracis
MISIGGVIGAGLFVGSGAVVHSAGPGSIVSYALAGLLVVFVMRMLGEMAAINPTSGSFATYAREAIGPWAGYTIGWLYWFFWVIVIAIEATAGAGIIQYWIPEIPLWLLSLILTILLTLTNVFSVKSFGEFEYWFSFIKVISIVLFLCLGLAVILGFVPGTEAPGTSNLVGQGGFMPNGISSVLLGITVVIFSFMGSEIVAVAAGESAEPVKAVKTATNSVIWRILVFFIGSIAVVVTLLPWNSANILKSPFVAVLEHIGIPAAAQIMNFIVLTAVLSCLNSGLYTNSRMLFSMAERGDAPKAFLKLNSSGVPVRAVLFGTFFAYIGVVFSYISPDKVFLFLVNASGGIALLVYLVIAISHLKIRKKMGRVEQQNLKVKMWFFPYVTYVTIAAIIAVLIAMLAIESLRSQALLTMLVTVLIIISYFIFNRNKNSTVLNTKSKNEESVRF

SEQ ID NO: 27015 - protein, 329 aa, Salinibacter ruber
MRNTFPAQRARRSNLTRSPKRPSPPPMQLGMIGLGKMGANMGRRLMRDGHEVVGFDLDESAVQALEDDGATGAPALEALVDELEPPRVCWMMVPAGDAVDATLGDLLPHLDEGDIVVDGGNSNYKDTLRRAGRAEEHGLHYVDVGTSGGVWGLEEGYSMMVGGPDAAVDQLRPALTTLAPGPDKGWGHMGDVGSGHFVKMVHNGIEYGVMQAYAEGFDIMKSKEKFDLDLQKVAETWRFGSVVRSWLLDLTARALEEGQDLSGIEPWVDDSGEGRWTVKEAIDLDVPAPVITDALISRLDSRVEDSYTHKLLAAMRNQFGGHDVKSSDE

SEQ ID NO: 27016 - protein, 112 aa, Photorhabdus luminescens
MKKIDAIIKPFKLDDVREALAEVGITGMTVTEVKGFGRQKGHTELYRGAEYMVDFLPKVKIEIVVPDDIVDTCVETIMQTAQTGKIGDGKIFVFDVARVVRIRTGEQDEEAI

SEQ ID NO: 27017 - protein, 254 aa, Rhizobium leguminosarum
MKNLFDLTGRRALITGSSQGIGYALAEGLAQHGAEVIINGRTPESVKRAVESLKDQGLSAHAAIFDVTSKDAAKEGIDAIETDIGPLDILINNAGMQFRTPLEDFPADKWELLLTTNISSVFYVGQAAAKPMIARGQGKIINIASVQSELARPGIAPYTATKGAVRNLTRGMCADWAKYGLQINAIAPGYFKTPLNQALVDNPEFSSWLEKRTPAGRWGNVEELVGAAVFLSGRGSSFINGHTLYVDGGITTSL

SEQ ID NO: 27018 - protein, 113 aa, Zea luxurians
  misc_feature (42)..(42): Xaa can be any naturally occurring amino acid
MGRRACCAKEGVKRGAWTTKEDDALAAYVKAHGEGKWREVPXKAGLRRCGKSCRLRWLNYLRPNIRRGNISYDEEDLIIRLHKLLGNRWSLIAGRLPGRTDNEIKNYWNSTLV

SEQ ID NO: 27019 - protein, 1096 aa, Burkholderia xenovorans
MKRMLFNATQQEELRVAIVDGQKLIDIDIETAGREQRKGNIYKGIITRIEPSLEACFVNYGEDRHGFLPFKEVARQYFRDGVDMRSARIQDALREGQELIVQVEKEERGNKGAALTTFISLAGRYLVLMPNNPRGGGVSRRIEGDDRQELRETMAQLQLPEGMSIIARTAGIGRSAEELQWDLNYLMQLWRAIEAASQSGSSGQPMLIYLESSLVIRAIRDYFQPDIGEILIDTTEIHDQARAFMDIVMPDNVSKVKRYHDDVPLFSRFQIEHQIETAYSRTVPLPSGGAIVIDHTEALVAIDVNSARATKGADIEETAARTNLEAADEVARQLRLRDLGGLIVIDFIDMESAKSQREVEQRLKDALKHDRARVQMGKISRFGLMELSRQRLRPALSEGSHVTCPRCNGTGHIRDTESSALQVLRIIQEEAMKENTAAIHCQVPVEVTAFLLNEKRAEINKIESRFKVNVVLIPNKHLDTPHYKLERLRHDDARLDEPRASWKMAEEAARELESETGYSKRTEEVKPKQEAAVKGITPEKPAPSAPVRPVAAPAPVAVTPASGGFIGWLKNLFGMQPAAPAPAAPATTDKQTRPQRSERTERGERTGERGGERNRNRRGGAGGRDAAGRGEGTTATGGRPVQGQQSSQRREEREPREAREGREAREPRGNREPREAREGREPRETRETREPRESREGRENRDRDNRGNERAETVEGAPRAERGERPERGERRERGERAERGERRKPQAEAADALTQSDAQTAEELAQNQTALGENGAPVDQEAVAREGEERRRRRRGRRGGRREREEDVNGNLAADVAEAEGENAAVTDEAQVLTARQPVERKTEANEAKDVTPVEVVVAAVATETAVVSELHAATETPALAVEKAAKAEAVVPVAQAPAATAVAEPVAETVAPAAAAPVEAAQAVPAASETVSPAEPVARVEAPAQAEPEAPAVTPSPVEAHAAPAPIETAAPAAVVEAQAIQPAPHAGIVEAQPVVAGAATVVEPVVAESAPVAAVAPQAPQPARHDAVSAEALKPVLEQAGLVWVNTDADKLRAAQEAAAQTVKPARVVRERKSLPPLDSAPMQQVETGKHAQ

SEQ ID NO: 27020 - protein, 113 aa, Zea luxurians
  misc_feature (109)..(109): Xaa can be any naturally occurring amino acid
MGRRACCAKEGVKRGAWTTKEDDALAAYVKAHGEGKWREVPQKAGLRRCGKSCRLRWLNYLRPNIRRGNISYDEEDLIIRLHKLLGNRWSLIAGRLPGRTDNEIKNYWXSTLV

SEQ ID NO: 27021 - protein, 417 aa, Francisella tularensis
MFSFEKNSLKNTDKEIFDAIELEVKRQHEHVELIASENYASPAVMEAQGSQLTNKYAEGYHGKRYYGGCEFVDIAEKLAIERAQQLFGVDYANVQPHSGSQANAAVYNAVLKPGDTVLGMDLGAGGHLTHGSKVNFSGKIYNSIQYGLDENGDIDYEQVAQLAKEHKPKMIIAGFSAFSGIINWQKFREIADSVDAVLMADIAHVAGLVAAGVYPNPFPYVYVATTTTHKTLRGPRGGLILCNNNPELAKKFQSAIFPGIQGGPLMHVIAAKAVAFKEALEPSFVDYQKQVLKNAKAMEKVLKQRGINIISGGTSNHLLLLDITNTGFSGKEAEAALGRANITVNKNSIPNDPRSPFVTSGLRIGSPAITTRGFKEKECELVANLLADVVFNCGDEKVENETAAKVLDLCDKLPVYK

SEQ ID NO: 27022 - protein, 162 aa, Coix lacryma-jobi
EGCGYEFQMQYGSIGWSVGATLGYAQAAKDKRVIACIGDGSFQVTAQDVSTMLRCGQKSIIFLINNGGYTIEVEIHDGPYNVIKNWDYTGLINAIHNSDGNCWTMKVRTEEQLKEAIATATGAKKDCLCFIEVIVHKDDTSKELLEWGSRVSAANSRPPNPQ

SEQ ID NO: 27023 - protein, 113 aa, Zea luxurians
MGRRACCAKEGVKRGAWTSKEDDALAAYVKAHGEGKWREVPQKAGLRRCGKSCRLRWLNYLRPNIRRGNISYDEEDLIIRLHRILGNRWSLIAGRLPGRTDNEIKNYWNSTLV

SEQ ID NO: 27024 - protein, 659 aa, Aspergillus oryzae
MASNNFPSSLHDEYPQRADLRQMMGQRPLPTIPAGTIDPASMAGDEPVKQARAVLDRLSAALAVDDAIALESCFFASQAYWKDQLALTYHLRTFSGPSVIAAGLLETKNLREIAGGFAVDGGAVFLPATPTLQFIDCGIIFRTGSPGATCKGKVVLLPVKNRDETIEWKIWVLSTFLESLDLQQEDEALLHSPGRELDGLATFDTDVFIIGGGNAAVTVAARLKALGVESVMAERNPRPGDNWASRYDCMRFHIPTSFCDLPYMSYDEELRAPHLLTRDELASQVRRYVETFKLNMITSAQILSTKYDPSTRLWEVKIKTPAGQQTAHSKHLVLATGISSQEPYLPGVADSDFYQGTSLHSAQYRNAKQLAETGAKSVLVVGSANTAFDVLEDCHAAGLKTTMVVRSPTYIVPVEYLCDNHSLGAYDMGVEIADRLFLTLPSYVDAQLARGLMTQFAAQEPHRYDALAAAGFPVIDSRDPDMALMHNLLERAGGHYVDVGGTKLLADGKAGVKAGVEPIAYTATGLRFSDGTSVDADAVVWCTGFADKDVRDNAFRILGGQSCSREADNGTTHKLGAREIAGRLDATWGLDAEGEVRGLWKRQSRLDNIWVAGGYTQQHRWHSRTIALQIKASLEGVLPPAYMNTPRPVRGSPQKCTLL

SEQ ID NO: 27025 - protein, 290 aa, Prosthecochloris aestuarii
MRSDQVRIALVQMSCTSEPETNLDAACSRIMDAAEKGARIVCLQELFTSLYFCQEESYEPFSLAEPVPGPSTGVLQKLAAELEVVIVASLFEQRARGLYHNTAAVIDADGSYLGKYRKMHIPDDPGFYEKFYFTPGDLGYRVFKTRYATIGVLICWDQWYPEAARLTALKGAEILLYPTAIGWATGESSAEVRRSQLDAWQTIQRSHAIANGVYVAAANRVGVEGDLQFWGSSFVCDPFGQMMTVGDSTDEALLLADCDLSGIGFYRSHWPFLRDRRIESYGEIVQRYLD

SEQ ID NO: 27026 - protein, 212 aa, Triticum aestivum
MATLVKHLILCSSTTTSSSASPSPSNPRSPSSPDGADKRAHLTQSSTRRLAVAASTAMVATAALSARRPAAPHPAMAAVRALAPPGTVPRWGTRSYVRERFFEPGLTTEEAAARIRQTAEGMRTLRPMLETMSWKYVLFYVRLKSKYLDLDLTTAMAGVPEPRRPEYILVANELVDNMTEFDRFVRTPKVYESYLYYEKTLKSLDDVAEFLG

SEQ ID NO: 27027 - protein, 223 aa, Brassica napus
GKKMKAIIVGGSIAGVSCAHSLTLAGWDVLVLEKSSEPPARSPTGAGLGLDPQARTIIKSWLPHPHLLDETTLPLSIDQNQATDSEKKVRRVLTRDESFDFRAAYWSDIHGLLFNALDPTMFLWGHKFLSFAMSQDGSTVKVETLVMETQETVEIQGDLLVAADGCLSSIRKTFLPNFKLRYSGYCAWRGVFDFSGDENSETVAGIKRGYPELGRCLYFDLAR

SEQ ID NO: 27028 - protein, 346 aa, Verticillium dahliae
MFSLRGLQRLRLTQAHLNKPTIHTAQPFRRLATMAGTTNPKNYKFNHSMIRVKDPKASIKFYELLGMTVIKTIRQPEAKFDLYFLAYDSPKAVSAGASVFDREGLIELTHNYGTEDDASYTVNNGNTEPHRGFGHLCIAVDNIQAACDRIEKAGYEFQKKLSEGRMRHIAFAKDADGYWVELITWNDVAATEGVAETDVSTYRMNHTMLRVKDADKSLAFYRDVLGMDLLRKNESSSFTLFFLGYNKDGDGTATREGVLELTWNHGTEKEADFKYHNGNDQPQGFGHICVTVDDIDAACERFESLNCNWKKRLTDGRMKNVAFLLDPDNYWVEVVQNEKFTGKDNF

SEQ ID NO: 27029 - protein, 459 aa, Lactobacillus plantarum
MNKKTIGFFSGIAVFAIIYFLPIAGLSAKGQMDLALSLMTVVWWATQIAQPAFVGGIYLMLLIIMNVATPSQVFSSAWTGSIMWLVIGAYLIAGAVNESGLGQRIAYAFIIKFVRSWKGIVISIFALTFILALLIPHPWPRAFMIMSVITVVAETAKMPKRDLAKLGLAVFAASCPLSGVFYTGDTSLNPLAVQASGQSVNFVSYFIYMGVPMIIAAILTMFLFLFLFKPSQEVHIDVEALKQQQAQLGGMTGKEVRTIIWLIIAIALWLTSGITGLDVGWLTLIVALMMSLPVVGGILTAKSWEGVPVNVLVFLTSAIAIGNVGGVTGMNNWIAKTLIPSNLPTNIYLLAIVITVFAMIIHMFMGSVIAVMGITIPAFVAATAHMGISPLAVSLLVFSVTNLHYILPFHNLAVLVGSDPDTGGGYTQKDVMRLGIPLTAVVFVVALVEMFWFHLVGLA

SEQ ID NO: 27030 - protein, 438 aa, Mycobacterium avium
MSEVATAPLAAVHLPPAVRGPKLLQGIGFAVSRRTMMRRLSRRYGNVFTLRLPMWGPVVMVSDPQLAKQIFTTSPDELGNIQPNLSRLFGSGSVFGLEGDDHRRRRRLLAPPFHGKSMKNYESIIEEETLRETAGWPEGESFPTLPPMMRITLNAILRAVFGAEGAELDELRRLIPPWVTLGSRLAALPKPQRYPRFGPWGQLDRWRRQYDGVIERLIAAEQADPNFAERTDVLALLLRSTYDDGAAMSHKEIGDELLTLLAAGHETTASTLAWAFERISRHPELLARLVEEADNGGNELRQAAILEVQRARTVIDFAGRHVYPDVYRLGEWVIPRGYSIIVGIAQIHDNPDVFPDPRRFDPQRFIDNKPSALSWIPFGGGTRRCVGAAFANMEMDVVLRTVLRHFTIETTDAPDEPWHCRGVAFTPKHGGRIVVHRR

SEQ ID NO: 27031 - protein, 568 aa, Unknown
  Frankia sp. EAN1pec
MWAAVSSTTPSSSSATTAAITGSTWSASGSSARTGRGSSTPSRRSSTPRAPSPGCAATSWTACHRRPARPGCRGSGSGTRWRSSSRRTARRSCGPGTPPTTMSCSASSSGRCPRCRAGCRGSPETCASSGRTSAAPACPRRRPTRTTRWPTRGTTWPAGPSSRRCVPSSPRRRPGTPPTDGTISRRNVVDWPRRVYGEGLVGVSGELGCRRQMCRRSGATRAERPWGVKIGVLTGGGDCPGLNAVIRAVVRKGVGVYGHSFVGFRDGWRGPLENDTVPLDVTAVRGILPRGGTILGSSRTNPFASADGPSRIRETLDRTGVDAIVAVGGEDTLGAAARLHAEGIPVVGVPKTIDNDLSATDYTFGFDTAVNIAMEAIDRLHTTAESHHRVLVVEVMGRHAGWIALHSGMAAGANVILIPERPFDIDKVCAFVEQRFATRYAPIIVVAEGARPIAGTAMAREGELDAFGHVRLQGISGLLETEIRGRTGRETRATVLGHVQRGGTPTAFDRWLATRFGLHAVDAVHEGDFGTMVALHGTRIDRVPLSEATGELKTVPEHLYGEAEVFFG

SEQ ID NO: 27032 - protein, 318 aa, Blastopirellula marina
MEGKVMPRGKSYDDACSAIGDTPMIKINRLVPEGHATVFAKCEFFNPLNSVKDRIGYAMIADAEKSGKINQYTHIIEPTSGNTGIALAFVCAAKGYKLTLTMPESMSLERRALLRVMGANLVLTPAAEGMKGAINTAHEMVEKESGAWLAGQFDNPANPAIHEATTGPEIWEDSGENIDAIVAGVGTGGTITGVARYIKSKNPDFKAVAVEPTSSPVISGGAPGKHRIQGIGAGFVPKNLDTSVLDEVIKVDDEDAFEWGRQLAKQEGIVAGISSGATMWAAAQLAARPEMKGKRIAVIMASLGERYISTPLFGGLDG

SEQ ID NO: 27033 - protein, 772 aa, Zea mays
MDTPDRPRAGAGAGFEDSPVFNFINNLSPIPPPKPLDSAHNVQLFKSSDLAPVSSIFASPHVNPTKGTKVLIRDESVQLPHELHSPSSVRTRIGTSGSFRMIRCKDIVPENCNITCQLNEASIDSSDHTSSSTGQLTQSIKDAAGSMESDKDQCAGGKIDLTMSQECTGLEGMNLDESSPDRMDSSHSGIVVHENQLSEQNNDEPAAYNGVYMITHQSSSDMLTLAVPSGTEAQPMNDTQKADNPYPCESLLDVQSSGNCTQNSVHEPHLYWNGAVEGAAVAYTPQALPGALQSQLMPCNKLNEPKDYMPTEQNALSQHLRGMRRRSLFNEKAGLSNKGVDKASDHHPVNSTTPKCKTISGDNSKTLRTPPCALPGIGLHLNALAATATPKEKIVPQDIQSTINESSNLIGPAGSSPAPSEQNIINDDFTQTTDVATAEASSQGSPKKKRHKFDSGDGTSCKRCSCKKSKCLKLYCECFAAGVYCSEPCSCIGCMNNQSHTETVLSTRQQIESRNPLAFAPKVIHTSEPGLELRDFSNKTPASARHKRGCNCKKSSCLKKYCECFQGGVGCSISCRCEGCKNAFGKREGAAVLSIEEPKQGLEEKDVCVKEEKSEIEKQLVVYQTPDDAPAENVLTTPSMVQCRPLACRPPPSSKKSSKKPRSSTKLTGHPSRLCNLQAPPKTDTMLSPFENYAEMVLGDSTSDILKGNSSPQTSVKVVSPNKKRISPLRMGTGLSPICRSGRKLILKSIPSFPSLGGDVNNEDPETKLPAP

SEQ ID NO: 27034 - protein, 481 aa, Yarrowia lipolytica
MQRFTRLSRPLNRGLLRAYATKASPDTQMTQQTLYASDPEIADIIKKETDRQIGSITLIPSENFTSQAVMNALGSVMQNKYSEGYPGARYYGGNEFIDQAESLCQKRALEAFNLDPKVWGVNVQPLSGAPANLYAYSAVMEAGDRLMGLDLPHGGHLSHGYQIPSKKISYISKYFNTMPYRLDESTGLIDYDTLAKNILLFRPKVLVAGASAYSRLIDYKRMREIADSVGAILMSDMAHISGMVAAGVIPSPFEYSDIVTTTTHKSLRGPRGAMIFYRKDGDRNLEEKINFSVFPGHQGGPHNHTITALAVALGQAKSPEFKEYQQKVVDNAQAFSKALSDAGFKLVSDGTDTHLILIDLKPFSIDGARTEMVLDGMNIAANKNTVPGDKSALVPGGIRIGTPAMTTRGFDQSEFEQVAKYIVKAVDIAKRLKQKAVSEGVKKISQFRPYVDADAEVKELRNEVESWAKKYPFPIDPAGYK

SEQ ID NO: 27035 - protein, 249 aa, Brassica napus
MEVSNHARKRKAIDAGPNSPPSYRASDGYEPTNAVDLSLLEELEKSSHHQVEAVDLKTLKKLVLSFERRLRDNIAARLKYVENPEKFADSEVDLHDELQKLKILAGAPELYPELVASNTVPSIVNLLSHENADIANDVVQLLQDLTDEDALEDNDEPARVLVDALVENNVLELLVQNMNRLSEGDPDEAAAIYATLTVIENLVEVKPAVAEMVCERTKLLRWLVLKIKVRDFERDQADMLPRILAIRRR

SEQ ID NO: 27036 - protein, 420 aa, Rhodopirellula baltica
MSFIQSQDPAIWDAIQAETTRQQDGLEMIASENYTSPAIMEAVGSILTNKYAEGYPGRRYYGGCEHVDVVETIAIDRAKELFGAEAANVQPHSGSQANAAVYLSCLEVGDTVLGLDLAQGGHLTHGMKLNMSGRLYNFVNYGVDKVNHRLDFDQIVKLAREHKPKLIVAGASAYPREIPHDRFKEIADEVGAKLMVDMAHYAGLVAAKIHNSPVPYADYVTTTTHKTLRGPRSGLIMCKEEHLKLVNRNVFPGTQGGPLMHVVAGKAICFAEAMTEEYAHYGQAVVDNAKTLADTLLSCGLRLVSGGTDNHLMLVDVTAVDLGGKKAEAVLDACGITVNMNMIPFDQRKPMDPSGIRIGTPALTTRGMGGDEMKRIGQWIYNALSDSDNAALHESIRTEIREMVQAFPVPAAAESPATVA

SEQ ID NO: 27037 - protein, 135 aa, Agropyron cristatum
KSRPDALVQIAALAIRSGNGLLLKGGKEAMRSNTILHKVITSVIPDVVGKKLIGLVKSKDEIADLLKLDDVIDLVIPRGSNRLVSQIKAQTKIPVLGHADGICHVYIDKSADMDMAKRIVLDAKVDYPAACNAME

SEQ ID NO: 27038 - protein, 590 aa, Phanerochaete chrysosporium
MIPLRSAVASSLLLASLGAAQLPLPNPPWVPLNATFGTHPSNPSDGSGNPHWTNFLENTLYFYEEQRSGKLPVTNRVPWRNDSATDDGRDVGLDLSGGYYDAGDYIKYTFPMSFSVMSICWGALDYGKGYDLANQTAYLDDMLRWSLDWLMKAHPDPNTLYVQVGDADLDNAYWGGDRGIPTPRTSYAINSTSPGTDAAAQAAAAFAACSALYNNRTLSQPAPNGITSTSYASTLLQHAQQLYNFATNSSVPQVTYQASEPSVADAYASSGFQDELAIAALFISLAGNSSDAYPQASQVYRKQGLSKHLEDDAVFNWDEKSPGVALLAAQIAQKYPELANGTGVDWKSDLNNYFDRIVSNSGRSFLTSGGLLYYPGDSDDATLNPALNAAMLLLRYADSGLASSSEKQSAYRQFAQSQIDYFLGNNPMTVQYMVGVHPNAPSNPHSALATGATPQDIANIDTVPEHEAYVLYGGVVGGPNDDDLFWDLRSDWVESEVGLDYVAPVVTIAARELVSGAGDPWYTQLQAGSYEERRPGGQPCDAAISAGCRGHDWRVGKIVMGALVGVTGLVVLSLGTVWMVLAYRNRIRKI

SEQ ID NO: 27039 - protein, 322 aa, Streptomyces coelicolor
MSDVRNVIIIGSGPAGYTAALYTARASLKPLVFEGAVTAGGALMNTTEVENFPGFQDGIMGPELMDNMRAQAERFGAELIPDDVVAVDLSGEIKTVTDTAGTVHRAKAVIVTTGSQHRKLGLPNEDALSGRGVSWCATCDGFFFKDQDIAVIGGGDTAMEEATFLSRFAKSVTIVHRRDTLRASKAMQERAFADPKISFVWDSEVAEVQGDQKLAGLKLRNVKTGELSDLPVTGLFIAIGHDPRTELFKGQLDLDPEGYLKVDAPSTRTNLTGVFGAGDVVDHTYRQAITAAGTGCSAAVDAEPFLAALSDEDKAEPEKTAV

SEQ ID NO: 27040 - protein, 248 aa, Zea mays
MDNALRITDASSRRPTNLGKDLAMTEPAADRKCQSLVMENNAVKEKNPGEKSKSAVIGHADSYPSQFLETNLGKQQYRNGYKNQEFREKDIFNHSNSSAFSRYGNKRIEPSGEIQFFPSPCIIGQGHVHGKNPVFQPNGVLLPPNEHNTGESTRQARISLDSRTEGAAILCSTSAREDAGANSSSHRKDSMSHPSYGFIPVPIPVGATMPYHCGAILQPVYYPQGPLMHCNSSAINKATIHQTSGQSN

SEQ ID NO: 27041 - protein, 547 aa, Oryza sativa
MDPNRRAGGARAPWASRGPDRAGQPRRHHAAALLACHGDAAGVEALLRGGVDVNSINLDGRTALHIASCEGHPDVVRVLLTWKANIDARDRWGSTAVADAKCYGHTEVYNLLKARGAKIPRNRRTPMMVSNPGDVPEYELNPSELQFKKGDEVVKGVYQVAKWNGTKVHVKILDRECYCDQEVINSFRHELTVLEKVRHPNVVQFVGAVTQNIPMMIISEYLPNGDLSSCIPRKGKLHGQKVLKYGLEIARGMTYLHQCKPDPIIHCDLKPKNIFLDSGGQLKIAGFGLTRLSKISPGRVKLADHESMVDSFSHYTAPELYRNEIFDASVDAFSFGFILYEMVEGTHTVHGKSSEESGHTIRYDGMRPSLKNKLRGYPPDFKALIEECWDTQGNDTCGLSCMNAFLCTYHCEANASLSVKKKPELALTRLEEDDTTYRQICAGAAAVRAMEEGRGGDPPSSSSSAAAAAGVAIGYPFLEPQQGARLRRRRTISPFKKYFSRGFAIGMEIAFIVFGTIVHFPVWARIFLIISLSILPFSAFSITFQEY

SEQ ID NO: 27042 - protein, 369 aa, Unknown
  Synechococcus sp. RS9917
MTLRVVKVGTSLLRGDDGSSTSAVIGWLTDALAASLIQGDRTVLVSSGAVGLGCRRLGLSHRPDNVVALQAAAAVGQGHLMSLYEEAMARHGQPVAQVLLTRSDLADRRSYRTASATLHQLLDWGVLPVVNENDTVSSAELRFGDNDTLSALVAAAVEADELILLTDVDRLYTADPRTDANAHPITDVHHPAELARLQDGAGDGGRWGTGGMTTKLAAARIATASGITVHLADGRQPEVLKKLLSGGRGGTVFHPHPEPLGNRKSWLAHALRPQGDLRLDNGACNALEQRGASLLLVGITAVQGHFAANQPIRLLAADGREVARGLSSWSSEALQRALTQAPANASGSPVVVHRDALVLTTPTIRPQDT

SEQ ID NO: 27043 - protein, 178 aa, Glycine max
  misc_feature (53)..(53): Xaa can be any naturally occurring amino acid
  misc_feature (101)..(101): Xaa can be any naturally occurring amino acid
  misc_feature (125)..(125): Xaa can be any naturally occurring amino acid
MASSTISSPTVTTVNRAGAGMDAPFTGLKAMAGFLTTKTNNDITSIASTGGRXHCMQVWPPPGNKNIETLSYLPHLDDAQLAKEGQHLLKKGWIPCLELQXEHSCRYREHNRSPRYYDGRYCTMXNLPMFGCTDAYHALNELRDADTAYPNGFIRIIRCNIVEQVQCINFIAYKPPDF

SEQ ID NO: 27044 - protein, 567 aa, Unknown
  uncultured sulfate-reducing bacterium
MPELADKSDVVIIGGVAAGPKTAATLARRLPGARITLFQKEKHLSYAKCGFPFLASGELGSFDALVQTSYGVARDSGFFQSSKGFKTVTSAEVTQINRGKKTVSVRMCETGETFEHGYGRLVIATGSIPNRPPIPMPQSDRVRPFSSPADVTGFRDLAQRGEIDNVVIIGGGFIGVELCEAVGEMWGIGVKLFEKQPQLLPYMLDPEMAAIVQRSLAVQGVDALVDVEVEKVELDSQGKPVVFVKGREPTPADYVFLCLGVHPEGRLARESGLDVSENGAIRVDSALRTSDPDIFAGGDCIESVHRITKQPIYMPMGSLANRHGRVIAENLAGASVEFPGVVGAFVLRAFELNIGGVGLSEQTARGAGLESWSVWGSFPDRPDYNPEAKTLTLKMVYEQKTNRLLGLQAVGRGDICRRIDVFSALLHGEKAVEDLMDFEHGYAPPFAEALDPLHHMAAIAMTRERGVTFVSPDFVHAPVDRDTLVLDVREDEESASAPLPSEISKVFGEALHIPLGQLRERLHEVDRNRRILTICQRGVRSYQAALILQTAGFEDVHILSAGLQAQT

SEQ ID NO: 27045 - protein, 511 aa, Paenibacillus macerans
MDMTGRVYLVGAGPGDARLITLKGLDCIEKGDVIVYDRLANPSLLRKAKPGAEKIYVGKRTDRHTMKQEDISRLLVDLALAGKTVVRLKGGDPTVFGRGGEEAELLRKHGIPYEIVPGITAAISVPAYAGIPVTHRDLASSVSIIAGHESPDKLDLSINWEKVTNATGTLVFMMGVANIGYISKQLIAHGRPPETPVALVRWGTRAEQETLTGTLADIEQKVLDSGFKRRVTVVGEVVNQREQLLWAEAMPLFGKRILVTRSRSQASDLVRGIEELGGEPYEFPVIQISMPSGAALERTDEALSRLETYDWAFFTSVNGVDYFFKHLERLGKDIRALYKAIAAVGGHAGALRERGIAAEELPGRFQAEPCWKRTARSLCPAKAYCCRTGILPGRGCRSCAIKGWPSPRRSCMRRVPAGEKDEELIKLLEKGRIHAVTFTSSSTVTHLLAALSGMGVRPVAALRGREIACIGPVTARTAEEAGLRVSILAKEATIPSLIEALCDWKERGASV

SEQ ID NO: 27046 - protein, 204 aa, Brassica napus
MKKLKLMDHSSCRRGYQDPPSKATARTLNNNNNNPKKKRVVKEDLDDDKIVSKHPTYRGVRMRQWGKWVSEIREPKKKSRIWLGTFSTAEMAARAHDVAALAIKGGSAHLNFPELVYQLPRPASADPKDIQAAAAAAAAAVAVDMEVETSTSSPVSSEPSSPATTTLADDAFSDLPDLLLDVNHNIDGFWDSFPYEEPFFSGTY

SEQ ID NO: 27047 - protein, 518 aa, Unknown
  uncultured sulfate-reducing bacterium
MNYGNREGKVYLVGAGPGNPDLITVRARQVLDRCDAVVYDSLIPDELLVTLPLEVDRRYVGKKAGKHSLPQQEINDLLVRLASQGKHVVRLKGGDPFVFGRGAEEATYLQEHGIPYEIVPGITSGVAALSFSGIPCTDRLQASYVMFLTGHQAVEKAVSTVPWSWVAGARDGTLVIYMGVSEIESIVGELVGAGMSPDTPSAVVERGTISTQRALTAKLSELPRKVAESAIRPPALFVIGEVVKYHETLKWFQDRPLFGVRVMVTRPADQSVALYGDLRELGAEVLAYPTLATVEDFRSDDWDALRRIQEKERWVVFTSENGVRYFLEQWFATIGDIRGLNDYRIAAAGDGTARSLNANNLAPDFVPTRASMAALAQQMAEKVPMSKATVVRVRGNARNDPIERALRETGAQVVSLPVYRTFPTKWRSAVKEKLFAYPPDVILFTSGTAVDGLAANLSARELKELSSGAAVVSIGPATSRTIRTHGITVELESKVHTMPSLLEELVAHHRTTPLLKEK

SEQ ID NO: 27048 - protein, 536 aa, Unknown
  Oceanobacter sp. RED65
MLDDSMKQQLKAYLENLKTEVQLVLSLDESDTASKLKALANDIAALSDKVSVQEDDNASNRKPMMQVVNPEKQSKLGFAGVPMGHEFTSLVLALLHSGGHPMKLEQEVIDQVAAIDKKLDFEVFISLSCQNCPDVVQALNMMSVINPNITATMIDGSAFQEEVEAKNIMAVPSVFLNGELFSSGRMSLNDILKKVDTGASQREAKAISEKAPYDVLVIGGGPAGASAAIYAARKGIRTGLVAERFGGQVMDTMAIENFISVKATEGPKLVHGLEEHVKDYDVDIMAEQKVDAVVPADETEDGYIHVILENGARLKARSTIVTTGARWREMNVPGEQEYRNKGVAYCPHCDGPLFKGKKTAVIGGGNSGIEAAIDLAGIVEHVTVLEFADTLRADQVLIDKANSLPNVEIIKMAQTTEVEGDGTRVTGLNYKDRESGEIKHVEVAGIFVQIGLVPNSEFLKTSGIELSDRGEIVIGDRGETSKPGIFAAGDVTTVPYKQIIIAMGEGSRASLGAFDYLIRNPAPSKASSETELKESA

SEQ ID NO: 27049 - protein, 128 aa, Oryza sativa
  misc_feature (31)..(31): Xaa can be any naturally occurring amino acid
  misc_feature (46)..(46): Xaa can be any naturally occurring amino acid
  misc_feature (62)..(62): Xaa can be any naturally occurring amino acid
  misc_feature (70)..(70): Xaa can be any naturally occurring amino acid
  misc_feature (88)..(88): Xaa can be any naturally occurring amino acid
  misc_feature (97)..(97): Xaa can be any naturally occurring amino acid
MQTAASSVVGLSAVLPTAVKGRSLQIQAPPXAALGVRQAQASVSVXTPQVVYSCSMWVFPKXACDLIGGXAPHVQMYPEAKLSSSAEXDVYGPAFQXVDRKYISCDEPITVFPEQASDDLVGKFCKAA

SEQ ID NO: 27050 - protein, 410 aa, Clostridium perfringens
MNFDNLEREDEQIAHLVQKEKERQENSIELIASENFVSKAVMEAMGSYLTNKYAEGYPSKRYYGGCHVVDEVEDLARERVKKLFGAEHANVQPHSGSQANMAVYFSILESGDTVLGMDLSHGGHLTHGSPVNFSGRLFNFVSYGVDKETETINYETVRELALKHKPKLIVAGASAYSRIIDFKTLREIADEVGAYLMVDIAHIAGLVATGLHPSPVPYADFVTSTTHKTLRGPRGGLILCKEKFAKVLDKNIFPGIQGGPLMHIIAAKAVCFKEALEPSFKTYMEQVVKNAHVLAEALESYGFKLVSNGTDNHLILVDLTNKDITGKDAEILLDSIGITLNKNTVPNETRSPFVTSGVRIGTPAITTRGFKEEEMKEIASIINDAIKEKDGDLEPLKARVKALCAKYPLY

SEQ ID NO: 27051 - protein, 118 aa, Brassica napus
MIRKTPNLQNDIINIQERYSNNPVMDAGGGRNNRKNVNFRRPPAMTSENSKHELRRTFSSQKRLMIPANYFSLESLVILVGLTASLLILPLVLPPLPPPPFMLLLIPIGIMVLLIFLA

SEQ ID NO: 27052 - protein, 637 aa, Musa balbisiana
MSSPPPSPSATPPSTSPPPPSSLSPPPASNSPPPAPNAPPPPTPPSPPPASSPPPTPPPPADVPPPPVVTSPPPPDPPPPSVSPPPPALSPPPASTPPPPPSASPPPAAAPPPPPFATPPPTNSPPPPPSATPPPTISPPPPGSQSPPARAPSNSTGGTPPAPPKPPSPPSPSPSASHRAPADPISPSSNGSGIPTSDVGQKSGQSSGDGGMKAGPAVAVALVTAVVLLGLVGAITWIVRRKRRKPPANYESGFAMSSPYQSPSAPLVHHHNHHKSGSLASESMVASTIGSATSWFSYEELYEITNGFSPQNILGEGGFGCVYKGCLSDGREVAVKQLKVGSGQGEREFKAEVEIISRVHHRHLVSLVGYCISDNQRLLVYDYVPNGTLESHLHGKGGPAMDWATRVKVAAGAARGIAYLHEDCHPRIIHRDIKTSNILLDNKFEAQVSDFGLARLAMDACTHVTTRVMGTFGYLAPEYASSGKLTERSDVFSFGVVLLELITGRKPVDGTRPLGDESLVEWARPLLAHAIETGEFGELPDRRLEDAYDDTEMFRMIEAAAACTRHSAAMRPRMGKVVRVLDSLSDVDLHNGVKPGQSEVFNVGQTADIRLFQRLAFGSQEFSSEYSQSNWSRQSDL

SEQ ID NO: 27053 - protein, 418 aa, Streptococcus agalactiae
MIFDKDNFKEFDQELWQAIHDEEIRQQNNIELIASENVVSKAVMAAQGSVLTNKYAEGYPSHRYYGGTDCVDVVESLAIERAKTLFNAEFANVQPHSGSQANAAAYMALIEPGDTVLGMDLAAGGHLTHGASVSFSGKTYHFVSYSVDPKTEMLDYDNILKIAQETQPKLIVAGASAYSRIIDFEKFRQIADAVDAYLMVDMAHIAGLVASGHHPSPIPYAHVTTTTTHKTLRGPRGGLILTNDEAIAKKINSAVFPGLQGGPLEHVIAAKAVALKEALDPSFKIYGEDIIKNAQAMAKVFKEDDDFHLISDGTDNHLFLVDVTKVIENGKKAQNVLEEVNITLNKNSIPFERLSPFKTSGIRIGTPAITSRGMGVEESRRIAELMIKALKNHENQDVLTEVRQEIKSLTDAFPLYEN

SEQ ID NO: 27054 - protein, 435 aa, Mycobacterium avium
MGLQAPFRSGGGTSRPQGRAAPRAVDLRREVHDAARRARVASRVLALLPAVAKDQALRSAADAIAGHAELILSANAEDLETARAAGTPSAMLDRLALDTKRVEGIAAGLRQVAGLPDPVGEVLRGYTLPNGLQLRQQRVPLGVVGMIYEGRPNVTVDAFGLALKSGNAVLLRGSSSATRSNQALVQVLRASLVSEDLPADAVQLLSADDRATVTHLIQARGLVDVVIPRGGANLINAVVRDAQVPTIETGVGNCHVYVHEGADLEVAERVLLNSKTRRPSVCNAAETLLVDAAIAEEALPRLVTALQDAGVTVHGGFARDATEDDLRREYLSMDIAVAVVDGVDAAIAHINEYGTGHTEAIVTTNMAAAQRFTDGVDAAAVMVNASTAFTDGEQFGFGAEIGISTQKLHARGPMGLPELTSTKWIAWGDGQTRPA

SEQ ID NO: 27055 - protein, 302 aa, Musa balbisiana
MDVSLERRDAPPPPPTPPTSSTLSPTRSASNDDKTKLFPRPRPLPPPLPPRLVPHRPDLAVQSPTHPPPPVQSPLFLHLGVGNEVLRKDTLYISNLVPAMRNLQKALQNPGLEKQIKLSAPQAASSILGVTFPPSAGRFEMHLFPVTKQLLQFLSETESPLMVNVNPFDTYVDNPLEVALNYVLFGMNKALFHDDGKAYSNLFDATVDALVAAMQKQGFPKIPAAAYAQGIIDMVGKGVGTPMRPHDTVEVFLSNLFDRNKKEGKEFEKHSGIFNVDHISCSLPTYIINDIWTFEISFVNSK

SEQ ID NO: 27056 - protein, 1550 aa, Anabaena variabilis
MKAQLPDNEVQRIAALLEYKILDTQSEAAFDDITRLASYICGTPIALISLIDQNRQWFKSKVGLERRETPRDEAFCTYTILESDVFIVPDATTDERFATNPLVISDPKIRFYAGVPLTNPEGYSLGTLCVIDYIPRNLSPEQIEALQILGRQVIKQLELRRNLANLVLVNNQHKQAQKIRHPFFKKIAGGFGLASVILVLLGLASYQSEIELIHSSNQVQITQESINNLEKLLSQIKDAETGQRGYILTGKDLYLQPYQTALTNIDQKFAELKNTTVDQVQQQRLVILKPLITAKITELKQTIKLRQNQGFQTALQVIQSDKGQTLMDDIRKVMREMETEEKVRLQQQLQAVKASGQKVIVILAIAIVSGLIILAVVYYLIYCEVIARQSMENILNEERNFISAVLDTVSALVIVLDSQGRIVRFNQACEVITGYSFDEVRGRHFWNLFLLPEDVESSKASFAKFPTDSRVSGIQESENYWVTKDGSRRLIAWSRTILQNHEGSVEYIIGTGIDITERKRADKHLTIQYAITRVLAESTTITEATPQILQAICETLKWDVCEIWMVNQQGNFLSFFDLWDQTSLEMQEFKTQSQPITFASGIGLPGQIWASGQPIWLTDIADDASFLRNQLAAQVGLRGAFGFPIRSGQKILGVITCFSHQVQPHDPDLAKIMDSIGEQVGQFIHRKQAEEELQRQNLRSQLFTEITLKIRQSLQIEEILQITVKEVQKILQTDRVLIYQLLPDGSGSLIIEAVVAGWAAIKGQNITDFYLQTEYQQQYCLQQYRLRHLEAIANLDLAEIQQSHLELLRKFGVKANLVIPILVKDELCGLLIVHQCANSRQWTSFETHLLRQIADQVGIAVAQAQLLEVETRQRQELEVARSQAELASHAKSAFLANMSHEIRTPMNAVLGMTGLMLETLLNQEQRDFMETIRISGDALLTLINEILDLSKLEAGEMALENLNFNLSTCVEEVLDLLAPQAHSKGLEIAALIYRHVPIQLQGDASRLRQILMNLIGNAIKFTSFGEVVMRVELRSETPTTAIIHFAVTDSGLGITLEDQHKLFTPFTQVDASTTRKYGGTGLGLAICKQLVTLMGGEIGVESQLGKGSKFWFEIPFAKQLQPVSFVEDCGLLNNRRLLVVDDHATNRKIIYHQVSRWGMQVDQADRAVAALGMIVEACQQNKPYDVILIDMQMPEMDGMALGKQIKANSAIPPTPLIMLTSTNQRDEVQQAIKIGFAAYLVKPVKSSRLLDTIMSVLKTPSQLEAEKLEVKSQELEKNNLDHSRNRNFTATQAQNSVSTKTRILLAEDNLVNQKVALKQLQSLGYTADVAANGKEVLQLLKQIPYDLILMDCQMPILDGLETTKEIHRWAESSFASGRRPVIIAMTANAMKEDKQMCLDVGMDDYLSKPVMKEQLATALEYWCQLILNARQAVEFDIHSLPIDWEHLHQLSENDTEFELHLLQIFVEDVRARLELAKEAIANTDFQKMAQQVHQLKGASTNLGATAMYLAAERLEQLANNQERRGSMELITEIEESVNQIQAFLTRSQVV

SEQ ID NO: 27057 - protein, 415 aa, Yarrowia lipolytica
MEDDKTTATPPTEFVWKLYMMLEEGNDNTVFWTPDGRSFVISDTIEFSKTTLPRHFRHKNFSSFVRQLNKYDFHKVKSTNDDGEPVYGENGWEFKHPNFLQFDTSGIDSIRRKLPEKRRAEGPSGYRELEDELHDLKRKHESLQKHFTSLSEDFSNAIGKLSGLQESLKKKEETMNHVFSMLAEFEYRFERLGMSQDDTASFDHIKRRRTDPSAAAQAQAQAQAQAQAQAQAQAQAQATTNYDDHMWPSTTHTWLPLHPPQVRRDSNGKAHPDGHADNTAESTEIHQNGEVQKILIASDDSDCVKICSTLLQKAGQVVEVIPDGVDAVEFLQTSASHVGLVLMETVLPRLDGCSAVELIRSMNRQVPIIMINDGSVNPKLEFLLQSGYVNEVLARPFNKDDFFKAVSPHVSLASY

SEQ ID NO: 27058 - protein, 140 aa, Idiomarina baltica
MVRVEDLDASLRFYCDLLGLKEMYRKEVEAGRFTLVFLAAPEDEDAANENKAPMVELTYNWDPESYDGGRNFGHLAYEVDDIYALCKKLQDNGVTINRPPRDGRMAFVRSPDGISIELLQKGGAREPEAPWDTMENTGEW

SEQ ID NO: 27059 - protein, 308 aa, Moorella thermoacetica
MGRIYQNITQLIGGTPIVKLHRMNPSEAEVLVKLELFNPGGSIKDRIALAMIEDAEERGLLDKDTVIIEPTSGNTGIGLAMVAAARGYKLILTMPETMSQERRQLLKGFGAELVLTPGAEGMKGAIRRAEELAATYPRAFIPQQFENPANPAAHRHTTAAEIYDATDGQLDILVCGVGTGGTITGTGEVLKERIPGLQVVAVEPASSPVLSGGMAGPHKIQGIGAGFVPEILNIDVIDEIIQVTDEEAIDTARRLAREEGIMVGISSGAACWAALRLAARPENAGKRILAVLPDTGERYLSTSLFQEI

SEQ ID NO: 27060 - protein, 1037 aa, Ralstonia metallidurans
MKRMLFNATQQEELRVAIVDGQKLIDIDIETAGREQRKGNIYKGVITRIEPSLEACFVNYGEERHGFLPFKEVARAFFKDGVDVRNARIQDALHEGQELIVQVEKEERGNKGAALTTFISLAGRYLVLMPNNPRGGGVSRRIEGEDRQELRETMAQLQVPEGMSIIARTAGIGRAAEELQWDLNYLLQLWKAIDGAAGDNKAPLLIYLESSLVIRAIRDYFQPDIGEILIDTDEIYEQARAFMSVVMPDNMSRVKKYRDDVPLFSRFQIEHQIESAYSRMVMLPSGGAIVIDHTEALVSVDVNSARATKGADIEETALRTNLEAADEIARQLRLRDLGGLIVIDFIDMESGKAQKDVETRLKDALRHDRARVQMGKISRFGLMELSRQRLRPSLSEGSHITCPRCNGTGHIRDTESSALQVLRIIQEEAMKENTAAIHCQVPVEVAAFLLNEKRQEINLIELRFKVNVLLIPNKHLETPHYKLERLRHDDPRLEESTASYRMAEAAAKELEADTSYSSRKKEETRPRQEAAVKGITPDAPAPVSVPRPERVRPEAPAARPAPATQPVASGGFIAWLKGLFGAKPATPPEAPAKPAAETPSRGGEGRRERGQRGEGRGEGREGREGREGREGRGQRGERGEQRGDRQGRGQRGERSEQQRGEQREQREPREQRGERPARAPREGQATPAIAQPERAEARQEGRRERSQERRERQRERQRERNEARETDEALSTEAPQLAVGAAQVAPVAAAAAAAAAAAMVAVTTEADTTELPAGVEGAETGEGEERRRRNRRGRNRYRRDRDDTAQNAEGIDGDEANLAEVSAGVTESESESTGFQPAVAEADESVKAVETAVAVTPAEVAPAAPVAPVAPVASEPVFAAVAEPQAAPVVTPAPVETAPVVAAPVAAAPVISEPVIATPDVAPAPVAAPVAAPVAAPVAAPVAAVVETVAVVSAATQVTAAPSAENLEPMLAAAGLEWVRTDGDKHRAAQEAASQIVPAPRVPRERKPLPPLPEGPMVLVETGGVQQAAAQQQQQQQ

SEQ ID NO: 27061 - protein, 748 aa, Oryza sativa
MDTPDRPPRAAATAAVEMLRPFAAPDWGLIVLEVSIQDSPVFNFINSLSPIPPPKPSDSAHNVQLFKSSDLAPVSSIFASPHVNPAKESKLPIREDSVQLSRESHSPNSVRTRTGATSSIIRMIRCKNIVSENCSITCYLNDSTSSKASQPIQLCGGSAESDTNQNTDGKKDPTTEQDRTDIEFVLLDQCGPEKMDSSQSGNNACENQLSEQHKDELGSFDGGYMFAHQPHSDMLRLAPPFESETQLVNETLQTDNVYCETLLTDGPSGSYTQNSAPDPHLYWAGAVEGCATDYTPQMLPGACQSQLVPNDQINNKLNEPSDYMPMDHNVSSQNLRGMRRRCLFNEKSGAANEGAKNSSARHSTNSTTPRRKISSSDNNLKTLRTPPCALPGIGLHLNALATVPKDKMVPHNDIQSSLNQASNVPSAVGSSPPTDDPHTINDDSSQTAVVAYVGESSQGSPKKKRHKFDNGDGTSCKRCSCKKSKCLKLYCECFHAGVFCSEPCSCQGCLNMPSNMETVLSTREQIESRNPLAFAPKVIRTEPGQELAGGVGCSVSCRCEGCKNAFGRREGVALLGIEEAKRGCEEKDGGVKEETTDNDKQLVIYQDSINLTPAESVLATPSVVDYRPLVALPPLSSKKPRSSTKLGGYSSRLEGHLKSDILLSPFESYAEMMLGDGTSNVLKGESSPQTSVKVVSPNKKRVSPPRIGTGLSPICKSGRKLILKSIPSFPSLGVDITNEDPNTSSLAP

SEQ ID NO: 27062 - protein, 237 aa, Brassica napus
RCEVNPTLLKTTSSARKDPARMSGHYNTSNCIQPLCIEPSCRVPCFSPRLSSKPRKQRRPDPLTQQFRSLPQLVAEPTEARSNSFVGTHEYLAPEIVKGEGHGAAVDWWTFGVLLYELLYGKTPFKGYDNEETLSNVVFQNLKLPDSPLASFQAKDLIRRLVMKDPESRLGWEKGAAEIKRHPFFEGLNWALIRCAIPPELPDVYDNGATEATSPKGNSNGYLECKAMGDHLEFELV

SEQ ID NO: 27063 - protein, 226 aa, Ostreococcus tauri
MFIKFEKVKKLLNMLQSMLEAGVHFGHQSRRWNPKMAPYIYEEKNGIHILDVVQTIGELEKARTAFKSAKNVIFVGTRPAIAPLIEQVATKTGSNYVNTRWVGGLLTNWTTMTMCLEKLGRLDAQLETATPKKGFTKKDILSLTRERERLEKFFGGLRNLKTLPDLVVIVGQPNERNAVLECQKLNIPTITLLDSNCDPTFVSYGIPANDDSARSVAFILDQLTKD

SEQ ID NO: 27064 - protein, 204 aa, Brassica napus
MKKLKLMDHSSCRRGYQDPPSKATARTLNNNNNNPKKKRVVKEDLDDDKIVSKHPTYRGVRMRQWGKWVSEIREPKKKSRIWLGTFSTAEMVARAHDVAALAIKGGSAHLNFPELAYQLPRPASADPKDIQAAAAAAAAAVAVDMEVETSTPSPVSSEPSSPATTALADDAFSDLPDLLLDVNHNIDGFWDSFPYEEPFFSGTY

SEQ ID NO: 27065 - protein, 965 aa, Thermus thermophilus
MDPLWYKDAVIYQLHVRSFFDANNDGYGDFEGLRRKLPYLEELGVNTLWLMPFFQSPLRDDGYDISDYYQILPVHGTLEDFKRFLDEAHGRGMKVIIELVLNHTSIDHPWFQEARKPNSPMRDWYVWSDTPEKYKGVRVIFKDFETSNWTFDPVAKAYYWHRFYWHQPDLNWDNPEVEKAIHQVMFFWADLGVDGFRLDAIPYLYEREGTSCENLPETIEAVKRLRKALEERYGPGKILLAEANMWPEETLPYFGDGDGVHMAYNFPLMPRIFMALRREDRGPIETMLKETEGIPETAQWALFLRNHDELTLEKVTEEEREFMYEAYAPDPKFRINLGIRRRLMPLLGGDRRRYELLTALLLTLKGTPIVYYGDEIGMGDNPFLGDRNGVRTPMQWSQDRNAGFSRAPYHALFLPPVSEGPYSYHFVNVEAQRENPHSLLSFNRRFLALRNQHAKIFGRGSLTLLPVENRRVLAYLREHEGERVLVVANLSRYTQAFDLPLEAYQGLVPVELFSQQPFPPVEGRYRLTLGPHGFALFALKPVEAVLHLPSPDWAEEPAPEEADLPRVHMPGGPEVLLVDTLVHERGREELLNALAQTLKEKSWLALKPQKVALLDALRFQKDPPLYLTLLQLENHRTLQVFLPLLWSPQRREGPGLFARTHGQPGHFYELSLDPGFYRLLLARLKEGFEGRSLRAYYRGRHPGPVPEAVDLLRPGLAAGEGVWVQLGLVQDGGLDRTERVLPRLDLPWVLRPEGGLFWERGASRRVLALTGSLPPGRPQDLFAALEVRLLESLPRLRGHAPGTPGLLPGALHETEALVRLLGVRLALLHRALGEVEGVEGGHPLLGRGLGAFLELEGEVYLVALGAEKRGTVEEDLARLAYDVERAVHLALEALEAELWAFAEEVADYLHAAFLQAYRSALPEEALEEAGWTRHMAEVAAEHLHREERPARKRIHERWQAKAGKA

SEQ ID NO: 27066 - protein, 399 aa, Rhodospirillum rubrum
MPLQAIVSFLRLDIAAGVILVGAAVLALIAANSPAAALYEQVFQTPFVIGYGPWLLEKPLLLWINDGLMAVFFLLVGLEIKREVRGGELSTPRLAALPAVAAVGGMVVPALIYASLTWGDAFALRGWAIPAATDIAFALGILTLLGPRVPISLKIFLTALAIIDDLGAILIIAFFYTASLSPLALLLAAACLALLIGLNLSGQRRLWPYLLIGVVLWVCVLKSGVHATLAGVVLALTIPLGATDDESASADKPLERLEHGLHPWVTYAILPLFAFANAGVSLAGLPPSALLAPVPLGIVLGLFLGKQIGVFGFSWLAIRSGLAPMPQGARWRDLYGVALITGVGFTMSLFIGTLAFETSDPLAADFGTEVRLGVLSGSLLSGVIGYLVLRLSRRNPATE

SEQ ID NO: 27067 - protein, 621 aa, Zea mays
MGAALLASWPWDNLGFYKYVLYGPLVGKAVASRAWEAASPDRWILLLLLLFGLRALTYQLWSSFSNMLFATRRRRVVRDGVDFDQIDKEWDWDNFLILHALMAAAALCAFPSLRHLPAWDGRGFAVALVAHAAATEPLSYLAHRALHGSSGRLYARYHSLHHSSRVPQPFTAGLATPLEHVALGALMSLPLAAARAAGCASVALAFAYVLAFDSLRAMGHCNVEVVPASLFRAIPALRYVLYTPTYHAIHHTKKEANFCLFMPLFDLLGGTIDRRSWDMQRKMSAGVDEVPDFVFLAHVVDVMQSLHVPFVMRTFASTPFSVQLFLLPMWPFAFLVMLAMWVWSKTFVISCYNLRGRLHQIWAVPRYGFQYFLPFAKDGINRQIELAILRADKMGVKVLSLAALNKNEALNGGGTLFVNKHPDLRVRVVHGNTLTAAVILNEIPKGTAEVFLTGATSKLGRAIALYLCKKRVRVMMMTLSTERFQKIQKEAPAEFQQYLVQVTKYRSAQHCRTWIVGKWLSPREQRWAPPGTHFHQFVVPPIIGFRRDCTYGKLAAMRLPKDVRGLGACEYSLERGLVHACHAGGVVHFLEGYTHHEVGAIDVDRIDVVWEAALKHGLRPA

SEQ ID NO: 27068 - protein, 757 aa, Streptomyces antibioticus
  misc_feature (3)..(3): Xaa can be any naturally occurring amino acid
  misc_feature (9)..(9): Xaa can be any naturally occurring amino acid
  misc_feature (18)..(18): Xaa can be any naturally occurring amino acid
  misc_feature (63)..(63): Xaa can be any naturally occurring amino acid
  misc_feature (91)..(91): Xaa can be any naturally occurring amino acid
  misc_feature (142)..(142): Xaa can be any naturally occurring amino acid
  misc_feature (201)..(201): Xaa can be any naturally occurring amino acid
  misc_feature (216)..(217): Xaa can be any naturally occurring amino acid
  misc_feature (399)..(399): Xaa can be any naturally occurring amino acid
  misc_feature (402)..(402): Xaa can be any naturally occurring amino acid
  misc_feature (418)..(418): Xaa can be any naturally occurring amino acid
  misc_feature (481)..(481): Xaa can be any naturally occurring amino acid
  misc_feature (489)..(489): Xaa can be any naturally occurring amino acid
  misc_feature (507)..(507): Xaa can be any naturally occurring amino acid
  misc_feature (536)..(536): Xaa can be any naturally occurring amino acid
  misc_feature (582)..(583): Xaa can be any naturally occurring amino acid
  misc_feature (592)..(592): Xaa can be any naturally occurring amino acid
  misc_feature (619)..(619): Xaa can be any naturally occurring amino acid
ASXTGGQQXGRGSGSEFXENETHYAEAVIDNGAFGTRTIRFETGRLARQAAGSAVAYLDDDTXVLSATTASKNPKDQLDFFPLTVDVEERXYAAGKIPGSFFRREGRPSEDAILTCRLIDRPLRPSFKKGLRNEIQVVATIXALNPDHLYDVVAINAASASTQLAGLPFSGPIGGVRVALIRGQWVAFPTHTELEDAVFDXVVAGRVLEDGDVAIXXVEAEATEKTIQLVKDGAEAPTEEVVAAGLDAAKPFIKVLCKAQADLAAKAAKPTGEFPVFLDYQDDVLEALSAAVRPELSAALTIAGKQDREAELDRVKALAAEKLLPEFEGREKEISAAYRALTKSLVRERVIAEKKRIDGRGVTDIRTLAAEVEAIPRVHGSALFERGETQILGVTTLNXLRXEQQLDTLSPVTRKRYXHNYNFPPYSVGETGRVGSPKRREIGHGALAERAIVPVLPTREEFPYAIRQVSEALGSNGSTSXGSVCASTXSLLNAGVPLKAPVAGIAXGLISQEINGETHYVALTDILGAEDAFGDXDFKVAGTKEFVTALQLDTKLDGIPASVLAAALKQARDARLHILDVXXEAIDTPDEXSPNAPRIITVKIPVDKIGEVIGPKRQXINQIQEDTGAEITIEDDGTIYIGAADGPAAEAARATINGIANPTSPEVGERILGSVVKTTTFGAFVSLLPGKDGLLHISQIRKLAGGKRVENVEDVLGVGQKVQVEIAEIDSRGKLSLIPVIEGEEAASDEKKDDAEQ

SEQ ID NO: 27069 - protein, 226 aa, Glycine max
MLRCLEGLKPLFASILRCCDLDIYNQPRGLEDPELLARETVFSVSEIEALYELFKKISSAVIDDGLINKEEFQLALFKTNKKESLFADRVFDLFDTKHNGILGFEEFARALSVFHPNAPIDDKIEFSFQLYDLKQQGFIERQEVKQMVVATLAESGMNLSDDVIESIIDKTFEEADTKHDGKIDKEEWRNLVLRHPSLLKNMTLQYLKDITTTFPSFVFHSQVDDT

SEQ ID NO: 27070 - protein, 217 aa, Triticum aestivum
MGGRVDHEYSYLFKMVLIGDSGVGKSNILSRFTRNHFSLDSKSTIGVEFATKSLQMEGKTIKAQIWDTAGQERYRAITSAYYRGAVGALLVYDITKKQSFDNVNRWLRELRDHADSSIVIMMVGNKSDLTQLRAVSEDQGKALAEKEGLFFLETSAMEAVNVVEAFQTIITEVYGIVNKKALAAKEAAAAAVPLPSQGKTISIDSTAGNSKRACCNT

SEQ ID NO: 27071 - protein, 138 aa, Coprinopsis cinerea
MARTKQTARKSTGGKAPRKQLASKSAARKTATTAAGGVKKPHRFRPGTVALREIRRYQKSTELLIRKLPFQRLVREIAQDFKTDLRFQSSAVMALQEAAEAYLVSLFEDTNLAAIHAKRVTIQPKDLALARRLRGERS

SEQ ID NO: 27072 - protein, 431 aa, Salmonella typhimurium
MVSLEKNDRVMLARQLPLKSVALILAGGRGTRLKDLTNKRAKPAVHFGGKFRIIDFALSNCLNSGIRRIGVITQYQSHTLVQHIQRGWSLFSEEMNEFVDLLPAQQRMKGENWYRGTADAVTQNLDIIRRYKAEYVVILAGDHIYKQDYSRMLIDHVEKGARCTVACMPVPIKEATAFGVMAVDESDKIIDFVEKPANPPAMPGDASKSLASMGIYVFDADYLYELLAADDKDDASSHDFGKDIIPKITREGMAYAHPFPLSCVQSDPQAEPYWRDVGTLEAYWKANLDLASVTPELDMYDQNWPIRTHMESLPPAKFVQDRSGSHGMTLNSLVSGGCIISGSVVVQSVLFPRVRINSFCNIDSAVLLPEVWVGRSCRLRRCVIDRACIIPEGMVIGENAEEDARRFYRSEEGIVLVTREMLRKLQVKQER

SEQ ID NO: 27073 - protein, 97 aa, Arabidopsis thaliana
  misc_feature (19)..(19): Xaa can be any naturally occurring amino acid
MGRFTVAASTVSAARAGLXLKSIAAISVPVFGLRLMGMKKGGVRVCNDVGEKQGRTSLDHGGVETLSAGQQVVGGGGGQTGMALAGGRVVTKGPGYP

SEQ ID NO: 27074 - protein, 259 aa, Oryza sativa
MWQPSHKLEVGPYCKITIHESAMAGRGGGGELRLLGTWSSPWVIRVRVALGMKGLSYEYTEEDLSSKSDHLLRSNPVHEKVPVLIHGGRPVCESLVVLEYIDETWGATGTPQLLPADPYDRATARFWTNYVNDTFFPSWKVLFRSTAAEQRAEAFKNVVPRVEALERAFGECSKGKAFFGGDDAGLVDVALGSHLVWIKVVDEVAGANLLDEAKFPGLAAWAERFLAVDAVRQVMPDAGDVLKQYKGFLAKWTAGAGSS

SEQ ID NO: 27075 - protein, 658 aa, Salmonella typhimurium
MTQLAIGEATPHGATYDGHGVNFTLFSAHAERVELCVFDSRGNERRYDLPGRRGDVWHGYLAGARPGLRYGYRVHGPWQPAQGHRFNPAKLLLDPYARRVEGELKDHPLLHGGHDEPDYRDNAAVAPKSVVISDHYDWEDDAAPRTPWGKTVIYEAHVKGLTYLHPELPQEIRGTYKALGHPVMVAYFKQLGITALELLPVAQFASEPRLQRMGLTNYWGYNPMAMFALHPAWASSPETALDEFRDAVKALHRAGIEVILDIVLNHSAELDLDGPTFSLRGIDNRSYYWIRDDGDYHNWTGCGNTLNLSHPGVVEYACECLRYWVETCHVDGFRFDLASVMGRTPTFRQDAPLFAAIKACPVLSTVKLIAEPWDIGEGGYQVGNFPPPFAEWNDHFRDAARRFWLPRNLTTGEFACRFAASSDVFKRNGRAPGASVNLLTAHDGFTLRDCVCFNQKHNEANGEENRDGTNSNYSDNHGKEGLGGPLDLMERRRDSIHALLATLLLSQGTPMLLAGDEHGHSQHGNNNAYCQDNALTWLDWQQANRGLTTFTAALIRLRQQIPALTGNSWWEEGDGNVRWLNKNAQPLSADEWQNGPKLMQILLSDRFLIAINATLEVTDIVLPEGEWRAVPPFAGEDNPVITAVWQGPAHGLCVFQRG

SEQ ID NO: 27076 - protein, 776 aa, Coprinopsis cinerea
MLSPCKTKEKKFVVVELCDDIRIDTVQLANYEFFSGVFKDFSVSVAKTYTDSEGWTQAGTYRAKNVRGVQTFRFPETLRDFYRYIRIDFHSHYGNEYYCPVSLLRVYGLTHLEEWKWDIWMAESKAKQAEALNIKPLSIEAQLSDETAESTGREGPSSRTENEHGGIDATIIETLAALSSKAAELSQPVSSDLASAIPDVPPSNHNIHPYSPPPPKPAEPYSHELHDPPSHHDSYIPSHSTDTFASPGSGSPHSATNTAPSVPQPPPTASAPSSSTAVATSAVSTSTRASPSDSPVHGKAHNNTSSSQRSSSQGPSSVIILSSASAAPSHPTGVPPIHATTGGESVYRTIMNKLTALETNYTLYTRYMDQQNGAIRELIKRLGEDIGRLEGVTRAQRTHSQKMLNEWEKQRLQMLIEYNQLVSRVEHLSEEILLEKRLGVAQLCLMLAVLIFMGLTRGSRGEAIVVNGPTSMREWGKRHLSLSGDWTSRFRRKSNAGHSAAIRSRPLTAKPASPSKKSAAATDVEGKVEFPSTDDAPLKKRPLEPIQVNNADTPTSSRVKKLSLTRSRTPSLRTNGTGKRVPHTAHIPRPQTPTPIRPVFHHRDLGSHSLQRSSSHGAQLSSGRSAKSAKKWARTAHLHPVKTPFYPQTNSEAFAQSYDGSNPSVGAGGSNASDLGYQDVFSAPAGSFAFPKKAVRERDLPGTGNTQELSLTRDSLEIWDSKDHGWRKRRPSAAGRSSENVVAEKLEDADAENNWIDTDSVVDSSDVDSMGLSGQL

SEQ ID NO: 27077 - protein, 466 aa, Francisella tularensis
MGSKAENLVVFHLVGSPGDGAVGKKRQVHHTLGDGVFGNFFDLSASAACVSAVITPENARREMNRVIAEAFKYRKPAYISVSLDSGNRPVTDITPDDIDCSYLKSDSHQLELATNLVLEHLSKAKKVVAIPAIKLDRFGVTEKAINLIEKLNIPFSIMPHDKSVISETHPNYVGFYAGLLSDTNTAEIVEGADLIINLGDALWSDFNTAGFTNNLDLNKVLNLGPLFVEDNKTYLADVYLSELLDALLEKVESINYRPNYSRMKIQDTTITKEKLTLRALYTQVLKFLENTDSLVVETGSSSLNMPKLPLPEGVKYFNQTLWGSIGWATPAALGVALANPDSRTILITGEGSHQLTLNELGVMGRYKINPIILCINNDGYMIERALELDPNPSYDDIAQLNYTKLPEAFGCNDWLAIRVKTSEELAEALKKAREHQSGVYIEVITGKYDYGNAFDFFNNHLKEMYS

SEQ ID NO: 27078 - protein, 403 aa, Candida glabrata
MSNRAVPQGYLANLQFRIRSDNLPLLSTVQPSRGHKRGGRAVNYAEFDNELLEDFSNFPTFDIDSDSNDEEQSSASAGNDDPQANANGGEAAGVNGQGSGDGGSANTGAGRHGKSQLTAEMEKNYKTGVPDLNEQKDSLNVLRYQKIRESFQHGKIAVPYRLYVPPELSTGQQEAILIPITLNVEHGNNTISDAFVWNVNDTSISVEDFVTTYCNDLGLYGNVSLHSQIVSSINEQIQELENVASLVIPDLEVVVNLTCTIQGKFFEDYFQWNLSDKSLSPEKFALIIVADLGLAREFAPGIAHSLHEYLLHVKKEWAEGSLHQDTVPNEAAFGYLAGVRLNIDDLGAKWAPKVEYLTQEEIQKREIEKERNMRRLKRESDRMGGGARRGRRRLDDLELTMKM

SEQ ID NO: 27079 - protein, 337 aa, Oryza sativa
MAKHGVAFILTLALVLGVLAVTPKVVQSIGVCYGVNGNNLPSPSDVVKLYQSKGIDSMRIYFPRSDILQALTGSNIALTMGVANENLSAFASDPSAVANWVKQNVQVYPGVNFRYIAVGNEVESGNTQNVLPAMQNMNSALSAAGLSNIKVSVSVSQKGVLAGYPPSNGMFSPEATSYMTPIAKYLASTGAPLMANVYPYFAYVGNLRAQIDDINYALFTSPGTVVPDGSKAYQNQFDAIVDTFYSALESAGAGSVPIVVSESGWPSAGGTAASASNAQTYNQNLIKHVGQGTPKRPGRIETYIFAMFNENDKRGDETERHFGLFNPDQSPAYTINF

SEQ ID NO: 27080 - protein, 85 aa, Unknown
  Azoarcus sp. BH72
MAKEELLEMSGTVLEVLPDARYRVTLDNGHSLVAYGAGKMRKHHIRIIAGDKVLLELSPYDLSKGRITFRHIEGRAPMTSRHQKR

SEQ ID NO: 27081 - protein, 469 aa, Thermotoga maritima
MKSHIGLIGLAVMGQNLALNIARKGYKVSVYNRTAQRTEEFVKNRVTNEEIEPHYDIESFVKSLERPRKIILMVKAGKPVDDTISQLLPHLEPGDLIIDGGNSHYMDTERRFKELSEKGILFLGMGVSGGEYGALHGPSLMPGGSREAYNLVEEILLEIAAKTEDGPCCTYVGERSAGHFVKMVHNGIEYAIMQAIAEVYHIMRDVLSLSSEEMSSIFEEWNRGELSSFLVEITYKILRKKDEETGKPMVDVILDKAEQKGTGKWTSQAALDLGIPTPSINLAVVERVISHFKDIRTRLSKLYNKRRSATQGSEEFLRDLRNSLFFAMFMAFSQGMWLIAEASKEFGYGVSLSEVLRIWKGGCIIRAKLIDTLRRYISNENAYLLENEEVMNLLKGKIDSLKNILKASIENEIPVPVLSSSYNYFMSLTEERLPANLIQAQRDFFGAHTFERVDREGVFHINWEEGEIG

SEQ ID NO: 27082 - protein, 471 aa, Synechococcus elongatus
MALQQFGLIGLAVMGENLALNIERNGFSLTVYNRTAEKTEAFMADRAQGKNIVPAYSLEDFVASLERPRRILVMVKAGGPVDAVVEQLKPLLDPGDLIIDGGNSLFTDTERRVKDLEALGLGFMGMGVSGGEEGALNGPSLMPGGTQAAYEAVEPIVRSIAAQVDDGPCVTYIGPGGSGHYVKMVHNGIEYGDMQLIAEAYDLLKSVAGLNASELHDVFAAWNKTPELDSFLIEITADIFTKVDDLGTGQPLVELIIDAAGQKGTGRWTVETALEIGVAIPTIIAAVNARILSSIKAERQAASEILSGPITEPFSGDRQAFIDSVRDALYCSKICSYAQGMALLAKASQVYNYGLNLGELARIWKGGCIIRAGFLNKIKQAYDADPTLANLLLAPEFRQTILDRQLAWRRVIAIAAERGIPVPAFSASLDYFDSYRRDRLPQNLTQAQCDYFGAHTYERTDRSGSFHAQWF

SEQ ID NO: 27083 - protein, 216 aa, Yarrowia lipolytica
MQRVRDSTWSHINSVVMIGDSGVGKTNILGRFTRDEFNLDSKSTIGVEFATRTVNIDNKIIKAQIWDTAGQERYRAITSAYYRGAVGALLLYDVTSTQSYKNISRWLQELQDHADSNIVLMLVGNKCDLKHLRAVPTEEAKQFASQNKLLFIETSALDGTDVALAFRNILTEIYHRVSAAENVHANLEDSRKPQQGTTISLTPQPGDSDKKSSSCC

SEQ ID NO: 27084 - protein, 255 aa, Thermotoga maritima
MKEVFDLRGRVALVTGGSRGLGFGIAQGLAEAGCSVVVASRNLEEASEAAQKLTEKYGVETMAFRCDVSNYEEVKKLLEAVKEKFGKLDTVVNAAGINRRHPAEEFPLDEFRQVIEVNLFGTYYVCREAFSLLRESDNPSIINIGSLTVEEVTMPNISAYAASKGGVASLTKALAKEWGRYGIRVNVIAPGWYRTKMTEAVFSDPEKLDYMLKRIPLGRTGVPEDLKGVAVFLASEEAKYVTGQIIFVDGGWTAN

SEQ ID NO: 27085 - protein, 554 aa, Pseudomonas aeruginosa
MKHHLTPLDATQLDSWRALAAHRQELQDFRMRQAFIDDPERFKRFSFSACGLFLDFSKNLIRQDTIDLLVKLAEEARLSDAIRAMFDGEAINASERRPVLHTALRRPIGDKVLVDGVDVMPEVHRVLHQMTELVGYVHNGLWRGYTEKPITDVVNIGIGGSFLGPQLVSEALLPFAQKGVRCHYLANIDGSEFHELASRLNAETTLFIVSSKSFGTLETLKNAQAARAWYLAQGGTEEELYRHFIAVSSNKEAAIAFGIREENIFPMWDWVGGRYSLWSAIGLPIAMSIGISNFKELLSGAYNMDQHFQTAPFERNIPVLLGLLGVWYGDFWGANSHAILPYDYYLRNITDHLQQLDMESNGKSVRQDGTPVTSGTGPVIWGGVGCNGQHAYHQLLHQGTQLIPADFIVPVSSYNPVADHHQWLYANCLSQSQALMLGKSREEAEAELRAKGLPEAEVQRLAPHKVIPGNRPSNTLVVERISARRLGALIAMYEHKVYVQSILWGINAFDQWGVELGKELGKGVYSRLVGSEETPAEDASTQGLIDFFRGRHRG

SEQ ID NO: 27086 - protein, 566 aa, Geobacter sulfurreducens
MKMTGARILLECLKLEGVDTVFGYPGGTVINIYDELFSFKEIRHILPRHEQAGVHAADGFARATGRVGVAIATSGPGATNTVTGIATAYMDSIPVVVITGQVPTALIGNDAFQEVDIVGITRPCTKHNFLVKDVKDIPSIIKKAFYIARTGRPGPVLVDLPKDVQIATAEFHYPDSIELRSYKPTVEGHPKQIEKAVSLMLEAKKPVIYVGGGVISGDAAGELYDFAKKLNMPVTTTLMGLGSFPEDDHQALRLLGMHGTYYANMAVTNCDMLFAVGARFDDRVTGKVATFAPHAKIIHVDVDPTSIRKNVRVDLPIVGEVKKVLSQMLKVLEEQGDKVERFRTGIEPWMAEIEGWKQKHPMTYKQTTSVIKPQYVIQKLRELSEPDAIIATDVGQHQMWTAQFFTFTKARTLLSSGGLGTMGYGLPAAMGAQAAYPDRQVIAICGDGGFQMNMQELATLVQNRLPVKICILNNNFLGMVRQWQELFFDRRYSQTCMELPIDFIKLAEAFGATGLQASKVDEVEGTIKKAFETPGPVIMEFKIAREEKVLPMVPAGASLNEMVLNA

SEQ ID NO: 27087 - protein, 430 aa, Bacillus licheniformis
MKTTINQVYKHVGEEVTIGAWIANKRSSGKIAFLQLRDGTGFIQGVVVKAEVDEETFQTAKSVTQETSLYVKGVVKEDERSPLGYELAVTSLEVIHEATDYPITPKEHGTEFLMDHRHLWLRSKRQHATMKIRNEIIRATYEFFNKEGFVKVDPPILTGSAPEGTTELFATKYFDEDAYLSQSGQLYMEAAAMALGKVFSFGPTFRAEKSKTKRHLIEFWMIEPEMAFVEFNENLEVQENYVSFIVQSVLENCKIELNTLGRDTSKLELIKAPFPRITYDEAIQFLKEKGFDDIEWGDDFGAPHETAIAESYDKPVFITHYPTSLKPFYMQPAPDREDVVLCADLIAPEGYGEIIGGSERIHDLELLEARLKEHGLESDAYQWYAELRKYGSVPHSGFGLGLERTVAWICGSPHVRETIPFPRLLNRLYP

SEQ ID NO: 27088 - protein, 655 aa, Idiomarina baltica
MKETLSVPNPEQIGNQNFAELLAAGNSVCLFVWQDSELWPVRYVSDNVESIFGYNKQQFIDREVHFKFLIHEDDLPRVNEEVKRLKSGETGFRITHNDYRIKHKNGRHVWVSDTTIIKMDTDDGVPLLFGYLIDITERKELEIKLETERNRLQLLLDATRLGTWEWNPQSNLTSFNDRWAQIFGWSREEIEQSPYSWSSRLHPDDYDRVWRAVKDHLDGITPFYESQHRIRHRDGHYVYVLDRGRVIERDEHGKATRYAGTVTDVTEQKQAEINARRAASAKNVFLANMSHEVRTPLHGILGLVSVLENTALDTHQHQLLMTVKESGDHLLQMLNDLLDLTRSEEGQLKLNKDVLELARILQHIESMYRAPIEEKGVKFIIHHSQVLPERIFSDRARLIQILTNLLNNAVKFTEQGTIMLSIDWSVDPATTTQTQAQGELLIKVRDTGAGIRDTQRIWQLFEQEHQGLSKKQSGSGLGLAIVRNLVQLLDGEIEVDSEPNRGTCFSLRLPMYAVYSDDVNHEALDKPKLPTLVPRRILIVDDNPINQLIVSEMLTSLDQHVTKVSSGHEAVEMLKQNTVDVVFMDLHMPTMDGIETTLKIRDLPIHQPHIVALTANAYPETRTHALRSGMDDYLTKPFVKADLARILNRLDKVKN

SEQ ID NO: 27089 - protein, 266 aa, Trifolium pratense
MAASSMALTSPALAGKPVKLTPSSQELGVAKFTMRKGATTKKVASSGSPWYGPDRVKYLGPFSGEPPSYLTGEFPGDYGWDTAGLSADPETFAKNRELEVIHSRWAMLGALGCVFPELLSRNGVKFGEAVWFKAGSQIFSEGGLDYLGNPSLVHAQSILAIWATQVILMGAVEGYRIAGGPLGEVVDPLYPGGSFDPLGLADDPEAFAELKVKELKNGRLAMFSMFGFFVQAIVTGKGPLENLADHLADPVNNNAWAFATNFVPGK

SEQ ID NO: 27090 - protein, 78 aa, Ostreococcus tauri
MASNRELIEMEGVVVESLPNAMFQVELENGFQVLAHISGKIRRNSIKILLGDRVTVELTPYDLTKGRIIYRLRKDRTQ

SEQ ID NO: 27091 - protein, 239 aa, Prochlorococcus marinus
MAVVTLSEMMEAGAHFGHQTRRWNPKMSRYIYCARNGVHIIDLVQTAICMNNAYKWTRSSARSGKRFLFVGTKKQASEVVALEATRCGASYVNQRWLGGMLTNWTTMKARIDRLKDLERMESSGAIAMRPKKEASVLRRELERLQKYLGGLKGMRRLPDVVVLVDQRRETNAVLEARKLDIPLVSMLDTNCDPDLCEVPIPCNDDAVRSVQLVLGRLADAINEGRHGTNEQRGADDNDD

SEQ ID NO: 27092 - protein, 220 aa, Zea mays
MGRRPARCYRQIKNKPYPKSRYCRGVPDPKIRIYDVGMKRKGVDEFPYCVHLVSWEKENVSSEALEAARIACNKYMTKSAGKDAFHLRVRVHPFHVLRINKMLSCAGADRLQTGMRGAFGKPQGTCARVDIGQVLLSVRCKDNNAAHASEALRRAKFKFPGRQKIIESRKWGFTKFSRADYLKYKSEGRIVPDGVNAKLLGNHGRLEKRAPGKAFLEAVA

SEQ ID NO: 27093 - protein, 244 aa, Solanum lycopersicum
MATVSSASAALRTISSSSSKLSSAFQTKKIQSFKLPNPLISQNHKLTTTSTTASRSFSCKSQSTSTDSTNTEVQELSVYEINERDRGSPAYLRLSQKTVNSLGDLVPFSNKLYTADLKKRIGITAGLCILIKHEEEKKGDRYEAVYSFYFGDYGHIAVQGAYLTYEETYLAVTGGSGIFAGVSGQVKLQQLIFPFKLFYTFYLKGIPGLPSELLCTAVPPSPTVEPTPEAKACEEGAALKNYTN

SEQ ID NO: 27094 - protein, 251 aa, Arabidopsis thaliana
MVNATVARNIAGICGNVISLFLFLSPIPTFITIYKKKKVEEYKADPYLATVLNCALWVFYGLPMVQPDSLLVITINGTGLAIEVVYLAIFFFFSPTSRKVKVGLWLIGEMVFVGIVATCTLLLFHTHNQRSSFVGIFCVIFVSLMYIAPLTIMSKVIKTKSVKYMPFSLSLANFLNGVVWVIYALIKFDLFILIGNGLGTVSGAVQLILYACYYKTTPNDDEDEEDEENLSKVNSQLQLSGNSGQAKRVSA

SEQ ID NO: 27095 - protein, 211 aa, Pisum sativum
PDVTYNDVGGCKEQIEKMREVVELPMLHPEKFVKLGIDPPKGVLCYGPPGTGKTLLARAVANRTDACFIRVIGSELVQKYVGEGARMVRELFQMARSKKACIVFFDEVDAIGGARFDDGVGGDNEVQRTMLEIVNQLDGFDARGNIKVLMATNRPDTLDPALLRPGRLDRKVEFGLPDLESRTQIFKIHTRTMNCERDIRFELLARLCPTP

SEQ ID NO: 27096 - protein, 614 aa, Coprinopsis cinerea
MASFGTSFSFGSAVSATGSAFSDAFESYRRAQYLVAGSAVAPTSEASDLEDEDEETGFSSRRHTAVEESDDEYDPDDYRQRMQMRPRDDSFVGQLDWDEDQHDAVFPASPLRRPSRPRYDTQQTVQLHQSITPRVEEIRKAHESTPLLSQKSSSIQEQLSIHEPVKDHGILVQTQDPSHLAPPSSLRRRSSAASHGSRSIHYSFGGRSTYGQTLFNSIAILLGIGMLSEPLAFAYAGWAAGTILIILYALISCYTAKILARIILSDPRLRSYSDIGRKAFGPRATGIISFMFCLELFAVTVVLVTLYADSLHTLIPAYSEDMYKLLGLIVLIPTVFMPLSLLSYTSILGIISTVMLVFVIFIDGFTKTDAPGSLWDPAPTRIGIQSYNKLGLAFGLFMAGFSGHPVIPSLARDMADPSQFDNMINWAFIIATFIYIAIGAAGYLMFGDSVHDEISIDLLNTPGYPAFLNHFCLWLLVISPLSKFGLNTQPLTTTIDLLLGLDTTTIASPEDLAAKPEGLSISPHGSHIMIKRFLAIFQRIFMTVMSVMVSILIPEFSSMMAFLGSFSAFMLAVVGPVLAKVAIAGRCGSVDGAIIVVGVVMAVWGTLAAFWATS

SEQ ID NO: 27097 - protein, 847 aa, Medicago truncatula
MAMAVAQQQRDNSIERHLDSSGKYVRYTAEQIEALEKVYVECPKPSSLRRQQLIRECPVLANIEPKQIKVWFQNRRCREKQRKEASQLQSVNRKLSAMNKLLMEENERLQKQVSQLVNENGFMRQQLHPTPAAPNADGSGVDSAAAAPMNSLRDANSPAGFLSIAEETLTEFLSKATGTAVDWVQMPGMKPGPDSVGIFAISQGGNGVAARACGLVSLEPTKIVEILKDRPTWYRDCRSSEVFTMFPAGNGGTIELVYTQTYAPMTLASARDFWTLRYTTNLENGSVVVCERSLSGTGAGPNAAAASQFERAEMLPSGYLIRPCEGGGSIIHIVDHLNLQAWSVPEVLRPIYESSQMVAQRLTIAALRYIRQVAQETSGDVVYSMGRQPAVLRTFSQRLSRGFNDAVNGFNDNGWSVLNCDGAEGVTISVNSIKNLSGTSNPASSLSLLGGIVCAKASMLLQNTTPAVLVRFLREHRSEWADFSVDAFSAASLKAGSYGYPGMRSTKFTGNQAIMPLGHTIEHEEMLEIIRLEGLAQDDSFVSRDVHLLQVLPLTLVMLCTGIDENAVGACSELIFAPIDDMFPEDAPLVPSGFRIVLLNSQPGDTKNTTTANRTLDLTSGLEVSPATAHANGDASCPNNRCVLTVAFQFPFESGLQDNVAAMARQYVRRVVSAVQAVATAISPSSVNTSGGAKLSPGTPEALTLAQWICQSYSHHLGAQLLRSDSLIGDMLLKHLWHHPDAILCCSLKQVPVFIFANQAGLDMLETTLVALQDITLDKIFDESARKNLIAYFAKLMQQGFACMPAGICMSTMGRHASYDQAVAWKVHAEDNSVHCLAFSFINWSFI

SEQ ID NO: 27098 - protein, 305 aa, Coprinopsis cinerea
MQIFVKTLTGKTITLEVESSDTIDNVKAKIQDKEGIPPDQQRLIFAGKQLEDGRTLSDYNIQKESTLHLVLRLRGGMQIFVKTLTGKTITLEVESSDTIDNVKAKIQDKEGIPPDQQRLIFAGKQLEDGRTLSDYNIQKESTLHLVLRLRGGMQIFVKTLTGKTITLEVESSDTIDNVKAKIQDKEGIPPDQQRLIFAGKQLEDGRTLSDYNIQKESTLHLVLRLRGGMQIFVKTLTGKTITLEVESSDTIDNVKAKIQDKEGIPPDQQRLIFAGKQLEDGRTLSDYNIQKESTLHLVLRLRGGN

SEQ ID NO: 27099 - protein, 373 aa, Staphylococcus epidermidis
MAKRDYYEVLGVNKSASKDEIKKAYRKLSKKYHPDINKEEGADEKFKEISEAYEVLSDENKRANYDQFGHDGPQGGFGSQGFGGSDFGGFEDIFSSFFGGGSRQRDPNAPRKGDDLQYTMTITFEEAVFGTKKEISIKKDVTCHTCNGDGAKPGTSKKTCSYCNGAGRVSVEQNTILGRVRTEQVCPKCEGSGQEFEEPCPTCKGKGTENKTVKLEVTVPEGVDNEQQVRLAGEGSPGVNGGPHGDLYVVFRVKPSNTFERDGDDIYYNLDISFSQAALGDEIKIPTLKSNVVLTIPAGTQTGKQFRLKDKGVKNVHGYGHGDLFVNIKVVTPTKLNDRQKELLKEFAEINGEDINEQSSNFKDRAKRFFKGE

SEQ ID NO: 27100 - protein, 839 aa, Oryza sativa
MAAAVAMRGSSSDGGGYDKVSGMDSGKYVRYTPEQVEALERVYADCPKPTSSRRQQLLRECPILANIEPKQIKVWFQNRRCRDKQRKESSRLQAVNRKLTAMNKLLMEENERLQKQVSQLVHENAHMRQQLQNTPLANDTSCESNVTTPQNPLRDASNPSGLLSIAEETLTEFLSKATGTAIDWVQMPGMKPGPDSVGIVAISHGCRGVAARACGLVNLEPTKVVEILKDRPSWFRDCRNLEVFTMIPAGNGGTVELVYTQLYAPTTLVPARDFWTLRYTTTMEDGSLVVCERSLSGSGGGPSAASAQQYVRAEMLPSGYLVRPCEGGGSIVHIVDHLDLEAWSVPEVLRPLYESSRVVAQKMTTAALRHIRQIAQETSGEVVYALGRQPAVLRTFSQRLSRGFNDAISGFNDDGWSIMGGDGVEDVVIACNSTKKIRSNSNAGIAFGAPGGIICAKASMLLQSVPPAVLVRFLREHRSEWADYNIDAYLASTLKTSACSLPGLRPMRFSGSQIIIPLAHTVENEEILEVVRLEGQPLTHDEALLSRDIHLLQLCTGIDEKSVGSSFQLVFAPIDDFPDETPLISSGFRVIPLDMKTDGASSGRTLDLASSLEVGSATAQASGDASADDCNLRSVLTIAFQFPYELHLQDSVAAMARQYVRSIVSAVQRVSMAISPSQTGLNAGQRIISGFPEAATLARWVCQSYHYHLGVELLSQSDGDAEQLLKMLWHYQDAILCCSFKEKPVFTFANKAGLDMLETSLVALQDLTLDRIFDEPGKEALFSNIPKLMEQGHVYLPSGVCMSGMGRHVSFDQAVAWKVLAEDSNVHCLAFCFVNWSFV

SEQ ID NO: 27101 - protein, 545 aa, Zea mays
MSMGYQVVAAQLKVASSADHASVVIITLFVALLCACIVLGHLLEENRWLNESITALIIGLCTGGVILMTTKGKSSHVFVFSEVLFFIYLLPPIIFNAGFQVKKKQFFRNFMTITLFGAVGTMISFFTISLGAIAIFSRMNIGTLDVGDFLAIGAIFSATDSVCTLQVLHQDETPFLYSLVFGEGVVNDATSVVLFNAVQKIQITHINAEVALQVFGNFLYLFSTSTLLGIATGLITSFVLKKLYFARHSTTRELAIMMLMAYLSYMLAELFSLSGILTVFFCGVLMSHVTWHNVTESSRITSRHVFAMLSFIAETFIFLYVGTDALDFDKWKTSSLSFGGTLGVSALIMALVLLGRAAFVFPLSVLTNFSNKHENESITFKHQVIIWWAGLMRGAVSIALAFKQFTYSGVTLDPVNAAMVTNTTIVVLFTTLVFGLLTKPLIRLLMPHRHLTMLSDDSTPKSLHSPLLTSQLGSDLEEPTNIPRPSSIRGEFLTMTRTVHRYWRKFDDAFMRPMFGGRGFVPVVPGSPIERSVPQWSEEAHNKEP

SEQ ID NO: 27102 - protein, 243 aa, Aspergillus oryzae
MYAQRPLAYAPTPYSYTPNPALSASINLDEEVKLASSSAERDLYESLAEIYSIIVTLDGLEKAYIKDVVTEAEYTETCARLLKQYKSSLGDDTVANEFVDLETFKRTWGLECPRATERLRIGLPATVEQASHNAPAANMGPAAGPPGGASGSLILTATENFITFLDALKLNMVSKDALHPLLSEVIQSVNKVTDGDFENRGKIIQWLITLNQMRATEELSEDQARELSFDIEQAYQGFKSTLG

SEQ ID NO: 27103 - protein, 317 aa, Yarrowia lipolytica
MAPPPAVVAHPLSSQATGLDMVHEFNQKLTKSDEHTWESFKFAPIRESTVSRAMTRRYFEDLDKYAESDVVIIGAGSCGLSAAYVLAKSRPDLKIAIVEAGVAPGGGAWLGGQLFSAMVMRKPAEQFLEEIGVPYEDEGDYVVVKHAALFTSTLMSQVLKFPNVKLFNATAVEDLITRKDAQGNLRIAGVVTNWTLVSMHHDDQSCMDPNTINAPIIISTTGHDGPFGAFSVKRLVSMNAIEKLGGMRGLDMGLAEDAIVKRTREIVPGLVVGGMELSEVDGANRMGPTFGAMALSGVKAAETVLEVFDTRKKQNQE

SEQ ID NO: 27104 - protein, 946 aa, Mycobacterium avium
MVDGAPTADPSEESTRSGDLPDRLRVHSLARTLGTTSKRVLDALSELDGRVRSAHSTVDREDAVRVRDLLAAQPSAEPEPAAEDAASGGPDAGIAGEPESRLLLETPDATERPHYMPLFVAPQPLESSDDDGDADETADSDDSDGDDDEQADRPSSRRRRRGRRGRGRGRGEQGGSDGPGDGDDDEPQNRGKKGGQSDGDDDSDGQDAEDADDSDTGDDGSADGGNRRRRRRRRRKSGSGDDNEDGPSPDDPPNTVVHERPPRNGKNGGDDGNGSSSSEIKGIDGSTRLEAKRQRRRDGRDAGRRRPPVLTEAEFLARREAVERVMVVRDRIRTEPPHQGSRYTQIAVLEDGIVVEHFVTSAASASLVGNIYLGIVQNVLPSMEAAFVDIGRGRNGVLYAGEVNWEAAGLGGSDRKIEQALKPGDYVVVQVSKDPVGHKGARLTTQVSLAGRYLVYVPGASSTGISRKLPDTERQRLKEILREVVPSDAGVIIRTASEGVKEDDIRGDVTRLQERWKQIEAKAIEIKEKAAGAAVALYEEPDVLVKVIRDLFNEDFAGLIVSGDDAWNTINEYVNSVAPDLVSKVTKYEPATGPDGTPGPDVFAVHRIDEQLAKAMDRKVWLPSGGTLVIDRTEAMTVIDVNTGKFTGSGGNLEQTVTKNNLEAAEEIVRQLRLRDIGGIVVIDFIDMVLESNRDLVLRRLTEALARDRTRHQVSEVTSLGLVQLTRKRLGTGLVEAFSTSCPNCGGRGILLHADPVDSAPSNGRKSESGGRRGRRKKSKAEEPVVAKVPVHSPGEHPMFKAMAAGSSTQAASDEDESAAEEAGDELERKKAARAEELEAAEDTEDLEDTEDDDEDSDDSDDEDLDDEDIDDEEDLGDDDEDLELDDDDLDTEDSDDSDDSDDSEDSDDSEDQRDPAAERPGVSALGRPRRRRAAGRPAGPPIHAD

SEQ ID NO: 27105 - protein, 319 aa, Eremothecium gossypii
MVHHKVTIIGSGPAAHTAAIYLARAEIKPTLYEGMFANGVAAGGQLTTTTEIENFPGFPDGLTGSDLMERMKAQSVKFGTEVVTETVAKVDLSARPFKLWTEFNEDEEPTTTDAIILATGASAKRLGLPGEETYWQRGISACAVCDGAVPIFRNKPLAVVGGGDSACEEASFLTKYGSKVFMLVRKDHMRASTIMQRRVERNEKIEVLYNTAPVEAKGDGSLLDALRVRDTRTGEESDLPVNGLFYAIGHTPATQLVAGQVDLDESGYVKTVPGSTLTNVPGLFAAGDVQDSRYRQAVTSAGSGCMAALDAEKFLSELE

SEQ ID NO: 27106 - protein, 262 aa, Oryza sativa
  misc_feature (35)..(35): Xaa can be any naturally occurring amino acid
WGLAFPNSPVSEDPNLVNRIVAYLKELQFPICLEXDADTVFDGLIEEDQMVILQGEDELGDVVVAECETNGANPETITMETDEFYSLCEELDLDLGSYQLVPTSARETVAAAAAAANDVDGVAYSHASCFVSWKRANPAEKVVAVPMTAGIESQKLLKKAVGGGTAWMSNIDDRGSVAITTTPGSNIKSHVMSERRRREKLNEMFLILKSLLPSVRKVDKASILAETITYLKVLEKRVKELESSSREPSRWRPTEIGQGKAP

SEQ ID NO: 27107 - protein, 132 aa, Bacillus cereus
MSKQPMTPFEAIGGEQCIAILVDTFYSYVSKHPDLSPIFPEDLTETARKQKQFLTQYLGGPNLYTEEHGHPMLRARHLPFEITPKRAEAWLSCMEQAMDDTGVHGHIREFVFERLALTAQHMVNTPNETGEV

SEQ ID NO: 27108 - protein, 433 aa, Oryza sativa
MADEDAEVAAGAEAEEEEAAPVAGEEDIVMGEASGKKTESHRQGRGRRASRFRGGGGGGDEDGDELPSSAYDAPPPHHEDSDGDDTDEAAAEDEHEGGVDGGDQEQREVGSMPSKFHLYQLSVQSPKGDISYLQKFFLMYVGGRVPLHFQEDFCGTALLSAEWLRTDARRTAVGLDLDLESLEWCLENNLSKIGADGYSRMLLFHGNVLQPNVARLVKQKICDAMQDLHVNNDNDSLASNICDQLDPASPKCSANSTMSDLVLPARDIICAFNYSCCCLHRRKDLVLYFRHAFNALSKRGGIFVMDVYGGTSSERKLRLQRRFPSFTYFWEQEEFDIISHQTRISLHFQAGKKQMLRHAFTYHWRLWSIPEIKDCLEEAGFKSIHVWIREMPNTQSSGNAKEYNANRDVKYEELQHFSQADAWNAYVVGVANI

SEQ ID NO: 27109 - protein, 565 aa, Caulobacter crescentus
MSFNPTRDDFEALLNDSMGGRDFAEGTVVKGKVVGIEKDFAIIDVGLKTEGRVQLKEFGVDENGKATVKAGDTVEVFLERLENAMGEAVISREKAKREEAWTRLEGVYARNEPVMGAIVGRVKGGFTVDLGGASAFLPGSQVDIRPVRDVGPLMGKEQPFAILKMDRPRGNIVVSRRAILEEARAEQRTELVSQLQEGEIREGVVKNITDYGAFVDLGGIDGLLHVTDMSWKRVNHPSQVLAVGDTVKVQIVKINPDTQRISLGMKQLQSDPWDGVEAKYPVGAKFTGRITNITDYGAFVELEAGVEGLVHVSEMSWTKKNVHPGKIVSTSQEVDVVVLDVDPSKRRVSLGLKQALANPWEAFLEAHPVGSTVEGEVKNATEFGLFVGLDNDIDGMVHLSDIDWSVPGEEAMARYKKGDMVKAKVLDVDVEKERISLGIKQLAGDPMSGDTYRKNQTVTVTVTEVTSGGIEVRFGEDDAPMTAFIRKSDLSRDRQEQRPERFAVGDRVDAQITNVDKAARRVSLSIKSLEMAEEKEAIEQFGSSDSGASLGDILGAALRERASKD

SEQ ID NO: 27110 - protein, 701 aa, Pseudomonas aeruginosa
MNPVTKQFQFGQSTVTLETGRIARQATGAVLVTMDDVSVLVTVVGAKSPAEGRDFFPLSVHYQEKTYAAGRIPGGFFKREGRPSEKETLTSRLIDRPIRPLFPEGFMNEVQVVCTVVSTNKKSDPDIAAMIGTSAALAISGIPFAGPIGAARVGFHPEIGYILNPTYEQLQSSSLDMVVAGTEDAVLMVESEADELTEDQMLGAVLFAHDEFQAVIRAVKELAAEAGKPAWDWKAPAENTVLVNAIKAELGEAISQAYTITIKQDRYNRLGELRDQAVALFAGEEEGKFPASEVKDVFGLLEYRTVRENIVNGKPRIDGRDTRTVRPLRIEVGVLGKTHGSALFTRGETQALVVATLGTARDAQLLDTLEGERKDAFMLHYNFPPFSVGECGRMGSPGRREIGHGRLARRGVAAMLPTQDEFPYTIRVVSEITESNGSSSMASVCGASLALMDAGVPVKAPVAGIAMGLVKEGEKFAVLTDILGDEDHLGDMDFKVAGTDKGVTALQMDIKINGITEEIMEIALGQALEARLNILGQMNQVIAKPRAELSENAPTMLQMKIDSDKIRDVIGKGGATIRGICEETKASIDIEDDGSVKIYGETKEAAEAAKLRVLAITAEAEIGKIYVGKVERIVDFGAFVNILPGKDGLVHISQISDKRIDKVTDVLQEGQEVKVLVLDVDNRGRIKLSIKDVAAAEASGV

SEQ ID NO: 27111 - protein, 964 aa, Saccharophagus degradans
MSHGTSLDELFNSRDFIGRHIGPNADQTRAMLDAMGLDSIDQLIDLTVPASIRGEETRALAAPVNEQQALAELKNIAGNNQRFKSYIGMGYHPTYVPPVILRNVLENPGWYTAYTPYQPEIAQGRLEGLLNFQQMIIELTGMDMANASMLDEATAAAEAMAMAKRVARKNKSNTFFADKHCHPQTLAVLQTRASHFGFELVIGDITQDLNKQEVFGAITQYPGTSGEVKDLRPIVNQAHEQDALLIVAADILSLVLLESPGAMGADIVVGSNQRFGIPMGFGGPHAAFFGFREKYKRATPGRIIGVSVDTRGKRALRMAMQTREQHIRREKANSNICTSQVLLAVMSVFYAMYHGSAGVTRIAQRVHTLTKMLAQGLTAQGHKLAFDNYFDTLCVIVNDQQQGLFDRAQQAGVNLRKLDKNALTISLNECTSLEDIHQLLDIFSLGKHSQDVKSLETKALAAEVIPASCRREGPALNHPVFEQYHSETEMLRYLKRLESKDIALNHAMIPLGSCTMKLNATAEMIPVTWPEFGELHPFAPMEQAAGYSTLFTQLQDMLKACTGYDAISLQPNAGSQGEYAGLVAIRKYFEHLGQTERNICLIPASAHGTNPASAQMVEMKVVVVACDNLGNVDLNDLKAKVAQYGETIAALMVTYPSTHGVFEEEITAICDLIHSVGAQVYIDGANMNALVGLAAPGKFGGDVSHLNLHKTFCIPHGGGGPGMGPIGVKSHLAPFLAGHPVQPVPNTLVENGTISAAPWGSASILTISWMYIRMMGAEGMKRATEFAILNANYIAHRLQDHYPILYKGKNGYIAHECLLDLRPLKESSGITEEDIAKRLMDFGFHAPTMSFPVAGTLMIEPTESESQAELDRFCDAMIKIRQEASLVESGELPRDNNPLVNAPHTLDDALDETWTRPYTRDEATRPLPYLHAHKIWPTVNRIDNVYGDRNLICSCPSIESYTEE

SEQ ID NO: 27112 - protein, 251 aa, Geobacter sulfurreducens
MSNITMKELLEAGVHFGHQTKRWNPKMKPYIFGARNGIYIIDLQKTVRLFKNAYNFVRENAQAGETMLFVGTKKQAQDAIGEEAVRCGMYFVNQRWLGGMLTNFVTVKQSIDRLKRLDAMFADGSIEAYTKKEALQLEKEREKLEKILGGIKGMGKLPGALFVIDPKNETIAISEAKKLGIPVVAVVDTNCDPDPIDYVIPGNDDAIRAIRLLTSKMADAVIEGSQARDAVLQTGDEEAMEAAAEESGAEA

SEQ ID NO: 27113 - protein, 60 aa, Glycine max
NDVVRLDFYSRVLGMSLLKRLDFPEMKISLYFMGYENTAEAPSNPIDTAARTFSPKGTAD

SEQ ID NO: 27114 - protein, 1029 aa, Oryza sativa
MHLRLLLLLVGVAAAAADADADADALLAAKAAMSDPTGALASWGGNGTRTNTTAAAAAHCAWAGVTCSSRGAVVGLDVSGLNLSGALPAELTGLRGLMRLSVGANAFSGPIPASLGRLQFLTYLNLSNNAFNGSFPAALARLRGLRVLDLYNNNLTSPLPMEVVQMPLLRHLHLGGNFFSGEIPPEYGRWGRMQYLAVSGNELSGKIPPELGNLTSLRELYIGYYNSYSGGLPPELGNLTELVRLDAANCGLSGEIPPELGKLQNLDTLFLQVNSLAGGIPSELGYLKSLSSLDLSNNVLTGEIPASFSELKNLTLLNLFRNKLRGDIPDFVGDLPSLEVLQLWENNFTGGVPRRLGRNGRLQLLDLSSNRLTGTLPPELCAGGKMHTLIALGNFLFGAIPDSLGECKSLSRVRLGENYLNGSIPKGLFELPKLTQVELQDNLLTGNFPAVSGAAAPNLGEISLSNNQLTGALPASIGNFSGVQKLLLDRNSFSGVVPPEIGRLQKLSKADLSSNALEGGVPPEIGKCRLLTYLDLSRNNISGKIPPAISGMRILNYLNLSRNHLDGEIPPSIATMQSLTAVDFSYNNLSGLVPGTGQFSYFNATSFVGNPGLCGPYLGPCRPGVAGTDHGGHGHGGLSNGVKLLIVLGLLACSIAFAVGAILKARSLKKASEARVWKLTAFQRLDFTCDDVLDCLKEENVIGKGGAGIVYKGAMPNGDHVAVKRLPAMGRGSSHDHGFSAEIQTLGRIRHRHIVRLLGFCSNNETNLLVYEYMPNGSLGELLHGKKGGHLHWDTRYKIAIEAAKGLCYLHHDCSPLILHRDVKSNNILLDSDFEAHVADFGLAKFLQDTGASECMSAIAGSYGYIAPEYAYTLKVDEKSDVYSFGVVLLELVTGRKPVGEFGDGVDIVQWVRMMTDSNKEQVMKVLDPRLSTVPLHEVMHVFYVALLCIEEQSVQRPTMREVVQILSELPKLAPRQGEVLSHAVDGFASNPPAPVPSGSAEALTGDAKDQQQQQTNSESTTPPDLISI

SEQ ID NO: 27115 - protein, 477 aa, Arabidopsis thaliana; identical to SEQ ID NO: 370

SEQ ID NO: 27116 - protein, 420 aa, Pyrococcus furiosus
MVEQDPYEIVIKQLERAAQYMEISEEALEFLKRPQRIVEVTIPVEMDDGSVKVFTGFRVQHNWARGPTKGGIRWHPEETLSTVKALAAWMTWKTAVMDLPYGGGKGGIIVDPKKLSDREKERLARGYIRAIYDVISPYEDIPAPDVYTNPQIMAWMMDEYETISRRKTPAFGIITGKPLSIGGSLGRIEATARGASYTIREAAKVLGWDTLKGKTIAIQGYGNAGYYLAKIMSEDFGMKVVAVSDSKGGIYNPDGLNADEVLKWKNEHGSVKDFPGATNITNEELLELEVDVLAPAAIEEVITKKNADNIKAKIVAEVANGPVTPEADEILFEKGILQIPDFLCNAGGVTVSYFEWVQNITGYYWTIEEVRERLDKKMTKAFYDVYNIAKEKNIHMRDAAYVVAVQRVYQAMLDRGWVKH

SEQ ID NO: 27117 - protein, 125 aa, Glycine max
ACSMISSPSVTTVNRACAGMFAPFTGLNSIAGFPIMNTNTDITSIASNGGRVQCMQVWPPVCKKKCETLSYLPDLDDAQSAYEVQHHLMNGWITCLECQLEHCFVYRVHYMSPVYYDGLYWTIWN

SEQ ID NO: 27118 - protein, 137 aa, Bacillus licheniformis
MKIALIAHDRKKQDMIQLTTAYKDILKKHELFATGTTGLKITEATGLPVVRFQSGPLGGDQQIGALIAKNDIDLVIFLRDPLTAQPHEPDVSALIRLSDVYAIPLATNMGTAEILIRSVEEGAFEFRNIVHGRDRDA

SEQ ID NO: 27119 - protein, 949 aa, Unknown
  Silicibacter sp. TM1040
MPFEPTDYLPYDFANRRHIGPSPEEMAEMLKVVGADSLDALIDETVPQSIRQKAALDFGRPMSERELLFHMREVAGKNKVMTSLIGQGYHGTVTPPAIQRNILENPAWYTAYTPYQPEISQGRLEALLNFQTMISDLTGLEIANASLLDEATACAEAMTMAERVSKSKAKAFFVDRDCHPQNIAVVKTRAEPLGIEVIVGNPDKMDPEAVFGALFQYPGTYGHVRDFTDHIAKLHEHKGIAVVSADPMSLTLLKEPGAMGADIAVGSTQRFGVPVGAGGPHAAYMATKDAYKRNMPGRIVGVSVDAHGNKAYRLSLQTREQHIRREKATSNVCTAQALLAVMASMYAVFHGPKGLKAIAQRIHRKAVRLAKGLEEAGFKVDPQAFFDTITVDVGPLQAAVMKSAVDEGINLRRVGETRVGISVDETTRPETIEAVWRAFGIVRADDDFTPDYRVPANMHRKSDYLTHPIFHMNRAETEMMRYMRRLADRDLALDRAMIPLGSCTMKLNAAAEMMPLSWPEFSTIHPFAPADQQAGYGEMVEDLSKKLCDITGYDAISMQPNSGAQGEYAGLLTIAAYHKARGEGHRNICLIPMSAHGTNPASAQMVGWKVVVVKSDERGDIDLEDFRAKAEKHADNLAGCMITYPSTHGVFEETVHEVCKITHDAGGQVYIDGANMNAMVGLSRPGDLGGDVSHLNLHKTFAIPHGGGGPGMGPIGVKAHLVEHLPGHPETGGSEGPVSAAPLGSASILTISWAYCLMMGGAGLTQATKVAILSANYLAKRLEGAFDVLYKGPTGRVAHECILDTRPFADSADVTVDDVAKRLMDSGFHAPTMSWPVAGTLMVEPTESETKAELDRFVDAMLSIRDEIKAVESGEMPRENNALKNAPHTMEDLVKDWDRPYSREQGCFPPGAFRVDKYWPPVNRVDNVYGDRHLICTCPPLEDYAEAAE

SEQ ID NO: 27120 - protein, 159 aa, Unknown
  Shewanella sp. ANA-3
MALATFGAGCFWGVEYFFRQVNGVTNATCGYMGGNNEATTYEEVKKGKTGHAEVVQVEFDPAIVSYDELLDVFWKNHNPTTLNMQGGDIGTQYRSTIFFHDREQKATAEASKLAFARSGRWGLRHIVTEIVPLQQFHVAEEYHQNYIDKNNLPSCHLEY

SEQ ID NO: 27121 - protein, 235 aa, Matricaria chamomilla
MIRNNAFDSDFALLESVRRHLLDDNAPPMSCRSNNFLFPHLSDSWGELPLQQNDSEDMLIAKFLNEALPLQQNDSEGIITPEMTSSSENIFFVKSEPETSSFQPKSLGSQKGKHYRGVRRRPWGKYAAEIRDPAKNGARVWLGTYETAEDAAVAYDMAAYRMRGSRALLNFPLRINSGEPEPVRITSKRKTTSPSEGLVVKKVKVELEMSTQAEFPLVYGCYYCVILGPFLVKCF

SEQ ID NO: 27122 - protein, 585 aa, Triticum aestivum; identical to SEQ ID NO: 405

SEQ ID NO: 27123 - protein, 279 aa, Solibacter usitatus
MACSLDPNENLAKAEWRIRDAAGKGAQIVCVQELFRSQYFCQTENIATFDLAETIPGPTTESFTRLARELDVVIVGSIFERRMAGVFHNTAVIIDAGGELLGLYRKMHIPDDPRFYEKYYFTPGDLGFRCFDTKYARIAPLICWDQWFPEGARMAALGGAQILFYPTAIGFHHSDAAEAGTQHNAWETVQRSHAIANGVYVAAVNRVGHEGPEGEGLQFWGGSFLSDPQGRMLAKAGDAEETLVVECDPRVIESVRRNWPFLRDRRIDAYGPIVNRVID

SEQ ID NO: 27124 - protein, 1009 aa, Clostridium perfringens
MILKNEYHEDISKLHVNMMPRRSYYVPFVDTDEALNIKDRSKQVNFFSLNGKWEFNYFDSLQKVKEFDNINQINFSDNIDVPSLWQLKGYDYNQYTNVKYPIPFDPPFVPINNPCGIYKRDFEIEILPENYDYNINFEGVDSCFYFWINDNFVGYSQISHSISEFDITEFLVKGKNTITVLVLKWCDGTYFEDQDKFRMSGIFRDVYILRRAKERIVDYKITQSIDFSAKEGKLDLEILSNIGNPKGKYYLLNPNNHMIASGNIDNNKVQINIKNVELWSAEIPNLYTLLIETEHEVIKERIGMREIKIENSILKINNKKVKLRGVNHHDSNPTKGYVMTYDDMILDLKIMKECNFNSIRTAHYPKSPIFYELCDEYGFYVMSEADIEIHGVVELYGLGYLDNYNMIADDKVYEKVIIDRVDSSIVPFKNKSCIFMWSLGNESGFGCNFERGLEYARALDPTRPLHYEGAYYASKERENDFTNIDVISRMYISIEEIKDYFEKGINKPLILCEYAHAMGNGPGGLQDYDEMIQKYDQFAGAYVWEWCDHAILINEDVNGKKAYGYGGDFEEENHDGNFCVDGLVYPDRTPHTGLLEYKNINRPIRAIEFDEVKKRVKFKNMLDFRDVSEFLDVTYKVFLDGETIFGGNIDLESLKAKEEKWYDLSISELPKGIITILFQYRVKNNNHLYEKGEVLGFDNFIIKNGVDNISSVDKILKSTINEQKFYVEETVNKIKVKNNEFIYNYNKNTGSFDFIQALGETFIDDPMKFIIWRAPTDNDRKIKNLWIEAGFNQITTRVYNSKIKEFSNRVEITSDLSLIPPYRERVLDLKLTWSIYSEGLIKCHVKGNKNMKTPYLPRFGVELKLNKSYEEVSYFGFGPYENYVDKNSSCYLGRFNSKVSEMHEDYIRPQENGSHHYCREVAINNEKGKVCVLSENDFAFNVSHFSLNQLTNANHNFDLNEEEATYLIVDYKQSGIGSNSCGPDLDEEYRLNEKEFSYDFYLKFVKENI

SEQ ID NO: 27125 - protein, 675 aa, Arabidopsis thaliana
MSSCFKSSVSLFSVFLFMILKTVTSDPTYLYHICPNTTTYSRNSSYLTNLRTVLSSLSSPNAAYASLFDNAAAGEENDSNRVYGVFLCRGDVSAEICRDCVAFAANETLQRCPREKVAVIWYDECMVRYSNQSIVGQMRIRPGVFLTNKQNITENQVSRFNESLPALLIDVAVKAALSSRKFATEKANFTVFQTIYSLVQCTPDLTNQDCESCLRQVINYLPRCCDRSVGGRVIAPSCSFRYELYPFYNETIAAAPMAPPPSSTVTAPPLNIPSEKGKGKNLTVIVTAIAVPVSVCVLLLGAMCWLLARRRNNKLSAETEDLDEDGITSTETLQFQFSAIEAATNKFSESNKLGHGGFGEVYKGQLITGETVAIKRLSQGSTQGAEEFKNEVDVVAKLQHRNLAKLLGYCLDGEEKILVYEFVPNKSLDYFLFDNEKRRVLDWQRRYKIIEGIARGILYLHRDSRLTIIHRDLKASNILLDADMHPKISDFGMARIFGVDQTQANTKRIVGTYGYMSPEYAIHGKYSVKSDVYSFGVLVLELITGKKNSSFYEEDGLGDLVTYVWKLWVENSPLELVDEAMRGNFQTNEVIRCIHIALLCVQEDSSERPSMDDILVMMNSFTVTLPIPKRSGFLLRTMKDSRDPRSGGSASDHSATSKSLPLSVDDSSITIVYPR

SEQ ID NO: 27126 - protein, 1387 aa, Nocardia farcinica
MSDAPTSPAPGTARTACSYCGVGCGISVQTTVQGGDGVAGAGKRVLAKVGGDPRHPANAGRLCTKGATHLELMRAPGRMETAYRRPQRDQVPVPIPVDEAVHEVADRLRAILDEHGPDAIALYVSGQMSLEAQYLATKLAKGFLRTKHIEANSRLCMASAGTGYKQSLGADGPPGSYDDIDHADLFFVIGANMADCHPILFLRMADRLKAGAKLIVVDPRRTATADRADLFLQLRPGTDLALLNGLLHLLVADGAIDAEFIAEHTEGWAAMPEFLADYPPARVAAITGLAEDDLRTAARWIAEAGEWMSLWTMGLNQSTHGTWSTNALCNLHLATGAICRPGSGPFSLTGQPNAMGGREMGYMGPGLPGQRSLLSAADRAFVESAWGLAPGSLRAESGPGTIEMFRSMAAGEIKAAWIICTNPVASVANRKTVIAGLEAAELVITQDAYTDTATNAYADVLLPATLWAEADAVMVNSERNVTLMPRCVDPVGEARPDWLLIAQVATAMGFPGFEYGSSAEVFAEITGFANPATGYDLRGMSYPALAEGPMQWPCPDPARRRNPIRYRNDGVSQELFVDEHGHRPRLAFPTPSRRAVFWPRPHLDPAELPDDDYPFVLNTGRLQHQWHTMTKTGRIGKLTRLDGEPFVEVHPEDAERLGVRPGDQLEIASRRGRAVLPARISDRVRPGDCFAPFHWNDEQGEYLTINAVTNDAVDPDSWQPEFKQCAVALRRVAPVPRADEPCPEASAPQHPLAALLGLDAAATPTLSETERIYLGGYLAALQSIPVTGQPVLPDSAPIAGASRVWIDGLLAGMYSRAAVTADAPVPVAKPVTVLWASQTGNAEDLAAAVAQRLSGAGFAPRLLDMDSCALDALDGDVLIVTSTFGDGGPPDNGADFWDRLEGSATRFPGLRYAVFALGDSAYDDFCGHGRKIDRLLAERGARRMLERVDCEPDHAERAQRWLDEIVAVLGQGGGVPGGAASGTRWAGPPGADGVADGVAGGATATATAVLTKPARQAAPFTRNAPVAAPLIRNEVLSHPDSVKEVRRVGFDLRDLGVSYETGDSLGVWPSNCPDLVAEWLAATGLDGGRGIEIDGRELPLAEALRTHYDITRVSHDLLTFVAERNPSQQLAKLLRRDNRNELDGYLWDRQAVDVLRDFPVRADLIEWQGVLTKLQPRQYSISSSPLVDPHEVQLTVGVVRYGESGRRGGVCSTFLADRADTRVPIFLQRAPHFRPPLDPAAPMIMVGPGTGIAPFRGFLHERRALGATGRNWLFFGDQHAAQNFYYRAELEDMFRTGFLTRLDLAFSRDQRERIYVQHRMIEHGAELWAWLCEGAHLYVCGDAARMAKDVDETLLAIARIHGKLDEDGALAFRKQLVAEKRYVRDVY

SEQ ID NO: 27127 - protein, 554 aa, Salmonella enterica
MCSIFGVFDIKTDAAELRKKALELSRLMRHRGPDWSGIYACDNAILAHERLSIVDVNAGAQPLYNAKKTHVLAVNGEIYNHQTLRAEYGDRYAFQTGSDCEVILALYQEKGPDFLDDLQGMFAFALYDSEKDAYLIGRDHIGIIPLYMGYDEFGNFYVASEMKALTPVCRTIKEFPAGSYLWSKDGEIRQYYQRDWFDYDAVKDNVTDKNALRQALEESVKSHLMSDVPYGVLLSGGLDSSVISAITKKFAARRVEDQERSEAWWPQLHSFAVGLEGSPDLKAAQEVANHLGTVHHEIHFTVQEGLDAIRDVIYHIETYDVTTIRASTPMYLMSRKIKAMGIKMVLSGEGSDEVFGGYLYFHKAPNAKELHEETVRKLQALHMYDCTRANKAMSAWGVEARVPFLDKKFLDVAMRINPQDKMCGNGKMEKHVLRECFESYLPASVAWRQKEQFSDGVGYSWIDTLKEVAAKQISDQQLETARFRFPYNTPSSKEAYLYREIFEELFPVPSAAECVPGGPSVACSSAKAIEWDEAFKTMDDPSGRAVGVHQSAYQ

SEQ ID NO: 27128 - protein, 630 aa, Magnaporthe grisea
MRRASTFALLALSWSAAVSAASSAGDYFVRSLPGAPPGPLVKMHAGHIEVSPEKNGNLFFWHFQNKHIANRQRTVIWLNGGPGCSSEDGALMEVGPYRLKDDHTLVPNEGSWHEFANLMFVDNPVGTGFSYVNTDSYVTELDEMADQFVIFLEKFFELFPEYSQDDIYIAGESFAGQHIPYIAKHILDRNKNSMTKIKWNLKGLLIGNGWIAPNEQYRAYLDFSYSKGLLDKNSETAKTLEAQHKDCAKEWEDNGPKVDVAKCESVLQTLLKLSSKVEADGKRHCVNMYDVRLRDTYPSCGMNWPPDLVNVTPYLRRKDVVEALHVNPNKATGWTECTGAVGQSFKAQKSKPSIDLLPKILEEVPILLFSGAEDLICNHIGTEAFIGKMTWNGGKGFEVTPGTWAPRRDWTFEGKDAGFWQEARNLTYVLFKDSSHMVPFDFPRRSRDMLDRFMGVDISSIGGNPTDSRLDGEKLPETTVGGAAGNSTSKQEEEKKKLDEAKWYAYRKSGEVVLVIVAVAAVAWGWYVWRDRRRRRGYQGIFGGSPSESTTRLPGLGSRISSTPSGLEGFRSKRQNGRDVEAGDFDESELDDLHTQTPTDARYSVGADSDDEEDASGSRKEGGPSGGRGR

SEQ ID NO: 27129 - protein, 450 aa, Oryza sativa
  misc_feature (328)..(328): Xaa can be any naturally occurring amino acid
MESKGGKKKSSSSRSLMYEAPLGYSIEDVRPAGGVKKFQSAAYSNCSDQPAPMGVLSAADPPPVSAIGFEGYEKRLEITFSEAPVFADPDGRGLRALSRAQIDSVLDLARCTIVSELSNKDFDSYVLSESSLFIYSDKIVIKTCGTTKLLLTIPRILELAEGLSMPLAAVKYSRGMFIFPSAQPAPHRSFSEEVAVLNRYFGHLKSGGNAYVIGDPAKPGQKWHIYYATQHPEQPMVTLEMCMTGLDKEKASVFFKTSADGHTSCAKEMTKLSGISDIIPEMEICDFDFEPCGYSMNAIHGLAFSTIHVTPEDGFSYASYEVVGFDAXTLAYGDLVKRVLRCFGPSEFSVAVTIFGGHGHAGTWAKELNADAYKCNNMVEQELPCGGLLIYQSFDATEDVPVAVGSPKSVLHCFEAENMVNPAPVKEGKLGNLLPWGEDALEENDGVFDE

SEQ ID NO: 27130 - protein, 465 aa, Musa acuminata
MEVDLGKLFIGGISWDTNEDSLRKYFSAFGEVVEAVIMKDRTTGRARGFGFVVFADPAVTERVVTEKHTIDGRMVEAKKAVPRDDHQFLNKNSSSSIHGSPVPGHTKKIFVGGLSSTITEGDFKKYFDQFGTITDVVVMYDHNTQRPRGFGFITYDSEDAVDKVLLNAFHELNGKMVEVKRAVPKEPSPGPIMRSSIGGYNYGLNRVNSFVNGYTQGYNASSVSGYGMRRLDDSRLGSLAGGRNGFASLSPGLGMGMDYEPPLSSTFVGNPGYDNNLGYGRALNPYHNANSSRYTSLIPYNDVNGNTSSLFSLTSRNVWENVALDHATKSAISNASMVSRSGSLGSLGTGNLNRGSGSSYTSGNLGFGGGGYIGLGRNSFDRRIAPASPNTNLIASSSGYEGSYAKLYGATSVYGDPTWGSSSSEFDATGSFSYKLNNSNSDVTGNGFADYMAGYNVNNNRGIAT

SEQ ID NO: 27131 - protein, 290 aa, Pseudomonas fluorescens
MSQQTPYIFDATTADFDQSVIEASFQKPVLVDFWAEWCAPCKALMPMLQGIAESYQGELLLAKVNCDIEQDIVARFGIRSLPTVVLFKDGQPVDGFAGAQPESAVRALLEPHVQMPAPSAADPFEQAQALFDEGRYADAEAKLVVLLGEDNTNAKALILYARCLTERGELGEAQTVLDAVKSDEHKAALAGAKAQIKFLGLARDLPDAADLKSRLAQNPQDDEAVYQLAIQQLARQQYEAALDALLKLFIRNRSYGEGLPHKTLLQVFELLGNDHPLVTAYRRKVFAALY

SEQ ID NO: 27132 - protein, 394 aa, Yersinia pseudotuberculosis
MTNIIRQFLRQEAAGGLILIIAAAIALLMANSALQGVYQSFLDIPVSIKIASLDISKPLLLWINDGLMAVFFLMVGLEVKRELMEGSLAGRDKAVFPAIAALGGMLAPALIYLLFNGADEVTRQGWAIPAATDIAFALGVMALLGNRVPTGLKVFLLALAIIDDLGVIIIIALFYTQQVSLQSLGIAAAAIALLAYMNWRGVGKTSAYLLVGLVLWVCILKSGVHATLAGVIVGFMIPLHTQDQRSPSESLEHGLHPWVAYLILPLFAFANAGVSLQGVSLSGLTSLLPMGIATGLFIGKPLGIFTFSWLAVKLGIAKLPDAINFKQIFAVSVLCGIGFTMSIFIASLAFEGTDIALTTYSKLGILLGSTTAAVVGYSLLRLVLPARRKAVNVR

SEQ ID NO: 27133 - protein, 247 aa, Zea mays
  misc_feature (76)..(76): Xaa can be any naturally occurring amino acid
MPPRPVPLFSRLRFRLPSCAAVSISTPPSSAAPLHYGHRTPLASPFPLSPPCPRILRAAVAVSSLDLRPITGGFAXYSAWLLASSATSVHDFTVKDASGKDVDLSTYKGKVLLIVNVASQCGLTNSNYTELSQLYEKYKDQGFEILAFPCNQFGGQEPGTNEEIVQFACTRFKAEYPIFDKVDVNGDNTAPIYKFLKSSKGSLFGDNIKWNFSKFLVDKEGHVVERYAPTTSPLSIEKDIKKLLGSY

SEQ ID NO: 27134 - protein, 364 aa, Triticum aestivum
  misc_feature (237)..(237): Xaa can be any naturally occurring amino acid
  misc_feature (250)..(250): Xaa can be any naturally occurring amino acid
  misc_feature (302)..(302): Xaa can be any naturally occurring amino acid
TSLYKKAGWYRSGIPGISSTHASVVAEYIWIGGSGMDLRSKARTLPGPVTDPSKLPKWNYDGSSTGQAPGEDSEVILYPQAIFKDPFRKGNNILVMCDCYTPAGVPIPTNKRYNAAKIFSNPDVAKEEPWYGIEQEYTLLQKDINWPLGWPVGGFPGPQGPYYCSIGADKSFGRDIVDAHYKACLFAGVNISGINGEVMPGQWEFQVGPTVGISAGDQVWVARYLLERITEIAGVVXVTFDPKPIPGDWXNGAGAHTNYSTESMRKDGGFKVIVDAVEKLKLKHKEHIAAYGEGNERRLTGXKHETADINTFSWGVANRGASVRVGRETEQNGKGYFEDRRPASNMDPYVVTSMIAETTILWKP

SEQ ID NO: 27135 - protein, 994 aa, Yarrowia lipolytica
MLRTLNRTSRILRLSATKTRFGSTFSAATRPLDTYLRRHVGSESADVNKMLRALDYATAESAMDSFVSDVVPPNVLTKRPLAVKPTQGFSESELTSRLGEIASKNKVFKSYIGKGYVGTVVPPVIQRNVLENPLWYTSYTPYQPEISQGRLESLLNYQTVITELTGMAVANASLLDEGTAASEAVTMAFNAFKGKRGIFLVDKNVHPQTIAVVQSRSVALDVDVKVVDVSDLSNGKSESPIDQVCGVLVQYPTTDGSIVDYQKLSDTLKGEGNGSLLCVAADLLALTLLKPPSDFGADIVLGTSQRFGVPMGYGGPHAAYFAVADGQHRKMPGRLIGMSRDRLGGEAYRLALQTREQHIRREKATSNICTAQALLANMSAFYAIYHGPEGLRKIAERVNLLTSILATAVEAKGVKVENKHFFDTLTLQVQDANKVISAAEAKEINLYKLDDKTVSLTLDETVTHGDLVNLASVFGVSEADLESAADNVTSSIPSDMLRTDKYMQHDVFNKYHSETELLRYMKHLQSKDLSLADAMIPLGSCTMKLNATTQMAPITWPEFGQLHPFVPLNQAQGYKELLIELEDDLADITGFDRMSLQPNSGAQGEYTGLRVIRAYLESQGQGHRNICLIPVSAHGTNPASAVMSGMKVVAVKCKKDGELDLVDLAAKAEKHKDNLAAFMVTYPSTFGVFEPGVKEAIDIVHKNGGQVYMDGANMNAQIGLTSPGEMGADVCHLNLHKTFCIPHGGGGPGMGPIGVKSHLAPFLPAHPVVEMSEVTGLSTEKSIQPVSAAPFGSASILPISWAYIKLMGATGLLKATEIALLNANYMKKRLEPHYPILYTNNKDKCAHEFILDMRPFKASSGIEAIDIAKRLQDYSFHGPTMSWPVANTLMVEPTESESLAELDRFCDALISIRQEIKEIEDGKIPRENNVLKNSPHPQQDLLAETWDRPYTREQAAYPVASLREKKFWPSVARVDDTFGDLNLFCTCEPPALEE

SEQ ID NO: 27136 - protein, 137 aa, Oryza sativa
MAAPDAIGVNPLYIGRGSDGAVWISSEMKALNEDCVEFEIFPPGHLYSSAAGGLRRWYKPQWFAENVPADRLPQLRLRLRQPHQPRKRQRQRQQQRQGRCCCTVSPCRCTCARETDPSMWRVIDHSSELILETIHRN

SEQ ID NO: 27137 - protein, 488 aa, Bacillus anthracis
MNSATNQTTSQTETTKGKGELRRGLKSKHLTMISLGGTIGTGLFLASGGVIHSAGPGGALIAYAAIGIMVYFLMTSLAELAAYMPVTGSFSTYATKFVDPSLGFALGWNYWYNWAITIAAELAAVTLIMKFWFPDTPSLIWSGLCLAIIFLLNYLSVKGFGESEYWFALIKVATIIIFLIVGFMMIFGIMGGETVGFKNFTVADAPFNGGIMAIIGVFMAAGFSFQGTELLGVAAGETSDPERNIPKAIRSIFWRILLFYILAILVIGLLIPYTTESLAASDVTVSPFTLIFEKAGVAFAASVMNAVILTAVLSAGNSGMYASTRMLWDLARQGKAPKFLGKLDSRGVPVNALIVTSIVGSIAFIASLFGDGVVYIWLLNASGMSGFIAWVGIAISHYRFRKAYIAQGKDLNDLPYRAKWFPFGPIFAFALCVIVILGQNYGAFMGESIDWNGVLVSYIGLPLFLVLWLGYKFTKKTKVIPLDKCELK

SEQ ID NO: 27138 - protein, 404 aa, Oryza sativa
PEAPHHNHNTPQRVGREREWRPWRSTSRGWRARRSGVRDHALTKEERERERMCQLFDEASERCRTAPMEGVSFSPEDLDSAVESTDIDTDIGSLIKGTVFMTTSNGAYVDIQSKSTAFLPLDEACLLDVNHIEEAGIRAGLVEEFMIIDENPGDETLILSLQAIQQDLAWERCRQLQAEDVVVTGKVIGGNKGGVVALVEGLKGFVPFSQVSSKSTAEELLDKELPLKFVEVDEEQGRLVLSNRKAMADSQAQLGIGSVVLGTVESLKPYGAFIDIGGINGLLHVSQISHDRVADISTVLQPGDTLKVMILSHDRERGRVSLSTKKLEPTPGDMIRNPKLVFEKADEMAQIFRQRIAQAEAMARADMLRFQPESGLTLSSEGILGPLSSDTPSEGSGEGQTTDE

SEQ ID NO: 27139 - protein, 789 aa, Unknown
  Photobacterium sp. SKA34
MKQVKILAQFYVDLMVKLGIVRFSLLLALALVALAVVVQVSVTLVLNGTVNDIDIVRSVTFGLLITPWAVYFLSVVVDQLEDSRQRLSKLVTKLEEMRSRDMELNKQLQDNVAQLNQEIEEREKAEEAREEAMHDLENEVYQRENAQLAVAEQSALLKSFLDASPDLIYYRNEKNQFSGCNRAMSELLGKTEKELVGLTPWDVYPEEVAKKIIKTDEEVFNENSAMTDEQWLVYPNGKRALFELRKVPFYNRNGRRLGLMGFGRDITERKKYEDALEKASSDKTSFISTISHELRTPLNGIVGLSRMLLDTDLTDEQRGYLRTVHVSAITLGNIFNDIIDLDKSDRRRLELMPKPLDFNEFIDEMGNISQLMAEQKGLRFDLECLTELPKNIEVDSTRLRQVLWNLIGNATKFTKQGGVILSVSSEIHEHDADIIFEVEDSGVGIPKSEIDNIFAMYYQVKQGDDNIHAVGTGIGLAVSRQLVQLMGGDIAVHSEVGEGSTFTVKIRVPLVEDVIEEEIVTEVKPELTGLSIFMVEDIELNITVAKSLLESLGHEVTVAMRGDEALAMFKPEDYDLVLLDIQLPDMTGFDIAQKLRERYQDLPALVALTANVISDKTEYLNKGMDEALSKPLSVKAITSVIENLVLSCSYEEDEVTTLVETETKSSKPSDTMVDKLLDLEMLTSYVEIVGTKPVYASIEMFEKMMPDYIAILDSNMVARDQDGIKFEAHKIKGAAGSIGLKHIQQVAQKAQSPELPAWWENINDWVDEIKNGYQNDIDVLKLWLKQYEK

SEQ ID NO: 27140 - protein, 978 aa, Coccidioides immitis
MDQGPVKRPPPSAIPRLSRLPLPTAAAPKLVRPSPSRERLQADQGLNVSRLRRPSEDVFKKPHLPPPSSRKVSDNFYAQRRSSQYGHSIRTAASAESLASKRNSELCLTEIGPSLEERTIETLSQIPSSPSPSRRQSGFFRPSSPMRSPSRPTSEISQHPVPQITSPTKQFRPRASLSTDPSRPKPRAASSAPSSRKASENSRKEDPPVPLPKQDVVSPRMPPNGEKRNAVLRSSKSRQSLAQTYSETNGSAPAKDTPKSKQPKPRKPPSTLSSNITSPTSSVSKTSQRTSVTSESNCSEPPRKVPEAKKASKSSSALRESIAKAKAARKAARQSNANDAFADPFNSISMKDPFNQLQNETSDKALLKSRTRAARKSGHLNIAALGLKEIPHEVMTMYDYDPESTDDWYEAVDLVKFIAADNEFESLSEDAFPDVDVTSLQMDEGCKGNQFGGLEALDLHGNLLASLPIGLRRLQRLRSLNLAKNRLNMDAIEVITQIGNLTELRLGNNDLDGMFTPQLGSLQKLEVLDLRGNALTGLPDNLSDLTGLRVLNVAENQLTSLPFSALSKLPLVEINAQKNRLQGCLVPASIRRIEGLQILNVSGNSLEGLSAGDVLELPSLQQLFADANRIKALPNVSSWTSLLSLIIEDNDLCEIPEGLSELTNLKHADFKGNSITTLNDRIGLMENLMTFHIGNNPLRERKFLSMDTENLKRELCTRCAPEVQEGEDGEESDHTEFTLAPERPETSHGWRVKSGGVLDRSSTDLSRLEVEDLEPLVSSSDIRCLYLKHNRFDRLPLSAISFLSHSLTDIDLSHNPMNGEDLFTSPIALPHLQNLTLAATGLTSFEPLQSFLSAPSLMFLDVSNNRLRGALPTLRSTYPKLITFLASENQINSLSFEAVEGLQALDVSNNNIDFLPPRLGLLGVEESGGLRRLDVSGNSFRVPKWQIVAKGTEAVLDWLKNRLTPEELREWQGDTDNM

SEQ ID NO: 27141 - protein, 325 aa, Pneumocystis carinii
MHSKVVIIGSGPSGHTAAIYLGRAELKPILYEGMLANGIAPGGQLTTTTDVENYPGFPDGILGPSLMEAFRKQSEKYGAQIITDTVSKLDLSKRPFKYCCESNEEVFHTADVVILATGAYARRLNIPGEEIYWQRGISACAVCDGAAPIFRGKPLAVVGGGDSAAEESLFLTRYATKVYLLVRRDKLRASPIMAKRLLHHPKIEILWNTVALESLGDNNLMNCVKIKNVKTQEVSELQVNGLFYAIGHEPATTLVRGQVECDKDGYIITKNGGPETNIKGFFAAGDVQDKKWRQAVTSAGSGCMAGLAAERLLAEEEEMKNIEDS

SEQ ID NO: 27142 - protein, 404 aa, Oryza sativa
MDPCPFVRVLVGNLPLVVADGGEQAPSGALAAAFHLSKADLEWFARKPSLLFSSSSSSRGPATLKVAVYAGRKGTTCGVSSGRLIGKATIPVDLKGAEAKAAVVHSGWICVGKKSGGKGGSAAAELSLTVRAEPDPRFVFEFDGEPECSPQVLQVRGSMKQPMFTCKFGCRSNSDLRRSVVQTERDAAAAAGKERKGWSVTVHDLSGSPVALASMVTPFVASPGTDRVSRSNPGAWLILRPAGDGSWEPWGRLECWRERGGAGASNSLGYRFDLLLPGVDHAVPLAESSIAASKGGKFAIDLTSMQPQSRGGTPGCSPRGSGDFSQWPLASYSYRGFVMSSSVQGEGRCSKPTVEVGVPHVGCAEDAAAFVALAAAVDLSMDACRLFSHKLRKELSHLRSDVLR

SEQ ID NO: 27143 - protein, 414 aa, Matricaria chamomilla
MKPASSSADSGTESCSSKGVAKTGEGLRQYYLQHIHDAQLQVRQKTHNLNRLEAQRNELNSRVGMLKEELQLLQEPGSYVGEVVKVMGKSKVLVKVHPEGKYVVDIDKSIDITKITPSTRVALRNDSYVLHLVLPSKVDPLVNLMKVEKVPDSTYDMIGGLDQQIKEIKEVIELPIKHPELFESLGIAQPKGVLLYGPPGTGKTLLARAVAHHTDCAFIRVSGSELVQKYIGEGSRMVRELFVMAREHAPSIIFMDEIDSIGSARMESGSGNGDSEVQRTMLELLNQLDGFESSTKIKVLMATNRIDILDPALLRPGRIDREIEFPNPNEDSRFDILKIHSRKMNLMRGIDLKKIAEKMNGASGAELKAVCTEAGMFALRERRVHVTQEDFEMAVAKVMKKETEKNMSLRKLWK

SEQ ID NO: 27144 - protein, 319 aa, Lactobacillus plantarum
MIAEYYIIINELAGSGHGKVVWETVKPILEQRQIRFEYRISEYAGHTIRLANEYVKTIQRRPNVTPVILVIGGDGTLNEALNGIMQVPQAEPIPLAYIPGGSGNDFARGLGMATDPAIALAQVLNNMRPRSLNVGYFHETLKNEHRYFVNNVGLGFDAQIVDDTNRSKKKGRLGRWAYLSNMLAAYSQQEGFPLTVHVNRKRDYYKRAFLCTVSNIPYFGGGVKILPQANLHDNQLELIVVEEPHWWIILWLFVLLLLGGRHLKSRFVHHYRNANLHLLVNSVEIGQMDGQIIGNRNYDLYLSTHPYPFWIDTSIHDHH

SEQ ID NO: 27145 - protein, 207 aa, Pseudomonas aeruginosa
MARSKTSQRWLKEHFDDPYVKMAQRDGYRSRASYKLLEIQEKDRILRPGMTVVDLGAAPGGWSQVTSRVIGDRGRLIASDILEMDSIPDVTFIQGDFTEDAVFARILEAIGDHPVDLVISDMAPNMSGVRAADQPRAMYLCELALDLAGRVLRPGGDFLIKIFQGEGFDQYHKQAREMFDKVQMRKPLSSRDRSREQYLLARGFRGE

SEQ ID NO: 27146 - protein, 220 aa, Matricaria chamomilla
MENTNVVLLTTWASGFGMRVQIALAEKGIEYEYKEEDLSNKSSLLLEMNPVHKKIPVLIHNGKPICESNIIVQYIDDAWSNKSPSLLPSDPYLKAQARFWADFVDKKIYDAARKIWTTKGEEQETAKKEFIDWLKVMEGQLGDKPYLIGDSFGYADIALIPFSCWFYTLETIGNMSIEKECPKLVAWVKRCMERESVSKSLADPHKMYEFVLQLKKKLGL

SEQ ID NO: 27147 - protein, 304 aa, Anabaena sp.
MTQAKAKHADVPVNLYRPNAPFIGKVISNEPLVKEGGIGIVQHIKFDLTGGNLKYIEGQSIGIIPPGVDKNGKPEKLRLYSIASTRHGDDVDDKTISLCVRQLEYKHPESGETVYGVCSTYLTHIEPGSEVKITGPVGKEMLLPDDPEANVIMLAGGTGITPMRTYLWRMFKDAERAANPEYQFKGFSWLVFGVPTTPNILYKEELEEIQQKYPDNFRLTYAISREQKNPQGGRMYIQDRVAEHADQLWQLIKNQKTHTYICGPPPMEEGIDAALSAAAAKEGVTWSDYQKDLKKAGRWHVETY

SEQ ID NO: 27148 - protein, 152 aa, Photobacterium profundum
MQVTTRTMNKSKHIALVAHDNCKQDLLRWVKEFEDKLEDHTLYATGTTGHLLSKETGLKINCMISGPMGGDQQLGALISESKIDMMIFFWDPLNAVPHDPDVKALLRISAVWNVPVATNRASAKFMITSPLLAEEISIEIPDYEAYLAERIG

SEQ ID NO: 27149 - protein, 431 aa, Prochlorococcus marinus
MKRVLAIILGGGAGTRLYPLTKMRAKPAVPLAGKYRLIDIPISNCINSNINKMYVLTQFNSASLNRHLGQSYNLSAAFGQGFVEVLAAQQTPESPSWFEGTADAVRKYQWLFQEWDVDEYLILSGDQLYRMDYSLFVEHHRRSGADLTVAALPVDAEQAEGFGLMRTDSDGNIQEFREKPKGESLKAMAVDTSRFGLSAESAKNKPYLASMGIYVFSRATLFDLLHKNPSHKDFGKEVIPEALARGDRLQSYVFDEYWEDIGTIGAFYEANLALTQQPNPPFSFYDEKFPIYTRPRYLPPTKLVDAQITESIIGEGSILKSCSIHHCVLGVRSRVESDVVLQDSLVMGSDFYESSEERTLLRQGGGIPLGVGEGTTVKGAILDKNTRIGNNVTIVNKDHVEEADRADEGFYIRNGIVVVVKNATISDGTVI

SEQ ID NO: 27150 - protein, 472 aa, Prochlorococcus marinus
MSKAHFGLIGLGVMGENLVLNAERNGFSSVVYNRTYAKTEEFLKGRGADKAIQGAKDLQDFVDKLERPRRILMMIKAGSAIDAVIEQISPYLQEGDLLIDGGNSEFRDTERRVAELESKSFGYIGMGVSGGAKGALEGPSMMPGGTKTSYEAIESLVCKMAAQVEDGPCVTYIGPGGSGHFVKTVHNGIEYGIEQILAEAYDLMKRVGGMTGTQMADVFAHWNATEELTSYLVEITEVCLRTKDPDDGSDLVEKILDKAGQKGTGLWTVVSALELGASVPTIYASLNGRVMSSMKPQRIAAEQILHGSAIRPFDLGSSADGMAPLMDAVVLSCMASYAQGMELLRIASAEYNYNLHLPSIAQIWKGGCIIRSRLLQRIQDAFNADPQLSNLLIDPWFAEQVNRRLPGLAKVVAGAAEAGIPVPCFSSTLDYINSYRTARLPQNLVQAMRDCFGSHTYQRVDKEGTFHTEWLD

SEQ ID NO: 27151 - protein, 960 aa, Pseudomonas putida
MINFFDPASDKNSDLGTPARDSDVQVSLSIDGRAISVPAGTSVMRAAAMLGTSIPKLCATDSLEAFGSCRMCMVEIEGMRGYPASCTTPVSEGMVVRTETPRLAGLRRNVMELYISDHPLDCLTCSANGNCELQTVAGQVGLREVRYGYDGANHLAEKKDVSNPYFDYEPSKCIVCSRCVRACEDIQGTFALTITGRGFESRVAAAGGDDFLTSECVSCGACVQACPTATLTEKSLVQLGQPERSVITTCAYCGVGCSFRAEMKGDQLVRMVPDKNGGANHGHACVKGRFAWGYATHPDRITKPMIRKRLEDPWQEVSWDEAVTYAASEFRRIQLKYGRDAIGGITSSRCTNEEAYLVQKLVRTAFGNNNVDTCARVCHSPTGYGLKQTLGESAGTQSFDSVMQADVVLVIGANPTDAHPVFGSQLKRRLRQGARLIVIDPRRIDLVDSPHARAELHLQLRPGTNVAMLNALAHVIVTEGLLAQRFIDARCETEDFARWRDFVSLADNAPEVLGPVCGVPAEQIRAAARLYATGGNAAIYYGLGVTEHSQGSTAVMGIANLAMATGNIGREGVGVNPLRGQNNVQGSCDMGSFPHELPGYRHISNEGVRAEFERAWGVTLQPDPGLRIPNMFEAALDGSFKALYCQGEDIAQSDPNTQHVTAALHAMECVVVQDIFLNETAKFAHVFLPGSSFLEKDGTFTNAERRISRVRKVMEPLAGKADWEATVALANALGYPMNYRHPSEIMDEIARLTPTFRRVSYAEIDRHGSLQWPCNDAAPDGTPTMHIDQFVRGKGRFMLTGYVPTDEKVNNRYPLLLTTGRILSQYNVGAQTRRTGNVAWHDADRLEIHPTDAESRGIQDGDWVGIGSRAGQTVLRAKVSARVAPGVVYTTFHFPESGANVITTDNSDWATNCPEYKVTAVEVVKVFQPSQWQKRYQDFSDEQRRLLIERRTAEKAEVRR

SEQ ID NO: 27152 - protein, 243 aa, Glycine max
TRPAIATSTRALRRSNCIPSCSVSYQKFVEFALDETKRHTHLIPSPLQEKFSFMNSKDVKGSFSMLSFEAAKIRLLRSLIIQTETMQVLDFTVFPKAEYDVPIFCANFFTSAKTNIIVLDLNPVHDIINQYEYKEKYFKSLIPLGLKYAEVWLELICKAVKETDESQIFHNLEAQHRYLTWRAEKDMLRSFLFNGVDELGSKTFNDYFPRYCCQEGTLNKKGNVIGKSFENRPWNARGEFIGE

SEQ ID NO: 27153 - protein, 372 aa, Cuphea lanceolata
MAPSELNCTHQNQHSSGYDGPRSRVTVVGSGNWGSVAAKLIATNTLKLPSFHDEVRMWVFEETLPSGEKLTDVINQTNENVKYLPGIKLGRNVVADPDLENAVKDANMLVFVTPHQFMEGICKRLEGKIQEGAQALSLIKGMEVKMEGPCMISSLISDLLGINCCVLMGANIANEIAVEKFSEATVGFRENRDIAEKWVQLFSTPYFMVSAVEDVEGVELCGTLKNIVAIAAGFVDGLEMGNNTKAAIMRIGLREMKAFSKLLFPSVKDTTFFESCGVADLITTCLGGRNRKVAEAFAKNGGKRSFDDLEAEMLRGQKLQGVSTAKEVYEVLGHRGWLELFPLFSTVHEISTGRLPPSAIVEYSEQKTIFSW

SEQ ID NO: 27154 - protein, 340 aa, Lactococcus lactis
MKRIAVLTSGGDAPGMNAAIRAVVRKAISEGIEVYGINHGYAGMVAGDIFPLTSASVGDKIGRGGTFLYSARYPEFAQVEGQLAGIEQLKKFGIEGVVVIGGDGSYHGAMRLTEHGFPAVGLPGTIDNDIVGTDFTIGFDTAVSTVVDALDKIRDTSSSHNRTFVVEVMGRNAGDIALNAGIAAGADDICIPEKEFKFENVVNNINKGYEKGKNHHIIVLAEGVMTGEEFATKLKEAGYKGDLRVSVLGHIQRGGSPTARDRVLASRMGARAVELLRDGIGGVAVGIRNEELVESPILGTAEEGALFSLTTEGGIKVNNPHKAGLELYRLNSALNNLNLN

SEQ ID NO: 27155 - protein, 553 aa, Oenococcus oeni
MKDGTISDFANKVVYQVYPKSFKDSNNDGIGDLQGIIENLPYLAKLGIDYLWLNPIFPSPQRDNGYDISDYRAIDPIFGTMNDFKELVSKAAEHKISIMMDMVFNHTSIAHQWFQKALAGDKKYQAYYILRPKKADGSTPNNWQSKFGGSAWASFGDSDLDYLHLYDISQADLNWRNPEVVSEVNHVLKFWLDKGVKAFRFDVINVIGKDRKLLDDPTGGDGKAMYTDKPIVHDYLQNMYRDVFAKENNIMTVGELSSTSVENAVEYTAPGRHELSMAFTFHHLKVDYQNGNKWTKVPYDFQKLRQVLHQWGKGLSDGNGWPAWFWNNHDQPRAINRFVSNPKYYRLGAEMLAAVVHLNRGTPYIYMGEEIGMINPDFKSIDSYVDVESHNAYKELLKKGTSASEAFQIVKSKSRDNSRIPMQWNSEKYAGFSRHKPWLANGNYKDINVAKDLSDPNGLFSFYQRLILLRKQEKVIAKGDYQPFFPDIPEIIAFKRQFQEDSLLVINHFGEEKITLSLPVESLGGKIILSNYSNTKIARQITLKPYETLAIKY

SEQ ID NO: 27156 - protein, 757 aa, Streptomyces antibioticus
ASMTGGQQMGRGSGSEFMENETHYAEAVIDNGAFGTRTIRFETGRLARQAAGSAVAYLDDDTMVLSATTASKNPKDQLDFFPLTVDVEERMYAAGKIPGSFFRREGRPSEDAILTCRLIDRPLRPSFKKGLRNEIQVVATIMALNPDHLYDVVAINAASASTQLAGLPFSGPIGGVRVALIRGQWVAFPTHTELEDAVFDMVVAGRVLEDGDVAIMMVEAEATEKTIQLVKDGAEAPTEEVVAAGLDAAKPFIKVLCKAQADLAAKAAKPTGEFPVFLDYQDDVLEALSAAVRPELSAALTIAGKQDREAELDRVKALAAEKLLPEFEGREKEISAAYRALTKSLVRERVIAEKKRIDGRGVTDIRTLAAEVEAIPRVHGSALFERGETQILGVTTLNMLRMEQQLDTLSPVTRKRYMHNYNFPPYSVGETGRVGSPKRREIGHGALAERAIVPVLPTREEFPYAIRQVSEALGSNGSTSMGSVCASTMSLLNAGVPLKAPVAGIAMGLISQEINGETHYVALTDILGAEDAFGDMDFKVAGTKEFVTALQLDTKLDGIPASVLAAALKQARDARLHILDVMMEAIDTPDEMSPNAPRIITVKIPVDKIGEVIGPKRQMINQIQEDTGAEITIEDDGTIYIGAADGPAAEAARATINGIANPTSPEVGERILGSVVKTTTFGAFVSLLPGKDGLLHISQIRKLAGGKRVENVEDVLGVGQKVQVEIAEIDSRGKLSLIPVIEGEEAASDEKKDDAEQ

SEQ ID NO: 27157 - protein, 334 aa, Cryptococcus neoformans
MASVKEGDYQALKEEIKKIMKQPGYDDGSAGPVLVRLAWHASGNFSLVEHNGGSNGAGMRFPPESVDPANAGLHYAISFLLPLQSANSWISHADLWTLAGVTAIEAMGGPQIPWEPGRLDYESEQAAVEHRGDVSNRLPDGALGAAHIRDVFGRMGFSDQEIVALSGAHNLGRCHADRSGFDGPWVVNPTRFSNQYFKLLLRPIWKPRQWDGPFQYEAIVAGTRLMMLPTDMALIEDPSFRPWVEKYAADQNLFFKDFANAFGKLIELGVDRDDTGFARLAKKAAEEGKPLDKTAPPAGDETCPVSGAVGGGVQRAAGGGGCPFMAMQNREAKL

SEQ ID NO: 27158 - protein, 354 aa, Candida albicans
MTPPTMLQTAPVESFNLNPKSTQQAINLKSDAKNGKVSFADWNEFKFAPIRESTVSRAMTRRYFADLDKFAESDIVIIGAGSAGLSAAYTLGKNRPDLKIAIIEASVSPGGGCWLGGQLFSAMVLRKPAHLFLDDMGLDYEDEGDYVVVKHAALFMSTLMSKVLQFPNIKLFNATAVEDLITRKDPATNLQRIAGVVVNWAQLDHDTQSCMDPNTINCNVVLSTSGHDGPFGAFTAKRLEQLGRAPRDVTAGFTKPSITTSKLQEPEPISNFQLGGMKGLDMNKAEDAIVKGTREVVPGLVIAGMELAEVDGSNRMGPTFGAMALSGVKAAESVLNVLELRKQQNEACYGAYKG

SEQ ID NO: 27159 - protein, 297 aa, Alteromonadales bacterium
MTSPAKLTVALVQQSNNDNADENMAKSIKAIREAAKKGAQLVVLQELHRSLYFCQTEDVDVFDLAETIPGPSSNTLGELAKELNIVIVASLFEKRATGLYHNTAVVLEKDGSIAGKYRKMHIPDDPGFYEKFYFTPGDLGFEPIQTSVGKLGVLVCWDQWFPEAARLMAMAGAELLIYPTAIGWDPNDDQNEQTRQKDAWVISQRAHAVANGVPVISCNRVGHESDPSGHSSGIQFWGNSFIAGPQGEFLAQANNIDEQILVVEVDQKRSENVRRIWPFLRDRRIDHYSDLTKIYRD

SEQ ID NO: 27160 - protein, 112 aa, Unknown
  Sulfitobacter sp. EE-36
MKLIIATIKPFKLEEVREALTEAGVRGLMVTEIKGFGAQSGHTEIYRGAEYVVNFVPKVKLELVVADALADQMVETITRTAHTGKIGDGKIFVLDVEQAVRVRTGETGEDAI

SEQ ID NO: 27161 - protein, 475 aa, Candida albicans
MSLEDDEALFEDLYGDDEKQEEKQDTVQKEVESTEKETTVVETASATENASSAEVETTTEGESESVPPPPPPPIPASGDVNAQSNTAQDNATSTAPGSVPAGMPQFPFDPAQFQQYAAANGLQFPGNANQQNFGAAGGVPPPPPPAPTANATSAESAGGPSRKCFIGGLSWDTTEEALVSHFQKYGNIVDYTIMKDSATGRSRGFGFLTFEDAKSVDALLKDRHVLDGKLIDPKRAISKEDQEKVGKIFVGGIDPMVTEEEFDNFFSQFGKIIDCQLMIDKDTGRSRGFGFVTYDSPAAVDKVCVNKYLTLKGKAMEVKRAAPRGQHNQQVMMQQQQQQQQQQAQQQAQQQAMYPYGSYGFQQMNPGAMNPAMSQEYMRYYQWFMYQQAQAAQQQQQSGTSASPEAQPAQPLNPQQQAAEEESEKSDEQARPAIPTGPKRAPPTGPSYRGGGRGGGRGGYRRGRGYHPYSRGGRR

SEQ ID NO: 27162 - protein, 712 aa, Bacillus cereus
MSQEKQVFSIDLAGRQLTVETGQLAKQANGAVLVRYGDTAVLSTATASKEAKNVDFFPLTVNYEERLYAVGKIPGGFIKREGRPSEKAILASRLIDRPIRPLFADGFRNEVQVVSIVMSVDQDCSSEMAAMLGSSLALSISDIPFEGPIAGATVGRINGEFVINPTVEQQEQSDIHLVVAGTKDAINMVEAGADQVPEETMLEAIMFGHDEIKRLIAFQEEIVQAVGKEKSEVKLYEVDADLNQSVREMAEKDMHSAIQVHEKHAREDAINEVKKRVIEHYEAQEADADTLGQVNEILYKIVKEEVRRLITVEKIRPDGRKGDEIRPLASEVGILSRTHGSGLFTRGQTQALSICTLGALGDVQILDGLGVEESKRFMHHYNFPSFSVGETRPMRGPGRREIGHGALGERALEPVIPSEKDFPYTVRLVSEVLESNGSTSQASICGSTLAMMDAGVPLKAPVAGIAMGLVKSGEHYTILTDIQGMEDHLGDMDFKVAGTAHGVTALQMDIKIDGLSREILEEALQQAKVGRMHILDHMLSVIAEPRTELSAYAPKIITMTINPDKIRDVIGPSGKQINKIIEETGVKIDIEQDGTVFISSINQEMNDKAKKIIEDIVREVQVGEIYEGKVKRVEKFGAFVELFSGKDGLVHISELALERVGKVEDVVKIGDVITVKVIEIDKQGRVNLSRKVLLKEEQEKEAAKEENKQEQQ

SEQ ID NO: 27163 - protein, 546 aa, Staphylococcus aureus
MKQRIGAYLIDAIHRAGVDKIFGVPGDFNLAFLDDIISNPNVDWVGNTNELNASYAADGYARLNGLAALVTTFGVGELSAVNGIAGSYAERIPVIAITGAPTRAVEHAGKYVHHSLGEGTFDDYRKMFAHITVAQGYITPENATTEIPRLINTAIAERRPVHLHLPIDVAISEIEIPTPFEVTAAKDTDASTYIELLTSKLHQSKQPIIITGHEINSFHLHQELEDFVNQTQIPVAQLSLGKGAFNEENPYYMGIYDGKIAEDKIRDYVDNSDLILNIGAKLTDSATAGFSYQFNIDDVVMLNHHNIKIDDVTNDEISLPSLLKQLSNISYTNNATFPAYHRPTSPDYTVGTEPLTQQTYFKMMQNFLKPNDVIIADQGTSFFGAYDLALYKNNTFIGQPLWGSIGYTLPATLGSQLADKDRRNLLLIGDGSLQLTVQAISTMIRQHIKPVLFVINNDGYTVERLIHGMYEPYNEIHMWDYKALPAVFGGKNVEIHDVESSKDLQDTFNAINGHPDVMHFVEVKMSVEDAPKKLIDIAKAFSQQNK

SEQ ID NO: 27164 - protein, 383 aa, Ralstonia metallidurans
MPRMYAAESALDHRTADPAPSGAPAAAPAETRTEAATRDLRRVPIHPDHWYPLAWSREVKAGQAHGVQFAGDPIVLVRTATGKIFALEDRCAHRQVPLHAGVVDGESIRCCYHGWTYDCSGRCIDVPYLGKERLPNGVRAYPCEERAGLIFVFPGNPALAGQQPLPEFASVADKHYKTRRFGREVKCHYSFMHENLMDMNHQFLHRRQMGMMRARSLGRRRGADFVEVDYTFSREGGKQPMGEALVFSKEGGEGNKDVMTVRTGYPYQTLKIRSGSGTLVMDLWIAYVPLDAAQRTNRTFGMLSIRRPGIPFALDLAWPLLVWFTERIFKEDRWIVEREQEAHDRQGEDWNHEVFPVIRDLRDLLRECGGRTVIPIQRLETQV

SEQ ID NO: 27165 - protein, 402 aa, Unknown
  marine gamma proteobacterium HTCC2207
MKSGVVIIGAGQAAAVAAATLRKEKYTGTIKILGDESHPPYDRPPLSKHYLAGELSLAETLIRPLAFYSDNDIELLTNTRVASIDIESKQVVTESETVFDYDKLVITTGSRARRLDLPGCQLGGIFYLRSLNDVDLIRASMGSAKKLCVIGGGYVGLEVAAVATKAGLDVTVIETQERILQRVTTPEMSDYYHSLHTERGVNIMLNQAVTGFDGEGSVSKVLCGDLSVDADIVVIGVGILPNVEIAENAGLECDNGIVVDDHGQTSNPDIYAAGDCANHPNRLLNRRLRLESVPNAIEQARVACINLLGGDLEYASIPWFWSDQYELKLQMVGFSADGEESVVRGDKSTNKFAVFHLKEGRVVAVDAVNNSKAFMLGKRLYGKSVDAKLLADESVELKAFLK

SEQ ID NO: 27166 - protein, 529 aa, Myxococcus xanthus
MTERELWERYQRYLCVVPALDFTLDVSRMRFPADYLERMRPRLEEAFGAMEALEKGAVANPDEKRKVGHYWLRAPELAPEPALQKEITDTVAAIHAFAKNVHEGRVKPQKAQRFTHMLIVGIGGSALGPQLVADALGTAKDPMQVSFFDNTDPDGFDRVLAQLGERLSETLTLVISKSGGTKETRNGMLEAERGYSARGLDFSKHAVAVTGAGSELDNHAKKQGWLRAFPMWDWVGGRTSVTSAVGLLPARLQGLDIDALLKGARDMDAATRERDALKNPAALLALMWHYAGDGRGHKDMVILPYKDRLLLMSRYLQQLVMESLGKETDLDGQVVNQGIAVYGNKGSTDQHAYVQQLREGVLNFFATFIEVLKDRDGGSQEVEPGVTSGDYLLGFLLGTRRALYEKDRESLTLTVPDVSARTLGALIALYERAVGFYATLVHINAYHQPGVEAGKKAAGVVLELQRKLTTRLREARAEARTAEQLAADIGMPDEVETVFKVLQHLAANPDRGVTRTPGATPTQARFQAK

SEQ ID NO: 27167 - protein, 176 aa, Ostreococcus tauri
  misc_feature (161)..(168): Xaa can be any naturally occurring amino acid
MACTPWRVLVKKTKHHEEDARRHISRRIASMSSDERESYGAETFAEGNWYHELLEDGLALSYRVQERIARVRVEEVLYEGASKFQEVEVVRTVPFGSLLITDGLMQSSEHDEYVYHESLVHPALAAHACPKRVFIGGGGEGATLREVLRHPCVEECVMVDXXXXXXXXPRRSHVAS

SEQ ID NO: 27168 - protein, 618 aa, Unknown
  Frankia sp. CcI3
MTWTPAEGAPRILLIKPPIRACMIEIGRHMPIGLAYLASRLRAAGMQVDIFDALANTEDNHVVDPADYTAADRAKVAAHPRWGHLVHWGARWDRLEQQLRRGYDLVGVSCMFTPYYEPAYELGRLARRILPHARVVLGGQHPTVAFQHAMTEPAFDALVLGEAESNVVEIVQALLDGAPLTGLAGVAYRCGTGLCGCPPGGPGVHVQPRTEFLTDLDGLPLPAVNLLEMSSYDSTATLITSRGCPFSCSFCTVHATVGRKFRARSPHNVADEIEHYVTDHGIRRFFVEDDNFTFDVPRVREICREITRRGLDVELHLPNGMTVVDLDGSLVDDMVSAGFRSLFLGLETTDPVRLRRIRKGFTSLQKVNDGAALFREQGVDVGASLIVGLLGQECSELARDSVNLMLAGVRFWTNPFYPIPGSPDFERCLRTGLITPTTELALYDQFNFAIGSDRLSPAELYWACVVTQAMAQWTGYLLEGAHARRRGAAATTEQALERLVQHSGDLFGPHGELEVPAVPVAVDRQTVRVHPDGCFHSMQRLDPARLPADSCTFTGDVIAAAVTLHTGVAHGGRQNAGTGSPCAFTISTTLADPVGAAVAATVLTELETALTTNMEVLG

SEQ ID NO: 27169 - protein, 334 aa, Glycine max
MWWPCGRSGGSSFSSSSTAEQVTEGIDGTGLTAIVTGASSGIGAETTRVLAMRGVHVIMGVRNVVAAKVVMEAILKEIPNAKVDAMELDLSSMISVRKFALEFISSGLPLNILINNAGIFGTPFKLSEDNIELQFATNHMGHFLLTNLLLDTIKRTTHESKKEGRIVNISSSGHQWLNYRGGILFDKINDESSYQKFCAHGQSKLANILHANELARRLKEEGVNITANSLHPGAIATNIHRYNRILTGIPGVVKRLLNLVIKNVQQGAATTCYVALHPEVRGISGEYFADNKIAKANSLGRDIDLAKKLWDFSMNLIKVEYLVPIVDADGILRE

SEQ ID NO: 27170 - protein, 322 aa, Prochlorococcus marinus
MEIAGDITSLVGKTPLVKLDRIKKYCNCHPEIIAKLESFNPSASVKDRIAYSMLNSAEKDGLILPGKTTLIEATSGNTGIALAMVAAAKGYRLILTMPDTMSIERRAMLRAYGAELQLTPGKEGMNGALDLASELSSSIPNSFQFNQFENLANPEIHERTTAKEIWDQSNQTIDGLVSGVGTGGTITGCSRFLKKVNPNCKIYAVEPAKSAVISGEKAGSHSIQGIGAGFVPKVLDTHLIDEIFKIDDEEAFYYGRLLARLEGLLSGISSGAALAATIKIGQRKELINQRLIVILPSFGERYLSTAMFESNTAIKARKDGYL

SEQ ID NO: 27171 - protein, 216 aa, Triticum aestivum
DLIIWKVQFLDRHHLFIKFGSVNGRVTRSTDQNLAFFAVYNMETTEIVSLYQNSSEELYSLSARRYDHFHANPQNSSHEKFISSHSNSVHALDQLRTIKNKASSSSQFVKKMMASLPYTCQSQSPSPYFDLSIFRYDEKLFSAIDRHRHCTEHPIKFISVRQPNVVKFKIKPGSDSGASDSRGKRISSLFHPFFPLALSIQQTNMQPTVVNVHFRR

SEQ ID NO: 27172 - protein, 129 aa, Mycobacterium avium
MDQVSFYDAVGGAETFQAIVSRFYAQVPEDEILRELYPLDDLEGAEERLRMFLEQYWGGPRTYSDRRGHPRLRMRHVPFRITPLARDAWLRCMHTAVASIDSKTLDDEHRRELLDYLEMAAHSLVNSPL

SEQ ID NO: 27173 - protein, 413 aa, Unknown
  Photobacterium sp. SKA34
MGQAGQQAAFELATTSTAVKNNALAIIADELESNKDIILAANKQDIDAALESGMSDALVDRLLLNESRLAGIANDVRNVINLNDPVGAELDSRVLENGMRLSRRRVPLGVVGVIYEARPNVTIDIAALCLKTGNASILRGGRETFHSNMALVKVIQVALEKAGLPAASVQYIEQPDRELVSQLLKLDQFVDMIIPRGGAGLHKMCKENSTIPVIIGGFGISHIYVDESADLTRSLDVVENAKVQRPSACNALDTLLVNEKVAEAFLSRLVERMNKAKVTFVADEHAYNLLEGKASSLRKITEGDFDTEWLSYTLGIKVVNDVDEAIFHMRKHNASHSDSILTNNLQSAERFVNAAGSAAVYVNASTRFTDGAQFGLGAEVAVSTQKLHARGPMGLEELTSYKWVGVADYLSRA

SEQ ID NO: 27174 - protein, 377 aa, Pseudomonas aeruginosa
MAKRDFYEVLGVERGASEADLKKAYRRLAMKYHPDRNPGDKEAEDKFKEANEAYEVLSDASKRAAYDQYGHAGVDPNMGGGAGAGFGGASFSDIFGDVFSDFFGGGGARGGSRGGAQRGADLRYTLDLDLEEAVRGTTVTIRVPTLVGCKTCNGSGAKPGTTPVTCTTCGGIGQVRMQQGFFSVQQTCPRCHGTGKMISDPCGSCHGQGRVEEQKTLSVKVPAGVDTGDRIRLTGEGEAGSMGGPAGDLYVVVNVREHPIFQRDGKHLYCEVPISFADAALGGELEVPTLDGRVKLKIPESTQTGKLFRLRGKGVAPVRGGGAGDLMCKVVVETPVNLDKRQRELLEEFRKSLQSDTSHSPKASGWFEGMKRFFDDL

SEQ ID NO: 27175 - protein, 1331 aa, Saccharomyces cerevisiae
MMMDILNTQQQKAAEGGRVLAPHTISSKLVKRLSSHSSHKLSRSDLKALGGSETISDGPSQLTFKDRYVFNESLYLKKLKKTALDDYYTRGIKLTNRYEEDDGDDEIIRLSNGDRIDEDLHSGVKFFSTTPYCRKMRSDSDELAWNEIATERFKWQSMLARVLKGDIVKGEKTRIANQVKKPGLNKELSDEIWLELKAWLNGRTMQEMEQSLTYLRDSSDSVFEEIMKFQIPQGKILSLDALEAILQDLMNRYHSVVSYWPNLKKMYKDKPITNTAEFTARIDVMNSWLNFKTNLTLRRQELDDWINRFSPISSSDNCQEDFDGVPQWNCKMKILAEQLMKEKNIESIFQKKIFYPLSPWMFKLKLHFIVYRETLTKMNIKYPYERLRSLLAFPVYLIKEVILTRLSYARKLKNPTMMMIDQMIDDFNAFIRLSVQLKYTLTKYCSNLPFDVDFDPTFENTVIEAIRYLFFLLNLKLIDSSKQNFKAPDLLLKYWDHLKNTGHYINGAETVIPNEFLKLTLRLVHKLQFYLLKQQNFPPTFANASEAEKWLSSIFENLGAMKRKLNRFSNILVKAFQNSAVYQINHNAQLVKKLKDAHYFLVYSGNTFESSGVYMFAAPELLGCDNDTILRILRNKSIGCDLVPKLDIGNNLNVYDITTKETDLNILVSKGEDSKGIPYYRVVANSSSDLDRHAHQSKKKNFSTDPFDQHLDEKNNEVFELEVALSSLGALVVLYPGEPVVWDGPVYKLPGNNLFASNEMDLGKIGNPNTLILLNQGSNYALTYQIDKFNQTVGDSVSFIEKRCSLNSIESSLQKINKAYYKLTYTVLNNYKGILGSFMKQCPGNELLNSIFMFGRDFGRSFLKYNAFSSKRKYVIIFLMVKLGMNWLKFLVEECDPTDQRTFRWCVLAMDFAMQMTSGYNILALNVKQFQELKERVSVCMSLLISHFDVMGARATEAENGMQQARLNIDTEENIDEEATLEINSRLRLEAIKTLEKTMKRNPRQMGKVLDATDQGNKYLLSLASSLSNVSMRWQKRSFIGGGTFGQVYSAINLENGEILAVKEIKIHDTTTMKKIFPLIKEEMTVLEMLNHPNIVQYYGVEVHRDKVNIFMEYCEGGSLASLLDHGRIEDEMVTQVYTFELLEGLAYLHQSGVVHRDIKPENILLDFNGIIKYVDFGTARTVVGSRTRTVRNAAVQDFGVETKSLNEMMGTPMYMAPETISGSAVKGKLGADDVWALGCVVLEMATGRRPWSNLDNEWAIMYHVAAGRIPQLPNRDEMTAAGRAFLERCLVQDPTMRATAVELLIDPWMIQIREIAFGNSEKDQVPILSS

SEQ ID NO: 27176 - protein, 341 aa, Lactococcus lactis
MNPQKIAVLGPGSWGTALSQVLNDNGHEVRIWGNNPEQMAEINEKHTNTRYFKDVVLDEKIKAFDRLDLALEDVDAILFVVPTKVTRLVAKQVAEVLKHKVHILHASKGLEQGTHERISTILEEEIPAQLRGEIVVVSGPSHAEETIVRDITLISAASKDHDEAKYAQAIFSNDYFRLYTNTDVIGVETAGALKNIIAVGAGALHGLGFGDNAKAAIITRGLAEITRLGVAMGAEPLTYSGLSGVGDLIVTGTSIHSRNWRAGDALGRGEKLADIEKNMGMVIEGVSTTKAAFELAQQLGIDMPITETIYKVLYENLDAKTGILDIMRRETRAENEFINNK

SEQ ID NO: 27177 - protein, 353 aa, Haemophilus influenzae
MKLSKTFLFITALCCAAPTLAIQNSTSSSGEQKMAMENTQNIREIYLAGGCFWGMEAYMERIHGVKDAISGYANGNTEKTSYQMIGLTDHAETVKVTYDANQISLDKLLKYYFKVIDPTSVNKQGNDRGRQYRTGIYYQDGADKAVIEQALAQLQTKYKKPVQVEVQPLKNYIVAEEYHQDYLKKNPNGYCHIDITKADEPVIDEKDYPKPSDAELKAKLTPLQYSVTQNKHTERSFSNEYWDNFQPGIYVDVTTGEPVFSSNDKFESGCGWPSFTKPIIKDVVHYETDNSFNMQRTEVLSRAGNAHLGHVFDDGPKDKGGLRYCINSASIKFIPLAEMEKAGYGYLIQSIKK

SEQ ID NO: 27178 - protein, 435 aa, Aquifex aeolicus [sequence omitted]

SEQ ID NO: 27179 - protein, 112 aa, Azospirillum brasilense
MKLVMAIIKPFKLDEVREALTSLGIQGLTVSEVKGFGRQKGQTEIYRGAEYSVSFLPKVKVEVAVSDDQYEQVVEAIQKAANTGRIGDGKIFVLDIAQAVRIRTGETNTEAL

SEQ ID NO: 27180 - protein, 405 aa, Aspergillus nidulans
MTVINEEGHETGRYLAIDMGGTNLRICDVTLTEEKGAYTIEQDKYRLPIHLRKGKGVELWEFIAAKLEDFLAKHKLAREDGEKLPLAFTFSYPVTQDHIRHGVLQRWTKGFDISGVEGEDVVAHLEEVFEKRNVPVRLVALVNDTVGTLIASAYKNPAIKIGSIFATGCNAAYMEKVSRIPKIADHGSEFESDALVSINCEYGAFDNAHKVLPMTRFDEEIDQTSARPGQQAYEKMVAGMYMGELLRLLLLHLHESSGFFTDAEIDRLRGYGTMDSASLSRMEAGGSEAERMSDAKCILKDLYGIEATDEEARVCCLLGEIVCTRAARLYACGIAALCRKQGISECAVGVDGSTFEKYSQFRERAVDALGEILDWPEGQQLVKLVTAEDGSGVGSALIGAITLNQ

SEQ ID NO: 27181 - protein, 451 aa, Oryza sativa
MASAPPVQEEALQPGTNHFRSRLAAAVRSISWSYTIFWSTSTSLPGVLTWNDGFYNGEVKTRKISNLEDLTADQLVLRRSEQLSELYYSLLSGECDHRARKPVAALSPEDIADTEWYYVVCMTYAFRPGQGLPGRSYASNRSVWLCNAQSADSKTFLRALLAKSASIQTIVCIPFMSGVLELGTTDPVSEDPNLVNRIVAYLKELQFPICLEVPSSTPSPDETEDADTVFDGLIEEDQMVILQGEDELGDVVVAECETNGANPETITMETDEFYSLCEELDLDLGSYQLVPTSARETVAAAAAAANDVDGVAYSHASCFVSWKRANPAEKVVAVPMTAGIESQKLLKKAVGGGTAWMSNIDDRGSVAITTTPGSNIKSHVMSERRRREKLNEMFLILKSLLPSVRKVDKASILAETITYLKVLEKRVKELESSSREPSRWRPTEIGQGKAP

SEQ ID NO: 27182 - protein, 703 aa, Fusobacterium nucleatum
MKELMFDEKIMELELAGRTLKVSTGKISRQSSGAIVIQYGDTVLLSTANRSKEARKGADFFPLTVDYIEKFYSSGKFPGGFNKREGRPSTNATLVARLIDRPIRPMFPDGFNYDVHIVNTVLSYDEINIPDYLGVIGSSLALMISDIPFLGPVASVIVGYKNGEFILNPSPKELEESELDLIVAGTKEAVNMVEAGAKELDEETMLKAIMFAHENIKKICEFQEEFSKLYGKENIEFEKPEVLTLVKDFIDTNGYERLQQAVLTTGKKNREDAVDSLEEELMEKFIQENYPDVPEEELPEDIILEFKTYYHDLMKKLVREAILYHKHRVDGRTTTEIRPLDAQINVLPIPHGSALFTRGETQSLAITTLGTKEDEQLIDDLEKEYYKKFYLHYNFPPYSVGEVGRMGSPGRRELGHGSLAERALSYVIPTEEEFPYTIRVVSEITESNGSSSQASICGGSLSLMSAGVPIKEHVAGIAMGLIKEGEEFTVLTDIMGLEDHLGDMDFKVAGTKSGITALQMDIKITGITEEIMRIALNQAHQARIQILELMNNTISKPAELKSNVPRIQQITIPKDKIAALIGPGGKNIKGIIEQTGATVDITDDGLVSVFAKDADTLEKTLKLVDSFVREVEYNEVYEGRVVSIMKFGAFMEILPGKEGLLHISEISPERVEKVEDVLSVGDVFKVRVISMEGGKISLSKKKV

SEQ ID NO: 27183 - protein, 97 aa, Cyanidioschyzon merolae
MYKIQLVNQKEGIDVTIQCAGDQYILDAAEEQGVDLPYSCRAGACSTCAGKLVKGSVDQSDQSFLDEDQISKGFILTCVAYPTSDCVIQTHQEEALY

SEQ ID NO: 27184 - protein, 409 aa, Corynebacterium efficiens
MVECVKGRPNVLAIVLAGGEGKRLFPLTEDRAKPAVPFGGTYRLIDFVLSNLVNAGYLKIAVLTQYKSHSLDRHISVSWNVSGPTGQYIASVPAQQRLGKRWFTGSADAILQSLNLISDEKPDYVIVFGADHVYRMDPSQMVDEHIKSGKSVSVAGIRVPRHEATAFGCIQSDDEGNITEFLEKPADPPGTPDDPDVTFASMGNYVFTTEALVRALKDDSENEDSEHDMGGDIIPYFVDRGDAHVYDFSRNIVPGATERDKGYWRDVGTIDAFYECHMDLISVHPIFNLYNKEWPIHTTVEGNLPPAKFVQGGIAQSSMVAPGSIISAGTVRNSVLSTDVIVEEGATVEGAVLMPGVRIGKGAVVRHAILDKNVVVRDGELIGVDHDRDSQRFKVSAGGVVTVGKNQVV

SEQ ID NO: 27185 - protein, 318 aa, Solanum demissum
MSLLLPEMLTWINPPKTLIPFSSITPNPSSPIPICSISPKPTKTSLKSLHLSTPPTLTSTDCGLKFREKILYLQELNINPTKVLQLNPHLRSATLDSIRSVEICLFSMGIERSAIGRILDMHPQLLTSDPYIHLYPIFDFLLNDVVIPFHDIRKSIIRCPRILVCSVEDQLKPTFEFLKEFGFVGQNRITCQTTVLLVSSVELTLNPKIDYMLSLGFERDDVVNMVLRSPGLLTFSIEKNFRPKVEYFLKEMNGDIGELKRFPQYFSFSLERKIKPRHRLLMEHGFSLSLSEMLKVSDGEFNARLIEMRLRIVEDKQL

SEQ ID NO: 27186 - protein, 607 aa, Coprinopsis cinerea
MPGTGSNIESLQAEISRLRMEMQALHTKQGADTVRIGDYLLTRLAQLGVRHMFGVPGDFNLGFLDLVEDHRLMEWVGNCNELNAAYAADGYARAKSTIGVVLTTFGVGELSATNGIAGAFSEMVPVLHIVGVPSTTQQKKRPLLHHTLGDGRFDAFSKAAGQFTCYQTMINDPNTAASEIDRALSECITKNRPVYLMLPTDMVSFEITSNRLHTPLTRRETLNESQVEEFVLDLIELRVKEAEADVAVLVDACVMRYGIRKEVMEFLKETGFPVFAAPMGKTAVDENWKRYGGIYVGSVTPPEVKEQVEKAKLILSIGSLQTDFNSGNFTYNIPTRRLIELHSSYTQVQYAVFPNIGFKELLPKLKDRLQQFYPIANKIPVTPFANRLPQEATQSITQAYFWPRMGHFFKSGDIIVTETGTANFGIMDVPLPPKSHLLSQIFWGSIGWSVGAALGAAVAAREMKSAGRVILFVGDGSLQLTVQELSPMIRLGLKPIIFVLNNHGYVIERMIHGKHRKYNDIADWKWSQLLDVLGDRQTETASHTLTNKQDLDRLLNEDSFMNPDKITLIEVLMDRLDAPRILKLQTELSSKQNIYAPAKLGTVNSPV
